United States Patent 11,739,335 (NUCLEIC ACIDS ENCODING CRISPR-ASSOCIATED PROTEINS AND USES THEREOF) - sequence listing, part 2

SEQ ID NO: 1411 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacacccugcucaacgaggugcugaagaacggcacccugaccuacaagcagacgaagaagcuccuggggcugagcgacgacuacgaguucaagggcgagaagggcaccuacuucaucgaguucaagaaguacaaggaguucaucaaggcccucggggagcacaaccugucccaggacgaccugaacgagaucgccaaggacaucacccucaucaaggacgagaucaagcugaagaaggcgcuggccaaguacgaccucaaccagaaccagaucgacagccuguccaagcuggaguucaaggaccaccucaacaucagcuucaaggcccugaagcuggugaccccgcugaugcucgagggcaagaaguacgacgaggccugcaacgagcugaaccugaaggucgccaucaacgaggacaagaaggacuuccuccccgcguucaacgagacguacuacaaggacgaggugaccaaccccgugguccugcgggccaucaaggaguaccgcaaggugcugaacgcccuccugaagaaguacgggaaggugcacaagaucaacaucgagcuggcccgcgaggucggcaagaaccacucccagcgggcgaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggggagaagaucaagaucagcgaccuccaggacgagaagaugcuggagaucgaccacaucuaccccuacucccggagcuucgacgacuccuacaugaacaaggugcugguguucaccaagcagaaccaggagaagcucaaccagaccccguucgaggccuucggcaacgacagcgcgaaguggcagaagaucgagguccuggccaagaaccugcccacgaagaagcagaagcgcauccucgacaagaacuacaaggacaaggagcagaagaacuucaaggaccggaaccugaacgacacccgcuacaucgcccggcuggugcucaacuacaccaaggacuaccuggacuuccugccccucuccgacgacgagaacaccaagcugaacgacacgcagaaggggagcaaggugcacgucgaggccaaguccggcaugcugaccagcgcccuccgccacaccuggggguucuccgcgaaggaccggaacaaccaccuccaccacgccaucgacgccgugaucaucgccuacgccaacaacagcaucgugaaggcguucuccgacuucaagaaggagcaggagagcaacagcgccgagcuguacgccaagaagaucuccgagcuggacuacaagaacaagcgcaaguucuucgagcccuucagcggcuuccggcagaagguccuggacaagaucgacgagaucuucguguccaagccggagcgcaagaagcccagcggcgcccugcacgaggagaccuuccggaaggaggaggaguucuaccaguccuacgggggcaaggaggggguccucaaggcgcuggagcugggcaagauccgcaaggugaacgggaagaucgugaagaacggcgacauguuccgggucgacaucuucaagcacaagaagacgaacaaguucuacgccgugcccaucuacaccauggacuucgcccucaaggugcugcccaacaaggccgucgcccgcagcaagaagggcgagaucaaggacuggauccugauggacgagaacuacgaguucugcuucucccucuacaaggacagccugauccugauccagaccaaggacaugcaggagccggagcucguguacuucaacgcguucaccuccagcacggugucccugaucgucagcaagcacgacaacaaguucgagacccuguccaagaaccagaagauccucuucaagaacgccaacgagaaggaggugaucgccaagagcaucgggauccagaaccugaagguguucgagaaguacaucgucuccgcccugggcgaggugaccaaggccgaguuccggcagcgcgaggacuucaagaacgagcuccgguga

SEQ ID NO: 1412 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacagcacccugaccuacaagcagaccaagaagcuccugggccuguccgacgacuacgaguucaagggggagaagggcacguacuucaucgaguucaagaaguacaaggaguucaucaaggcccucggcgaccacagccugucccaggacgaccugaacgagaucgcgaaggacaucacccucaucaaggacgagaucaagcugaagaaggcccuggccaaguacgaccucaaccagaaccagaucgacagccuguccaagcuggaguucaaggaccaccucaacaucagcuucaaggcccugaagcugaucaccccgcugaugcucgaggggaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagguccugaacgcccuccugaagaaguacggcaaggugcacaagaucaacaucgagcuggcgcgcgagguggggaagaacuacucccagcgggccaagaucgagaaggagcagaacgagaacuacaaggccaagaaggacgccgagcucgagugcgagaagcugggccugaagaucaacagcaagaacauccucaagcugcgccuguucaaggagcagaaggaguucugcgccuacuccggcgagaagaucaagaucagcgaccuccaggacgagaagaugcuggagaucgaccacaucuaccccuacucccggagcuucgacgacuccuacaugaacaagguccugguguucaccaagcagaaccaggagaagcucaacaagaccccguucgaggcguucgggaacgacagcgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucuccgacgacgagaacaccaagcugaacgacacccagaagggcagcaaggugcacguggaggccaaguccgggaugcugacgagcgcgcuccgccacaccuggggcuucuccgccaaggaccggaacaaccaccuccaccacgccaucgacgccgucaucaucgccuacgcgaacaacagcaucgugaaggccuucagcgacuucaagaaggagcaggaguccaacagcgccgagcuguacgccaagaagaucuccgagcuggacuacaagaacaagcgcaaguucuucgagcccuucagcggguuccggcagaaggugcuggacaagaucgacgagaucuucgucuccaagccggagcgcaagaagcccagcggcgcgcugcacgaggagaccuuccggaaggaggaggaguucuaccaguccuacggcgggaaggagggcgugcucaaggcccuggagcuggggaagauccgcaaggucaacggcaagaucgugaagaacggggacauguuccggguggacaucuucaagcacaagaagaccaacaaguucuacgccguccccaucuacacgauggacuucgcccucaaggugcugcccaacaaggccguggcgcgcagcaagaagggcgagaucaaggacuggauccugauggacgagaacuacgaguucugcuucucccucuacaaggacagccugauccugauccagaccaaggacaugcaggagccggagcucgucuacuucaacgccuucaccuccagcaccgugucccugaucgugagcaagcacgacaacaaguucgagacgcuguccaagaaccagaagauccucuucaagaacgccaacgagaaggaggucaucgccaagagcaucggcauccagaaccugaagguguucgagaaguacaucguguccgcccugggggaggucaccaaggcggaguuccggcagcgcgaggacuucaagaacgagcuccgguga

SEQ ID NO: 1413 - RNA, 2964 nt, Artificial Sequence
  Cas9 variant
auggcccgcauccuggccuucgacaucggcaucagcuccaucgggugggcguucagcgagaacgacgagcucaaggacugcggcgugcggaucuucaccaaggccgagaaccccaagaccggggagucccuggcccugccgcgccggcucgcccgcagcgcccggaagcgccuggcgcggcgcaaggcccggcugaaccaccucaagcaccugaucgccaacgaguucaagcugaacuacgaggacuaccaguccuucgacgagagccucgccaaggcguacaagggcucccugaucagccccuacgagcugcgcuuccgggcccucaacgagcugcuguccaagcaggacuucgcccgcgucauccuccacaucgccaagcggcgcggguacgacgacaucaagaacagcgacgacaaggagaagggcgccauccugaaggcgaucaagcagaacgaggagaagcuggccaacuaccaguccgugggcgaguaccucuacaaggaguacuuccagaaguucaaggagaacagcaaggaguucacgaacgugcggaacaagaaggaguccuacgagcgcugcaucgcccagagcuuccugaaggacgagcugaagcucaucuucaagaagcagcgggaguucggguucuccuucagcaagaaguucgaggaggagguccuguccguggccuucuacaagcgcgcccugaaggacuucagccaccucgugggcaacugcuccuucuucaccgacgagaagcgggcgcccaagaacagcccccuggccuucauguucgucgcccugacccgcaucaucaaccuccugaacaaccugaagaacaccgaggggauccucuacacgaaggacgaccugaacgcccugcucaacgaggugcugaagaacggcacccugaccuacaagcagaccaagaagcuccuggggcugagcgacgacuacgaguucaagggcgagaagggcacguacuucaucgaguucaagaaguacaaggaguucaucaaggcccucggggaccacucccugagccaggacgaccugaacgagaucgcgaaggacaucacccucaucaaggacgagaucaagcugaagaaggcccuggccaaguacgaccucaaccagaaccagaucgacucccugagcaagcuggaguucaaggaccaccucaacaucuccuucaaggcccugaagcugaucaccccgcugaugcucgagggcaagaaguacgacgaggccugcaacgagcugaaccugaagguggcgaucaacgaggacaagaaggacuuccuccccgccuucaacgagaccuacuacaaggacgaggucacgaaccccguggugcugcgggccaucaaggaguaccgcaagguccugaacgcccuccugaagaaguacgggaaggugcacaagaucaacaucgagcuggcgcgcgaggugggcaagaacuacagccagcgggccaagaucgagaaggagcagaacgagaacuacaaggccaagaaggacgccgagcucgagugcgagaagcugggccugaagaucaacuccaagaacauccucaagcugcgccuguucaaggagcagaaggaguucugcgccuacagcggggagaagaucaagaucuccgaccuccaggacgagaagaugcuggagaucgaccacaucuaccccuacagccgguccuucgacgacagcuacaugaacaagguccugguguucaccaagcagaaccaggagaagcucaaccagaccccguucgaggcguucggcaacgacuccgccaaguggcagaagaucgaggugcuggccaagaaccugcccaccaagaagcagaagcgcauccucgacaagaacuacaaggacaaggagcagaaggacuucaaggaccggaaccugaacgacacgcgcuacaucgcccggcugguccucaacuacaccaaggacuaccuggacuuccugccccucagcgacgacgagaacaccaagcugaacgacacccagaagggguccaaggugcacguggaggccaagagcggcaugcugacguccgcgcuccgccacaccuggggguucagcgccaaggaccggaacaaccaccuccaccacgccaucgacgccgucaucaucgccuacgcgaacaacuccaucgugaaggccuucagcgacuucaagaaggagcaggagagcaacuccgccgagcuguacgccaagaagaucagcgagcuggacuacaagaacaagcgcaaguucuucgagcccuucuccggcuuccggcagaaggugcuggacaagaucgacgagaucuucgucagcaagccggagcgcaagaagcccuccggcgcgcugcacgaggagaccuuccggaaggaggaggaguucuaccagagcuacgggggcaaggagggggugcucaaggcccuggagcugggcaagauccgcaaggucaacgggaagaucgugaagaacggcgacauguuccggguggacaucuucaagcacaagaagaccaacaaguucuacgccguccccaucuacacgauggacuucgcccucaaggugcugcccaacaaggccguggcgcgcuccaagaagggcgagaucaaggacuggauccugauggacgagaacuacgaguucugcuucagccucuacaaggacucccugauccugauccagaccaaggacaugcaggagccggaguucgucuacuacaacgccuucaccagcuccaccgugagccucaucguguccaagcacgacaacaaguucgagacgcugagcaagaaccagaagauccuguucaagaacgccaacgagaaggaggucaucgccaaguccaucgggauccagaaccucaagguguucgagaaguacaucgugagcgcccugggcgaggucaccaaggcggaguuccggcagcgcgaggacuucaagaacgagcugcgguga

SEQ ID NO: 1414 - RNA, 2979 nt, Artificial Sequence
  Cas9 variant
augcgcaucuucagcgacggccggaaccccaaggacggguccagccuggccgugacccgccgggccgcgcgcgccaugcggcgccggcgcgaccggcuccugaagcgcaagacccggaugcaggccaagcuggucgagcacggcuucuucccggccgacgccgggaagcgcaaggcgcucgagcagcugaaccccuacgcccugcgggccaagggccuccaggaggcccugcugcccggggaguucgcgcgcgcccucuuccacaucaaccagcggcgcggcuucaaguccaaccggaagacggacaagaaggacaacgacagcggcgugcugaagaaggccaucgggcagcugcgccagcagauggccgagcagggcucccggaccgugggggaguaccucuggacccgccugcagcagggccaggggguccgggcccgcuaccgcgagaagcccuacaccacggaggagggcaagaagcggaucgacaagagcuacgaccuguacaucgaccgcgcgaugaucgagcaggaguucgacgcccucugggccgcccaggccgcguucaacccgacccuguuccacgaggccgcccgggccgaccugaaggacacccuccugcaccagcgcccccugcggcccgugaagcccggccgcugcacccuccugccggaggaggagcgggcgccccuggcccuccccuccacgcagcgcuuccggauccaccaggaggugaaccaccuccgccugcucgacgagaaccugcgggaggucgcccugacccucgcccagcgcgacgccguggugaccgcccuggagaccaaggcgaagcugagcuucgagcagauccggaagcuccugaagcuguccgggagcguccaguucaaccucgaggacgccaagcgcacggagcugaagggcaacgccaccuccgccgcgcuggcccggaaggagcuguucggggccgccuggagcggcuucgacgaggcccugcaggacgagaucguguggcagcuggugaccgaggagggcgagggggcgcucaucgccuggcugcagacccacacgggcgucgacgaggcccgcgcccaggccaucguggacgugucccugcccgagggguacggcaaccucagccggaaggcgcuggcccgcaucgucccggcccugcgggccgccgugaucaccuacgacaaggcggugcaggccgccggguucgaccaccacucccagcucggcuucgaguacgacgccagcgaggucgaggaccuggugcaccccgagaccggcgagauccgcuccguguucaagcagcugcccuacuacgggaaggcgcugcagcgccacgucgccuucggcagcgggaagcccgaggacccggacgagaagcgguacggcaagaucgccaaccccaccgugcacaucgggcucaaccaggugcgcauggucgugaacgcccugauccggcgcuacggccggcccacggaggucgugaucgagcuggcccgcgaccucaagcagucccgggagcagaagguggaggcgcagcgccggcaggccgacaaccagcgccggaacgcccgcauccggcgcagcaucgccgagguccugggcaucggggaggagcgggugcgcggcagcgacauccagaaguggaucugcugggaggagcuguccuucgacgccgcggaccggcgcugccccuacagcggggugcagaucuccgccgccaugcuccugagcgacgaggucgagguggagcacauccugccguucuccaagacccucgacgacagccugaacaaccggaccguggccaugcgccaggccaaccggaucaagcgcaaccgcacccccugggacgcgcgggccgaguucgaggcccagggcugguccuacgaggacauccugcagcgcgccgagcggaugccccuccgcaagcgguaccgcuucgcgcccgacggguacgagcgguggcugggcgacgacaaggacuuccuggcccgcgcccucaacgacacgcgguaccugagccgcgucgccgccgaguaccugcggcucgugugcccgggcacccgcgugauccccgggcagcugaccgcgcugcuccggggcaaguucgggcugaacgacguccugggccucgacggcgagaagaaccgcaacgaccaccggcaccacgccguggacgccugcgugaucggggucaccgaccagggccugaugcagcgcuucgccacggccuccgcgcaggcccgcggggacggccugacccggcucguggacgggaugcccaugcccuggccgaccuaccgggaccacguggagcgcgccguccgccacaucugggugagccaccggcccgaccacggcuucgagggcgccaugauggaggagaccuccuacgggauccgcaaggacggcagcaucaagcagcggcgcaaggccgacggguccgcgggccgggagaucagcaaccugauccgcauccacgaggccacgcagccccugcggcacgggguguccgccgacggccagccgcucgccuacaagggcuacgucgggggcagcaacuacugcaucgagaucaccgugaacgacaaggggaagugggagggcgaggugaucuccaccuuccgcgccuacggggucgugcgggcgggcggcauggggcgccugcggaacccccacgagggccagaacgggcgcaagcugaucaugcggcucgugaucggcgacagcguccgccuggagguggacggggccgagcggaccaugcgcaucgugaagaucuccggcagcaacggccagaucuucauggcccccauccacgaggccaacgucgacgcgcggaacacggacaagcaggacgccuucaccuacaccagcaaguacgccgggucccugcagaaggccaagacccgccgggugaccaucagccccaucggcgaggugcgcgacccgggguucaagggcuga

SEQ ID NO: 1415 - RNA, 2985 nt, Artificial Sequence
  Cas9 variant
augacccugggccucgaccuggggaccaacagcaucggcugggcccugaucgacuucgacgacaaccagcagccccgcaaccucaucgccugcgggucccggaucuuccaggaggcgguggaggccaagacgggcaccccgaagaaccacgcccgccggaccgcccgcgccgcgcggaagcuggucgcccgccggaagcagcgccggaccaagcugcucaaccugcugauccgccacgggcuccugccccaggacguggccgagcggaacgcccugcuccuggacaaccaggcgaacaaccccuaccagcugcgcaagcggggccucgacgagaagcuggagcccuucgccuucggccgcgcccuguaccaccucgcccaccggcgcggguuccagagcaaccggaaggccgcguccgacgaggacggcaaggugaagacggccaucagcacccugcgcgccgagaugcaggggcggacccugggcgccuuccucgccgaccagccgacccagcgccggcgcuacacggaccgcgcgauguacgucgaggaguucgagcagcugugguccaagcaggccagcuucacccaggagcagcugacccaggcccucaagguggccauccacaacuccaucuucuuccagcggccccucaagagccagaagcaccugguggggaagugcaccuucgagcccacgcgcaagcgggccgcgaaggccauccuccugacccagcgcuuccggauccugcaggacgucaaccaccucgccgugaagaaccccaucacccgcgaguuccggccgcugacccaggacgagcgcaacaagcuggccgaggcccucgacaagcagaaguccaugacguggggcgcggugcggaaggucaucggcuggaacaagaaggacagccugcacgagggggagaccuucaaccuggaggagggcaagaaggacaagcucaucgggaaccgcaccgccugcgaccugcggggcgcccugggcgaccgcugggacgcccucaccgcgcagcagcaggacgaccuggugacggaccugcucaccaucgacaacaccgacggguuccugaagcggaugaagacccacugggaguucgacgacgccacggccgaggugaucgccaagaucgagcuggagcccggcuacgcccgccucuccgcgaaggccaugcgggccauccugcccuaccuggagcaggggaugaucuacagcgacgccugcaaggccgcgggcuacgaccacuccaaccccaaccagcgcaccaucaccgacaagcucgggcugccgagcaacguccggaaccccguggugcagaaggcccuguucgagacccgcaaggucgugaacgccaucgugcggaaguacggcaagcccgccgucauccgcguggagauggcccgcgacaugaagcuguccaagcggcagaaggaggagcuccagaaggagcagaacaagcagaagaaggcgaacgagcuggccgagggcauccugcgcaaggaguucgggauccagcagcccgcccgggccgacauccagaaguacaaccucuggcuggagugcaaggaggugugcccguacacgggcaccaccaucagccgcgagaugcuguucucccccgaggucgacguggagcacauccuccccuacagccggucccuggacgacagcuacaugaacaagacccugugcauggcgacguucaaccgccaggugaagcucaacaacacccccuacgagaucgggcagggcgacccgcuggccuacgccgagaucuuccagcggaucaagacccugcccuuccccaagcgccggcgcuucgagcagaaggagaucgagaccgacaaguucaucgagcggcagcucaacgacacgcgcuacaucugcgucgaggugcgggacuuccugcagcagcugggggcccccgucgaggugagcaagggcgaggccaccgcgaagcuccgcggccgguggaagcugaacacccugcucuccccggacgggagcaacgagaaguaccgcggcgaccaccggcaccacgccaucgacgccguggucaucgcccugaccaaccgcucccuguuccacaagcucagccggcuguccgcccagagcaucucccuggacaagagccgcuucgacgugcccccgcccugggacggguucuacgacgacguguacgagaagaucgacaaggucaucgugucccacgcgcccgcccggaagaucggcggggcccuccacgaggacaccgccuacggccacuucaaggaggagguggccgaccccaagacgggcaaggucagcaucgaggaccgcuucguguaccgcaagccccuggcgacccugaccgccaacgagguggggaagauccgggacgccaagguccgcgaguucguggaggcccggcucgcgcaguucggcaacaacuccaagaccgccuucggggacccgaacaacccccugcugcacgccgacggcaagacgcccauccgcaccgugcggcucgucaccaacuucaacaaggccaccacgcacgccauccagaagggccaggggcgcgacuacaaguucuucaaguacggcaacaaccaccacguggagaucaucgagcacguggagaccgggaagcggaagggcaucuucgucaccgcgauggaggccgcccgccgggugcgcgggguggccaacaccgagaaguccgacaucguccagcggaaccacggcgaggaguggcgcuucgugaugagccugagcaucaacgaccugguguccauccaggaggccgaccagguccggaucaugcgcgugcagcuguucgacgcgagcaacggcaacaucaucuuccgggaccagaaguccgccaugcuggacgacaagcugagccgcuaccagacgaaggcccaccuccuggugugccagaagaucaccaccgacccccuggggaaccucgccccgugcaacgacuga

SEQ ID NO: 1416 - RNA, 2988 nt, Artificial Sequence
  Cas9 variant
augagcaaggugcugggccucgacaucggggccaacuccaucggcugggcccugaucgacgacgaggagaacgacaucaucggggcgggcguccgcguguucaaggagggggugaaccugaagggcgucaaggaggagagcaagaacguggagcggcgcgccgcccggcucgcccgccggcagcacaagcgccggucccagcgccggaaccgccugguggcccugcucaagacccuggagauguuccccgagaacaacgaggacaucagcgacuacuacgcgcaggacccguacgagcugcggaagaagggccucuacgagaagcugaccauguacgaguucgggcgcguccugcuccacaucugccggcgccggggcuucaaguccagccgcaagacggacaucuccgaggaggggaagaucuucgagggcaaggacgggaucgugggcaucaaccagacccgggacagcauccgcgagggcggguucaagaccaucggcgaguaccuggccucccuggacccccacgugauccggcgccggaaccgcuucacccuccgcgacauguacgaggaggaguucaaccugaugugggagaagcagcagagcuucuacccccugcagcucuccaacgaguucaaggaggccaucgccgaggucauccugagccagcggaagcugaagucccagaaggcgcucguggggaacugcggccuggagcccaacaagaagacggcccccaagagcuccccggccuuccaguacuuccgcauccuggagcagcucagccggauccugaucuccaucccccacaccggccgcuacaacgacccccugaacgaggaggagcggcgcaugcucaucgacaagcugagcgugaccgagaagcugaaguucuccgacaugcggaagaugcucaaccugccgggggagagcgacaucaacaucgaggaggagggcgggcgccugcucggcaacaccacguacgcccggcugaucaaggucuucgggaagaagcgcugggccggcuucagcgaggaggagaaggagcagaucuggcacaccuuccacuucgcggacaaccacgaguggcugaaggaguacgcccucaagaagugguccaucacccccgacgagaucaaggagcugggcaagguggcccuggagaaggaguacgcccgguucagcaagaagucccucaagaagaucaucccccagcuggaggaggggcugacccucgacaaggccaagaucgaggcgggcuacacgcccgaguacgagaucgagaagucccugagcgccuaccugccgcuccccgagaacauccgcaaccccaucgugcagcaggcccuguacgagcugcggcacgucgugaacgccgugauccgcaccuacgggaagcccgacaucgcccgggucgagcucgcgcgcgagaugaagaagccgaagcagaagcgggagaagaugcgcagcgagcugcggaagcgccagaugaaguucgaggagaucaaguccauccugaaggagcgccugggcuucaucgaccccaagcgggacgagauccacaaguacaugcucugggaggagugccgcgagaccugccccuacaccgggcggaagaucagccuguccgcccuguacggcggcgacuucgagguggagcacaucauccccuacaagcgcagccucgacgacucccuguucaacaagacggugugccugcgggaggagaaccagaucaagggggaccgcaccccguacgaggccuacagcggcgaccggcagaaguacgaggagaucauccuccgcguccagaagaccuccaugccccgggggaagaagaaccuguucgccaucaaggagcugaaggacgacuucgcccaccgccagcucagcgacaccgcguacaucucccgggagacgcgcaaguaccugggcagcaccaucaagaaggugcaggccgugaagggcggguccaccgccaagcugcgguacuacuggggccucaacagcauccuggggguccgcgacaucaagaugcgggacgaccaccgccaccacgccguggacgcgcuggucaucgccaacaccacguacgccuucgugaacacccucucccgguaccacagcauggacguggagccccacgagagccgcuucccccugccgugggagcaguuccggaacgacgccgaguccgucgugcgcaacaucuucgugagccaccggcugggcaagaaggccaccgggcagcuccacgaggagaccuacuacggcaagauccgcaacacggacggcgagcccuacuucgucgugcgcaagaagcuggggacccugaccgcgaagcagaucgccaacaucguggaccccgucgugaagacccagguguucgagcggcucgaggagaagggcaucgacaucgaguccagcaacaagauccccgccgacgccuucgucgagacgcuguacaugccggaccgcaagacccccaucaaguccgugcgggugaagguccccagcaccaccaugauccagcuguacaaggacaaggagcucuacguggacccgggguccaaccaccacaucgugaucuucgagaacgaggagggcaagcgcgacgggaucgucgugagccuguucgaggccgcgcagcggcugcgccggaacgagcccgugauccagaagacguggaagcccgaguggcacuucgucaugucccucagcaucgacgagcugauccugcucgacguggacgagaagaacaucgacuggggcgacaccggccuggcccugcgcuacuccaaggcccucuaccgggugcagaagauggacgucaacaagaucaucacccugcgccaccaccugguggcccggcucaaggacgacgaggggaaggaguucggccgcgagcaccggauccccagcacccugcgcgggcugaaggugaagaucgaccacaucggccggcuccgccgggccuacgacuga

SEQ ID NO: 1417 - RNA, 2988 nt, Artificial Sequence
  Cas9 variant
augaaggugaucggcuucgacaucgggaucaacagcaucggcugggccuucgucgagaacgacgagcugaaggacugcggggugcgcaucuucaccaaggccgagaaccccaagaacaaggagucccucgcgcugccgcggcgcaacgcccggagcucccgcaagcggcugaagcgccggaagcuccgccugaucgccaugaagcacauccuggccaaggagcucaaccugaacuacaaggacuacaucgccaacgacggcgagcugcccaaggcguacgaggggaagcucaucagccccuacgagcugcgguacaaggcccugaaccagaagcucgaggccaaggaccuggugcgcgucauccugcacaucgccaagcaccggggcuacaugaacaagaacgacaagaaguccaacgacgcggagaagggcaagauccucagcgcccugaagaacaacgcccugaagcucgagaaguaccaguccgugggggaguacuucuacaaggaguucuuccagaaguacaaggagaacaccaaggacuucaucaagauccgcaacaucaaggacaacuacaacaacugcgugcuggccagcgaccuggagaaggagcucaagcugauccuggagaagcagaaggaguucggcuacuccuacagcaacgacuucaucgaggaggucauccagguggccuucuuccagcggccccucaaggacuucucccaccugguggggaccugcaccuucuucgaggaggagaagcgcgcgugcaagaacagcuacuccgccugggaguucgucgcccugaccaagaucgugaacgagcucaagagccuggagaagaucuccggcgagcugaucagcacccagacgaucaacgagauccucaacuacauccuggacaagggguccaucaccuacaagaaguuccggagcuacaucaaccuguacgaguccaucaaguucaagagccucaaguacgacaaggacaacgccgagagcgccaagcugaucgacuuccgcaagcugguggaguucaagaaggcgcucggcgagcacuacuucaaccggcaggagcuggaccagaucuccaccuacaucacccugaucaaggacaacgucaagcucaagacggcccuggagaaguacaaccugagcaacgagcagaucaacaaccuccuggagaucgaguucaacgaccacaucaaccuguccuucaaggcccucagcaugauccugccgcugaugaaggagggcaagaaguacgacgaggccugcgagaucgccaaccucaagcccaagaccaccaaccagaagcaggacuuccugcccgcguucugcaacuccaucuucgugcacgagcugagcaaccccaucgugaaccgcgccaucuccgaguaccggaagguccugaacgcccuccugaagaaguacgggaaggugcacaagauccaccuggagcucgcccgcgacaucggccugagcaagaaggcccgggagaagaucgagaaggagcagaaggagaaccaggcgaucaacaccugggcccugaacgagugcgagaacauggggaucaaggccaacgccaagaacauccucaagcugaagcuguggaaggagcagaaggagaucugcaucuacuccggcaagaagaucagcaucgagcaccucaaggacgagaaggcgcuggagguggaccacaucuacccguacucccgcagcuucgacgacuccuacaugaacaagguccugguguucacgaaggagaaccaggagaagcucaacaagacccccuucgaggccuucggcaagaacaucgagaaguggaacaagauccagacccuggcccagauccugcccuacaagaagaagaacaagauccucgacgagaacuucaaggacaaccagcagcaggacuucaucagccgcaaccugaacgacacccgguacaucgccacgcugaucgccaaguacaccaaggaguaccucaacuuccugccccugaacgagaacgagaacaucaaccucaaguccggggagaagggcagcaagauccacauccagaccgugaacgggaugcugaccuccguccugcgccacacguggggcuucgacaagaaggaccggaacaaccaccuccaccacgcgcuggacgccaucaucguggccuacagcaccaacucccugaucaaggccuucagcgacuucaagaagaaccaggagcuccugaaggccaagcuguacgcgaaggagcucaccaacgacaacuacauccaccaggccaaguucuucgagccguucgagggguuccgcgagaagauccugaacaagaucgacgagaucuucgugagcaagccgccccggaagcgcgcccggggcgcccugcacaaggagaccuucuacuccgagaagaagaugaucaagaaguacaacagcaaggagggccucaacaucgcccuggacugcgggaagauccgcaagaucggcacgaaguacgucgagaacgacaccauggugcgggucgacaucuucaagaagcagaacaaguucuacgcgauccccaucuacaccauggacuucgcccuggggauccuccccaacaagaucguggugaucggcaaggacaagaacaacaaccccaagcaguggcaggagaucgacgaguccuacgaguucugcuucagccuguacaagaacgaccugauccuccugcagaagaaggacaugcaggaggccgaguucgccuacuacaacggguucgacaucgacuccagccgcaucaacaucaagaagcacgacaacaaguucgagaaccugaccuccaaccagaagcuccuguucacgaacaaggagaagaaccggaccggcauccagaaccugaagaucuucgagaaguacaucgucacgccccucggcaacaagaucaaggcggacuuccagccccgccagaacaucagccugaaguccagcaagaagaacgggcuguga

SEQ ID NO: 1418 - RNA, 2988 nt, Artificial Sequence
  Cas9 variant
augaagauccugggcuucgacaucgggaucaacagcaucggcugggccuucguggagaacgacgagcucaaggacugcgggguccgcaucuucaccaaggccgagaaccccaagaacaaggagucccuggcgcugccgcggcgcaacgcccggagcaaccgccggcgccucaagcggcgcaagucccggcugaucgccaucaagcacauccuggccaaggagcucaaccugaacuacaaggacuacaucgccaacgacggcgagcugcccaaggcguacgaggggaagcucaccaacguguacgagcugcgcuacaaggcccugaaccagaagcucgaggccaaggaccuggcccgggugauccugcacaucgcgaagcaccgcggcuacaugaacaagaacgagaagaaguccaacgacagcgagaagggcaagauccucagcgcccugaagaacaacgcccugaagcucgagaaguaccaguccgucggggaguacuucuacaaggaguucuuccagaaguacaaggagaacaccaagaacuucaucaagauccggaacaccaaggacaacuacaacaacugcgugcuggccagcgaccuggagaaggagcucaagcugauccuggagaagcagaaggaguucggcuacuccuacaacgacgacuucaucaaggagaucaucaacaucgccuucuuccagcgcccccucaaggacuucagccaccuggugggguccugcaccuucuucgaggaggagaagcgggcgugcaagaacagcuacuccgccugggaguucgucgcccugagcaagaucaucaacgagcucaagcgccuggagaagaucuccggcgagcugaucagcgcccagaccaucaacgagauccucaaccacauccuggacaaggggaacaucacguacaagaaguuccgguccugcaucaaccugcacgagagcaucgaguucaagucccucaacuacgacaaggacaacgccgagagcgcgaagcugguggacuucaagaagcugaucgaguucaagaaggcccucggcgagcacagcuucaaccgccaggagcuggacgagaucgccacccacaucacccugaucaaggacaacgacaagcucaagaccgcccuggagaaguacaaccugaacaacgagcagaucaacgcccuccuggagaucgaguucaacgaccacaucaaccuguccuucaaggcgcucaaccugauccugccccucaugcgggagggcaagcgcuacgacgaggccugcgagaucgugaaccucaagagcaagacguccaaccagaagcaggaccugcugccggccuucugcgacagcaucuucucccaggagcugagcaaccccgucgugaaccgggccaucuccgaguaccgcaaggugcugaacgcccugcucaagaaguacgggaagguccacaagauccaccuggagcuggcgcgcgacgugggccucagcaagaaggcccgggagaagaucgagaaggagcagaaggagaacaaggagaucaacgacugggcccuggacgagugcgagaaguucgggcugaaggccaacaacaagaacauccucaagcugaagcuguggaaggagcagaaggagaucugcgcguacuccggcaagaagaucagcaucgagcaccucaaggacgagaaggcccuggagguggaccacaucuaccccuacucccgcagcuucgacgacuccuacaugaacaagguccugguguucaccaaggagaaccaggagaagcucaacaagacccccuucgaggccuucggcaagaacaucgagcgguggaacaagauccaggcccuggcccagaaccugccguacaagaagaagaacaagauccucgacgagaacuucaaggacaagcagcagcaggacuucaucagccgcaaccugaacgacacccgguacaucgcgacgcugaucgccaaguacaccaaggaguaccucaacuuccugccccugaacgagaacgagaacaccaaccucaaguccggggagaagggcagcaagauccacgugcagaccaucaacgggaugcugacguccguccugcgccacaccuggggcuucgacaagaaggaccggaacaaccaccuccaccacgcccuggacgccaucaucguggccuacagcaccaacuccaucaucaaggcguucagcgacuucaagaagaaccaggagcugcucaaggccaagcuguacgccaaggagcugaccagcgacaacuacaagcaccaggccaaguucuucgagcccuucgagggguuccgcgagaagauccucaacaagaucgacgagaucuucguguccaagcccccgcggaagcgcgcccggggcacgcugcacaaggagaccuucuaccccgaggagaccaugaucaagaaguacaacagcaaggagggccugaacaucgcgcucaacugcgggaagauccgcaagaucggcaccaaguacgucgagaacgacacgauggugcggcuggacaucuucaagaagcagaacaaguucuacgccauccccaucuacaccauggacuucgcccuggggauccuccccaacaagaucgugaucgccggcaaggacaagaacaacaacccgaagcaguggcaggagaucgacgaguccuacgaguucugcuucagccuguacaagaacgaccugauccuccugcagaagaaggacaugcaggaggcggaguucgccuacuacaacuccuucgacaucgacagcucccgcaucaacaucaagaagcacgacaacaaguucgagaaccugaccgacaaccagaagcuccuguucaccaaccaggagaagaaccggacggggauccagaaccugaagaucuucgagaaguacaucgucacgccccucggcgacaagaucaaggccgacuuccagccccgccagaacaucagccugaagaccuccaagaaguacggccuguga

SEQ ID NO: 1419 - RNA, 2991 nt, Artificial Sequence
  Cas9 variant
augaugggcaacuucacccuggggcucgaccugggcaccaacagcaucgggugggcccugaucgacuucgacgacaaccagcagccccagaaccucaucgccugcggcucccgcaucuuccaggaggcgguggaggccaagacggggaccccgaagaaccacgcccggcgcgccgcccgggcggcccgcaagcuggucgcccggcgcaagcagcggcgcaccaagcugcucaaccugcuggugugccacgaccuccugccccaggacgaggccgagcggaacgcgcugcuccuggacaaccaggccaacaaccccuaccagcugcgcaagcggggccucgacgagaagcuggagcccuucgccuucggccgcgcccuguaccaccucgcccaccggcgcggguuccagagcaaccggaaggcggccuccgacgaggacggcaaggugaagaccgccaucagcgcccugcgcgccgagaugcaggggcacacgcugggcgcguuccucgccgaccagccgacccagcggcgccgguacaccgaccgcgccauguacgccgaggaguucgagcagcugugguccaagcagaccaucuucgcccccgagcagcugacgcaggcgcucaaggucgagaucaagaacagcaucuucuuccagcggccccugaagucccagaagcaccugguggggaagugcaccuucgagcccacccgcaagcgcgccgccaaggccauccuccuggcccagcacuuccggauccugcaggacgugaaccaccucgcggucaagaacccgaucacccgcgaguuccggccccugacgcaggacgagcgcaacaagcuggccgaggcccucgacaagcagaagggcaugaacuggagcgccgugcggaaggugaucggcuggaacaagaaggacucccugcacgagggggagaccuucaaccuggaggagggcaagaaggacaagcucaucgggaaccgcaccgcgugcgaccugcggggcgcccugggcgaccgcugggacgccuucaccgcgccccagcaggacgaccucgucacggaccugcugaccaucgacaaccccgacggguuccucaagcggaugaagacccacuggggcuucgacgacgccaccgccgaggcccuggccacgaccgagcuggagccgggguacgcccgccucagcuccaaggccaugcgggcgauccugccccaccuggagcagggcaugaucuacagcgacgccugcaaggccgccggguacgaccacuccaaccccaaccagcgcaccaucaccgacaagcucggccugcccagcaacgugcggaacccggugguccagaaggcccuguucgagacgcgcaagguggugaacgcgaucguccggaaguacggcaagcccgccgugauccgcguggagauggcccgggacaugaagcuguccaagcgccagaaggaggagcuccagaaggagcagaacaagcagaagaaggccaacgagcuggcggaggggauccugcggaaggaguucggcauccagcagcccgcccgcaccgacauccagaaguacaaccucuggcuggagugcaaggaggucugccccuacaccgggaccgugaucagccgcgagaugcuguacuccccggagguggacgucgagcacauccuccccuacagccggucccuggacgacagcuacaugaacaagacgcugugcauggccaccuacaaccgccagaccaagcucaacaacacccccuacgagaucggccagggggaccccguggccuacgccgagaucuuccagcggaucaagacgcugccguuccccaagcgccggcgcuucgagcagaaggagaucgagaccgacaaguucaucgagcggcagcugaacgacacccgcuacaucugcguggagguccgggacuuccuccagcagcugggcgcgcccguggaggucagcaagggcgaggccaccgccaagcugcgcgggcgguggaagcucaacacgcugcugucccccggcgggggcaacgagaagaaccgcgccgaccaccggcaccacgccaucgacgcgguggugaucgcccucaccaaccgcagccuguuccacaagcugucccggcucagcgcccaguccaucagcuucgacaagucccgcuucgacgucccgccgcccugggacgacuucuacgacgacguguacgagaagaucgacaaggugaucgucagccacgcccccacccggaagaucuccggggcccugcacgaggcgaccgccuacggccacuucaaggaggagaucgccgaccccaagaccggcaaguucagcaucgaggaccgcuucguguaccggaagccccugacgacccucaccgccaacgagguggggaagauccgcgacgcgaagguccgggagcugguggaggcccgccuggcccaguucggcaacaacuccaaggccgccuucggggaccccaacgagccgcuccugcacgcggacggcaagacccccauccgcacgauccggcugaccaccaacuucaacaagaccacgacccacgccauccagaagggccaggaccgcgacuacaaguucuucaaguacgggaacaaccaccacguggagaucaucgagcacgucgagaccggcaagcggaaggggaucuucgugaccgccauggaggccgcccgccgggcgcgcggcguggccaacacggagaaguccaacaucguccagcggaaccacggggacggcuggaaguucgugaugagccucgccgugaacgacaugguccgcaccgaggacacccaggccaucuaccgggugcagaagcuggacggcagcaacaaccgcuucacccugcggucccacaacgccgcgacgcucgacgacaagcagaccgggguggacaagacccccaaccuguucaagggcaccaagaucaucgucgacccccuggggaaccucacgcagugcaacgacuga

SEQ ID NO: 1420 - RNA, 2994 nt, Artificial Sequence
  Cas9 variant
augaaggugcuggucgacgccggccucaugcccagcgaccccgccgcggccaaggcccuggagacccuggaccccuacgagcuccgcgccaccgggcuggacgugaugcugccccucacgcaccugggccgggccguguuccaccugaaccagcgccggggguucaaguccaaccgcaagaccgaccggggcgacaacgagagcgggaagaucaaggacgcgaccaagcgccucaccugggccaugcaggaggccggcgcccggacguacggcgaguuccugcacaugcgccgggcgcgcgccuccgacccccggcaggucccgagcgugcgcacccggcuguccguggccagccgcgggggccccgacuccaaggaggaggccggguacgacuucuaccccgagcgggcccaccucgaggacgaguuccacgcgcuguggagcgcccaggccgccuuccaccccgaccugaccugcgagcuccgcgacgucguguucgagaagaucuucuaccagcggccgcugaaggagcccaaggugggccugugccucuucaccgccgaggagcgccugcccaaggcgcacccccugacggggcggcgcguccucuacgagaccgugaaccagcugcgggugaccgccgacggccgcaccacgcgcccgcugacccucgaggagcgggacaugaucgucuacgcccuggacaacaagaagcccgugaagucccugagcuccaugcaccucaagcugguggcccugggcaagcucgucaagcugaaggacggggagcgcuucacccuggagagcggcgugcgggacgccaucgcgugcgaccccauccgcgccaccauggggcaccccgacggcuucggcccggccuggucccggcucgacuggcaggcccagugggcccugaucgagaagcugcgccaggugcagagcgacgacgacuucgcgucccucgucgccuggcugggggccacgcacaaccugagcgaggaccacgccaagcggguggcgaaccuccaccuccccgagggcuacgggcgccugggccucaccgccaccgaggccauccugugcaaccugaaggccgaggugugcaccuacucccaggccgucgagcggugggggaagcaccacagcaaccagcgcacgggcgagugccucgaggcgcugcccuacuacggcgaggugcuggaccggcacgugauccccgggaccuacaacgaggacgacgacgacgucacccgcuacggccggaucaccaacccgacggugcacaucgggcucaaccagcugcgccggcuggucaaccgcaucaucgccaccuacggcaagcccgaccagaucgugguggagcuggcccgggagcucaagcaguccgaggcccagaaguccgaggcccugaagaagauccgcgacaccaccgcggacgccauccggcgcgggcgccagcuggaggagaucggccagaagaacacgggcgccaaccggcuccugcugcgccucugggaggaccuggggcccgccgucggcccccggugcugcccguacaccgggaagcccaucagcgugaccaugcuguucgacggcgccugcgacguggaccacauccuccccuacagccgcacccuggacgacagcuucgcgaaccggacgaucugccugcgcgaggccaaccggcagaagggggaccgcacccccugggaggccuggggcggcuccgaccagugggacgccaucgaggcgaaccucaaggaccugccggagaacaagcggaagcgcuucgcccccgacgccauggagcgguucgagggggagcgcgacuuccuggaccgggcccucgucgacacccaguaccuggcccgcaucagccgggcguaccuggacacccucuucacggagggcgggcacgugugggugguccccggccgcaugaccgagaugcugcggcgccacuggggccugaacgcccuccuguccgacaaggaccgcggggccggcaaggugaagaaccggaccgaccaccggcaccacgccaucgacgccgcggugaucgccgccaccgaccacagccuggucaaccgcaucuccaaggccgccgggcagggcgagagcgcggggcaguccgccgagcucaucgcccgcgacaccccggagcccugggagggcuuccggaacgacaucagcgcccagaucgcgcgcaucguggugucccaccgggccgaccacggccgcaucgacgucgaggggcggaagcacggcaaggacagcacggccgggcgccugcacaacgacaccgccuacggcaucguggacgaccacaccguggucucccggacgccccugcucagccugaagcccggggacaucgaggugaccaccaagggcaagaacauccgcgacacccagcugcagaaggcccucuccguggcgaccacgggcaaggacgggaagggcuucgaggaggcccugcggaacuucgccgagaaggaggggccguaccagggcauccgccggguccgccugaucgagacccuccagagcuccgcccggguggagguggggagcgacgaggacggccagccccugaaggccuacaagggcgacuccaaccacugcuacgaccuguggaagcuccccgacgggaaggucgugccccacguggucagcaccuacgaggcgcacgccggcaccgacaagcgcccgcaccccgccgccaagcggauccugcgcguguucaagaaggacaugguggccaucgagcaggacgaccagacggcgaucuucuacguccagaagcuggaccgggccaacgggcuguuccuggcgccccaccuggaggccaacgccgacgcccgccaccggaaccccaacgacgccuucaaguuccuccagaugggcgccgggagcguggugcgcaacaagcugcgccgggucuacguggacgagaucggccgcaucaaggacccgggcccgcccaagcacuga

SEQ ID NO: 1421 - RNA, 2994 nt, Artificial Sequence
  Cas9 variant
augaagauccugggcuucgacaucgggaucaacagcaucggcugggccuucguggagaacgacgagcucaaggacugcgggguccgcaucuucaccgaggccgagaaccccuccaacaaggagagccuggcgcugccgcggcgcaacgcccgguccagccgccggcgccucaagcggcgcaaggcccggcugguggccaucaagcgcauccuggccaaggagcucaagcugaacuucaaggacuacguggcggccgacggcgagcugcccaaggccuacgaggggaagcucaccuccaucuacgagcugcgguacaaggcccugauccagcagcucgagacgaaggaccuggcgcgcgucauccugcacaucgccaagcaccggggcuacaugaacaagaacgagaagaaguccaacgacaccaagaagggcaagauccucagcgcccugaagaacaacgcccugaagcucgagaacuaccagagcgugggggaguacuucuacaaggaguucuuccagaaguacaaggagaacaccaagaacuucaucaagauccgcaacaccaaggacaacuacaacaacugcgugcuguccagcgaccuggagaaggagcucaagcugauccuggagaagcagaaggaguucggcuacaacuacuccgaggacuucaucaacgagauccucaaggucgccuucuuccagcggccccugaaggacuucagccaccuggugggggcgugcacguucuucgaggaggagaagcgcgccugcaagaacuccuacagcgccugggaguucguggcccucaccaagaucaucaacgagaucaagucccuggagaagaucagcggcgagaucguccccacccagaccaucaacgagauccugaaccucauccuggacaagggguccaucacguacaagaaguuccggagcugcaucaaccugcacgaguccaucagcuucaagagccucaaguacgacaaggagaacgccgagaacgcgaagcugaucgacuuccgcaagcugguggaguucaagaaggcccucggcgugcacucccugagccggcaggagcuggaccagaucuccacccacaucacccucaucaaggacaacgucaagcugaagaccgugcuggagaaguacaaccucagcaacgagcagaucaacaaccugcuggagaucgaguucaacgacuacaucaaccucuccuucaaggcccugggcaugauccugccgcucaugcgcgaggggaagcgguacuacgaggccugcgagaucacgaaccugaagcccaagaccguggacgagaaggaggacuuccugcccgccuucugcgacagcaucuucgcgcacgagcuguccaaccccgucgugaaccgcgccaucagcgaguaccgcaaggugcucaacgcccugcugaagaaguacggcaagguccacaagauccaccucgagcuggcccgggacguggggcuguccaagaaggcccgcgagaagaucgaggaccagcagaagaacaacaaggcgaucaacgacugggcccucaaggagugcgagaacaucggcaucaaggccagcgccaagaacauccugaagcugaagcucuggaaggagcagaaggagaucugcaucuacuccggcaacaagaucagcaucgagcaccugaaggacgagaaggcgcuggagguggaccacaucuacccguacucccggagcuucgacgacuccuucaucaacaagguccucguguucaccaaggagaaccaggagaagcugaacaagacccccuucgaggccuucgggaagaacaucgagaaguggagcaagauccagacgcuggcccagaaccuccccuacaagaagaagaacaagauccuggacgagaacuucaaggacaagcagcagcaggacuucaucucccgcaaccugaacgacacccgguacaucaccacccucaucgccaaguacacgaaggaguaccugaacuuccugccccucagcgagaacgagaacaccaaccugaaguccggcgagaaggggagcaagauccacauccagaccaucagcggcaugcugaccuccgugcuccgccacacguggggguucgacaagaaggaccggaacaaccaccuccaccacgcccuggacgcgaucaucgucgccuacagcaccuccagcaucaucaaggccuucuccgacuucaagaagaaccaggagcuccugaaggcccgcuucuacgccaaggagcugaccagcgacaacuacaagcaccaggugaaguucuucgagccguucaagggcuuccgggagaagauccucuccaagaucgacgagaucuucgucagcaccccgccccgcaagcgggcgcgcggcgcccugcacgaggagacguucuacuccgaggacaagaugaucaagaaguacaacagcaaggaggggcugcagaucgcccucuccugcggccgggugcgcaagaucgggaccaaguacguggagaacgacaccaugguccggguggacaucuucaagaagcagaacaaguucuacgccauccccaucuacgugauggacuucgcccugggcauccugcccaacaagaucgucaucaccgggaaggacaagaacaacaaccccaagcaguggcagacgaucgacgagagcuacgaguucugcuucucccucuacaagaacgaccugauccugcuccagaagaagaacaugcaggagcccgaguucgcguacuacaacagcuucgacaucgaccgcucccggaucaagaucaagaagcacgacaacaaguucgagaaccugaccagcaaccagaagcugcuguucaccaacaaggacaagggcaagaaccgcaccggcauccagaaccugaagaucuucgagaaguacaucgugacgccccugggggacaagaucaaggccgacuuccagccgcgggagaacaucucccucaagaccagcaagaagcacggccuguga

SEQ ID NO: 1422 - RNA, 2994 nt, Artificial Sequence
  Cas9 variant
augggcaacuacacccuggggcucgacaucggcagcaacuccaucgggugggcccugguggaggacgccgucgaggcgccccgcaucguggacaugggcgugcgggucuucccggaggggguggaccgcgacaccaagggccuggagaaguccaagaacgccacgcggcgcgaggcccggggcgcccgccggacccaccagcgccggcgccagcggaagcagcgccucgugcgggcccugcgccaggucgggcugcuccccugcgacaaggcggaggugcggagccuguuccagaccgaccccuacgagauccgcaagcggggccuggaccaccgccucgagcuguacgagaucgggcgggccuucuaccaccugagccagcgccggggcuucaaguccaaccgcaagagcggggcccucaaggaggacggcaccgugaagaaggaggccggcgagcugcagcgcaagaucgacgaggcggggugccggacgaucggcgaguacuucgccgggcuggaccccgagcagcagcgcauccggggccgcuacaccuuccgguccauguaccagaaggaguucgaccuccugugggccaagcaggucgaguucuacccgaaggugcugaccgaggaccuccgcagcaaggugcgggacgagaucaucuucuuccagcgcccccugaaguccgccaaggaccugaucggcgacugcgagcucgagcccaccgagaagcggugcccccgcgccgacugguacgcgcggcgcuuccggcugcugcaggacaucaacaaccucaucauccagaacccggacgggacggagcagaagcugagccccgaccagcgcgccgcccugcucggcgagcuggggcagcgggagaagcugaccuucgacaacauccgcgccaagcucggccugcuggagacccagaaguucaacgccgaguaccggaucgggcgcaagggcaagaaggucgaggcgaucaagggcgacguguucguguggaccaugcgggggaaguccgucuucggccccaaggccugggacgccauggccgacgagcgcaaggugagccucaacgagcuguucguggagcuggaggacgacgaccucgcccgcaagcuggagacggaguacgggcugaccgacaagcagguccaggcggccaugaaggccucccucccccagggcuacaugagcuucucccggaaggccgugcugaagcugcucccguucauggaggccggggcgcugacccacgaggccaucgaccaggccggcuaccgcaaggaggagcccacccagacggacgccaucgcgcgggugagcuucccgcccgaccugcgcaacccgaucguccagaaggcccucuucgaggugcggaagguggucaacgcccuggugcgcgaguacggcaagcccacccggaucaagaucgagauggcccgcgacguccagggguccaagcggcagcgcgaggagcugcacuggcggaacgaggacaaccgcaagaagaacgaggaggugcgggaccgccuccggaccgacauccacaucgacgaccccagccgcgacgacgugaucaaguacaagcuguggcaggaguccggcaagaugugccccuacaccgggcggcagaucugccaggaggcccuguucggcccgaaccccgaguuccaggucgagcacauccugcccuacgaccgcagccucgacgacagcuacaugaaccugacgcugugcgaggugcacgagaacauccacgggaagcggaaccagacccccuucgaggcguacggcuccggcgccgagcgcuacgagcagaucaagcagcggaucaaggugcucccguggcccaagcgccagaaguuccugcagcaggagaucaaccuggacagccacaucucccgcgagcucaacgacacccgguacaucugccgcgagaccgucgccuaccugaagcagcugggggugcacgugcggggcacgcgcgggaagaucaccgccgagcuccggcaccaguggggccuggacggcaucuucagcgagcuggggguccgccgggacgacgaccaccgccggcacgccguggacgcgcucguggucgccgugaccgacaacgagcaccuccgccggcuggccguguccaaguacguccuggccggcccccgcuucgagacccccuggagcgccuuccgggacgaggcgcgcgggaacgugaagcggaugaacgugucccaccgcgucugccggaaggugagcggcgcccugcacgaggagacgaacuacgggccgaccggcgugcgcgaccaggccggccaggacaucuacgccuaccggaagaagcuggaggaccucaccacccccauggucgagaagaucguggaccccgugguccgcgacaucgugcgccagcggcugcugaugaaggggaucgacccggcggccgccgaccgcaagauccccaaggacguguggaaggagccccucuacaugcggcgcacgaaguccgacaagaugauccagauccggcgcguccggauccacgacgugaagaacagcaucaucgugcugaccgacgaguccggccgccccuaccgggccgucgagcccgggggcaaccaccacguggagguguucgaguacguccacgggaccaagaccggcacgcgcgaggccgagguggugaccauguucgaggcgguccggcgcagccgggcccgcgcccccguggugcggcgcgaccacggccccgggacccgguucgucugcucccuggccaucaacgacauggugaugaugcccgacaagagcggcaagauggaccucuuccgcauccagaagauguccgccagcaagcaggucuacuuccggcaccacaccgcggcccgcaucgacuccgagcggacccugauccgcaagcaggcccaccuguucaacggguacaaggugagcguggacccgacgggcgccaucugccgcgccaacgacuga

SEQ ID NO: 1423 - RNA, 3000 nt, Artificial Sequence
  Cas9 variant
augaagauccugggcuucgacaucgggaucaacagcaucggcugggccuucguggaggacaaccagcuccaggacugcgggguccgccuguucaccaaggccgaggaccccaagaccaaggagucccuggcgcucccgcggcgcaacgcccggagcaaccgccggcgccugggccggcgccggucccgccugaucgcccucaagcacaucaucagcaaggggcugaagcugaacuaccaggacuacaucgccaacgacggcgagcuccccaaggccuacgagggccggcugaucucccccuacgagcugcgcuacaaggcgcucaacgagaagaucgagcccaaggaccuggcccgggugauccugcacaucgccaagcaccgcggguacaugaacaagaacgagaagaaguccagcgacaacgagaagggcaagauccucagcgcccugaagacgaacgcgcugaagcucgagaaguaccaguccgugggggaguacuucuacaaggaguucuuccagaaguaccgggagaacaccaaggacuucaucaacauccgcaacaaggagggcagcuacgagaacugcguccuggccuccgaccuggagaaggagcucaagcugauccuggagaagcagaaggaguggggguacagcuacaacgacaacuucaucaaggagauccucaagguggccuucuuccagcggccgcugaaggacuucuccuaccuggugggcgccugcaccuucuucgaggacgagaagcgcgccugcaagaacagcuacuccgcgugggaguucgucgcccucaccaagaucaucaacgagcucaagagccuggagaaggaguccggcgagcucgugagcucccagaucaucaacgagauccugaaccacauccuggacaaggggagcaucacguacaagaaguuccgggaguacaucaagcuccacgagagcaugaaguucaagucccugaaguacgacaaggacaacguggagagcaccaagcugaucgaguuccgcaagcucgucgaguucaagaaggcccugggcgagcacucccugagccgggaggagcucgaccagaucgccaccuacaucacccugaucaaggacaacgagaagcugaagaucacgcucgagaaguacucccugaacaacgagcagaucaagaaccugcucgagaucgacuucaacgaccacaucaaccugagcuucaaggcccugaaccucauccugccccugaugaaggaggggaagcgcuacgacgaggcgugcaagcugcucaaccugaagaccaaguccaacaaccagaaguucgacuuccugcccgccuucugcgacagcaucuucgcccaggagcucaccaaccccaucgugaaccgcgccaucuccgaguaccggaaggugcugaacgcccugcucaagaaguacggcaagaugcacaagauccacaucgagcuggcgcgcgacaucggccugagcaagaagcuccgggccaagaucgagaaggagcagaaggagaacuacgagaacaacaucugggcccugaacgagugcgagaaguucgggcugaaggccaacgccaagaacauccucaagcugaagcuguggaaggagcagaaggaguucugcaucuacuccggcaagaagaucagcaucgagcaccuccgcgacgagaaggcgcuggaggucgaccacaucuacccguacucccggagcuucgacgacuccuuccugaacaaggugcucguguucaccaaggagaaccaggagaagcugaacaagacgcccuucgaggccuucggggccaacgaggagcgcuggagcaagauccaggcccuggcgcagaaccuccccuacaagaagaagaacaagauccuggacgaggccuucaagggcaagcagcagcaggacuucaucucccggaaccugaacgacacccgcuacaucagcacccucaucgucaaguacaccaaggaguaccuggacuuccugccccucgacgagaaggaggacgugaaccugaaguccggggagaagggcagcaagauccacgugcagacgaucaacggcaugcugaccagcguccuccggcacaccuggggguucgcccagaaggaccgcaacaaccaccuccaccacgcccuggacgccaccaucguggcguacuccacgaacgccaucaucaaggccuucagcgacuucaagaaggagcaggagcugcugaaggccaagcuguacgccaaggagcucaccuccgacagcuacaagcaccaggcgaaguucuucgagccguucgagggcuuccgggagcagauccugaaccagaucaacaagcuguucguguccaagccgccccgcaagcgggcccgcggggcccuccacaaggagaccuucuacagcaaggacgagaugaucaagaaguacaacucccaggagggcgucgagaucgcccugaacugcgggaagauccggaagaucggcaccaaguacguggagaacgacacgauggugcgcaucgacaucuucaagaagcagaacaaguucuacgccauccccaucuacaccauggacuucgcgcugggcguccuccccaacaagaucgugaucaucgggaaggacaagaagggcaaccccaagcaguggcaggagaucgacgagagcuacgaguucugcuucucccugcacaaggacgaccugguccucauccagaagaaggacaugcaggagcccgaguucgccuacuacaacggguucgacaucagcaacuccagcaucugcguggagaagcacgacaacaaguucgagaaccugaccgacaaccagcggcugcuguucaccaacgccgagggcaacgugaaggccaagaagaucgggauccagggccugcgcaucuucgagaaguacaucaucacgccccugggcgagaagaucaaggcggacuucaagccgcgggaggacaucgcccucaagaccuccaagaagcacgggcuguga

SEQ ID NO: 1424 - RNA, 3003 nt, Artificial Sequence
  Cas9 variant
augaagauccugggcuucgacaucgggaucaacagcaucggcugggccuucguggagaacgacgagcucaaggacugcgggguccgcaucuucaccaaggccgagaaccccaagaacaaggagucccuggcgcugccgcggcgcaacgcccggagcucccgccggcgccucaagcggcgcaaggcccggcugaucgccaucaagcgcauccuggccaaggagcucaagcugaacuucaaggacuacguggcggccgacggcgagcugcccaaggccuacgaggggagccucgccuccguguacgagcugcgguacaaggcgcugacccagaagcucgagacgaaggaccuggcccgcgucauccugcacaucgccaagcaccggggcuacaugaacaagaacgagaagaaguccaacgacgccaagaagggcaagauccucagcgcccugaagaacaacgcgcugaagcucgagaacuaccagagcgugggggaguacuucuacaaggaguucuuccagaaguacaaggagaacaccaagaacuucaucaagauccgcaacaccaaggacaacuacaacaacugcgugcuguccagcgaccuggagaaggagcucaaguucauccuggagaagcagaaggaguucggcuacaaguacuccgagggguucaucaacgagauccugaaggucgccuucuuccagcggccccucaaggacuucagccaccuggugggcgccugcaccuucuucgaggaggagaaccgcgccugcaagaacuccuacagcgccugggaguucguggcgcugacgaagaucaucaacgagaucaagucccucgagaagaucagcggggagaucgucuccacccagaccaucaacgaggugcugaaccugauccucgacaagggcagcaucaccuacaagaaguuccgguccugcaucaaccugcacgagagcaucagcuucaagucccugaaguacgacaaggagaacgccgagaacgccaagcucaucgacuuccgcaagcugguggaguucaagaaggcccugggcguccacagccucucccggcaggagcuggaccagaucagcacgcacgugacccugaucaaggacaacgugaagcucaagaccguccuggagaaguacaaccuguccaacgagcagaucaacaaccuccuggagaucgaguucaacgacuacaucaaccugagcuucaaggcccucgggaugauccugccccugaugcgcgagggcaagcgguacgacgaggcgugcgagaucaccaaccucaagccgaagacgguggacgagaagaaggacuuccugcccgccuucugcgacuccaucuucgcccacgagcugagcaaccccguggucaaccgcgccaucuccgaguaccgcaaggugcugaacgcccuccugaagaaguacgacaaggugcacaagauccaccuggagcucgcgcgggacgucgggcugagcaagaaggcccgcgagaagaucgagaaggagcagaaggagaaccaggccgugaacgccugggcgcugaaggagugcgagaacaucggccucaaggccuccgccaagaacauccugaagcugaagcucuggaaggagcagaaggagaucugcaucuacagcggcaacaagaucuccaucgagcaccugaaggacgagaaggcccuggagguggaccacaucuaccccuacagccgguccuucgacgacagcuucaugaacaagguccucguguucaccaaggagaaccaggagaagcugaacaagaccccguucgaggccuucgggaagaacaucgagaagugguccaagauccagacccuggcgcagaaccuccccuacaagaagaagaacaagauccuggacgagaacuucaaggacaagcagcaggaggacuucaucagccgcaaccugaacgacacgcgguacaucgccacccucaucaccaaguacaccaaggaguaccugaacuuccugccccucaacgagaacgagaacacgaaccugaaguccggcgagaaggggagcaagauccacguccagaccgugaacggcaugcugaccagcgugcuccgccacaccuggggguucgacaagaaggaccggaacaaccaccuccaccacgcccuggacgccaucaucgucgccuacuccacgaacagcaucaucaaggcguucuccgacuucaagaagaaccaggagcugcugaaggcccgcuucuacgccaaggagcugaccagcgacaacuacaagcaccaggugaaguucuucgagcccuucaagggcuuccgggagaagauccucuccaagaucgacgagaucuucgugagcaagccgccccgcaagcgggcccgcggcgcccugcacaaggagaccuucuacuccgaggacgagaugaucaagaaguacaacagcaaggaggggcugcagaucgcgcucuccugcggccggguccgcaagaucgggaccaaguacguggagaacgacacgauggugcgggucgacaucuucaagaagcagaacaaguucuacgccauccccaucuacgccauggacuucgcccugggcauccugcccaacaagaucgugguggucgggaaggacaagaacaacaacccgaagcaguggcagaccaucgacgagagcuacgaguucugcuucucccucuacaagaacgaccugaucaugcugcagaagaaggacaugcaggaggcggaguucgccuacuacaacggcuucgacaucagcaccuccagcaucugcguggagaagcacgacuccaaguucgagaaccucaccagcaaccagaagcugcuguucuccaacgccaaggagggcagcgugaaggucgagaaccucgggauccagaaccugaagaucuucgagaaguacaucaucacgccccugggcgacaagaucaaggccgacuuccagccccgcgagaacaucagccucaagaccuccaagaagaacgggcuguga

SEQ ID NO: 1425 - RNA, 3003 nt, Artificial Sequence
  Cas9 variant
auggcccgcgcccagcggcgccugaucagccggcgcgcgaaccggaugaacaagcuccgccggcugcugaagcaggagaacgugcuccaggccaacgacuacgacgagaagggccugaucaucgggcugcccaaccaggccugggagcuccgcgcccagggccuggaccggaagcuggagccgaaggagugggccgcgguccucaucaaccuggugaagcaccgcggguaccugucccagcggaagaacgagagccagaccgccgacaaggagcucggcgcccugcuguccgggaugaaccacaaccaccagcuccugcagagccaguccaaccaguaccgcacccccgccgagcuggcgaucaagcaguucgccacgcaggacggccacauccggaaccagcgcggcgccuacacccacaccuucaaccggcucgaccugcagaacgagcugaaccagcuguucgacgcccagacccgccuggggaacccccacgugagcggcucccugaagacggccaucaacgaccuccugaugaaccagaaggcggcccugagcggggacgccauccucgagaugcugggccggugcaccuucgagcccuccgaguacaaggccgccaagaacaccuacagcgcggagcgcuucgucuggcuggggaagcucaccaaccugcggauccaggacaacggccuggaguccgcccucagccgcgagcagcgggagcugcugcucaacgagccguacaacaagacgaagcugaccuaccagcagguccgcaagcugcuccgccugcccgagaccgccuucuucaagggccugcgguacgggaaggacaacgccgaguccgccaccuucauggagaugaaguccuaccacgcgauccgcaagagccucgagaacaagagccugaaguccgagugggagaagcugaagacgcagcccaagcuccuggaccugaucggcaccgccuucagcaucuacaagaccgacgacgagaucgccgggugccucaagaaccagcugcccgagaacgugaucaucgcccugcaggagcagcugaacuucuccaacuucauggagcucagccugaaggcccuggagaagcuccugccgcugauggagcagggccuccgguacgacgaggcgugcacccagaucuacggcaaccgccacgagaagaucgccgacaagacggagaaguuccugcccaacauccccgccgacaagcugcggaaccccguggugcuccgcacccugacccaggcccggaaggugaucaacgcgaucauccgccgguacgggagcccggcccgcguccacaucgagaccggccgggagguggggaaguccuucagcgaccgcgacaagcugaagaagcagcaggaggagaaccaggagcagcggcgccgggccaucgacgaguggaagcaguucuuccccaacgccgcccacgagcccaaggcgguggacauccucaagcugcgccuguaccagcuccagcagggcaagugccuguacuccgggcugcccaucgacguccggcgccucccggagaagggcuacguggagaucgaccacgcccugcccuucagccggacgugggacgacuccuucaacaacaagauccuggugcucgccagcgagaaccagaacaagggcaaccagacccccuacgaguaccugcgcggggccgacaacuccgagagcuggcgccuguucgucgagaacgugcagaacugccaguucucccccaacaagaagcagaagaucauggccaagcagcucgacgagaagggcuuccuggagcggaaccugaacgacacccgcuacgugagccgguuccucugccaguucaucuccgagcaccuccaccugaccgggaagggcaagaagcgcgucuucgcgagcaacgggcagaucacggcccuccugcggggccgcuggggccuguccaagaaccgggaggagaacgaccgccaccacgccguggacgccguggucguggccugcagcaccguggcgaugcagcagaagaucacccaguucguccgguaccagaaggggaacguguucaccggcgagcgcaucgacaaggagacgggggaggucaucuccauccacuucccgacccccugggagcacuuccgggaggaggugaugauccgcguguucgacgacaacccccuccggacccugcccgagaagcugccgaaccgccccgaggcccuccacgaguacgucaugccccuguucgugagccggaugcccacccgcaagaugacgggccaggggcacaaggagaccaucaaguccgccaagcggcuggacgagaagaucagcgugcuccgcgucccgcugacccagcugaagcucaacgaccuggagaacauggugaaccgggagcgcgagcccgcccuguacgaggcgcucaaggcccggcuggagcaguucaagaacgaccccgccaaggccuucgccgagccguucuucaagcagggcggccagcaggucaaggcggugcgcguggagaucgugcagaaguccgggaugcugcuccgcaagaucaacggcgucgccgacaacgggagcauggugcggguggacgucuucgagaaguccggcaaguucuaccuggugcccaucuacgccuggcaggucgccgagggcauccugcccaacuacgccgugguggcgcacaaggacgagagcgacuggauccucauggacgagagcuaccacuucaaguucgcccuguacaagaacgaccugcucgaggugcagaccaagaagggcgggaucaugggguacuucgccucccuggaccgcgccacgggcgccaucaccauccgggagcacgaccgcgacaagaagaagugcaaggacggggagcaccggagcaucggcgucaagauggcguccagcuucaagaagcuccagguggacgagcugggcaagaacauccacgagacccgcucccggaagcgccccaacaucggguga

SEQ ID NO: 1426 - RNA, 3012 nt, Artificial Sequence
  Cas9 variant
augcgcauccugggcuucgacaucgggaucaacagcaucggcugggccuucguggagaacgacgagcucaaggacugcgggguccggaucuucaccaaggccgagaaccccaagaacaaggagucccuggcgcugccgcgccggaacgcccgcagcucccggcgccggcucaagcgccggaaggcccgccugaucgccaucaagcggauccuggccaaggagcucaagcugaacuacaaggacuacguggcggccgacggcgagcugcccaaggccuacgaggggagccucgccuccguguacgagcugcgcuacaaggcgcugacccagaaccucgagaccaaggaccuggcccgggucauccugcacaucgccaagcaccgcggcuacaugaacaagaacgagaagaaguccaacgacgccaagaagggcaagauccucagcgcccugaagaacaacgcgcugaagcucgagaacuaccagagcgugggggaguacuucuacaaggaguucuuccagaaguacaagaagaacaccaagaacuucaucaagauccggaacaccaaggacaacuacaacaacugcgugcuguccagcgaccuggagaaggagcucaagcugauccuggagaagcagaaggaguucggcuacaacuacuccgaggacuucaucaacgagauccucaaggucgccuucuuccagcgcccccugaaggacuucagccaccuggugggggccugcaccuucuucgaggaggagaagcgggccugcaagaacuccuacagcgccugggaguucguggcgcucacgaagaucaucaacgagaucaagucccuggagaagaucagcggcgagaucguccccacccagaccaucaacgaggugcugaaccucauccuggacaagggguccaucaccuacaagaaguuccgcagcugcaucaaccugcacgaguccaucagcuucaagagccucaaguacgacaaggagaacgccgagaacgccaagcugaucgacuuccggaagcugguggaguucaagaaggcccucggcguccacucccugagccgccaggagcuggaccagaucuccacgcacaucacccucaucaaggacaacgugaagcugaagaccgugcuggagaaguacaaccucagcaacgagcagaucaacaaccugcuggagaucgaguucaacgacuacaucaaccucuccuucaaggcccugggcaugauccugccgcucaugcgggaggggaagcgcuacgacgaggcgugcgagaucgccaaccugaagcccaagaccgucgacgagaagaaggacuuccugcccgccuucugcgacagcaucuucgcccacgagcuguccaaccccguggugaaccgcgccaucagcgaguaccggaagguccucaacgcgcugcugaagaaguacggcaaggugcacaagauccaccucgagcuggcccgcgacguggggcuguccaagaaggcccgggagaagaucgagaaggagcagaaggagaaccaggccgucaacgcgugggcccucaaggagugcgagaacaucggccugaaggccagcgccaagaacauccugaagcucaagcuguggaaggagcagaaggagaucugcaucuacuccggcaacaagaucagcaucgagcaccugaaggacgagaaggcccucgagguggaccacaucuacccguacucccgcagcuucgacgacuccuucaucaacaaggugcuggucuucacgaaggagaaccaggagaagcugaacaagacccccuucgaggcguucgggaagaacaucgagaaguggagcaagauccagacccucgcccagaaccugcccuacaagaagaagaacaagauccuggacgagaacuucaaggacaagcagcaggaggacuucaucucccggaaccucaacgacacccgcuacaucgccacgcugaucgccaaguacaccaaggaguaccugaacuuccuccugcugagcgagaacgagaacgccaaccucaaguccggcgagaaggggagcaagauccacgugcagaccaucagcggcaugcugaccuccguccugcggcacacguggggguucgacaagaaggaccgcaacaaccaccuccaccacgcgcuggacgccaucaucguggccuacagcaccaacuccaucaucaaggccuucagcgacuuccggaagaaccaggagcugcucaaggcccgcuucuacgcgaaggagcugaccuccgacaacuacaagcaccaggugaaguucuucgagcccuucaagagcuuccgggagaagauccuguccaagaucgacgagaucuucgucagcaagccgccccgcaagcgggcccgccgggcccuccacaaggacaccuuccacuccgagaacaagaucaucgacaagugcagcuacaacuccaaggagggccugcagaucgcccugagcugcggccgcgugcggaagaucgggacgaaguacguggagaacgacaccaucguccgcguggacaucuucaagaagcagaacaaguucuacgcgauccccaucuacgccauggacuucgcccucggcauccugcccaacaagaucgugaucaccgggaaggacaagaacaacaacccgaagcaguggcagaccaucgacgaguccuacgaguucugcuucagccuguacaagaacgaccucauccugcugcagaagaagaacaugcaggagcccgaguucgccuacuacaacgacuucuccaucagcacguccagcaucugcgucgagaagcacgacaacaaguucgagaaccucaccagcaaccagaagcugcuguucuccaacgccaaggagggcagcgugaagguggagucccucgggauccagaaccugaaggucuucgagaaguacaucaucacgccccugggcgacaagaucaaggcggacuuccagccccgggagaacaucagccucaagaccuccaagaaguacggccugcgcuga

SEQ ID NO: 1427 - RNA, 3012 nt, Artificial Sequence
  Cas9 variant
augaucgacgagagccugaccuucggcaucgaccucgggaucggcuccugcgggugggccgugcugcgccggcccagcgccuucggccgcaagggggucaucgagggcaugggcuccuggugcuucgacgugccggagaccagcaaggagcggacgcccaccaaccagauccgccgguccaaccgccugcuccggcgcgugauccggcgccggcgcaaccggauggcggccauccgccggcugcugcacgccgccgggcuccugcccagcaccgacuccgacgcccugaagcgccccggccacgacccgugggagcuccgggcgcgcgggcuggacaagccccugaagcccgucgaguucgccguggugcucggccacaucgccaagcggcgcggguucaagagcgccgcgaagcggaaggccaccaacaucuccagcgacgacaagaagaugcugacggcccuggaggccacccgcgagcgccucggccgguaccgcaccgucggcgagauguucgcccgggaccccgacuucgcgucccgccggcgcaaccgggaggggaaguacgaccgcaccacggcccgggacgaccuggagcacgaggugcacgcccuguucgccgcccagcgccggcucggccagggguucgcgagcccggagcuggaggaggccuucaccgccuccgccuuccaccagcgccccaugcaggacagcgagcggcuggugggcuucugccccuucgagcgcaccgagaagcgggccgcgaagcucacccccuccuucgagcgcuuccggcugcuggcccgccuccugaaccugcggaucacgaccccggacggcgagcgcccccucaccgucgacgagaucgcccuggugacccgcgaccuggggaagacggccaagcucagcaucaagcgggugcgcacccugaucggccuggaggacaaccagcgguucaccaccauccgccccgaggacgaggaccgggacaucgucgcccgcaccgggggcgcgaugacggggaccgccacccuccggaaggcccugggcgaggcccuguggacggacaugcaggagcgccccgagcagcucgacgcgaucguccaggugcuguccuucuucgaggccaacgagaccaucaccgagaagcugcgggagaucggccucacccuggccgugcuggacgugcuccugacggcccuggacgccgggguguucgcgaaguucaagggcgccgcccacaucagcaccaaggccgcccgcaaccuccugccgcaccuggagcaggggcggcgcuacgacgaggcgugcaccauggccggcuacgaccacgccgccucccggcucagccaccacgggcagaucgucgccaagacccaguucaacgcgcuggugacggagaucggcgagagcaucgccaaccccaucgcccgcaaggcccugaucgagggccugaagcagaucugggcgaugcggaaccacugggggcuccccggcuccauccacguggagcuggcccgcgacgucgggaacagcaucgagaagcggcgcgagaucgagaagcacaucgagaagaacaccgcccugcgggcccgcgagcggcgcgaggugcacgaccuccuggaccuggaggacgugaacggcgacacccuccugcgcuaccggcuguggaaggagcagggcgggaagugccucuacaccggcaaggccauccacauccgccagaucgcggccacggacaacuccguccagguggaccacauccugcccuggagccgguucggggacgacuccuucaacaacaagacccugugccucgccagcgccaaccagcagaagaagcgcuccaccccguacgaguggcugagcggccagaccggggacgccuggaacgcguucguccagcggaucgagaccaacaaggagcugcgcggcuucaagaagcggaacuaccuccugaagaacgccaaggaggccgaggagaaguuccgcucccggaaccugaacgacacgcgcuacgccgcccgccucuucgcggaggccgugaagcugcuguacgccuucggcgagcggcaggagaagggcgggaaccggcgcguguucacccggcccggggcccucaccgcggcccugcgccaggccuggggcgucgagagccugaagaagcaggacgggaagcggaucaacgacgaccgccaccacgcccucgacgcccugaccguggcggccguggacgaggccgagauccagcggcugacgaaguccuuccacgagugggagcagcagggccucggccgcccccugcgccgggucgagcccccgugggagagcuuccgcgccgacguggaggccaccuaccccgagguguucgucgcgcggcccgagcgccggcgcgcccggggcgaggggcacgccgccaccauccgccaggugaaggagcgggagugcacccccaucguguucgagcgcaaggccgucuccagccugaaggaggcggaccucgagcggaucaaggacggggagcgcaacgaggccaucguggaggccauccgguccuggaucgccacgggccgcccggccgacgcgccgccccggagcccccgcggggacaucaucaccaagauccggcuggccaccaccaucaaggccgccgugcccguccgcggcggcacggcggggcggggcgagauggugcgcgccgacguguucuccaagcccaaccggcgcgggaaggacgagugguaccugguccccguguacccgcaccagaucaugaaccgcaaggccuggcccaagccgcccaugcggagcaucguggccaacaaggacgaggacgaguggaccgaggucggccccgagcaccaguuccgcuucucccucuacccccggagcaacaucgagaucauccgccccagcggggaggugaucgagggcuacuucgugggccugcaccggaacaccggggcccugauccccaccccggucggccccgacuccuacgugaucgcguga

SEQ ID NO: 1428 - RNA, 3024 nt, Artificial Sequence
  Cas9 variant
augaaggugcugggcuucgacaucgggaucaacagcaucggcugggccuucgucgagaacaacgagcucaaggacugcggggugcgccuguucaccaaggccgagaaccccaagaccaaggagucccuggcgcucccgcggcgcaacgcccggagcucccgcgugcggcugcgccggcgccggagccgccugcucucccugaagcacaucaucagcaaggaguucggccugcacuacgaggacuacaucgcccucgacgggaaccugcccaaggccuacacgggcaagaucgaguccaucuacaagcugcgguacgaggcccucagccaggcgaucuccaaggaggaccuggcccgcgucauccugcacaucgccaagcaccggggcuacaugaacaagaaccagaagaccagccaggacuccgagaagggggccauccucagcgcgaucaaggagaacuccaacaagaucaagcacuaccagaccgccggcgaguacuucuacaaggagcuguucgagaaccugcgcgacgggaccaaggaguucaagaacauccggaacaaggccaugaagaacgagaagacgggcaacauggagagcaccuacuacaacaccauccucgccuccgaccuggagaaggagcugaagcucauccuggagaagcagcaggccuaccacaacuacagcgacaccuucaucaaggaggugcuggagaucgcguucuaccagcgcccccucaaggacuucucccaccugguggggagcugcacguucuacgagaacgagaagcgggccugcaagaacuccuacagcgccugggaguucaucgcccugggcaagaucaucaacacccucgagagcaucaagaaggacaccggcgagaucuucuccaacgagaucaucacccagauccugaaggagguccuggacaaggggagccucuccuacacgaagcugcgcaagaugaucaaccuggacgagaaggugaaguucaagggccucaaguacgacaaggaggggguggagaagaccaaccugaucgaguucaagaagcugaaggaguucaagaaggcccucggcgagcacaaccuggagcggaagacccuggacgagaucgcgacccacaucacgcucaccaaggacgagaaccagcugaagaagcagcuggagcaguacgcccucagccagaaccagaucgacgcccuggccgagcuggacuucaacgaccacaucaaccucuccuucaaggcccuguacgagauccugccccucauggagaagggcaagcgcuacgacgaggcgugcaacgagcuggggcugaaggccaagaccagcaaccagaaguccgaguuccugccggccuucugcgacagcaucuucgcccaggagcucaccaaccccaucgucaaccgggccaucuccgaguaccgcaaggugcugaaccgccugcucaagaaguacggcaagaugcacaagauccacaucgagcuggcgcgggacgccgggcugagcaaggaggcccgcaacaagaucgagaaggagcagaaggagaacaaggacaucaacgacaaggccgagaagacgugcaaggaguucggccucaagcccaacgcgaagaacauccugaagaucaagcuguggcgggagcagggggagaucugcgccuacuccggcaagaagaucaccaucgacgaccucaaggaggacaaggcccuggagguggaccacaucuaccccuacagccgcuccuacgacgacagcuacaacaacaagguccugguguucaucaaggagaaccagcucaagcugaaccagaccccguacgaggccuucggcuccaaccaggagaaguggagcaagauccaggugcuggcccagaagcuccccuacaagaagaagaaccggauccuggacgagaacuucaagaacaaggaccagaucgaguucaucucccgcaaccugaacgacacccgguacgcgacgagccucaucgccaaguacaccaaggaguaccuggaguuccugccccucuccgacgacgaggacaucagccucaagagcggggagaagggcuccaagacccacguccagaccaugaacgggaugcugacgagcgugcuccgccacgccuggggcuucucccagaaggaccggaacaaccaccuccaccacgcccuggacgccaucaucaucgcguacagcaccaacuccaucaucaaggccuucagcgacuucaagaagaaccaggagauccugaaggccaagcuguacgccaagaagcugaccuccgaggaguacaagaaccagagcaaguucaccggguucgagaaguaccgcuccaagauccucgagaagcuggacagcaucuucguguccaagcccccgaacaagaacacgaagggcgcccugcacgagcagaccuucuacagcuaccaggacauccucgaggaguacaagacccaggagggccugaagcgggcgcuggagugcgggaagguccgcaagaucggcaccaaguacguggugaacgaccggaugguccgccucgacaucuucaagaaggacaacaaguucuacgggauccccaucuacacgauggacuucgcccugggcgugcugcccaacaagguggucaccaucgggaccgacaaggacaagaucaagaaggaguggaagaccaucgacgagaccuacgaguucugcuucucccucuacaagggcgaccuggugcugauccagaagaaggagaugcaggagagcgaguucgccuacuacaacggcuucgacaucuccagcgccuccaucagccucgagaagcacgacaacaaguucgagaaccugacggagaaccagaagcugcuguuccccaaggcgaaggagggggacgucgaggugcggggcaucgggauccagggccugaagguguucaagaaguacauggucaccccgcugggcgagauccaggagacccgcaccgaggcccggcagaacauccagccccgcaagaagcacgggcuccgguga

SEQ ID NO: 1429 - RNA, 3033 nt, Artificial Sequence
  Cas9 variant
augagcgacuccagcuacgugcugggccucgaccuggggaccaacuccaucggcugggccugcguccgccugaacaaggggaagcccgacggccuccuggcccagggggugcggaucuucgaggcgggccuggagaucgacgccuacggccgcgggaccccgcucaacacggagcggcgcaacgcccggcagcgccggcgccugcacgaccggcgcaagcggcgcauccugaaggugcggcgcauccuccaggaggccggcaugcugcccgccaacaagcccgaccacaaggacgcggaguggaagaugcugcucgcccggaaccccuaccgccugcgggccaaggcccuggacgagcagaucgaccucaaggagaucgggcugugcaucuaccaguucgcgcaccgccggggcuuccugagcaacuccaagauccucaagaaggacgacgaccgcgggaagcugaaggacgccaccaaggccuucgccgaggacauggagcagaagggcgcccggaccuggggcgaguaccugagccaccucgacccgcacgagcagcgcauccgcaccaacuacacgcugcgggagugguacaccuccgaguucgaccugaucugggagaagcagcagagcuucuacccccacguccucaccgacgaccuguacaagcgcgugaaggaggcgcuguucuaccagcggccccucaagucccaggcccaccuccuggggcagugcgagcuggagcccggccgcaagcgggccccguucgcccugcugauggcccaggaguuccgccuccugcagagccugaaccaccuccggguggucuccagcaccggggacgagcgccugcugacggacgaggagcggaagcaggcgcucgcccugcugcgcucccggggcaaccagaaguucaccacccuccgcaaggugcugaaccugcggggcaccaaguucaaccucgagcgcgggggcgagaagacgauccaggggaacaacaccgccgccgcccugggcaaccuguucggggaggcgugggaccacuucagcuccgagcagaagaaccagaucguggaggaccggcucaccaucggcgacaccgacgcccugauccgccggaugaagaagacguggggccuggacagcgucaccgccgagauguucuccgagaccgagcuggaggacggguacugcggcuucagccgcaaggcccucgagaagcugcugccccuccuggagcgggggcacgcccugauggaggcggugcaggccgccuaccccgacuaccagaagaaccucccccgcaccgacacgcugccgccccuggagaaccuccgcaaccccaucgugcagcggacccuguccgagcugcgccgggucgugaacgccaucaucaaggaguacggcaagagcgacaagauccgcaucgagcucgcgcgggacaugaagcagaccgccaagaaccgcgagaaguccugggaccggaugcgcgugcgggagcgccagcggaaggaggccgccaagaagauccuggaggagaccgggaaccccgccccgcgccggcacgagaucgagaagguccugcucgcggaggagugcaacugggagugccccuacacgggcaagcgcaucugcaugaacacccugcugggcgacgcgccccaguucgacaucgagcacaucauccccuucagccggagcuucgacaacuccuucagcaacaagacccucugcgacgugaacuacaaccgcaacgugaaggggaacaagaccccguacgaguccgccagcgagacggagcacgaggagauggucugccgggugaagcgcuucaccggcgacuacaaggagaucaagcuggaccgguucaacacccgcgagaccgacucccgggccgacuucaucgaggaguucagcacgucccagcugaacgacacccgcuacgccagccgccucgccggggaguaccugggcaagcuguacggguccgaguggcggaagcacauccagaucgccaagggcggcaccaccaaguaccuccgcgacgccugggaccugaaccggauccugagcgacgggggcacgaagucccgcgacgaccaccggcaccacgccguggacgccgucgugguggcgcucaccacgccccagaccgucaaggcccugagcgacgccaaccagcgcgcccccgagcaccggcgcuacgcguucuccgacaugccccugccgugggagaccuuccggcaggacguggagcaggccaucaacagcaucaccgucucccacaaggugugccgcaaggccaacgggcagcuccacaaggagaccuucuacggccugaucaaggaccggaagaccggcgacacccgcacggugcugcggaagccccuccacgagcugaccgacaaggagaucaagcgcgccgagaucgucgacagcuccauccggaagcugaucgagcagaagcucaaggaccuggaccagccgcccaagaccgccuucaaggaccgcaacaaccaccccuucaucaucgacaagaacgggaacaagcgguucauccacaaggugcgcguguaccaggacgcgaagcccgucaagaucgccgagaaccggcacgugaagcugggcgggaaccaccaccucgagaucuucgaggugaucgacaagaagggcaaccccaccuggaagugcgaggucaucagccuguucgacacgcgccagcgcgugaaggagaagcggccggugaucguccgccaggaccagaacgggaacccccugaaguucagccucuccaucggcgaggccgugcagcuggacuggaacggcgggcgggagaccgccgugguccagaagaugagcaagacccccaacaccguggaguacguguuccgcaagcacaacgacgcccggaaggcggccgacauccccuacaaggagacgaucaccgucaaguccgacagcgcccuguucgccuccaaccuccagaagaucgugaucaccccgaccggccugauccgccgggccaacgacuga

SEQ ID NO: 1430 - RNA, 3033 nt, Artificial Sequence
  Cas9 variant
augaagaaccgcaacgugaucggcaucgacgucgggaccaacagcaucggcugggcccugguggaggagaacgagaacgggcucccccagucccugaaggccgcgggcgugcggaucuuccaggaggccgucgaggccaagacccgcacgccgaagaaccacaagcggcgccaggcccggcuggcccgccgggugcucgcgcgccgggcccgccggaagcagcgccugcagaaccugcuccugaagcacgggcugcuccccggcggcgugaccgaccccguccagcgggaggccgccuucaccacccugggggaccccuaccagcugcgcgcgaagggccucaaccugccgcuggggcuccacgaguucggccgggugcuguuccagcugggggcccgccggggcuuccucagcaaccgcaagacgcgguacggccaccugaacaagcuggacgagcucgccgaccugaucgaggccgaggacgccgcgcccaagaccggggacgccgaggagggcaucauccgcaaggagaucggggagcugcggcaggccauguccgccgccggcagccgcacccucggcgaguaccuggcggggcuggccaaggaggagcgcaagcggugccgccacaccgagcgggccaugcucgaggaggaguucgagcgccuguggauggugcaggcccgguuccaccccgagcuguccgacgagcucaagguccaggugcacacggugaucuucuuccagcgcccccucaagagcaaccgggccucccugggcaagugcagccuggagccgucccgccggaaggcggcccgcgccuggcccgaggcccagcgguuccgccugcugcaggaccucaacaaccuggagauccuggacccccggaccggggagcuccgccggcugcgcgacaccgagcgggccauccugcucaacgcgcuggagcagcagaaguccaugaccuggaacgccguccgcaagaagcugggccuccaccagggggagaaguucaaccuggagacgggcgccaaggccgagaccggccugaaggggcuccagacccuggcgagccugcacgccauccugcagggcugguucgacgagcucggggacaagcgggaccugcugaucgaggaccucaucaccaucgaggacagcgccggccuguaccgccgccugcgggagcacuggggguucgaccgcgagacggccuuccggcucgccacccuggagcuggagcccggcuacgcgucccucagccugaaggccauccgcaagcugcucccgcacaugggcgccgggcaccgguacuccgaggcccgccagcaggucggcuacggguacgagaccggccagcgggaccugcaggagcgccugggggagccgcccgacccccggaaccccgugguggacaaggcccuccacgagcugcgccgggugaucaacgcgcugauccaccgcuucggccggcccgacgugguccgcguggagcucgcccgggaccugaagcuggccaagcgcgacaaggagcggcucgagaagcagaaccgcgagaaccagcggcugaaccgcaaggccgaggccgcgcuggccgagcucggccuggggcagcccagccgggacgaccugaucaaguaccgccucugggaggaguccaagggccugugccccuacaccgggcgcgagaucggccugagcacccucuucuccccggagguggacgucgagcacaucauccccuacagccggugccuggacgacagcuacaugaacaagacgcugugcaugaccgaggagaaccgcaugcagaagggcaaccggacccccugggaggccuacgggggcgaccccgcccgcuacgagcagauccuccagugcgcgcgguacuucccgauggccaagcgcaagcgguuccuggagcagggguccgacuucguggaccaguucauccagcgccagcugaacgacacgcgguacaucgccaagcucgccaaggaguaccuggccgcggugugcaccaacguccaggugaccaagggcgggaccacggccaugcugcgccaccacuggggccucaaccggcugcugggcgaggacgacgggcagaaggagcgcggcgaccaccggcaccacgcccucgacgccgccgucaucgcggugaccagccgcucccuguaccagcggcuggcccgcaucgcccaccagcgggggcacgcccccagccagcgcggcuucuacaucgacccgcccuggcagggguaccaggccgaccucgcgcagacccuggccggcaucguggucucccacgccaccaaccggaagcugacgggcgcccuccacgaggagaccgcguacgggcacaucccccacgugggcuucguguaccgcaagacccugaacaaggacuucaagcugggggacaucgaggccaucuacgaccccagccuccaggagcuggucaaggcccaccuggagcaccacggcaacgaccccaagcgcgccuucgccgaggggauccagugcuaccacaaggacggccacaccccgaucaagcgggugcgcauccgggcgaagcaggucuccgagaagggcacguucagcaucuccgaccgcgccgggcgggccuacaagcaccacaagaccggcagcaaccaccacguggagauccuccgccaccgggccaccgggaagaucgagcccguguaccugaccaccaaggaggccacggagcgcgcgcggcgcggcggggagcccgugauccagcgggaccacggccccgagugggaguucaucaucucccugugcaucaacgacaugguccgccucggcgagggcggccagguggccuacuuccgggugcagaagaucgaggccaccaacaaccgcgucacccugcggagccaccuggccgccacccucgacgacgaggacaugaaggugacgaccuccgugccgaagcuggcggucaugcccggguuccagaaggugcuggugaccgccgucggggaggugcucgagcugcacgacuga

SEQ ID NO: 1431 - RNA, 3033 nt, Artificial Sequence
  Cas9 variant
augaagcgcauggccgccgugggccugaugcccgcggacccgaccgaggccaaggcccucgagcugcuggaccccuacgcccuccgggccgcggggcuggaccaggcccugccccucacccacuucggccgcgcccuguuccaccugaaccagcggcgcggguucaagagcaaccggaagacggacaagggcgacaacgaguccgggaagaucaaggacgccaccaagcgccucgacgaggagauggcgaucaagaacgcccggaccuacggcgaguuccugcacaugcgccggaccagcgccacggaccccaagaacgucccgaccgugcgcacccggcuguccaucgcccgccgggacaacgccgagaaggaggaggcgggcuacgacuucuaccccgaccgccggcaccucgccgaggaguucgacaagcuguggaaggcccaggccggguacagccccgacgugcugaccgacgagcuccgcgacgagaucuccgucaucaucuuccaccagcggccccugaagacgccggaggugggccugugccucuucagcgggucccacggcgugcccaagaaggacaagcgcauccccagcgcccacccccugaaccagcggcgcauccuguucgagaccaucaacaaccuccgggucgcggcccgcggggagccggcccgcggccugacccgggacgagcgcgacgccaucgugcacgcccuggacaacaaggcgcacaccaagucccucagcggcauguccaugaagcugaaggcccuggggaaggugaucaagcuccggcccgagcagagcuucacgcugcagaccgccaaccgcgagaccaucgccugcgaccccguccgggccucccugagccaccccgaccgcuucggcccgcggugguccaugcucgacgcggacgcccagugggacguggugcagcgcauccgggccguccagagcgaggccgagcacgacgcgcuggugaaguggcugauggccacccacgggcucgaccgcgaccacgccgaguccacggccaaggcgccccugcccgagggcuacggccggcuggggcucaccgccaccaagcgcauccuggccgcccuggaggccgacgugauccccuacagcgacgccgucaaggcgugcggcuggcaccacuccgacgggcggaccggcgaggugcucacggagcugccguacuacgggcagauccuggaccgccacgugauccccggcaccuacaacgagagcgacgacgacgucacccgguacggccgcaucaccaaccccacggugcacaucgggcucaaccagcugcggcgccuggugaacaagaucaucaccgucuacggcaagcccgacgagaucgugguggagcucgcccgggaccugaagcugagcgaggaccagaagcgcgacguccagcgcgacaucaagaagaacaccgacgccgccaucgcccgcggggcgaagcucuccgagaugggcgugccggacaccggggccaaccggaugguccugcggcugugggagagccugggcgacgacgugaugacgcgcaacugccccuacuccggcaagcggaucagcgccaccaugcuguucgacggguccugcgacguggaccacauccugcccuacagccgcacccuggacgacggcuucgccaaccggacccucugccugaaggaguucaaccgccagaagacggacaagacccccugggaggcguggggcgacaccccggccugggccaccaucgaggccaaccugaagaaccuccccgccaacaaggcguggcgguucgcccccgacgccauggagcgcuucgagggggagaacgacuucacgucccgggcccugaaggacgcccaguaccugagccgcaucgcgcggaccuaccucgacgcccuguacgacggggccgacggcaagucccacgucuggguggugccgggccgccugaccgagaugcuccggcgccacugggggcugaacagccugcuccccgacaaggacggcgccgucaaggccaagaaccggaccgaccaccgccaccacgcgaucgacgccgccgugguggccgcgaccgaccggucccugauccagcgcaucagcaagauggcccggaaggacgaggucaacggggccgaggagguggcccgcuccgugcccccgcccugggagggcuuccgcacggacaucgagacccagcuggaccggaucaucaucagccaccgcgccgaccacggccggaucgaccccgcggcccgcaaggacgggcacgacuccaccagcggccagcuccacaacgacaccgccuacgggcugggcgaggggaacuccgucgugagccggaagccccugcucucccucaagagcaacgacaucgaggugacgaccaagggcgccaacauccgcgacgucgaccugcagcggcaccucgagcgcaucacccggggccuggacgggaaggcccuggaggcggcccucgccgaguucgccgccaccgcgaagcugcccgacggcacggacaacccguacuacgggcugcgccgggugcgccucgaggagacccugcagcagggcgcccggguggaggucaaggaccgcaacgggaagcccuucaaggccuacaagggcgacagcaaccacugcuacgagaucuggcggaugcccgacggcaagguggugccccaggucaucaccaccuacgaggcccaccagaucgacguggagaagaagccgcaccccgccgcgaagcgccugcuccggaucuucaagcgcgacaugguggccaucgagcaggacgacaaggccaucaucggguacguccaguccaugcacguggccaacggccuguucaucgcgccccacacggaggccaacgccgacgcccggagccgcgacaaguccgacagcuuccgccugauccagauguccgccgggccccucgugaaggcgaacgcccggcgcgucuacguggacgagaugggccggcugcgcgacccgggggcccccagcuga

SEQ ID NO: 1432 - RNA, 3039 nt, Artificial Sequence
  Cas9 variant
auggccaacaugcgcuaccggcuggcccucgaccugggcagcaccucccuggggugggcgauggugcgccucgacgcccagaacgagaccugcgccgucaucaaggccggcgugcggaucuucagcgacgggcgcaaccccaaggacggcuccagccuggccgugucccggcgcgaggcgcgggccaugcgccggcgccgggaccgccugcucaagcggaagacgcgcaugauggccacccugaugaagcacggguucuucccgcaggacgaggccgcgcggcaggcccuggucaacaaggagcccuucgcccuccgcgccaagggccuggaccacgcccugcuccccgaggaguucgcgcgggcccuguuccacaucaaccagcgccggggcuucaagagcaaccgcaagaccgacaagaaggagaccgacuccagcgcccugaagaaggccaucgggcagcuccgggaggccaugcaggcguccggcugccgcacggugggggaguggcugugcgcccgccaccagcagggccugagcgugcgggcccgcuaccgggagaaccgcaucaccaaggacgacgggaagaccaagaucgagaaguccuacgaccucuacaucgaccgggccaugaucgaggccgaguucgacgcgcugugggccaagcagagcgagcugaaccccgagcuguuccacgagaccgcccgcgccgagcugaaggacugccugcuccaccagcggccgcugaagcccgucaagcccggccgcugcacgcugcuccccgacgaggagcgggccccgcuggcgcugcccucccagcagcgcuuccggaucuaccaggaggugaacaaccuccgccugcugcgggagggccucaacgaggagccccugacccugacccagcgcgaccagcucauccaggcccuggagaccaaccccaagcggagcuucacgcagauccagaagcugcucggguucuccggccaguucaaccugcaggacgacaagcgcaccgagcugaaggggaacagcaccuccgccaugcucagcaagaaggaguucuucggcucccaguggcugagcuucgacgagacccaccaggacgagaucgugaugcagcuggucagcgaggagaacgaggcccggcucaucgcguggcugcaggccgagacgggcguggacgagaucaccgccgagcgcaucgccaacaccccgcuggccgagggguacggcucccucagcgcgaaggcccuggagaagauccugcccgcccugcgggccgacgugaucaccuacgacaaggccguccucgcggccggguucgaccaccacucccacaucagccacgccgccacgggcgagauccugcccgaccugcccuacuacgggcaguaccuccagcgccacgugggcuucggcaccgggaagccggaggaccccgccgagaagcgcuacggcaagaucgcgaaccccaccgugcacaucgggcugaaccagguccggaccguggugaacgcccugaucaagcgcuacggccaccccuccgaggucgugguggagcucgcccgggaccugaagcagagccaggagcagcgcaaggaggagcaggcccagcaggcgaagaaccagcggcgcaacgagcggaugcgccaggacaucgccgggcugcucaacacguccaccgagcggguccgcgcccuggaccugcagaagaugauccucugggaggagcugagcuucaacguggccgaccggcgcugcccguacuccggcgugcagaucagcgcccagaugcuguucuccgaccaggucgagaucgagcacauccuccccuucagccagacccuggacgacucccugaacaacaagaccguggcgaugcggcaggccaaccgcaucaagggcaaccggacgcccgccgaggccgccgcggacuucgccgcccagggguggcccgucgaggacaugcuccaccgcgccagccugaugccgaagggcaagcgguaccgcuucgcccaggacgggauggcgcaguggcugcgggaggacaagggcuuccucgcccgcgcccugaacgacacccggcaccugucccgcguggcccgcgaguaccucagccuggugugcccccaggggacccgggucauccccggccgcaugaccgcgaugcugcgggccaaguucggccucaacgacauccuggggcugaacggcgagaagaaccgcaacgaccaccggcaccacgccguggacgccugcgugaucgccgucacggaccaguccaugcuccagaaguucgcgaaggccagcgccuccgcccgcgagaagcagcugaacaagcugguggagagcaugccccucccgugggacagcuaccgggaccacgugcagcgcgccgucgagcggaucugggugucccacaagcccgaccacgggcacgagggcgcgaugcacaacgacaccgccuacggccugcucgggggcgggcacgugcagguccgcaagcggauggacggcgugcgcacccgggagaccgccgcccucaaggugaucgaguucgccgaccgccaggcgcacccccggcacgggcugcugccgaacggcgagcccaugcccuacaagggcuacaagggggacagcaacuacugcauggagaucguccgcaacgacaagggcaagugggagggggaggugguguccacguucgaggccuaccagcucguccggcagcacggccuggcccgccugcggcaccccgcccucagcguguccgggcgcccgcuggugaugcgccugcuccggaacgacacccugcgcgucauccacaacggcgagcagcggaccgugcgcaucugcaagaugaccgccgagggcgugaucgcgcuggccgacaccacggagagcaacgucgacgcccggacccgcaccaaggaccucuccuacaucuucaagaccgccgggagccugcagaaguccaagggccggcgcguggcgaucagccccuccggggagaugaaggaccccggcuucuucgacuga

SEQ ID NO: 1433 - RNA, 3051 nt, Artificial Sequence
  Cas9 variant
auggagguguucgucgacgugagcgcccgccagcugggcaucgaccucgggaucgggaccugcgggugggcccugcuggcggaggacucccucaucgcccugggcacccggacguucgacgugcccgagaccgacaaggagcgcaucccgaccaaccagauccggcgccaggcccgggggaugcgccgggucaucgaccgccggcgccagcggaugaacgccgugcgccggcugcucgccgaccacggccugcuggcggacggcgggaagcucggccuggccaccgugcgccuggaccccuggcaggcccgggccgaggggcucgaccgccugcugagcgcgggcgagcucgccgucgcccuggggcacaucgccaagcaccggggcuuccgcuccaacagcaagcgggaccgcggcgccaacgcgcccaaggaguccagcgccaugcugggggccaucgcccagacgggcgagcggcuccagcacuggcgcaccgugggggagauguucuggaaggacgaguucuaccagacccgccggcgcaaccgggacggcgacuacucccgcaccgugcagcggcuggaccuggagacggagguccaccgccuccuggccgcgcagcggcgccugggcaacccccucgccaccuucgaccuggagcagagcuucaucgacguggccuucuuccagcggccgcuggccgacuccgacgacaagguggggcccugccccuucgagcccagcgagaagcgcgccgcgcggcacuccccgagcuucgagcgcuuccggcuccugucccgccuggccgcccuccggcugagcuccggcgccggggagcgcccccugagcgacgccgaguucgcggccgccugcgccgacuucggccggcuccagggguucuccuucaagcgccugcggcagcaccugaagcucgaccccagcauccgcuucgcgggcaucgcccccgacgaggagggcaagcgcgacgucguggcccgguccggggaggccaccccgggcagcgccgcgcugcgccacugccugggggacaccgugugggacaacaugcucggcacgcggcccgcccugcuggacgccaucgccgccauccucaccuuccgcgacgacgcggaccggaucgccgaggggcuggccggccugggcaucgaggagcccauccucgacgcccugauggacgggguccgcaacggcagcuucgggaaguucaagggccccgggcacaucuccgccaaggcgugccgggcccugcucccgcaccuggcccgcggccggguguacagcgacgccugcgcggacgccggcuacgaccacucccgccagaccgagaccaaccuggacgacauccggaaccccguggcccgcaaggcccugggggaggcccucaagcagaucaagaucaucauccacacgcacggccggcccaccgcgauccacgucgagauggcccgcgacaucggcaagagcgccgacgagcgggacgagaucaagaagggcaucgacaagcgcaacuccgagaaggaccgggcccgccagcaguuccacgagauggugggcacccccgccgcgggggccgaggaccugcugcgguucgagcucuggaaggagcagaacggcuggugccuguacaccgggcgcgagaucccgaucgacgcccuggugagcuccgacaaccggauccaggucgaccacauccuccccuggagccgcuccggcgacgacagcuacaucaacaagacgcugugcuucaccgaggccaaccagcacaagaaggggaugacccccugggaguggcugcacgacgaccccgagcgcugggagaaguucgcccggaccguggagggcugcaagacgaugaagggccgcaagaagcggaaccuccugcugcgcgacuccagccggcucgagaaggaguuccgcucccggaaccugaacgacacccgcuacgcgugccggcugcuccuggggauccugaagcacaccuacccggacaucguggucgccgcccgccccggcccccucaccgaccggcugcgccgggccugggggcugcagagccucaagaagcacgaggacggcacgcgcaaggacgacgaccggcaccacgcgcuggacgccgccguggucgccgccaccucccagagcaugcugcagcgccucaccacccuguuccagaaggcggagcgggagggcgggcgccgggacuucgugggccuggagcccccguggcccggguuccgcgccgaccucgaggccaagcuggagggcguggucgugucccgcgccgagcggcgccgggcccgcggggcgggccacaaggacacgauccgggccaucggggagggcgacgccggccccguggucuacgagcgcaagccgguggccgcccugaccgagaaggaccucgaccgggugaaggaccccgagcgcaacaagguccugaucgagaaccugcggcaguggaucgcggccgggaagcccaaggaccccgacaaggccccgcgcagccccaagggcgaccccaugaccaaggugaagcucgugaccacggacgacguccggauccuggugcgcgggggcaccgccgaccgcggggacauggcccggguggacgucuuccggcaggcggaccccaagggccgcuggcgguucuuccuggugccgguguacccccaccaggucuucgaccccaccgacuggccccagccgcccaaccgcgccgugguggccuacaagcccgagaaggaguggaccgucaugggccccgaccacgaguuccucuggucccuguacccguucagcuggaucgccguggagaaggcggacgggacccggaucgagggcuacuuccgcgggaugcaccggagcacgggcgccaucuccaucagcccccaccacuccaagagccuggccuccaccggcaucggggccaagacccucgccagcuuccgcaaguucgcgauggaccgcaugggcaaccuguccgagaucgagcgggaggugcgcaccuggcacggggucgccugcacguga

SEQ ID NO: 1434 - RNA, 3054 nt, Artificial Sequence
  Cas9 variant
augcgcguggacagccugggccggugccucuccgacgaggagugggcccgcgucaucuaccaccugugcaagcaccggggguuccacuggaucagccgcgccgaggcgaagcagaccgagggcgacuccaagagcgagggcggcaaggugaagcaggggcuggccggcaccgccaagcucauggacgagaagggcuaccgguccgccgccgagauggugcuggcggaguuccccgaggcccagcgcaacaagcagggggaguaccggaaggcccugagccgcgagcuccuggccaaggagcuggcgcuccuguucgcccggcagcgcgucuucggcaaccggcacgccacggacacccuggagaccgccauccucgggaacuccgacaagaaguccggccuguucuggcagcagaagcccgcccuggcgggggccgaccuccugaagaugcuggggaccugcacguucgagaagaacgaguaccgcgcccccaaggccagcuucaccgccgagcggcacguguggcucacccgccugaacaaccugcggaucgugaccgacggcaucacgcgccagcucaccgagcaggagcggcagcugguccugccccuccccuaccgccaggcgggggaccugaccuacaagcagcugggcauggcccucaccaaggccgggcugcuggaggccggcugcuucaaguucaucggccucgccuacccgacggaggcgcagaaggccgaggggaagaccaaggaccccgagagcgccacccuggugaagauccccgccuggcaggagcugcggcagacccucaacaaggccucccugaacgacgagugggagaagcugagcggcgacgcgcucugcgggcagcccgagaucuucgacaagaucgccuggauccuguccguguacaaggacgacgacgagguccgcacggagcuggccaagcucgugcugccgaaccccgagggccugaccgaggcccuccugaacauccgguucgacaaguuccacgcgcugagccucaaggcccugcgcgccaucgugccccacauggagaaggggcugcgcuacgacgaggccugcguccaggccggcuaccaccacucccagcuccacaagaucggcgagggggagcacaaguaccugcccccgcuguacgacggccgggacggggacggccgcaugaucuucgcggaggacgccgacaucccccggaaccccguggugcugcgcagccucaaccaggcccggaaggucgugaacgccaucauccgccgguacgggucccccagcgccgugcacaucgagauggcgcgcgaccugucccggccguucgacgagcgcaacaagaucaagaaggaccaggacgaguaccaggcccggaaccagcgcgaccgggagcaguucaucgagcuguucggccacccgcccaagggccucgaguucgagaaguggcgccuguaccgggagcagaacgggcagugcgccuacagccagaagccccuggccagcuccggcgacgucgccgagaucuuccucgacgggagcaccgagaucgaccacgcgcugcccuacucccgcagcuucgacgacuccaagaacaacaaggugcuggugcucacccgggagaaccgcgacaagggcaaccggacgcccuacgaguaccucgggggcgccgagaacagcgagcgcuggcagcgcuucuucuccuucgucgagagcaacaaggccuaccggcuggccaagcgcacccggcugcugcgcaaggacuucggcgcgaaggaguccgaggaguuccgggagcgcaaccugaacgacacccgguacgugugccgcuucuucaagaacuacguggagcagcaccucaagcuggccgaggggagcgaggccaagcggugcgucguggucuccggccagcugaccaacuuccuccgcacgcggugggggcugcugaagauccgcagcgacuccgaccggcaccacgcccucgacgccgcggugguggccgccugcagccacuccaugguccagcgccugagcaacuacucccggacccgcgagcuggagcagguccgggacggcuucgugaacaucgagaccggcgagaucgugaaccccgccaugcaccagcagcuccgcgagcacuuccccgacccguggcccuacuuccggcacgagcuggaggcccgccugaagaucgacagccccgcgcuccugcgggaggagauggcccgccuguccagcuacaccgaggaggagcucgccgcccugaagccccuguucgugagccgcgccccgcagcggcgcaacgggggcgcggcccacaaggacacgaucuacgggcagcccgagaagcucaagaagaacggcuccgugagccagaaggucgcccuggccucccuggcgcucaaggacaucgaccugcuggccgacccccaccggaacgccaagcucuacggggccauccgcgagcggcuggaggcccacggcggcaagggggacaaggcguucccggccaccaacccccugcgcaagcccgacaaggagggcaaccccaccgggccgaucgugcggaccgugacgaaggucaucgacaagcucagcggcauccccgugcgcgggggcaucgccaagaacgacaccaugcugcggguggacgucuucaccaaggccggccgcuuccaccuggugcccguguacguccaccaccgggugaccgggcuccccaaccaggccaucacgcgcggcaaggacgagaaccagugggcgaucaucgacgacaccuucgaguggcgguucucccuguacccgaacgaccuggugcagauccgccucaaggacgagacccaccugggguacuacgccagcaccgaccgguccaccagcuccaucagcaucugggcccacgaccgcaaccaguccgucggcaaggacgggcugauccggagcaucggcgugacgaccgccaaggacaucgagaaguuccacguggacacccucggcaacgucuaccccgccccgcccgagaagcgccgggggcuggcguga

SEQ ID NO: 1435 - RNA, 3066 nt, Artificial Sequence
  Cas9 variant
augcgccggcgccgggaccgcuucaagcagcggcaggccgcccugcucaagcaccuggcgggcguggggcuguuccccgccgacgaggccgcccgccgggagcucgccggccuggacccguacgagcugcgcgcgcgggcccuccacgaggcccugccccugaaccacaucgggcgcgcccucuuccaccugaaccagcggcgcggcuucaagagcaaccggaagaccgaccgcgggaaggcggacgacgagggcaagauccggcugggcgucgcccgccuccaggaggccaugcacgagaagggguccgccacccugggcgaguuccugcacgggcggcgcgccgcggccacggaccccaaccagauccccagcgugcggacccgccuccgggccgaguccggcgagggggcccgcggcgacggcuacgacuucuacccggaccgccggaugcuggaggacgaguucgaggccaucugggagagccagcagguccaccaccccgcggugcugaccgacgagaucaagcagcgcuucuucgaggugaucuucuaccagcggccccucaagcagcccgagaucgggaccugcacgcugguggccggcgagcgccggcugccgaaggcccacccccucuuccagaagcgccggcugcuggaggagcucaacgcccugcgcaucgucuggcccggggugcaggccgagcugcucucccgggagcagcgcgaccuggcguaccugaagcucaaggacaagcgggccgugcgcuucgagagccugcggaaggcccugaagcucgaccccgacgcccgcuucaacaaggaguccgagaaccggagcgagcugaagggcgacgaggucgccgcggagcugggcgccaagucccgcuucgggggccggugggggcacaccgccccggccgaccagugggagaucgugagccgcauccaggcgcucgaguccgacgacgacgaggcccaguucugcguguggcugagcgagcgguacggccuggacuccgagcaggcccgcgccgucgccgcggcccgccucccccagggguucggccgguucggccugaccgccaccacgcgccugaucaaggcccuccaggacgaggugaucguguacagcgaggccguccagaagaccgggcugggccaccacuccgacuuccggaacggggaggugcuggcggagcuccccuacuacggcaucgcccuggagcgccacaucaugcccgggaccggcgacccgggcgacagcgacgagaugcggguggggcgcgucaccaaccccacggugcacaucggccugaaccagcuccggcgcguggucaaccggcugaucaagcgcuacgggccgccccggcagaucgccguggagcuggcccgcgagcugaagcucgacgaccagcacaagcgggagaucaacggccgcaaccggcagaaccgcgaggccgcggagcggcgcucccagaagcugguggacaucgggaucgccgacaagggcgccaaccgggcccugcucaagcugugggaggagcugaaccccgacaacgcgcucgaccgccggugcgucuacaccggccgccagaucagcaucgagaugcuguucuccggggccguggaggucgaccacauccugcccuucgccgccacccucgacgacagcaacgccaacaagcugcugugccuccgcgaggcgaaccggaacaagcgccggcgcagccccuucgaggccuucggccagggggccgacugggaggagaucgccgcccgggcggcccgccugccccgggagaagcgcuggcgguucgagccggacgccauggcccgcuucgacaccgaggagaaguuccuggcccggcagcucguggacacgcaguaccugucccgccuggcgcgggaguaccucggcgugcuguuccccgacaagggcgaggggagcggccgcgucugggugucccccgggcggcugaccgagaugcuccgccggagcuggggccugaaccaccuccugcccgaccacaaccucgggggcggcgccgaccagccgaagaaccgccgggaccaccgccaccacgccaucgacgccaucguggucgcggugaccgaccgccaccuccugcaggccaucgcccgggaggccgggcagcgcggccacgaggccgcgaaccggaugaccgccgaccugcccgugcccuggccggacuucgaccgcgacgucggccaggugauccgccagguggucgugucccaccgggccgaccacgggacggugagcaaggccggggccgcgaagggccaggacuccaccgccggccggcugcacaacgacaccgccuacgggcugaccggccagacggacgagaaggggaacaccaucgucgugcgccgggugccccugaccgcccugaagaagcccaccagcaucgaggccguccgcgacgacgagcuccggaaggcgcuguccguguggacgcgcggcuacgacgggaaggccuucgaggcccggcugagccgcuuccccgagcucggcccgcugcaguuccggggcauccgccgggugcgcgucguggagccccugaccgugauccccauccgggacuccagcgggcgcgucuacaagggcuacaagggggacuccaacuaccgguacgacgugugggagcucaaggacggcaaguggguggccgaggucgugagcauguucgacgcccaccaguccagcuggaccucccccgugcgccgcgagaacccgaccgcgcggaagguccugagccugcagcagaacgacaucguggccaucgagcccgaggggaaggagcgcgagcucaugcggguggcccagcugcgccagggcggccagaucacgcuggccgcgugccacgaggccggggaccucaagcggcgcgacgccgaguccaacgaggucgaccccuucaaguacuucagccccaccgccggcgggcugaagcgggugcgcgcccgccaggugcgggucgacgagcugggccgggugcucgacccgggcagccgcgaccgggagcgcggggcggccuga

SEQ ID NO: 1436 - RNA, 3066 nt, Artificial Sequence
  Cas9 variant
augaaguacacccugggccucgacguggggaucgccagcgucggcugggccgugaucgacaaggacaacaacaagaucaucgaccugggggugcgcugcuucgacaaggcggaggaguccaagaccggcgagagccuggccacggcccggcgcaucgcccgggggaugcgccggcgcaucucccggcgcagccagcggcuccgccuggucaagaagcuguucgugcaguacgagaucaucaaggacuccagcgaguucaaccggaucuucgacaccucccgcgacggcuggaaggaccccugggagcuccgguacaacgcccugagccgcauccugaagccguacgagcucgugcagguccugacccacaucaccaagcggcgcggcuucaaguccaaccggaaggaggaccugagcacgaccaaggaggggguggugaucaccuccaucaagaacaacagcgagaugcuccgcaccaagaacuaccggacgaucggcgagaugaucuucauggagacccccgagaacuccaacaagcgcaacaaggucgacgaguacauccacaccaucgcgcgggaggaccugcugaacgagaucaaguacaucuucagcauccagcgcaagcucgggucccccuucgugaccgagaagcuggagcacgacuuccugaacaucugggaguuccagcgccccuucgccagcggcgacuccauccucagcaagguggggaagugcacgcugcugaaggaggagcuccgggccccgaccuccugcuacaccagcgaguacuucggccugcugcagagcaucaacaaccucguccugguggaggacaacaacacccugacgcucaacaacgaccagcgcgccaagaucaucgaguacgcgcacuucaagaacgagaucaaguacuccgagauccggaagcugcuggacaucgagcccgagauccucuucaaggcccacaaccugacccacaagaaccccagcggcaacaacgaguccaagaaguucuacgagaugaaguccuaccacaagcucaagagcacccugcccaccgacaucugggggaagcugcacagcaacaaggagucccuggacaaccucuucuacugccugacgguguacaagaacgacaacgagaucaaggacuaccugcaggccaacaaccucgacuaccugaucgaguacaucgccaagcugccgaccuucaacaaguucaagcaccucagccuggucgccaugaagcgcaucauccccuucauggagaagggcuacaaguacuccgacgcgugcaacauggccgagcuggacuucaccgggagcuccaagcucgagaagugcaacaagcugaccguggagcccaucaucgagaacgugacgaaccccgucgugauccgggcccugacccaggcccgcaaggugaucaacgccaucauccagaaguacggccucccguacauggucaacaucgagcuggcgcgggaggccggcaugacccgccaggaccgggacaaccugaagaaggagcacgagaacaaccgcaaggcccgggagaagaucagcgaccugauccgccagaacgggcggguggccuccggccucgacauccugaaguggcgccugugggaggaccagggcgggcggugcgccuacagcgggaagcccauccccgugugcgaccuccugaacgacucccugacccagaucgaccacaucuaccccuacagccgcuccauggacgacagcuacaugaacaagguccucgugcugacggacgagaaccagaacaagcgguccuacaccccguacgaggucuggggcagcaccgagaagugggaggacuucgaggcgcgcaucuacagcaugcaccucccccaguccaaggagaagcggcugcugaaccgcaacuucaucaccaaggaccuggacagcuucaucucccgcaaccucaacgacacgcgguacaucagccgcuuccugaagaacuacaucgaguccuaccugcaguucagcaacgacucccccaagagcugcguggugugcgucaacggccagugcaccgcccagcuccggucccgcugggggcugaacaagaaccgggaggagagcgaccugcaccacgcccucgacgccgccgugaucgcgugcgccgaccgcaagaucaucaaggagaucaccaacuacuacaacgagcgggagaaccacaacuacaaggugaaguacccccugccguggcacuccuuccgccaggaccugauggagacccucgccggcgucuucaucagccgggcgccccgccggaagaucacggggcccgcccacgacgagaccauccgcucccccaagcacuucaacaagggccugaccagcgugaagaucccgcugaccaccgugacgcucgagaagcuggagaccauggucaagaacaccaagggcgggaucuccgacaaggccguguacaacgugcugaagaaccggcucaucgagcacaacaacaagccccugaaggccuucgccgagaagaucuacaagccccugaagaacggcaccaacggggccaucauccgcagcauccgggucgagacgcccuccuacaccggcguguuccgcaacgaggggaagggcaucagcgacaacagccucauggugcgggucgacguguucaagaagaaggacaaguacuaccuggugccgaucuacgucgcgcacaugaucaagaaggagcugcccuccaaggccaucgugccccucaagccggagagccagugggagcugaucgacuccacccacgaguuccuguucagccucuaccagaacgacuaccuggugaucaagaccaagaaggggaucacggagggcuacuaccgcuccugccaccggggcaccgggagccugucccucaugccccacuucgccaacaacaagaacgucaagaucgacaucggcgugcgcaccgccaucagcaucgagaaguacaacguggacauccuggggaacaaguccaucgucaagggcgagccccggcgcggcauggagaaguacaacagcuucaaguccaacuga

SEQ ID NO: 1437 - RNA, 3072 nt, Artificial Sequence
  Cas9 variant
augaagauccugggcuucgacaucgggguggccagcaucggcugggccuucgucgagggggacgagauccgcgacugcggcgugcggaucuucaccaaggcggagaaccccaagaccggggagucccucgcccugccgcgccgggaggcccgcggcgugcggcgccggcuggcccgccggcgcguccggcucaacacgaucaagaagaucaucugcaaggaguucgaccugcgccugagcgacuacaucgccgacgacggcgagcuccccaaggcguaccagaccaacaaggacaccaagucccccuacgagcugcgguacaaggcccugaacgagcgccucagcaaggaggagcuggcccgggugauccugcacaucgccaagcaccgcggguacggcaacaagcacgcgaaggacggggacgacaaggacuccggcaaggugaagaaggccaucggggagaacaagacccuccuggagcagaagggcuacgagagcgucggcgaguacugcuuccgggaguucuucaaguccaucaaggacaaggacggggagacgcacaacauccccagccagaacauccgcaacaagaagggcaacuacgaccggugcgugucccagaagcagcuggaggacgagcucaagcugaucuucgccaagcagcgcaagcugggguucaacaaggaguucgaggacgccauccucgagguggccuucuaccagcggccgcugaaggacuucgacgacaagaucggcgacugcaucuucuucgacaacgagaagcgcgcgcccaaggagagcaucuccgccaucgaguucgucgcccugacccgcaucaucaacacccucaaguaccugagcaagaccacgggcgagguguacgagaaggagaucaucaacaagaucuggcagaagauccuggagaacgggaagaugaccuacgccgagcuccggaagauccuggcccuggacuccagcguguucuucaaggacaaggaccucgacuacacccugggcaucaaggaggcggagaagaucaaguucaucgaguucaagaagcugaucaaguucaagaaggcccucggguccuucgacggccugagccgcgagauccuggacaacaucgccaugcagaucgccaucaccaaggaccggcagcgccuccuggagaagcuggaggucuucccccucaacaaggagcagaaggagaaccugucccagcugaacuucagcaaguacaucgaccucucccugaaggcccugaaccagauccuccccuucaugcgggaggggcgccgguacgacgaggcgaaggacgacgccaagcugcaggagaaggccaagaacacgaagaaggaggaguuccugccgccccucaaggaguucgaccugaaccugaccaaccccgugguggcccgcgcccucgcggaguuccggaagguccugaacgcccugcugaagaaguacggcaaggugcacaagauccaccucgaguucgcccgcgacaugcggcuggacuucgacgagcgcgagcggcugaucagcauccagaacgacaacuucaacaagcgccagcucgccgaggacuucugcaaggagcacggccuggagcccagcaacgcgaacauccugaagaucaagcucuggcaggagcagcaguggcacugcauguacuccggggagcugaucggcaucccggaccugaaggaccccaccaagcuccagguggaccacaucuaccccuacagccgguccuucgacgacagcuacaccaacaagguccuggugcgcgccgaguggaaccaggagaaggggaaccacacgcccuucgaggccuucggcggggacaagaacaagugggacaagaucguggcccuggccgagaagcucccgcccuccaagaagcugaaccggagcgagaaguccaagaaggacaagcugcucgacgagaaguucaacgacaaggagcugggcuuccuggcgcgcaacaucgucgacaccggcuacaucgcccggcucguggccaaguacaucgacauguaccuggaguuccugccccucgaggagaacgagaacaccagccuggcccgcggggagaagggcuccaagaagcacaucgggaucgugaacggccgccugaccagcgagguccggcacaacugggggcucgaccccaaggaccgcgacaaccaccuccaccacgccaucgacgcgaucgugaucgccuacaugaacgacaagcggaucaaggccuucgccgacuuccgccggcugaaggagcugaagaucaagcgcuacggccgggagaucacggaggacgaguaccaggagaagaagaaggagcuguccugcgccccguucgacgacuuccgcaaccggacccuggagaacaucgacaagaucuucgucagccgcccgccccggaagcgcgcgcggggcacccuccacgaggagaccuucuacuccaucgacgacaagaagcugcugaaggccuacgggggcaaggaggggaugcagcgcgcccucagccugggcaagauccggcagaucggcacgaagaucgugaagaacgggaccauggugcgcgucgacaucuucaaggacaagcggggccgcuucuacggggugcccaucuacaccauggacuucgcccugggcgugcuccccaacaaggcggccgucuccgggaaggacaagaacggccugaucaaggagugggccgagauggacagcggcuacgaguucugcuucucccuguucaaggacgaccucauccuggugcagcggaaggagaugcaggagcccgagcugugcuacuucgugagcuucgacuccagcaacgcccagaucgacguccgcagccacaacaaccacuucuccgugcucaacgagaaccagaagcugcuguucaagagcgccacccaggcggaggugaucggggaguccaucggcauccagaaccucaaggucuucgagaaguggcacgugagcccccugggggaggugcggaaggccgaguucagcccccgcggcgaggccaagcugaagacguccaagaagcgcaagaaguga

SEQ ID NO: 1438 - RNA, 3072 nt, Artificial Sequence
  Cas9 variant
augaagaucuacagcuucgacaucggcguggccuccaucgggugggccuucaucgagaacgagguccugcaggacugcggcauccgcaucuucaccaaggcggagaaccccaagaacggggccagccucgcccugccgcggcgcgaggcccggggcgugcgcaagcggcuggcccgccggcgcgggcggcucaacaccaucaagcagcugcugugcaaggaguucggccuccagcuggaggacuaccuguccaacgacggcgagcuccccaaggcguacacggccagcaaggccaacccccugaagucccccuacgagcugcgcacccucgcccugagccagaagcuggacuccaaggaccucgugcgggucauccugcacaucgcgaagcaccgcggguacggcaacaagcacgccaaggacagcaaggacaccgaguccgggaaggugaagaaggccaucgaguucaaccggaagacccuggccgagaagggcuaccgcagcgugggggaguaccucuaccgggaguucuuccagcagucccgcaucagccagaacaacggcgccacggaguucaucaacguccggaacaaggcgggcaacuacgagcacugcguggcccaggacaugcugaaggaggagcuggaguccauccucaacgcccagcgccaguucggguucagccugaagcaggacuucgaguccaagcugcucaccaagaucuucgagcagcggccgcucaagagcuucgccgacaaggugggcaacugcugcuucaucgccggggagaagcgcgcgcccaaggacucccccagcgccaucgaguucaucgcccugucccggaccaucaacacccugaucaaccugagcaaggagagcggcgagaucuacaaccgcgccaucauccugcagaucgucgaguccacgcucaagaagggcgagaucagcuacaaggagcugcgcgagaucauccggcuggacgagcgccuccgguucaaggacccccgccuggacuacucccgggagaucaaggaggccgagaaggugaaguuccuggaguucaagcagcucaagggguucaagaaggcgcugggcgagagcuucaccacccuggccaucucccagcucgacgagaucgccgagcacaucgcccugaucaaggaccgcgugaagcugaacgagaagcucgagagcuacgcccugaccaaggagcagcgggaggcgcuguccaaccucagcuucuccgcccacaucaaccugagccugcaggcccucaagcagauccugccguucaugcgcggggacaacggcgagcagugccuggacuacgacgaguccgucgagaaggccgggcugaaggcgcucagcaaggacacgcugaagggccagaugcugccgccccucaacgaguucgagcccuaccuguccaaccccgugguggcccgggcccuggccgaguaccgcaagguccucaacgugcugcugaagcaguacggcagcccccacaagauccacaucgaguacgcccgggaggcgaagcucuccagcaccgagcgccagaaguacgagaaggagcagaaggacaacuacgccgccaaccaggccgcccacaagaagugccaggagcuggggcuggagcccuccagcaccaaccuccugaagcugaagcucuggcaggagcagggcgggcugugccuguacuccggcgcgaagaucaccaucagcuaccuccaggaccccacggcccuccagguggaccacaucuacccguacagccgguccuucgacgacagcuacaugaacaagugccugguccugaccaaggccaaccaggagaaggggaaccgcacccccuucgaggccuucggcaccgacuccgccaaguggggcgugaucacgacccuggcgcagaagcugccccacaagaagcggcgccggauccucaacaccgccuucaacgacaaggaggccggguucaagcugcgcaaccugaacgacaccagcuacaucgcccggcucguggcggacuacacggagaccuaccuggaguuccugccccucgucgaguccgagaacaccacccugagcaagggccagaagggguccaagaagcacaucgccaucgugaacggcgugcugacgagcaccaugcgcuacuaccucggguucgccuccaaggaccgcgacaaccaccuccaccacgcccuggacgccgucaucaucggcuucaugaacgacagcgugaucaaggcguucuccgacuucaagaagacccaggagaccagcaaggccgccuacuacgcccacacgcuguccaagcaggaguacaagaagcagcgggccuucauccagcugccgagcggcgagaacuuccgcgucuccgugcuggagaagguggagagcgucuucguguccaagccgccccggaagcgcgugcgcggggcgcuccacgaggccaccuucuacagccccaacgaccccaagcugcugaagaacuacggcgggaccaagggcgucgagcgggcccucgcccugggcaagaugcggaaggugggggccaagaucgugagcaacggcgcgaugguccgcguggacaucuuccggcacaaguccagcgggaaguucuacggcgugcccgucuacaccauggacuucgcccuggggauccuccccaacaaggccgugguggucggcaaggaccagaacggcgugaucaaggacuggcuggagauggacuccagcuacgaguucaucuucucccuguacaaggacgacgugauccucguccagaagaaggagaugcagcgccccgagcugugcuacuucgugagcuucgacacguccggggccagcaucaagguggcgaagcacgacaacaacuucuccacccugaccgagaaccagaagcuccuguucagcaacgccaccaaggaggaggucgugggcaaguccaucgggauccagaaccugaagguguucgagaaguggcaggucagcgugcucggcgaggugaagcggacccaguccuacccgcgcgagaacaucagccuggccuccaaggccaagaaguga

SEQ ID NO: 1439 - RNA, 3075 nt, Artificial Sequence
  Cas9 variant
augauccgcacccugggcaucgacaucgggaucgccagcaucggcugggccgugaucgagggggaguacaccgacaagggccucgagaacaaggagaucgucgcguccggggugcggguguucacgaaggccgagaaccccaagaacaaggagagccuggcccugccgcgcacccucgcccgguccgcccgccggcgcaacgcgcggaagaagggccgcauccagcaggucaagcacuaccugagcaaggcccugggccucgaccuggagugcuucgugcagggggagaagcuggccacccucuuccagaccuccaaggacuuccugagccccugggagcugcgggagcgcgcccucuaccgggugcuggacaaggaggagcuggcgcgcgucauccuccacaucgccaagcggcgcggcuacgacgacaucacguacgggguggaggacaacgacuccggcaagaucaagaaggccaucgccgagaacagcaagcggaucaaggaggagcagugcaagaccaucggggagaugauguacaagcuguacuuccagaagucccugaacgugcgcaacaagaaggagagcuacaaccggugcgucggccgcuccgagcuccgggaggagcugaagaccaucuuccagauccagcaggagcucaagagccccugggugaacgaggagcugaucuacaagcugcugggcaaccccgacgcccaguccaagcaggagcgcgaggggcucaucuucuaccagcggccgcugaagggcuucggggacaagaucggcaagugcagccacaucaagaagggcgagaacucccccuaccgcgcgugcaagcacgcccccagcgccgaggaguucguggcccugaccaaguccaucaacuuccucaagaaccugacgaaccgccacgggcugugcuucagccaggaggacaugugcgucuaccucggcaagauccugcaggaggcccagaagaacgagaaggggcugaccuacuccaagcucaagcugcugcucgaccugcccagcgacuucgaguuccugggccucgacuacagcgggaagaacccggagaaggcgguguuccugucccugcccagcaccuucaagcucaacaagaucacccaggaccggaagacgcaggacaagaucgccaacauccugggcgccaacaaggacugggaggccauccugaaggagcucgagucccugcagcugagcaaggagcagauccagaccaucaaggacgccaagcucaacuucuccaagcacaucaaccugagccuggaggcgcuguaccaccuccugccccugaugcgcgagggcaagcgguacgacgaggggguggagauccuccaggagcgcggcaucuucuccaagccccagccgaagaaccggcagcugcugccgccccucagcgagcuggccaaggaggaguccuacuucgacauccccaaccccguccugcgccgggcccucagcgaguuccgcaagguggugaacgcccugcuggagaaguacgggggcuuccacuacuuccacaucgagcucacccgggacgucugcaaggccaaguccgcgcgcaugcagcuggagaagaucaacaagaagaacaagagcgagaacgacgccgccucccagcugcucgaggugcuggggcugcccaacaccuacaacaaccggcucaagugcaagcuguggaagcagcaggaggaguacugccuguacagcggcgagaagaucacgaucgaccaccucaaggaccagcgcgcccugcagaucgaccacgcguucccccugucccggagccucgacgacucccagagcaacaaggugcugugccugaccuccagcaaccaggagaaguccaacaagacccccuacgaguggcucggcagcgacgagaagaagugggacauguacgucgggcgcguguacagcuccaacuucagcccguccaagaagcggaagcugacccagaagaacuucaaggagcgcaacgaggaggacuuccuggcccggaaccucguggacacgggcuacaucgggcgcgucaccaaggaguacaucaagcacagccuguccuuccugccccuccccgacggcaagaaggagcacauccggaucaucagcggguccaugaccagcaccaugcgcuccuucuggggcgugcaggagaagaaccgcgaccaccaccuccaccacgcccaggacgccaucaucaucgccugcaucgagcccagcaugauccagaaguacacgaccuaccugaaggacaaggagacccaccggcugaagucccaccagaaggcgcagauccugcgcgagggcgaccacaagcugagccuccgguggccgauguccaacuucaaggacaagauccaggagagcauccagaacaucauccccucccaccacgucagccacaaggugaccggggagcugcaccaggagacggugcgcaccaaggaguucuacuaccaggccuucggcggggaggagggcgucaagaaggcccugaaguucggcaagauccgggagaucaaccaggggaucguggacaacggcgccauggugcgcgucgacaucuucaagagcaaggacaaggggaaguucuacgccgugcccaucuacaccuacgacuucgcgaucggcaagcuccccaacaaggccaucgugcaggggaagaagaacggcaucaucaaggacuggcuggagauggacgagaacuacgaguucugcuucucccuguucaagaacgacugcaucaagauccagaccaaggagaugcaggaggccguccucgccaucuacaagagcacgaacuccgccaaggcgaccaucgagcuggagcaccugagcaaguacgcccucaagaacgaggacgaggagaagauguucaccgacaccgacaaggagaagaacaagacgaugacccgggaguccugcggcauccaggggcugaagguguuccagaaggugaagcugagcguccucggcgaggugcuggagcacaagccgcgcaaccggcagaacaucgcccugaagaccacccccaagcacguguga

SEQ ID NO: 1440 - RNA, 3078 nt, Artificial Sequence
  Cas9 variant
augggcggguacaugccccagcugaugcgcuaccggcucgcccuggacaucggcagcaccuccaucgggugggccaugauccgccugagcaugcagaacgagccgaucgcgaucauccggaugggcgugcgcaucuucuccgacgggcggaaccccaaggacggcagcucccucgccgucacccgccggguggcccgccagaugcggcgccggcgcgaccggcugcugaagcgcaagacgcggcuccugaacgcccuggugcagaagaaguucuuccccgaggacgccgacgcgcgcaaggcccucgucgugcugaaccccuacgagcugcggaaggagggccucuaccgccagcugagcgggccggaguucggccgggcccuguuccacaucucccagcgccggggguuccucagcaaccgcaagaccgacaagaaggacaacgacuccagcgugcugaagaaggccaucgucgaccugcgccagcagcucgagguggagaacugccagaccaucggcgaguggcuguucaagcagcagcaguccggcaagagcgugcgggcgcgccugcgggggaagacccagaaggacaaggccuacgacuucuacaucgaccgcgccaugaucgcccacgaguucgacacgcucugggucucccaggccaaguacgacccccugcuguucaacgaggacgcgcgggccauccuccgcgacauccugcuguaccagcggccccucaagcccgugaagccgggccgcugcacccugauccccgacgagagccgggcgccccuggcccucccccugacccagcaggcccgcaucuaccaggagcugaaccaccuccggaucaccacgccggcccugggggcccaggcccugaccguggcccagcgcaacaccaucgccgcgcuccuggagaaguccgacgucaccuucgugaagaucgccaaggcccugggccucacgagcaccaccgaguucaaccugcaggacaucaagcgggaccgccugaaggggaacgccaccgccaucauccucgcgcggaaccaguacuucggccgccgguggcacgacuucaacgccgaccugcagaaccugaucguggacaagcucgucaacgagggcuccgagacggcccugaucgaguggcugaaggccaacaccgacguggacgagagcgcggccgagcgcguguccggggucacccuccccgagggcuacgggagccugagcguggccgcccugcggcgccugcuccccgcccugaaggaggacguggucguguacuccgaggcggugaagcgcgccggcuucgacagccacuccgcccugagccucaucgagcagaccggggagcuguaccaggagcugcccuacuacggcgagguccuccagcggcacgugggcuucggguccggcgacccgaacgacagccccgagcgccgguucgggaagaucgccaaccccacgguccacaucggccugaacgagcugcgcaagaucaucaacgcccucaucaagcgguacgggaaccccgcggaggugguggucgagcuggcccgcgaccugaagcucucccgggagaagcgcaaggagauccaggaggagcagaagcagcggcaggaccgcaacgagaagcggaucaaggacgccugcgagauccugggcaucgacccgcuggugaucgaccgcggcaagcggcgcgagaucagccagaagaugcagcucugggacgagcugaaccccaaggacgccgccaaccggcgcugccccuacaccggggaccagaucuccaucgagaagcugcucagcgcggagguggagaucgagcacauccugcccuucuccaagacccuggacgacagccucaacaacaagaccgucgccaugcggcgcgccaaccgggacaagggcaaccgcacgccguacgaggccuucggggagucccugaaccccgacuacgacuacgacgcgauccugcagcgggccagccucaugccccgcgagaagcgcaagcgguucgccuccgacggcuaccagcaguggcugcgcgacgacaaggacuuccugagccgggcccucaacgacaccgccuaccugucccgcaucgcgaaggaguaccugacccucaucugcccgcccaacagcgugcgggccauccccgggcgcaugaccgcccagcugcgggccauguucggccugaaccgccuccuguccgagggcgggaucaagaaccgggaggaccaccgccaccacgccaucgacgcggccgugaucggcgucacggaccaggggcugcuccagaaguucagccgggccagcgcccgcacccgggagcugcagcugucccgccucguggacgacaugccccugccgugggacaccuaccgggagcacgugacccgcgcccuggagcaccucgucgugagccacaagcccgaccacggcuaccagggcaagaugcacgaggacacggcgugggggcugcgggacaacggccaggugacccgccggguccgcuccgaggacgggggcccccgccagcggcugcucgagaacaagaacguggugaagaucaacagcacccgcgacuucucccggcacgggaucgacgagcagggccaggucaacgccuacaagggcuacgucgggggcagcaacuacugcaucgagaucuggaucgacgagaaggggaaguggaacuccgacguggugagcaccuuccaggccuaccagaucgugcgcgagcugggcgagaaggccgcguggcagaagcugcggaacccccuccugucccugagcgccaagccgcucgugaugcgccugaucaucgacgacgucgugaagaugcagaucgccgggcagaacaagaucaugcggguggucaagaucgcccagaacggccagaucuucuucgccgagcacaacgaggcgaacguggacgcccgcgacaaggacaagaacaaccccuucaaguacaucuccaagacggccggcagccugcagaaggccgggggcauccacauggccaucucccccaucggggacgcgcggcccgugcgcuacggccgguga

SEQ ID NO: 1441 - RNA, 3084 nt, Artificial Sequence
  Cas9 variant
augaaguacacccugggccucgacguggggaccaacagcaucggcugggccguccuggagcugaacacgaacggggagccccagcgcaucgagaagcucggcucccggaucuucaccgacgggcgccacccgaaggacggcaccacccuggccagcaagcggcgccagaagcggcacgagcgccggcgccgggaccgccugcaccagcggaagaagcucgugcugaaccagcugguguccaugggccucuucccccagagcgagcaggagcagcaggaccugaagucccuggacguccucacgcugcgcgcgaacggggugagcaagcagcuguccgccuacgagcucggccggguguucuacuaccugaaccugaagcgcggguucaagagcaaccggaagggcggguccgaggaggacaaggccaacaagaucagcgagcgcaucaagaagcuccaggagcagcugaaggagaacgacuucaagaccgucggccaguaccugcacgaccgguacaucaagggccucuccaccaaggccaccaucgagaacgacuuccaccuccugcgccagcugaucgaggacgaguucgacuucaucguggagacgcagagcaaguucuuccccgagaucuccgacgagcaguggaacacccugcggaaccgcauguuccaccagcggccccugaagccgguggagaccgggaccugcagccucuucgaggacaagaagcgcacguacaaguacaugcccuccuucgaggaguaccgcuuccugaccgagcuguucaaccucagcuaccaggacgagaacuuccacucccacagccuguccagcgagcagaucuucaaggucuuccacgagcugaagaacacccgggaggccaccuacacgaagaucaagaagcuccugaagcugcccagcgaccucuccuucagcaucgagcgcuccaagagcaaggacaagaucaagaucuccaccaccaaccacuucuucagcaagucccugcuguucgcggaggagugggccagccucgaccugaagcugaaggacgagguggccgagaucuacuucuccgacaugagcguggaggagaucaagaagggccuccugcagcugaagaucgacuccgagaucaucgagaaccuccuggaggagaagguccccaacgugcaggaggcgaccugcagcuacuccaaggaggcccugcagaagaucgugagccucauccuggaggaggagcggcacccgacgcugaucgucgacgaccuguucaagaacgagaaggaggagaccucccucaucgaccgccuggacuacuacggggccagcauccccgacuccaugcagcccaucccccagcacaucaaggacaacaaccugacccucaacgaggacgagaagcgguacggcaagaucgccaacccgaccgugcacgccgcccugaaccagauccgccagguggucaacgaccugaucgagcaguacggcaagcccacgaacauccacaucgaguucgcgcgggaccucaagaaguccaaggaggagcgcgacuucgacaaccggaagaagaagaagaacgaggagcugaacgagcagguccgcgacuucaucgagaagcacaaccagaagcccagcgccuucaacuucgagcgggugaagcugugguucgagcucgacgccaugaacaaccaggugugcgccuacagcgggaagaccaucagcgcccgcauggugcuguccgacgaggugcaggucgaccacauccugcccuucagccggacccucgacgacucccuggcgaacaaggugcugguccucgccagcgagaacgugaagaagcgcaaccggaccccguacgaggccuucggccaggacacggagaagugggccuccauccaggagcuggccaagcgccugcccuaccacaagcaguggcgguucgcggaggacgccaucaagaaguucgaggagaaggaccaguuccuccagcgccaccugaacgacacccgguacaucagcaagaucgccaagaaguaccugggguccaucaccgaccccuacaagaucguggccagccgcggccagaugaccuccaucauccgcgggaagcucggccugaaccaguucauccagaagcccgacggcacgaagaaccgggaggaccaccgccaccacgccaucgacgcgcugaccgucgcccucaccagccgguccuaccugaagcgcaucagcgacgccuccgcccggaaccaggacccgaaccgcauccccauccccgagcccuggaagggguucaucaaggacgcggacgugaaguucaacgagaucaucgugagccacaaggucgaccacggcaagaacgggccguucauggaggagaccugcuucggccugaucaagaaccccaacaaguacgaggaggagaacgacuucaagcucaucacgaccaagucccuggacagcgugaaggaccccuccaccauccggagccagagccugcagaaccucgccgagaaguccggggugaucagccuggccaaguccggcgucaagaagcugcgcguguacgacgugaccaaggagaaccccgccgacaucggccucaucgagagcgggcuggccaagaucacccacggcaaggacaagcagcacgucaagcacuaccagaagggggacaucaacuaccuggcgaucuggugccucccgcagaacaucacgcugaaguccgacaaccacaagaagcggaagaccgacuacaucuucaccgccaucaagaccuucgaccugaacagcaagaaccccaacgaccuccgcccccacccggccgccaagcuggugacgaagguguacaagggcgacaccgucgcccuggaggugaacaaccagcucaacuacuacaucgugaaguccauccgggcggccaacaagaagcuguacuuccugaagaucaaccagagcuccgagcucgccaacgagacccaguucauccccgccuacaccaagcuggucgacuacaaguuccgcaaggugagcgugucccccacgggggucaucaccgacaacggcccccugcucaaguga

SEQ ID NO: 1442 - RNA, 3090 nt, Artificial Sequence
  Cas9 variant
augcgcagccugcgguaccgccucgcccuggaccugggcuccaccagccucgggugggcccuguuccggcuggacgcgugcaaccgccccaccgccgugaucaaggccggcguccggaucuucuccgacgggcgcaacccgaaggacggcagcucccucgccgugacgcggcgcgccgcgcgggccaugcgccggcgccgggaccgccugcugaagcggaagacccgcaugcaggccaagcucguggagcacggguucuuccccgccgacgcgggcaagcggaaggcccuggagcagcugaaccccuacgcccuccgcgccaagggccugcaggaggcccugcuccccggggaguucgcgcgggcccuguuccacaucaaccagcgccggggcuucaagagcaaccgcaagaccgacaagaaggacaacgacuccgggguccugaagaaggccaucggccagcuccgccagcagauggccgagcaggggagccggaccgugggcgaguaccuguggacgcgccugcagcagggccagggggugcgggcccgcuaccgggagaagccguacaccaccgaggagggcaagaagcgcaucgacaaguccuacgaccucuacaucgaccgggcgaugaucgagcaggaguucgacgcccugugggccgcccaggccgcguucaaccccacccuguuccacgaggccgcccgcgccgaccucaaggacacgcugcugcaccagcggccccuccgccccgucaagccggggcggugcacccugcugcccgaggaggagcgcgcgccccucgcccugcccagcacccagcgguuccgcauccaccaggaggugaaccaccuccggcugcuggacgagaaccugcgcgagguggcccucacccuggcccagcgggacgccgucgugacggcgcuggagaccaaggccaagcucuccuucgagcagauccgcaagcugcugaagcucagcggcuccgugcaguucaaccuggaggacgccaagcggaccgagcugaagggcaacgccaccagcgccgcgcucgcccgcaaggagcuguucggggccgccugguccggcuucgacgaggcccugcaggacgagaucgucuggcagcucgugacggaggagggggagggcgcgcugaucgccuggcugcagacccacaccgggguggacgaggcccgcgcccaggccaucgucgacgugagccugccggagggcuacggcaaccucucccggaaggcgcuggcccgcaucgugcccgcccugcgggccgcggucaucaccuacgacaaggccgugcaggccgccggguucgaccaccacagccagcucggcuucgaguacgacgccuccgagguggaggaccugguccaccccgagacgggggagauccgcagcguguucaagcagcugcccuacuacggcaaggcgcuccagcggcacguggccuucgggagcggcaagccggaggaccccgacgagaagcgcuacggcaagaucgccaaccccaccguccacaucgggcugaaccaggugcggauggucgugaacgcccugauccgccgguacggccgccccaccgagguggucaucgagcucgcccgggaccugaagcagucccgcgagcagaagguggaggcgcagcggcgccaggccgacaaccagcggcgcaacgcccggauccgccggagcaucgccgaggugcuggggaucggcgaggagcgcguccggggguccgacauccagaaguggaucugcugggaggagcucagcuucgacgccgcggaccgccgcugcccguacuccggcgugcagaucagcgccgccaugcugcuguccgacgagguggaggucgagcacauccuccccuucagcaagacccuggacgacucccugaacaaccggacgguggccaugcgccaggcgaaccggaucaagcgcaaccggacccccugggacgcccgcgccgaguucgaggcccagggcuggagcuacgaggacauccuccagcgggccgagcgcaugccccugcggaagcgcuaccgguucgcgccggacggguacgagcgcuggcugggcgacgacaaggacuuccucgcccgggcccugaacgacacccgcuaccugucccggguggccgccgaguaccuccgccuggucugccccgggacccgggugauccccggccagcugacggcgcuccugcgcggcaaguucgggcugaacgacgugcucggccuggacggggagaagaaccggaacgaccaccgccaccacgccgucgacgccugcgugaucggcgugaccgaccaggggcugaugcagcgcuucgccaccgccagcgcgcaggcccggggcgacggccucacccgccuggucgacgggaugcccaugccguggcccacguaccgggaccacguggagcgcgccgugcggcacaucugggucucccaccgccccgaccacggcuucgagggggccaugauggaggagaccagcuacggcauccggaaggacggguccaucaagcagcgccggaaggccgacggcagcgcgggccgcgagaucuccaaccugauccggauccacgaggccacccagccgcuccgccacggggugagcgccgacggccagccccuggccuacaagggguacgugggcggguccaacuacugcaucgagaucaccgucaacgacaagggcaagugggagggcgaggugaucagcacguuccgggcguacggggugguccgcgccggcgggaugggccggcugcgcaacccccacgaggggcagaacggccggaagcucaucaugcgccuggugaucggcgacagcgugcggcuggaggucgacggggccgagcgcaccaugcggaucgugaagaucuccggcagcaacgggcagaucuucauggcccccauccacgaggccaacguggacgcgcgcaacaccgacaagcaggacgccuucaccuacaccuccaaguacgccggcagccuccagaaggccaagacgcgccgggucaccaucuccccgaucggcgaggugcgcgaccccggguucaagggcuga

SEQ ID NO: 1443 - RNA, 3090 nt, Artificial Sequence
  Cas9 variant
augaaguaccgccuggcccucgaccugggcagcaccucccuggggugggccaucgugcagcucaacgcgaaggacgagcccugcgccaucguccgggccggcgugcgcaucuucccggacgggcggaaccccaaggacggcagcucccuggccgugacccgccggaacgcccgcgcgaugcggcgccggcgcgaccggcugcucaagcgcaaggcccggaugcagcgccugcugaucgagcacgaccucuuccccgccgacgaggccgcgcggaaggcccuggagacgcugaaccccuacgagcuccgcgccaaggggcuggacgccgcccugaccccggcggaguucgcccgggcccucuuccaccugaaccagcgccggggcuucaagagcaaccgccggaccgaccgcaaggacaacgacuccggcgcccugaaggccgcgaucgggggccuccgcgcccagcuggacaccgccggggccgacggccgggcccgcacggucggggagcugcucuggcggcgcaugagcgaccccaacgugcugaccgugcgggcgcgcuaccgggagcagcgcaucaccaaggacgacggcaagacccgggucgacaaguccuacgaccuguacguggaccgcgccaugguggaggccgaguucgacgcccucugggccaagcaggcggagcugagccccacgcaguucggcgaggccgcccgggccacccugaaggacugccuccugcaccagcgcaaccugcggcccguccgcccggggcggugcacccucgagcccgacgagccccgcgcgccccuggcccugccgucccagcagcgguuccgcauccuccaggaggugaaccaccuccggcugcugggcgggcgccugcuggaggagagccucuccguggagcagcgcgacaagcuggucgccgcccuggaggacggcagcaaguccuucaagaccgccauccccaagcuccugggccugcccgggacggugcaguucaaccucgcggacgccaagcggaccgagcugaagggcaacgccaccagcaugcugcucgggaagaaggacuucuucggccccgccuggcacggguucuccgaggcccgccaggacgagaucgugaugcggauccaggaggaggagagcgaggcgcgccuggucgacuggcuggccaccuccacgggcguggacgaggcccacgcccugaagaucgccaacgcggcccucccggagggcuacgggagccuguccgccaaggcccuggcgaagauccuccccgccaugcgggccgaggugaucaccuacgacaaggccguccuggccgcgggcuacgaccaccacagccacaucagccacgccgccuccaccggggagauccugcccgagcuccccuacuacggcgaguaccugcagcgccacgugggguucggcaccggcgagcugaacgacacgccggagaagcgguucgggcgcaucgccaaccccaccgugcacaucggccucaaccagguccgggugguggucaacgcccugaucaagcgcuacgggcaccccaccgaggugaucgucgagguggcgcgggaccugaagcagagccaggaccagcgccgggagacccaggagcagcaggccaagaaccagaagcgcaacgagcggcuccgcaaggacgccgccgccauccugggcaucgcggacgagcgggugcgccuggccgacauccagaagcucauccugugggaggagcuguccuucgacaucgccgaccggcgcugccccuacagcgggguccagcucuccgccgcgauggugcugagcgagcaggucgagaucgagcacauccugccguucuccaugacgcucgacgacagccugaacaacaagaccguggccaugcggcuggugaaccgccucaagggcaaccgcacccccugggacgcccgggaggccuucgccggccaggggugggacuacgacggcauccugaugcgcgcggagcggaugccccgcgccaagcggcagcgcuucgcccccgacgggcuggagaaguggcucaaggaggacaaggacuuccuggcccgggcccugaacgacacccgccaccucucccggguggcgcgcgaguaccugagccuggucugcccggccuccacgcgggugauccccggccagaugaccgccaugcuccgcgccaaguucggccugaacgacauccuggggcucaacggcgagaagaaccggaacgaccaccgccaccacgccguggacgcgugcgucguggccgugaccgaccaggggcugcugcagcgguucgcccaggccagcgccgacgcgcgcggcaaggggcucgaccggcuggucgagaccaugcccgacccgugggacuccuaccgcgagcacgugcagcgggccgugaacagcaucugggucucccacaagcccgaccacggcuucgagggcgccaugcacgaggacacgaccuaccgcccgccccaccuggaccccaagaacauguggcgcacccgggggaucggcgggggcaagcccaacgagaaggaggccgacagcaaggcgauggugggguucaccggccccgagcaccuccagcgccaccaccgggacaaggccggccagcagcugcccuacaagggguacguggccuccccgaaguucugcauggacaucguccgcaacgacaagggccggugggagggggagguggugagcacguucgaggccuaccgccuggucuccgaguucggccgggacgccgcgcucgcccacauccagagcaagagccgcuccaucagcgggaagccccuggugaugcggcugcagggcggcgacauggugcgcuucgacgacgacgaggggcggcccgucgugcuccgcguggucaacaugaccggcaacgggcagaucuucuucgcgccccacaacgaggccaacggcgacgcccggaaccgcgacaagcaggaccaguucguguaccuguccaaguacgccgggagccugcagaaggcccggggccgccgggugaccgucuccccggccggcgagcuccgcgaccccggguucaaggaguga

SEQ ID NO: 1444 - RNA, 3090 nt, Artificial Sequence
  Cas9 variant
augcgcagccugcgguaccgccucgcccuggaccugggcuccaccagccucgggugggcccuguuccggcuggacgcgugcaaccgccccaccgccgugaucaaggccggcguccggaucuucuccgacgggcgcaacccgaaggacggcagcucccucgccgugacgcggcgcgccgcgcgggccaugcgccggcgccgggaccgccugcugaagcggaagacccgcaugcaggccaagcucguggagcacggguucuuccccgccgacgcgggcaagcggaaggcccuggagcagcugaaccccuacgcccuccgcgccaagggccugcaggaggcccugcuccccggggaguucgcgcgggcccuguuccacaucaaccagcgccggggcuucaagagcaaccgcaagaccgacaagaaggacaacgacuccggggcccugaagaaggccaucggccagcuccgccagcagauggccgagcaggggagccggaccgucggcgaguaccuguggacgcgccugcagcagggccagggggugcgggcgcgcuaccgggagaagccguacaccaccgaggagggcaagaagcgcaucgacaaguccuacgaccucuacaucgaccgggccaugaucgagcaggaguucgacgcccugugggccgcccaggcggccuucaaccccacccuguuccacgaggccgcccgcgccgaccucaaggacacgcugcugcaccagcggccccuccgccccgugaagccggggcggugcacccugcugcccgaggaggagcgcgcgccccucgcccugcccagcacccagcgguuccgcauccaccaggaggucaaccaccuccggcugcuggacgagaaccugcgcgagguggcccucacccuggcccagcgggacgcgguggucacggcccuggagaccaaggccaagcucuccuucgagcagauccgcaagcugcugaagcucagcggcuccgugcaguucaaccuggaggacgccaagcggaccgagcugaagggcaacgccaccagcgcggcccucgcccgcaaggagcuguucggggccgccugguccggcuucgacgaggcgcugcaggacgagaucguguggcagcucgucacggaggagggggagggcgcccugaucgccuggcugcagacccacaccgggguggacgaggcccgcgcccaggcgaucguggacgucagccugccggagggcuacggcaaccucucccggaaggcccuggcccgcaucgugcccgcccugcgggcggccgugaucaccuacgacaaggccguccaggccgccggguucgaccaccacagccagcucggcuucgaguacgacgcguccgagguggaggaccuggugcaccccgagacgggggagauccgcagcgucuucaagcagcugcccuacuacggcaaggcccuccagcggcacguggccuucgggagcggcaagccggaggaccccgacgagaagcgcuacggcaagaucgccaaccccaccgugcacaucgggcugaaccagguccggaugguggucaacgcccugauccgccgguacggccgccccaccgagguggugaucgagcucgcgcgggaccugaagcagucccgcgagcagaaggucgaggcccagcggcgccaggccgacaaccagcggcgcaacgcccggauccgccggagcaucgccgaggugcuggggaucggcgaggagcgcgugcggggguccgacauccagaaguggaucugcugggaggagcucagcuucgacgcggccgaccgccgcugcccguacuccggcguccagaucagcgccgccaugcugcuguccgacgagguggagguggagcacauccuccccuucagcaagacccuggacgacucccugaacaaccggacggucgcgaugcgccaggccaaccggaucaagcgcaaccggacccccugggacgcccgcgccgaguucgaggcccagggcuggagcuacgaggacauccuccagcgggcggagcgcaugccccugcggaagcgcuaccgguucgccccggacggguacgagcgcuggcugggcgacgacaaggacuuccucgcccgggcccugaacgacacccgcuaccugucccggguggccgcggaguaccuccgccuggugugccccgggacccgggucauccccggccagcugacggcccuccugcgcggcaaguucgggcugaacgacgugcucggccuggacggggagaagaaccggaacgaccaccgccaccacgccguggacgccugcgucaucggcgugaccgaccaggggcugaugcagcgcuucgccaccgcgagcgcccaggcccggggcgacggccucacccgccugguggacgggaugcccaugccguggcccacguaccgggaccacgucgagcgcgccgugcggcacaucugggugucccaccgccccgaccacggcuucgagggggccaugauggaggagaccagcuacggcauccggaaggacggguccaucaagcagcgccggaaggcggacggcagcgccggccgcgagaucuccaaccugauccggauccacgaggccacccagccgcuccgccacggggucagcgccgacggccagccccuggcguacaagggguacgugggcggguccaacuacugcaucgagaucaccgugaacgacaagggcaagugggagggcgaggucaucagcacguuccgggccuacgggaucgugcgcgccggcgggaugggccggcugcgcaacccccacgaggggcagaacggccggaagcucaucaugcgccuggugaucggcgacagcguccggcuggagguggacggggccgagcgcaccaugcggaucgugaagaucuccggcagcaacgggcagaucuucauggcccccauccacgaggcgaacgucgacgcccgcaacaccgacaagcaggacgccuucaccuacaccuccaaguacgccggcagccuccagaaggccaagacgcgccgggugaccaucuccccgaucggcgaggugcgcgaccccggguucaagggcuga

SEQ ID NO: 1445 - RNA, 3096 nt, Artificial Sequence
  Cas9 variant
augcccgccaucuaccgccuggcccucgaccugggcagcaccucccuggggugggcggugcuccggcuggagccggccgcccuggagcccaucgccaucaucaaggccggcguccgcaucuucagcgacgggcggaaccccaaggacggcgcgucccucgccgugacccgccgggccgcccgcgcgaugcggcgccggcgcgaccggcugcugaagcgcaaggcccggaugcaggacaagcucgugaagcacggguucuuccccagcgacauggacgagcgcaaggcccuggagcggcuggacccguacgcccuccgcgccaagggccugcgggaggcgcugacgcccggcgaguucgcccgcgcccucuuccacaucaaccagcggcgcggguucaaguccaaccggaagaccgacaagaaggacaacgacagcggcgcccugaagaaggccaucucccaccuccgccagcagauggaggccgggggccaccgcaccgucggggaccaccuguggagccggcugcagcagggccugggcgugcgcgcccgguaccgcgagacccccuucacgaacgacgaggggaagaagcggaucgacaaguccuacgaccucuacaucgaccgcgccaugaucgagcaggaguucgacgcccugugggccgcgcaggccgccuucaaccccgcccuguuccacgagguggcccgggcggaccucaaggacacccugcugcaccagcgccggcuccgcccggucaagcccggccggugcacccugcugcccgaggaggagcgcgcgccccucgcccugccgagcacccagcgguuccgcaucuaccaggaggugaaccaccuccggcugcugggggaggaccugcgcgagguggcccucacgcuggcgcagcgggacgccgucgccaacgcccuggaguccaaggcccgccucaccuucgagcagauccggaagcugcugaagcucagcggcuccgugcaguucaaccuggaggacgcgaagcgcaccgagcugaagggcaacgccaccagcgccgcccucgcccgcaaggagcuguucggggcggccuggggcggguucggcgaggcccugcaggacgagaucguguggcagcucgucacggaggagggggagggcgcccugaucgccuggcugcaggcgcacaccggcguggacgaggcccgggcccaggccaucgcggacgccucccugcccgagggguacggcagccucucccgcaaggcccuggcccggaucgugcccgcccugcgcgcgggggucgugaccuacgacaaggccgugcaggccgccggcuucgaccaccacagccagcucggguucgaguacgacgccggcgaggucgaggacugggugcaccccgacaccggcgagauccggccgguguucaagcagcugcccuacuacgggaagccccugcagcgccacgucgcguucggcuccgggaagcccgaggacccggacgagcggcgcuacggcaagaucgccaaccccacggugcacaucgggcucaaccaggugcggaccgucgugaacgcccugauccgccgguacggccgccccaccgaggucgugaucgagcuggcccgggaccucaagcagagccgcgagcagaagguggaggcccagcggaagcaggcggagaaccagcgccggaacgcccgcauccgcaagagcaucgccgagguccugggcaucggggaggagcagguccggggcgccgacauccagaaguggaucugcugggaggagcuguccuucgacguggcggagcggcgcugccccuacagcggggugcagaucuccgcccgcaugcuccugagcgacgagguggagguggagcacauccugccguucuccaagacccucgacgacagccugaacaaccggacggucgccaugcgccaggccaaccggaucaagcgcaaccggacccccuggaccgcccgcgacgacuucgaggcgcagggcugguccuacgagggcauccugcagcgggccgagcgcaugccccuccggaagcgcuaccgguucgcccccgacggguacgagcgcuggcugggcgacgacaaggacuuccuggcccgggcccucaacgacacccgcuaccugagccggguggcggccgaguaccugcgccucgugugcccgggguccggcacgcgggucauccccgggcagaugaccgcccgccugcggggcaaguucggccugaacggggugcucggccccgacggggagaagaaccgcaacgaccaccgccaccacgccguggacgccugcgucaucggcgugaccgaccaggggcugaugcagcgguucgcgaacgccagcgcccaggcccgcgaggacggccugacccggcucguggacgacaugccgcgccccuggcccacguaccgggcccacgucgagcgcgcggugcggcacaucugggugucccaccgccccgaccacggcuucgagggggccaugauggaggagaccagcuacggcaucgggaaggacggcuccaucaagcagcggcgcaaggccgacgggagcccgggccgggagaucaccaaccugauccgcauccacgaggccacccagccccagcggcacggcgcggggcccgacggccagccccugccguacaagggguacgucggcggguccaacuacugcaucgagaucacgcgcaacgacaagggcaagugggagggcgaggugaucagcaccuuccgggccuacgggaucgugcgcaccuccggccucgggcagcugcggcacccccgcgucggccagaacggccgggagcuggugaugcgccucgugaucggggacagcguccggcuggagaucgacggcaucgagcgcaccaugcgcaucgugaagaucuccgggagcaacggccagaucuucauggcccccauccacgaggccaacguggacgcccggaacagcgacaagcaggacgcguucgccuacacguccaaguacgccgggagccugcagaagaccaaggcccgcuucgucaccaucucccccaucggcgaggugcgggaccucggcuucaagggguga

SEQ ID NO: 1446 - RNA, 3099 nt, Artificial Sequence
  Cas9 variant
augaagaagcgcauccugggccucgacaucgggaucgccagcgugggcugggcccuggucgaguucgacgacgaguuccaggacaacaagaagaaggggaccaucaucaaguccggcgugcggaucuucacccgcgcggagacgcccaaggagcgggagagccuggccaagccgcgccgggaggcccgcucccagcggcgccggauccgccggcgcguggagcggcucaacagcauccgcgagcuguucgucaagaacggggugguggaggagugguccgucagcaagaagaaccccaacaacaucuacaucacccugaaccagaucaagacccccuggcagcuccggauggagucccuggaccgcaagcugaccaacgagcaguucgccguggugcucacgcaccuggccaagcaccggggcuacaagagccugcgcaaggacgacaaggcgggcaagguccucgaggccaucucccagaacaagaagcggcugaacgacagcgacuaccgcacccugggggagauguucugcaagaacgaguccuacaaggagcacaagcggaacaagggcggggaguacaucaacagcguggcccgcgagcucaucgaggaggagguggagaagaucuucgucaagcagcgcgagaagggcaacaacuucgccgacgugaacaccgagcgggaguaccugaagaucgcguucucccagaagcccgccgggagcaucuccaagauggugggcuucugcaccuucgagaacggcgagaagcgcgccccgcgggacagcuacuccgccgagcuguucaagguccucugcacgaucaacaacaccaccuucaccgacaugaagacgggggagauccgcagcuucuccaaggaggagaucggcaagacccuggagaccgugaagaacgugaaggacgucaaguacgccaagauccggaaggaccuggggcucgaggacagcgugaaguucagcggcguggacuaccgcgagaacgcgaaguccaagggcgagggggagaucuucgucagcaugaagaccuaccacgagaucaaguccaagaucgagaagcugagcaaggagaagugggacaaccugaagggcaacacggagcuccuggacuccaucgugaacaucaucgccaaccugaaggacgacgagagcaucaagaaggaguuccagaagcucaagaucgacgaggacaucaucgacgugcugcugaacuucgaguucaagaaguucaucaaccucuccuucaaggcccugcggaagaucauccccuuccaguuccaggggcagaaguacaucaccgccagcaccuccgccggcuacagccugaagcaggaggggaucaagaacaagcucgucccgcccgcgaaggagaacaucaacguggccgucguggcccgcgccuucgcccagacccggaaggugaucaacgcggucauccgcaaguacggccaguucgaccagaucaacaucgagcuggccacggagcugaagaacuccaaguucgaccggagcaagaucgaggagggccagaagaaguuccagucccagaaggacaagaucuucaaggaggugcaggagcuccgcgggggcaugacccccagcuccagccugcugcucaaguaccggcuguggcgcgagcaggacgagcggugcguguacuccgggcgcaagaucagcuucgaggaccugcucgacaccggcuuccuggacaucgaccacaucauccccuacuccaagagcauggacgacagcuucaacaacaagguccugugccucgccgaggagaaccggaacaagaagaacgacauccccuucaacuacuaccagcgcaucgaccgggacuggaaccugcugaucuccaucaucaccagcaugaagaacaugaagaucgccaagaagucccgccuccugaagcaggagcugagcgacaucgagggguucaucgagcgcaacaucaacgacacgcgguacgccacccgcuacaucaaggacuuccuggagaacaaccucgaguucaaggagaacgaguucaucaaggugaaggugcaggcgcgguccggcggccugaccagcguccuguccuacaacugggggaugagcaaggaccgcgaggaguccuacuuccaccacgccaaggacgccaucaucguggccugcagcacccagggcauggugcaguacaucuccaagaucagccagcaguacgagaacgacaaggacaagaugaagaagaucaaggacaagacggagaacugcauccccaagccgugggacuccuuccgggcggacgucgaggagagcaucgaggggaucuucguguccuucgcgccccgccacaaggugaccggcagcgcccacaaggagaccaucuacuccaagaagcaccucgagaaggagcgguacgucaccgugaagaagucccuggacaagaucaagcugagcgaccucgagaacauccccugcaacgagaacugcgggaucauccgcgugcugaaggagcggcuggagaaguucaagaacgacagccucaaggccuucgccgaccccguccacaugccgacgaagugccccaacaagaagggccccgugauccgcagcgugaagaucaaggaguccaacaagaccggcaucgagguccggaaggggcuggccgagcgcggcgagauggugcggguggacgucuucaucaaggacaagaaguacuaccuggugcccaucuacgugagcgacuucaagaacaaggaccucccgaacaaggccaucgccgcccugaagcuggagaacgaguggaucaugaucgacaagaccuacuccuucaaguucagccucuucaaggacgaccugaucaagaucaagaagaagaaggaggagaucuucggguacuucggcggcguccaccgcuccaccgggacgaucaagaucaagagccggcacaagcccaaggagaucgacgagggcaucgggucccgcugccugcucgacuuccggaaguuccagguggacgugcugggcaacuacaccgaggucaagcacgagaagcgcaugcccgccuacaucacccggaaggacaagaagcacuga

SEQ ID NO: 1447 - RNA, 3105 nt, Artificial Sequence
  Cas9 variant
augaagauccugggcuucgacaucgggaucgccagcaucggcugggccuucguggagaacggggagcuccgcgacugcggcguccggaucuucaccaaggcggagaaccccaagaccggggacucccuggccaugccgcgccgggaggcccgcagcgugcggcgccggcuggcccgccggaagggccgccucgagacgcugaagcggcugcucgccaaggagugggaccugugcuacgaggacuacaucgcggccgacggcgagcugcccaaggccuucauggggaagaaccucaccaaccccuacgugcugcgcuacgaggcccugcagcggcuccugggcaaggaggagcuggcgcgcgucauccuccacaucgccaagcaccggggguacggcaacaagaacgccaagaucaccaaguccgaggagagcaagcgcgagcaggggaagauccuguccgcccuggccaccaacgcgagcgugaucgcccgguaccgcacggugggcgaguacuucuacaaggaguucugcgaggucaucaagaacccccagggccucaacaccaacgagaacugcacccagccgaaggugcgggugcugaagcccauccgcaacaagggcggggaguacaccaacugcauccugcaggaggaccuccagcgggagcugcgcugcaucuucgagcaccagaagggguucggcuuccccaucacgcaggaguuccaggacaagauccugaagaucgccuucuaccagcgcucccucaaggacuucagccaccuggucggcaagugcaccuucuaccccgacgagccgcgggcccccaaguucucccugagcgccaucgaguucaucaccaaggcgaagaccaucaaccuccugguggggaucgugaaggaguccggcgaggucugggacaaggagcaguggcgcgagcggcuggacagcguguucuccgccgugugcgagcgcgggaaccucacguucgcccagaugcggaagauccugaagaucgacgagcgcauccaguucaaggaggucgacuacaccgccaagaaccccgagaacaagaaguucguggaguucaagaaccugaagaaguucugcgagauccucggcgccaucgugggggaccgggcgcuggccgacagcaucgcccgcgacaugacccugaucaaggacgaggaggagcucgcccagaagcugcggggcuacggcaaguucucccaggagcagaucacccagcugggggcccucaacuucagccaccacaucaaccugucccugaaggcgcucagcgagauccugcccuucaugcgcgagggcaugcgguacgacgaggccugccaggaggccaagcugcaggccaagcacaacgacaagaaguccaaguuccucccgcccuucugcgggagcaucuacgcggacgagcugacgaaccccgucgugcaccgcgccaucgccgaguaccggaagauccugaacgcccucaucgccaaguacggcaacgugcacaagauccacaucgagcugacccgcgacgucgggaagaacuuccaggagcgggagaaguacaagaaggagaucgagagcaacuacaaggcgcgcgugcaggccaugcaggagugcgagaagcugggccugacccucuccgagggcaacauccugaagcugcgccucuucauggagcagaacgagcggugcguguacagcgggcggaagaucacccuggccaaccugaaggagcagggcgcccucgagaucgaccacauccugcccuacucccgcagcuccgacgacagcuacaugaacaagguccugguguucacgaacgagaaccagaacaaggggaacaagaccccguacgaggccuucggcggggacucccagaaguggggcgagaucgagagccucgcgcugcgcuccggcuaccccaagaagaaggccaagcggauccuggacaagggguucggcgaccgcgaggccggguucaagagccggaacaucgucgacuccggcuacaucgcccgccucaucgccaacuacaccaaggaguaccugaaguuccugccccucgacagccacgagaacaccgcgcugaucgccggcgagaaggacuccaagauccacguggaggccgugaaggggaugcugacggccaccaugcggcacuucuggggccucgggagcaagaaccgcuacgagcacacccaccacgcgaucgacgccaucaucaucgccuacaucaacgccgccaugauccagcgguucucccaguuccgccagaaccaggagagccugaaggcgcgguucuacgccaaggagcuggccaaggaggaguucaagacccagcgcgccuucuucgagcccuucuccggcuuccgggagcagguccucgccaagguggggcagaucuucgugagccgcccgccccggaagcgcgcgcggggcgcccugcacgaggagacguucuacuccaucgacgacaagaagcugagcgagaccuacggcgggaaggagggcguccagcgcgcccucagccuggggaagauccggcagaucggcaccaagaucguggccaacgggcccauggugcgcgucgacaucuucaagcacaagaaguccggccgguucuacgccgugcccaucuacaccauggacuucgcgcugggcauccucccgaacaaggccguggucagcgggaaggacaacgaccgcaucaucaaggacuggcuggagauggacuccaacuacgaguucugcuucagccuguucaaggacgacgugaucgaggugcagaagaaggacauggagaagcccgagcucgccuacuucgucucccugaacacgagcuccgccagcaucgcgcuggugaagcacgacaacaaguucgagacccucaccuccaaccaggccaagcuguucagcaacgccaaggagaacaacgugaucgccgagucccugggcauccagaaccucaaggucuucaagaaguacaaggugagcccccugggggagaucaaggaggccaaguacgagccccggcagccgaucgcgcugaagaccucccccaagaagcaccgcaagcagaacaacgcccaguga

SEQ ID NO: 1448 - RNA, 3108 nt, Artificial Sequence
  Cas9 variant
augcgccggcugggccucgaccuggggaccaacagcaucggcuggugccugcucgaccugggggacgacggcgagcccguguccaucuuccgcaccggggcccggaucuucagcgacggccgcgacccgaagucccugggcagccucaaggccacgcggcgcgaggcgcggcugacccgccggcgccgggaccgcuucauccagcggcagaagaaccugaucaacgcccucgucaaguacgggcugaugcccgccgacgagauccagcgccaggcccuggccuacaaggaccccuaccccauccggaagaaggcgcucgacgaggccaucgacccguacgagaugggccgcgccaucuuccacaucaaccagcggcgcggguucaaguccaaccgcaagagcgccgacaacgaggcgggcguggugaagcaguccaucgccgaccuggagaugaagcugggggaggccggcgcccggaccaucggcgaguuccucgccgaccggcaggcgaccaacgacacgguccgcgcccgccggcugagcgggaccaacgcccuguacgaguucuaccccgaccgcuacaugcucgagcaggaguucgacacccugugggccaagcaggccgcguucaaccccucccuguacaucgaggccgcccgggagcgccucaaggagaucguguucuuccagcggaagcugaagccccaggaggugggccgcugcaucuuccugagcgacgaggaccggaucuccaaggcccucccgagcuuccagcgcuuccggaucuaccaggagcuguccaaccuggccuggaucgaccacgacggggucgcgcaccgcaucaccgccagccucgcccugcgggaccaccuguucgacgagcucgagcacaagaagaagcugacguucaaggccaugcgcgccauccugcggaagcagggcgugguggacuaccccgucggcuucaaccucgaguccgacaaccgcgaccaccugaucgggaaccugaccagcugcaucaugcgggacgcgaagaagaugaucggcuccgccugggaccgccucgacgaggaggagcaggacagcuucauccugaugcugcaggacgaccagaagggggacgacgaggugcgguccauccucacccagcaguacggccugagcgacgacguggccgaggacugccuggacguccgccuccccgacgggcacggcagccuguccaagaaggccaucgaccggauccugcccgugcuccgcgaccagggccugaucuacuacgacgcggugaaggaggccgggcugggcgaggccaaccucuacgacccguacgccgcccugagcgacaagcuggacuacuacgggaaggcgcuggccggccacgucaugggggccuccggcaaguucgaggacagcgacgagaagcgcuacggcaccaucuccaaccccacggugcacaucgcccucaaccaggugcgggccgucgugaacgagcugauccgccugcacgggaagcccgacgagguggucaucgagaucggccgggaccuccccaugggggcggacggcaagcgcgagcuggagcgguuccagaaggaggggcgcgccaagaacgagcgggcccgcgacgagcugaagaagcucggccacaucgacagccgggagucccgccagaaguuccagcugugggagcagcuggccaaggagccgguggaccggugcugccccuucaccggcaagaugaugagcaucuccgaccucuucagcgacaagguggagaucgagcaccuccugcccuucucccugacccuggacgacagcauggccaacaagaccgucugcuuccgccaggcgaaccgggacaaggggaaccgcgcccccuucgacgccuucggcaacuccccggccggguacgacuggcaggagauccugggccggagccagaaccuccccuacgcgaagcgcuggcgguuccugcccgacgccaugaagcgcuucgaggccgacggcggguuccuggagcggcagcucaacgacacgcgcuacaucucccgguacaccaccgaguacaucagcaccaucauccccaagaacaagaucuggguggucacgggccgccugaccucccugcuccgcggguucuggggccugaacagcauccugcgggggcacaacaccgacgacggcaccccggccaagaagucccgcgacgaccaccggcaccacgccaucgacgcgaucguggugggcaugacgagccgcgggcuccugcagaaggucagcaaggccgcccggcgcuccgaggaccuggaccucacccggcuguucgagggccgcaucgaccccugggacggguuccgggacgaggugaagaagcacaucgacgccaucaucgugagccaccgcccccggaagaagucccagggcgcccugcacaacgacaccgcguacgggaucgucgagcacgccgagaacggcgccagcaccguggugcaccgcguccccaucacgucccucggcaagcagagcgacaucgagaaggugcgggacccgcugaucaaguccgcccugcucaacgagaccgccgggcugagcggcaaguccuucgagaacgcggugcagaaguggugcgccgacaacagcaucaagucccugcgcaucgucgagaccgugagcaucauccccaucaccgacaaggaggggguggccuacaagggcuacaagggggacggcaacgccuacauggacaucuaccaggaccccacguccagcaaguggaagggcgagaucgucucccgguucgacgcgaaccagaagggguucaucccgagcuggcagucccaguuccccaccgcccgccucaucaugcggcugcgcaucaacgaccugcucaagcugcaggacggcgagaucgaggagaucuaccgggugcagcgccugagcgggagcaagauccucauggcgccccacaccgaggccaacguggacgcccgcgaccgggacaagaacgacaccuucaagcugacguccaagagccccggcaagcugcaguccgccagcgcccgcaagguccacaucuccccgaccgggcucauccgggagggcuga

SEQ ID NO: 1449 - RNA, 3108 nt, Artificial Sequence
  Cas9 variant
auggagcagcugaacuacauccucggccuggacaucgggaucgccagcgugggcugggccgucguggagaucgaccacaacgaggaccccauccgccugaucgacguggggguccggaccuucaacaaggcggagguggccaagaccggcgagucccucagccugauccgccggcuggcccgcgggucccggcgccucgugcggcgcaagaagaugcggcugcugacggccaagcgccuccucaagagcgagggcauccuguccgaccucgacuucaacaagggcgccauccugaaccugccgaacaacugcugggagcuccgggucaaggggcuggacaagaagcugagcgacaaggagugggcggccgugcuccugcacaucaucaagcaccgcggcuaccugucccagcggaagcacgaccgcaagaccgacgacaaggagcucggggcccugcugagcggcguguccaagaaccacagccuccuggaggagggggaguuccggaccgccgcggagcuggccaucaacgucuucugcaacuccaagggccacauccgcaaccaguggggcgacuacagccacaccuucucccggcucgaccugcagaaggagaucaagcagcuguucgugagccagcgcgagcucgggaaccccuacacguccagcuccuucgaggagaacaucaucagccugcugaugaagcagaaggaggccaucuccggcaacgacauccucaagaugcuggggaagugcaccuacgagaagaacgaguacaaggccgccaagaacaccuacagcgcggagcgguucguguggcugaccaagcucaacaaccugcgcaucgucgacgacggcguggagcgggcccugaacagcuccgagcgcaagcuccugaucgacgagcccuacaagaaggccaagcugacguacgcccaggugcgcaagauccucgagcugcccgacagcgccgucuucaagggcgugcgguacuucgcggacaacgccgaguccagcacccugauggagaugaaguucuggcacuccauccgcaaggcccucgagagcaacaaccugaaggacgaguggcuggugcucaagaccaagccggagcugcuggacgagaucgggaccggcuucuccaucuacaagacggacgacgacaucaccagcuaccuguccaacaagcucgacaagaagguccuggacauccugcucguggaggugagcuucgacaaguucaucgagcugucccugaagugccuccggaagaucaucccccugauggagaagggguaccgcuacgacgaggccuacaaguacaucuacggcgaggucaacaucgaguacaaccugaacgacaucaagaaccccguggugcuccggagcuucucccagagccgcaaggucaucaacgccgugauccggcuguacgggucccccgcgcgcauccacaucgagaccgcccgggacaucggcaagagcuucaaggagcgcaaggccaucgagaagcagcaggagaagaaccggcuggagaagguccgcgccgccgagcacuucaagcagcuguucccgaacuacgugggcgagcccaaggcgaaggacauccugaaggugcggcuguacgagcagcagcaggggaagugccucuacuccggcaagauccuggacaucaagcgccugauggagcacggguacgucgagaucgaccacgcccuccccuucagccggaccugggacgacuccuucaacaacaaggugcuggugcuggccaacgagaaccagaacaagggcaacaagacgcccuacgagugguucaacgggaaggacaacagcgacagcuggaagcgcuuccucgcccuggucaacaacuccggcuucagcgcggugaagaagcagcacauccugaugaaggagaucgacgaggagggcuucaagcagcggaaccucaacgacacccgcuacaucacccgguuccugugcaacuggguggagaacaacaucccgcugcucgggaagggcgucaagcgcguguucgcgccccaggggaagaucaccgcccugcugcgcuccaacuggggcauccggaaggugcgcgaggacaacgaccggcaccacgccaucgacgccaucgucguggccugcacgaccgugagcauccagcagcgcaucaccaacuacgucaagaacuccgagaucaaccggaagaucaagcgccagaacuaccucaaguuccccgagcccuggaaguucuuccgggaggacaucagcauccgcguguucuccaacaacccgaucgaggagcugaagcagcagcugagcgaccggcccgaggccaaccaccaguucgugacgccccucuucgucucccgcgcccccgugcggaagaugaccgggcagggccacgaggacaccauccgcagcgccaagcggaucuccgagggcaucagcgugcugcgcgucccgcugaccaagcucaacgacaagucccuggagcugauggugaaccgggagcgcgagaaggagcucuacgacgcccugaagcagcggcugcucgaguucaagaacgaccccgagaaggcguucgccgagcccuucuacaagaagggcgggcagcaggucaagaccgugcgcaucgagcgggugcagaagaacggggugcuggucaacaacaacacgggcaucgccgacaacggcaacaucgugcgcguggacgucuuccugaagaagaagaaguacuuccucgugcccaucuacagcuggcaggucgccaaggggauccugccgaacaaggccaucguggcgcacaagaacgagugcgacugggccgacauggacggcuccgcccaguuccuguucagccucuacaccaacgaccugaucgagguggugcugaaggacuccaccauccucggguacuucagcagcaucgaccgggccaccgcggccaucaucaucaaggagcccgacauggagaaguccaagggcaaggaggggauccaccgcgucggcgugaagacggcccgcagcuucaucaaguacaacguggacguccugggcaagaacaucucccggugccgcaaggccaagcggcugcccgugcgcuga

SEQ ID NO: 1450 - RNA, 3108 nt, Artificial Sequence
  Cas9 variant
augcugcgcaagaugcacuaccggcucgcccuggaccugggcagcaccucccucgggugggccaugauccgccugaacgcgggcaacgagcccugcgccgugaucaaggccgggguccggaucuucagcaacggccgcaacccgaaggacggguccagccuggccgugacccggcgcgaggcccgggcgaugcgccggcgccgggaccgccuccugaagcggaaggcccgcaugauccagacgcugaucgaguacggcuucuuccccgccaaggaggaccagcggaaggcccucgagaucaugaaccccuucgcgcugcgcgccaagggccugaacgaggcccucacccccgccgaguucgcccgggcgcuguuccacaucaaccagcgccggggguucaaguccaaccgcaagaccgacaagaaggacaacgacagcggcgcccugaagaccgccaucaacaagcuccgggagacgcugaagaccgagaacugccgcaccgugggggaguggcugaacaagcgcgacgucgccggccucaccgugcgggcccgcuaccaccaggacaagacgaucaaggaggacgggaaguccaagaucaacaaguacuacgaccuguacaucgaccgggcgaugaucgagcacgaguucgacgagcuguggaagaagcaggccgagcucaacccgacccuguucaccgaggccgcccgcgccgaccugaaggacgugcuccugcaccagcgggcgcugaagcccgucaagcccggccgcugcaccuucaugcccgacgaggagcgggccccgcucgcccugcccagcacgcagcgcuuccggauguaccaggaggugaacaaccugcgcauccuccgggacggccugaaggaggagucccugacccucaaccagcgcgacgaccugaucgccgcccuggaggagaacaacaagcggaccuucacccagaucaagaagcuccuggggcugggcgggguggucaaguucaacuucgaggaccccaagcgcgaggagcucaagggcaacacgaccagcgcgauccugggcaaggacgagcacuucggguccgugugguucaaguucgacgaggccaagcaggacgccaucgugaugcagcuguucaaggaggagaacgaggccaagcuccugcgguggcugcagaacgagaccggcaucgacgagaagcgcgcggagaccaucgccaacgucgggcuccccgagggcuacgggagccugugcgcccuggcccucgcccggauccugccggagcugcgccgggacguggugcccuacuccgacgcggccaaggccgccggcuuccaccacagcgacacguccaacaaccaggagguccccggccugaccuuccccaucgagcucguggugaccgagaccggggagaucaagacgaagcacaucuuccacgagcugccguacuacggcgaguaccugcagcgccacgucggguucggcagcgggaagcccgaggacuccgccgagaagcgcuacggcaagaucgcgaaccccaccgugcacaucggccucaaccaggugcggcuggucgugaacacccugaucaagcgcuacgggcaccccagcgaggugaucgucgagguggcccgggaccucaagcaguccaaggaccugcgcgacgaggagggcaagcggcaggccgagaaccagaagcgcaacaagcggauccgcaccgccaucgccgggguccugcagacgagcgaggagcgggugcgccgggacgacaucgagaagaugauccucugggaggagcugagcuucgacccggcggaccgccggugccccuacuccggcgugcagaucagcgccgccaugcugcucuccgacgaggucgagaucgagcacauccugcccuucagccagacccuggacgacucccucaacaacaagaccguggcccugcgccaggcgaaccgggugaaggggaaccgcacccccugggaggccuucggcgcccagagcacggccggcuucgacuacgccaccauccuggcgcgggccgagcacaugccgaaggggaagcgcuaccgguucgccgaggacggcuaccagcgcuggcucaaggacgacgccggguuccugccccgggcccugaacgacacccgccacauguccaaggucgcgcgcgaguacaugagccucaucugccccaacacccgggugauccccggccgcaugacggccaugcugcggggcaaguucgggcugaacgacgugcucggccugaacggggagaagaaccgcaacgaccaccggcaccacgccgucgacgccugcgugaucgccgugaccgaccagggccugcuccagcgcuucgcgaaggccuccgccagcgcccgggagcagcagcugaaccgccuggucgagaacaugccgcuccccugggaguccuaccgggagcacguggagcgcgcgaucgacgccaucugggugagccacaagcccgaccacucccacgagggggccaugcacaacgacaccgccuacggccugcugggcgacgggaaggucagcauccacaagaugguggagggcaagcgggagcgcaucgaggagucccucaaggugaucgccuucaccaacgcgaaggccaacgaccggcacgggcugcuggacaacggcgagccgcgccccuacaagggguacaagggcgacagcaacuacugcaucgagaucauccggaacgagaagggcaagugggagggggaggucaucuccaccuucgacgccuaccagcucgugcgcgagcacggcguggcccggcugcgccaccccacgcugagcgucuccgggaagccccucgugaugcggcugaugaaggacgagaccauccgcauggugaccaacgagaagccgaucaccgcccgcgucugcugggugcggagcgacacgcgcaucgcguucgccagcaccuccgaggccaacguggacgcccgggaccgcgacaagaacgacagcuucuccuacaucgucaagaccgccagcgugcugcagaagcuccaggcgcggcgcaucuccaucagccccaccggcgagcugcgggaccccggguucaaggaguga

SEQ ID NO: 1451 - RNA, 3108 nt, Artificial Sequence
  Cas9 variant
auggagcagcugaacuacauccucggccuggacaucgggaucgccagcgugggcugggccgucguggagaucgaccacaacgaggaccccauccgccugaucgacguggggguccggaccuucaacaaggcggagguggccaagaccggcgagucccucagccugauccgccggcuggcccgcgggucccggcgccucgugcggcgcaagaagaugcggcugcugacggccaagcgccuccucaagagcgagggcauccuguccgaccucgacuucaacaagggcgccauccugaaccugccgaacaacugcugggagcuccgggucaaggggcuggacaagaagcugagcgacaaggagugggcggccgugcuccugcacaucaucaagcaccgcggcuaccugucccagcggaagcacgaccgcaagaccgacgacaaggagcucggggcccugcugagcggcguguccaagaaccacagccuccuggaggagggggaguuccggaccgccgcggagcuggccaucaacgucuucugcaacuccaagggccacauccgcaaccaguggggcgacuacagccacaccuucucccggcucgaccugcagaaggagaucaagcagcuguucgugagccagcgcgagcucgggaaccccuacacguccagcuccuucgaggagaacaucaucagccugcugaugaagcagaaggaggccaucuccggcaacgacauccucaagaugcuggggaagugcaccuacgagaagaacgaguacaaggccgccaagaacaccuacagcgcggagcgguucguguggcugaccaagcucaacaaccugcgcaucgucgacgacggcguggagcgggcccugaacagcuccgagcgcaagcuccugaucgacgagcccuacaagaaggccaagcugacguacgcccaggugcgcaagauccucgagcugcccgacagcgccgucuucaagggcgugcgguacuucgcggacaacgccgaguccagcacccugauggagaugaaguucuggcacuccauccgcaaggcccucgagagcaacaaccugaaggacgaguggcuggugcucaagaccaagccggagcugcuggacgagaucgggaccggcuucuccaucuacaagacggacgacgacaucaccagcuaccuguccaacaagcucgacaagaagguccuggacauccugcucguggaggugagcuucgacaaguucaucgagcugucccugaagugccuccggaagaucaucccccugauggagaagggguaccgcuacgacgaggccuacaaguacaucuacggcgaggucaacaucgaguacaaccugaacgacaucaagaaccccguggugcuccggagcuucucccagagccgcaaggucaucaacgccgugauccggcuguacgggucccccgcgcgcauccacaucgagaccgcccgggacaucggcaagagcuucaaggagcgcaaggccaucgagaagcagcaggagaagaaccggcuggagaagguccgcgccgccgagcacuucaagcagcuguucccgaacuacgugggcgagcccaaggcgaaggacauccugaaggugcggcuguacgagcagcagcaggggaagugccucuacuccggcaagauccuggacaucaagcgccugauggagcacggguacgucgagaucgaccacgcccuccccuucagccggaccugggacgacuccuucaacaacaaggugcuggugcuggccaacgagaaccagaacaagggcaacaagacgcccuacgagugguucaacgggaaggacaacagcgacagcuggaagcgcuuccucgcccuggucaacaacuccggcuucagcgcggugaagaagcagcacauccugaugaaggagaucgacgaggagggcuucaagcagcggaaccucaacgacacccgcuacaucacccgguuccugugcaacuggguggagaacaacaucccgcugcucgggaagggcgucaagcgcguguucgcgccccaggggaagaucaccgcccugcugcgcuccaacuggggcauccggaaggugcgcgaggacaacgaccggcaccacgccaucgacgccaucgucguggccugcacgaccgugagcauccagcagcgcaucaccaacuacgucaagaacuccgagaucaaccggaagaucaagcgccagaacuaccucaaguuccccgagcccuggaaguucuuccgggaggacaucagcauccgcguguucuccaacaacccgaucgaggagcugaagcagcagcugagcgaccggcccgaggccaaccaccaguucgugacgccccucuucgucucccgcgcccccgugcggaagaugaccgggcagggccacgaggacaccauccgcagcgccaagcggaucuccgagggcaucagcgugcugcgcgucccgcugaccaagcucaacgacaagucccuggagcugauggugaaccgggagcgcgagaaggagcucuacgacgcccugaagcagcggcugcucgaguucaagaacgaccccgagaaggcguucgccgagcccuucuacaagaagggcgggcagcaggucaagaccgugcgcaucgagcgggugcagaagaacggggugcuggucaacaacaacacgggcaucgccgacaacggcaacaucgugcgcguggacgucuuccugaagaagaagaaguacuuccucgugcccaucuacagcuggcaggucgccaaggggauccugccgaacaaggccaucguggcgcacaagaacgagugcgacugggccgacauggacggcuccgcccaguuccuguucagccucuacaccaacgaccugaucgagguggugcugaaggacuccaccauccucggguacuucagcagcaucgaccgggccaccgcggcccugaucaucaaggagcccgacauggagaaguccaagggcaaggaggggauccaccgcgucggcgugaagacggcccgcagcuucaucaaguacaacguggacguccugggcaagaacaucucccggugccgcaaggccaagcggcuccccgugcgcuga

SEQ ID NO: 1452 - RNA, 3111 nt, Artificial Sequence
  Cas9 variant
augcgcaucuucggcuucgacaucgggaucaccagcaucggcugggccuacguggaguccaacgagcugaaggacugcgggguccggaucuucaccaaggccgagaaccccaagaacggcaagagccucgcgcugccgcgccgggaggcccgcggggcccggcgccggcuggcccgccggaaggcccgccucaacgcgaucaagcggcugcugugcaaggaguucggccucaacguguccgacuacuucgccaacgacggcgagcugcccaaggccuacgagacgaccaaggacaccaagagccccuacgagcugcgcucccucgcccuggagcagaagcuggagcccaaggagcucgcgcgggugauccugcacaucgccaagcaccgcggguacggcaacaagcacgccaagaccgggagcgacaaggacuccggcaagguccugagcgccaucaaggugaacgagacggccaugaaggacaaguaccaguccgugggggaguaccucuacaaggaguucuaccagaagcugcggcuggagagcgagaagaagggcaacaacaucaccaaggaguucaagaacguccgcaacaagggcgagaacuacgagcacugcguggcgcaggagcagguccgggccgagcucgagcugaucuucgccaagcagaaggacuucggggccaccuucuccgagaacuucgagagccagaucaucgagaccgccuucuaccagcgcgaccugaaguccuucgaggacaaggugggcaagugcguguucuacgagaacgagaaccgggcgccgaaggacagccucuccgccauggaguucguggcccugacgcgcaucaucaacacccugaagaaccucgaggagaaguccaagaaccuggggaucggcgaggucuacggcaaggacaagauccaggagauccugaagaucgugcucgacaagggggagaugagcuacaagaagcugcgggagauccugcaccucgacgagcacauccuguucgccaaggacagcaagcuggacuacacccagggcgugcaggaggccgagaaggcgaaguucaucgagcucaagaaccugaaggccuucaagaaggccaugggcggggacuucuccaacuucgcccgcgaggagcuggacaagaucgccaccgacaucacgcucgucaagagcaaggagaaccuggcgaagaagcugcagaacuacagcgcccucuccaaggagcaggucgaggcccugagcaaccuguccuucgccaagcacaucgaccucagccugaaggcgcuggagcagauccuccccuucaugcgcggggacaagaccggcaagugccugcgguacgacgaggccgugaagaaggccgagcugcaggagcaccgcaagcacaagcagaagggcgaguuccucaucccccugaaggacuacgagcccuaccuggccaacccggugguggcccgggcgcuguccgaguaccgcaaggugcucaacgcccugcugcggaaguacgggaagguccacaagauccaccucgaguucacccgcgaggccaagcugagcgccaaggagcggcagaaguacgagaaggagcagaaggagcacuucgaggccaaccagcgcgcgauccagcagugcgagauccugggccuccccaucaacgggaccaacauccugaagaugaagcuguggcucgagcagggcgagugcugcgccuacuccggggagaagaucacgcgggagcaccuccuggacagcaacgcccuccagguggaccacaucuaccccuacucccgcagcuucgacgacuccuacaugaacaaggugcuggucuucgccaaggagaaccaggacaagggcaacaagacccccuucgaggccuucggcggggacaaggagaagugggaccggauccugagccuguccgcgaagcugccgaagcagaagcagcgccggaucagcaacaccaacuucaaggacaaggagggcggguuccuggcccgcaaccucaacgacaccggcuacaucgccaagcuggccucccaguggacgaaggacugccuggaguucgaggaccuccgggagaacgaggugaccaucgcgggggagaagggcagcuccguccacaucgagguggugagcggccagcugaccuccaugcugcgccacuacugggggcucggcaacaaggaccggaacaaccaccuccaccacgccgucgacgccgugauccuggccuacaccaacaacgccaugaucaaggcguucgccaacuuccgcaagaaccaggaggagaacaagaagaaguucuacgccaagcagaucgccgagagcgaguacaaggccaagaaggcguucuucgagcccugcaagaacuuccggcagcgcguggaggagaagaucaaggagaucuucgucagcaagccgccccgcaagcgggugcgcggggcccugcaccaggagacguucuaccccuucgagaagcugugcaacgacaaggaguacuccgagaagcugaagauggacuacggcggcgagaaggggaugcagaaggccaucgcccucggcaagauccggcagaucgggaccaagaucgugagcaacggcgccaugguccgcguggacaucuucaaggacaagaaggggaaguucuacgcggugcccaucuacaccauggacuucgcccugggcauccugcccaacaaggccgucgccaucggcaaggacaaggacggggugaucaaggacuggaucgagauggacuccaacuacgacuucugcuucagccucuucaaggacgaccugauccuggugcagaagaaggagauggagcgggcggagcucugcuacuucgucuccuucggcagcaccaacgcccagaucaacguggagaagcacaacaacaaguucgaggggcuguccgagaacgagaagauccuguacagcaacgccacgcagaaggagguggccggcaaguccaucgggauccagaaccucaagaccuucgagaaguaccaggucagcccccugggcgaggugcagaaggccgaguucgagccgcaccaggagaucaagcugaaguccagccccaagcgcaaggacuga

SEQ ID NO: 1453 - RNA, 3111 nt, Artificial Sequence
  Cas9 variant
augcugcacaagaugcacuaccgccucgcccuggaccugggcagcaccucccucgggugggccaugauccggcuggacgcggacaaccagcccugcgccgugaucaaggccggcguccgcaucuucagcaacgggcggaacccgaaggacggcuccagccuggccgugacccgccgggaggcccgcgcgaugcggcgccggcgcgaccggcuccugaagcgcaaggcccggaugaugcgcacgcugaucgaguacggguucuuccccgccgaggccgcgcagcggaaggcccucgagaccaucaaccccuucgcccugcgcgccaagggccuggacgaggcccucacccccgcggaguucggccgggcccuguuccacaucaaccagcgccggggguucaaguccaaccgcaagaccgacaagaaggacaacgacagcggcgcccugaagacggccaucgggaaggugcgggccaccaucgaggcggagggcugccgcaccgucggggaguggcuccacaagcgcgacguggccggccugaccgugcgggcccgcuaccaccaggacaaggucaucaaggaggacggcaagacgaagaucgacaaguacuacgaccuguacaucgaccgggccaugaucgagcaggaguucgacgagcucuggaagaagcaggccgagcugaacccggcgcuguucaccgaggccgcccgcgccgaccucaaggacgugcugcugcaccagcggccccucaagcccgugaaguccgggcgcugcaccuucaugcccgacgaggagcgggccccgcuggcgcugcccagcacccagcgcuuccggauguaccaggaggucaacaaccuccgcauccugcgggacggccugaaggaggagccccucacgcugaagcagcgcgacgaccugaucgccgcccucgagaagaacuccaagcacagcuucacccagaucaagacccugcugggggugggcggcgccgugcaguucaacuucgaggaccucaagcggcaggagcugaaggggaacaccacguccgcgauccugagcaacgacaagcacuucggcaaggccugguucaccuucgacgaggccaagcaggacgccaucguccuccagcuggugaaggaggagaacgaggccaagcuggugcgcuggcuccaggacgagaccgggaucgacgagaagcgggcggaggccaucgccaacgucggccugcccgagggguacggcucccugugcgccaaggcccucgcgcgcauccugccggagcugcggcgcgacgugaugaccuacgacaaggccgugcaggccgccggcuucgagcaccacagccggcucggguccaacacggagauccccggccugaccuucaagaucgagagcaucgaccaggacuccggggaggucaagcaguuccacauccacaaggugcugcccuacuacggcgaguaccugcagcgccacgugggguucggcagcggcgagcccgaggacccggccgagaagcgcuacgggaagaucgcgaaccccaccguccacaucggccucaaccagauccggcugguggugaacgcccugcucaagcgcuacgggcaccccuccgaggucaucguggagcuggcccgggaccugaagcagagcaaggaccagcgcgacgaggagagcaagcggcaggccgagaaccagaagcgcaacaagcggcuccgcgacgcgaucgccggcacccugaagaucuccgaggagcggguccgccgggacgacauccagaagaugauccugugggaggagcucagcuucgaccccgccgaccgccggugcccguacuccggggcccagaucagcgccacgaugcugcuguccgacgagguggagguggagcacauccuccccuucagccagacccuggacgacucccugaacaacaagaccgucgcgcuccgccaggccaaccggaucaagggcaaccgcacccccugggacgccuucggcgcccaggccguggcgggguucgacuacgagagcauccuggugcgggccgagggcaugcccaaggccaagcgcuaccgguucgccgagaacggguaccagcgcuggcugaaggacgacgccuccuuccucgcgcgggcccugaacgacacgcgccacaugagcaaggucgccuucgaguaccugaagcucaucugcccgaacacccgcgugauccccggccggaugaccgccaugcugcgcgcgaaguucggccugaacgacgugcucgggcugaacggcgagaagaaccggaacgaccaccgccaccacgccgucgacgccugcgugaucgccgugaccgaccaggggcugcuccagcgguucgccaaggcguccgccagcgcccgcgagcagcagcugaaccggcuggucgagaacaugccccuccccuggggcuccuaccgcgagcacgugcagcgggccaucaacgccaucuggaucagccacaagccggaccacucccacgagggggcgaugcacaacgacacggccuacggccugcgcggcgacgggaaggugagcuuccacaagauggucgagggcgugcggacccacuccgaggacaaccugaaggugaucgagaucagcaacgccaaggccaccgaccgccacgggcuccugcccaacggcgagccccggccguacaagggguacaagggcgacuccaacuacugcaucgagaucguccgcaacgagaagggcaagugggagggggaggugaucagcaccuucgaggccuaccagcuggugcgggagcacggcaucgcgcgccuccggcacagcacgcuguccgucagcgggaagcugcucgugaugcgccugaugaucgacgacgugguccggcugaucaucgacgagcagacccgcaccaugcgcaucgccacccucuccggcaacgggcagaucuucauggccgacaccagcgaggccaacguggacgcccggaaccgcuccaaggaggagacguucgcguacgugagcaagauggccggcucccugcagaaggccaacgcccggcgcaucaacaucagccccaucggcgagcugcgggaccccggguucaaggaguga

SEQ ID NO: 1454 - RNA, 3114 nt, Artificial Sequence
  Cas9 variant
auggagcgcaucuucggcuucgacaucgggaccaccagcaucggcuucuccgugaucgacuacagcuccacgcagagcgccgggaacauccagcggcugggcguccgcaucuuccccgaggcccgggacccggacgggacgccccucaaccagcagcgccggcagaagcgcaugaugcggcgccagcugcggcgccggcgcauccggcgcaaggcgcugaacgagacccuccacgaggccggcuuccugcccgccuacggcuccgccgacuggcccguggugauggccgacgagccguacgagcugcggcgccgggggcucgaggagggccugagcgcguacgaguucgggcgcgccaucuaccaccuggcccagcaccggcacuucaagggccgcgagcucgaggaguccgacacccccgaccccgacgucgacgacgagaaggaggccgcgaacgagcgggccgccacccugaaggcccugaagaacgagcagaccacccucggggccuggcuggcgcgccggcccccgagcgaccggaagcgcggcauccacgcccaccggaacgugguggccgaggaguucgagcgccugugggagguccaguccaaguuccaccccgcccucaagagcgaggagaugcgggcccgcaucuccgacaccaucuucgcgcagcggcccguguucuggcgcaagaacacgcugggcgagugccgguucaugcccggggagccgcugugccccaagggcagcuggcucucccagcagcgccggaugcuggagaagcugaacaaccucgccaucgccgggggcaacgcccgcccccuggacgccgaggagcgggacgcgauccugagcaagcuccagcagcaggccuccaugagcuggcccggcgugcgcuccgcccugaaggcccuguacaagcagcgcggggagccgggcgccgagaagucccucaaguucaaccuggagcucgggggcgagagcaagcugcuggggaacgcgcuggaggccaagcucgccgacauguucggccccgacuggcccgcccacccccgcaagcaggagauccggcacgcgguccacgagcgccugugggccgccgacuacggcgagaccccggacaagaagcgggugaucauccugagcgagaaggaccgcaaggcccaccgcgaggccgcggccaacagcuucguggccgacuucgggaucaccggcgagcaggccgcccagcuccaggcgcugaagcugcccaccgggugggagcccuacuccauccccgcccucaaccuguuccuggccgagcucgagaagggcgagcgguucggggcccuggucaacggcccggacugggagggcuggcgccggacgaacuucccccaccgcaaccagcccaccggggagauccuggacaagcuccccagcccggccuccaaggaggagcgggagcgcaucagccagcugcggaaccccaccguggugcgcacccagaacgagcugcggaaggucgugaacaaccucaucggccuguacgggaagcccgaccgcauccggaucgaggugggccgcgacgucgggaaguccaagcgggagcgcgaggagauccagagcggcauccggcgcaacgagaagcagcggaagaaggcgacggaggaccugaucaagaacggcaucgccaacccgucccgcgacgacguggagaaguggauccuguggaaggaggggcaggagcggugccccuacaccggcgaccagaucggguucaacgcccucuuccgcgagggccgguacgagguggagcacaucuggccccgcagccgcuccuucgacaacagcccccggaacaagacccugugccgcaaggacgucaacaucgagaagggcaaccggaugccguucgaggccuucgggcacgacgaggaccgcugguccgcgauccagauccggcugcagggcauggugagcgccaagggcgggaccgggaugucccccggcaaggugaagcgcuuccucgccaagacgaugcccgaggacuucgccgcccggcagcugaacgacacccgcuacgcggccaagcagauccuggcccagcucaagcggcuguggcccgacaugggcccggaggcccccgucaagguggaggccgucaccggccaggugaccgcgcagcugcgcaagcucuggacgcugaacaacauccuggccgacgacggggagaagacccgggccgaccaccgccaccacgccaucgacgcccucaccguggcgugcacccaccccgggaugacgaacaagcugagccgguacuggcagcugcgcgacgacccccgggccgagaagccggcccucaccccgcccugggacaccauccgcgccgacgcggagaaggccgucuccgagaucguggugagccaccggguccgcaagaagguguccggcccccugcacaaggagaccacguacggggacaccggcaccgacaucaagaccaagagcggcacguaccggcaguucgugacccgcaagaagaucgagucccugagcaagggggagcucgacgagauccgcgacccccggaucaaggagaucgucgccgcccacguggccggccgcgggggcgaccccaagaaggcguucccgcccuaccccugcgugagccccgggggccccgagauccggaagguccgccugaccuccaagcagcagcugaaccucauggcccagaccggcaacggguacgccgaccugggcagcaaccaccacaucgccaucuaccggcugcccgacgggaaggccgacuucgagaucgugucccucuucgacgcgagccgccggcuggcccagcgcaacccgaucgugcagcggacccgcgccgacggcgccuccuucgucaugagccuggccgcgggggaggccaucaugauccccgagggcuccaagaagggcaucuggaucgugcagggggugugggccagcggccaggucgugcucgagcgggacacggacgccgaccacuccaccaccacccgccccaugccgaaccccauccugaaggacgacgccaagaaggugagcaucgaccccaucgggcggguccgccccuccaacgacuga

SEQ ID NO: 1455 - RNA, 3117 nt, Artificial Sequence
  Cas9 variant
auggccaagcagguccgcuaccggcugagccucgaccugggcuccaccagccuggggugggccaucuuccgccucgacgcggacgcccaccccaccgccaucaucaaggccggcgugcggaucuucuccgacgggcgcaacgccaaggacggcagcucccuggcggugacgcggcgcgccgcccggagcaugcgccggcgccgggaccgccugcuccggcgcaagacccggaugcuggacgcccugcucgaguacggguucuucccgcaggacgcggcccagcgcaaggcccuggagcggcugaaccccuacgcccuccgcgccgagggccuggcgcggccccugacccccggcgaguucgcccgcgccaucuuccaccucaaccagcggcgcggguucaaguccaaccgcaagaccgacaagaacgacaacgacagcggcgcccugaagacggccaccucccagcugcggcaggacauccaggcgagcgggugccgcaccgugggcgaguggcucuggacccagcggcugcagaagaagccggagggggucccccaccagggcgugcgcgcccgguaccgcgagacgccccacaucaacuccgagggcaagaagcggaucgagaagaaguacgaccuguacaucgaccgcagcaugaucgaggccgaguucgacgcccucugguccgcccaggcgaccuucaaccccguggucuuccacgccaccgcccacgagaagcugaaggacauccugcucuaccagcggccgcugcgccccgugaagcccgggcggugcacccugcuccccgaggaggagcgcgccccgcuggcccugcccagcacgcagcgguuccgcaucuaccaggagcucaacaaccugcggcugcucguggaccagcugaacgagcagccccugacccucgcgcagcgcgacaccaucgccacccugauggagggccgggccaagaucuccuucgaccagauccgcaaggcccugaagcucgggagcaugacgaaguucaaccuggaggacgacaagcggaacgagcugaagggcaacgcgaccggcucccagcucgccaagaaggaguucuucgggcccgccuggcaccaguucgacgaggcccugcaggacgacaucgucuggcaccuccugagcgaggagaacgaguccgcccugaucagcuggcugcaggaccgcaccggcaucgacgcggccaccgcccaggccgugagcaacgccucccucccggagggguacggcagccugucccgcaaggcgcuggaggugauccugccccggcuccgcagcgaggucaucacguacgacaaggccgugcaggccgccggguucucccaccacagccagcugggcuucgaguacgaccccgacgacguggaggacuggaucgaccacgccaccggcgaggucaagcccaucuucaagcggcugccguacuacgggaaggcgcuccagcgccacguggccuucggcuccgggaagcccgaggacagccaggagaagcgguacggcaagaucgccaaccccaccgugcacaucgggcugaaccagguccgcgugguggccaacgcgcugaucgcccgguacggccgccccaccgagaucaucaucgagcucgcccgggaccugaagcagucccgcgagcagcggcagcaggaccagcgccggcaggccgacaaccagaagcgcaacgcccggauccgcaacagcaucgcgcaggcccugggcaucgccgaggcccggguccgccgggaggacauccagaaguggauccucugggaggagcuggacccgggggacgccaugcaccgcugcugccccuacuccggcgugcccaucagcgcguccaugcugcucagcgagcaggucgagaucgagcacauccugcccuucuccaugacgcuggacgacagccucaacaaccggaccgugucccugcgccaggccaaccgcaucaagcggaaccgcagcccgugggacgcccgggaggacuucgaggcccagggguggcacuacgacggcauccugcagcgcgccgggcucaugcccgugcagaagcgguaccgcuucgcggccgacggcuaccagcgguggcugcgcgacgaccaggacuuccuggcccgggcccucaacgacacccgcuaccugucccggaucgcggccgaguaccugcgccucgucugcccccagggcacccgggugaucccggggcagcugacggcccugcuccgccggcgcuucggccugaacgacauccuggggcucgagggcgagaagaaccggaacgaccaccgccaccacgccguggacgccugcgucaucggcaucaccgaccacgggcugaugcagcgguucgcgcgcgccagcgcccaggcccgcgagcagggccugacccggcucgccgaggagaugccccugcccuggcccaccuaccgcgaccacguggaccgggcggugagccugaucugggucucccacaagccggaccacgggcacgagggcgccaugauggaggagacggccuacgggcucaugaaggacggcaccauccgccagcggcacaaggccgacggcaccaaggggcgcgagguggccaacgugauccggaucgcggagcccgcccagcccacccgccacggcgucgacgaccaggggcggccccugccguacaagggcuacaucgggggcagcaacuacugcaucgagaucacgcgcggcgcccaggggaagugggagggcaccgugaucuccaccagcgacgccuacgggaucgugcgggcccgcggcaucgcggggcugcggaacaccucccagggccagaacggccacccccucgucaugcgccuggugaucggggacagccugcggcuccgcaucaacgacgcccugcagaccaugcgggugacgaagaucuccggcaacgggcaggucuucauggccggcgugcacgaggccaacguggacgcgcgcaaccgggacaagagccaggccuucgcccuggucuccaagauggccgggagccuccaggccgcgcaggcccgccaggccaccaucucccccaucggcgagauccgggaccccggcuucccgggguga

SEQ ID NO: 1456 - RNA, 3120 nt, Artificial Sequence
  Cas9 variant
augaagaagcgcauccugggccucgacaucgggaucgccagcgugggcugggcccugaucgaguucgacgacgaguuccaggacaacaagaagaaggggaccaucaucaaguccggcguccggaucuucacccgcgcggagacgcccaaggagcgggagccgcuggccaagccccgccgggaggcccgcagccagcggcgccggaucuccugccgcguggagcggcucaacuucgugcgcgagcuguucgucaagaacgggcugguggccaaggagagcgugaacaagaacaaccccaacaacaucuacaucacccucaaccagaucaagacccccuggcagcugcggauggaggcccuggaccgcaagcucaccaacgaggaguucgcggucgugcugacgcaccuggccaagcaccggggcuacaagucccuccgcaagaccgacagcaaggacaacaagaccggcgagaugcugaaggccaucaaccagaacaaggagcggcuggacaacuccgacuaccgcacccucggggagauguucugcaagcacgagagcuacaaggagcacaagcggaacaaggacggcgaguacaucaacuccgugacgcgcgagcugaucgaggaggaggccgagaagaucuucgcgaagcagcggaaggaggggaacaacuucgccgacgucgacaucgagcgcgaguaccugaagaucgccuucagccagaagccgaccggcuccaucaacaagauggugggguucugcaccuucgagaacggcgagaagcgcgcgccccgggacagcuacuccgccgagcuguucaaggugcucaacaccaucaacaacacgaccaucaccgacaugaagaccggcgagacgcgcaacuucaccggggccgagaucaagaagaucaucgagaucaucaaggacaccaagggcaucaccuacgucaagaucaagaaggagcugaagcucgggagcucccaguucagcggcguggacuaccgggagaacgccaaguccaagggcgagggggagaucuucgugagcaugaagacguaccacgagaucaaguccaagaucgagaagcugagcaaggagaaguggaacaagcugaaggagaacaccgagcuccuggacagcaucgucaacaucaucgccaacuucaaggacgacgaguccaucaagaaggaguuccagaagcugaagaucgacgaggacaucaucgacgugcuccugaacuucgaguucaagaaguucaucaaccugagcuucaaggcccuccgcaagaucauccccuuccaguuccagggccagaaguacaucaccgccuccaugagcgugggguacucccugaagcaggagggcaucaagaacaaguuccugcggguccccagccaggaggagaacgugaacgugccggucguggcgcgcgccuucgcccagacccggaaggugaucaacgccgucauccgcgaguacgggcaguucgaccagaucaacaucgagcucgccacggaccugaagaacuccaaguucgaccggagcaagaucgagaagggccagaaggaguuccagucccagaaggacaagguguuccaggagguccaggaccugaccggcgagaucauccccagcuccagccuccugcugaaguaccgccucuggcgggagcaggacgagcgcugcaucuacuccgggcggaagaucagccgcaaggaccugcuggacaccggcuuccucgacaucgaccacaucauccccuacuccaagagcauggacgacggguucaacaacaaggugcugugccuggcggaggagaaccggaacaagaagaacgacauccccuucaacuacuaccagcgcaucggccgggacuggaacuuccucaucuccaucaucgccagcaugaagaacaugaaguacgugaagaagaagcgccugcugaagcaggagcucuccgacaucgagaucgagagcuucaucgagcggaacaucaacgacacccgcuacgccacgcgcuacaucaagaacuuccuggagaacaaccuggaguucaaggagaacgaguucaucaaggccaagguccaggcccggcacgggggccugaccagcgugcuccgcuacaacuggggcaucuccaagaaccgggaggagagcuaccugcaccacgcgaaggacgccaucaccguggccugcuccacccaggggaugguccaguacaucagcaacaucucccagaaguacgagaacggcaaguacaagaugaagcagaucaaggagcgcacggagaaccggaucccgaagcccugggacagcuucaaggacgacguggagcgcuccaucaacgacaucuucgugagcuucgcgccccggcacaaggucaccggguccgcccacaaggagaccaucuacagcaagaagcaccuggagaagggcuacgugaccaucaagaagucccucgacaagaucaagcugagcgaccugaagaacauccccugcgacgagaacugcgacaucauccgcgugcucaaggagcggcuggagaaguucaacgacgacucccugaaggccuucgccgacccgguccacaugcccacgaagugcagcaacaagaaggggcccaucauccgcuccgugaagaucaaggagaacaacaagaccggcaucgaggugcggaagggccucgucgagcgcggggacauggugcggguggacgucuucaucaaggacaagaaguacuaccuggugcccaucuacgugagcgacuucaagaacaaggaccugccgaacaaggccaucgucuccagcaagagcgagaacgaguggaucaugaucgacaagaccuacuccuucaaguucagccucuucaaggacgaccugaucaagaucaagaacaagaagggcgagaucuucggguaccugggcggcgugcaccgccucaccgggggcaucaacaucaaguccugcuacaagcccaaggagaaggacgggaacaucggcagcaagugccugcuggacuuccggaaguuccagguggggauccucggcgacuacaacgaggucaagcacgagaagcgcaugcccgccuacaucaacaccaagaaggacaaggagcacuga

SEQ ID NO: 1457 - RNA, 3123 nt, Artificial Sequence
  Cas9 variant
auggaccgccgggacgcccgcgccaugcggcgccggcgcgaccgguuccagcagcgccagcgggcgcugcucaaguaccugguggccgacggccuguuccccgaggacgagggggagcgcaaggcccucgccgcccuggacccguacgcgcugcgggcccgcgcccucgacgaggcccugagccugcacgagcucggccgggcgcuguuccaccugaaccagcgccggggguucaaguccaaccgcaaggccgaccggaaggccgacgacgacgccggcaagaucgccaucggggucgaccgcgcgcgggaggccauggccgagaacggcgcccgcaccuacggcgaguggcuccaccggcgccgcgccagcgcgaccgacgccaacgccaucccgcccgugcggacgcgccugcggcccgaguccggggaggacgccaagggcgacggguacgacuucuaccccggccgcgaccugcucgaggaggaguucgccgcgaucugggaggcccaggccgcccaccaccccgacgugcugaccgacgacgucuacgagcggcuguucgagaucguguucuaccagcgcccccucaaggcgccccagaucgggaugugcacccugaucgccggcgaccggcgccugccgaaggcccacccccucuuccagcggcgccggcugcuggaggagcucaacgcccugaugaucgugcgccccggcgaggucgcccagcggcugacccgcgaggagcgggacacccucuuccugaagcugaaggaccgcaacaaggugagcuucgagucccuccggaagacgcugaagcuggaccccgacgcgcgcuucaacaaggagagcgagaaccggaccgagcucaagggggacgagguggccgccgccaugggcuccaagacccgcuucgggaaccgcuggguccaccugagcaucgaggagcagugggccgugaucgagcggcugggcgacguggaguccgacgcggaggacgccgccuuccgcgccuggcucgccgagcgguacgagcugacgccggagcagacccgcgcggucaccaacgcgccccugccccagggcuacgggcgguucggcgagaccgccacgcgcaagcucaucgacgcccugcgggacggggagaaggacggccgcgugcugguguacagcgaggccgucaccgccgccgggcucggccaccacuccgaccggcgcaccggcgagguguucgaggacgaggaggggcggccccagcugccguacuacggcguggcccuggagcgccacaucaugcccgggaccggcgaccccagcgacuccgacgagaugcgggucgggcgccucacgaaccccaccgugcacaucggccugaaccagcugcggcgcaucgugaaccggcucauccgcgccuacggcccgcccgcggagaucgccaucgagcuggcccgggagcugaagcugaccgacgaggacaagaagcgcaucaacaaggagaacaacagcaaccggcucgacgccgagcgccgcuccgagaagcugcuggccaucgggaagcccgacaccggcgcgaaccgggcccuccugaagcugugggaggagcucaaccccgccaacguccuggaccgccggugcaucuacagcggggugcagaucuccaucgacaugcuguucagcgccgccguggaggucgaccacauccucccguucacggcgacccuggacgacuccaacggcaacaagaucgugugcacccgcgaggccaaccgggagaagcgcaagcggagccccuacgaggccugggggcacagcgcccgcugggaggagaucgccgcgcgggccgcccagcugccccgcaacaagcgguggcgcuucgagcccgacgccauggagaaguucaaggacgacggcggcuuccaggcgcggcaccucaucgacacccaguaccuggcccgccugucccgggaguaccucgccacgcuguacccggacaagggggagggcagcgggcacaucugggucucccccggccgccugaccgagauggugcggcgcaagcucggccugaacgaccugcuccccgaccacaacuucgggggcggggccgaccaggccaagaaccggcuggaccaccgccaccacgcgaucgacgccguggucguggccaucguggaccgcggcaugcugaaccggaucgcccgcgccagcgggcaggagggcgcggagggccgggagcgcaucaucaucccggagcccugggagggguuccgggacgaccuccgcaccgccgucaacgccaucaccgugucccaccggacggaccacggcaccgccagcaaggccgggcugcccaagggcaaggacgcgaccgccgggcgccugcacaacgacaccgccuacggcuucacgggcgaguccgacgccaaggggaacagcaucgugguccggcgcgugccccucuccagcuucaagaagcuggccgacaucgaccgggugcgcgacccggagcugaaggcggcccucuaccagcaccuggacggccuggaggggaaggccuucgagaaggccaucggcgaguucgggucccgggaguggcaccccuacggcggcguccgccgggugcgcgugaccgagccccucagcgucauccccauccgggaccgcaacgggcacaucuacaagggcuacaagggggacuccaacuaccgguacgacgugugggagcugccgggcgggaagugggugaacgaggucgugagcauguucgacgcgcaccagcccggcuggcaguccgccauccgcgccgccaaccccaccgcccggaaggugcugagccuccaccgcgacgacguccuggcgaucgagcgcaacggcgccgagcgggagcuggugcgcguggucaaguucuccgagaagcaguucgccguggcgcccccgaacgagggcggggcccucaaggcccgggacgccgacaagggggaccccuucaaguacagcuaccccucccccaacacccugaaggcccugcgcgcccgccaggugcggaucgacgagcucggccggguccuggacccgggcuuccccgcccgcacgaagcagcggaagacccgcaagcccaacuga

SEQ ID NO: 1458 - RNA, 3132 nt, Artificial Sequence
  Cas9 variant
augcagcgcgacaacccccugguguaccggcucgcccuggaccugggcagcaccucccucgggugggccgucuuccgccuggacgcggagggcagcccgcuggccaucaucaaggccggggcccggaucuucuccgacggccgcaaccccaaggacgggagcucccucgccgugacccggcgcgcggcccgggccaugcgccggcgccgggaccgccugcugaagcggaaggcccgcaugcucggcgcgcuggagcggcacggcuucuucccccaggacgagagcgcccgcaaggugcuggagacgcucaaccccuuccugcugcgggcccaggggcucgaggucgcccugaagccggaggaguucggccgcgcccuguuccaccucaaccagcggcgcggguuccaguccaaccggaagaccgaccgcaaggacagcgacuccggcgcgcugaagcaggccaucgggacccugcgcgcccagaugcacgagagcggcugccggaccgugggcgagugguucuggaaggugcgcauggagcacaagcccgagggggucaagggccagggggugcgggcccgcuaccgggagacgcccuucaccaccgacgagggcaagaagcgcaucgacaagcgguacgaccucuacguggaccgcgccauggucgcgcaggaguucgacgcccugugggccgcccaggccgcguucaaccccgcccuguucaacgaggccgcccgggccgagcuccgcgacauccugcugcaccagcggaagcuccgcccggugcagcccggccggugcacccuggugcccgaggagccccgcgcgcugcucgcccuguccagcacgcagcgguuccgcaucuaccaggaggucaaccaccuccgggugcugcacgacgagcugcgcgaggagacccugacccucgcccagcgggaccagaucguggcccugcuggagaagcaggcgaaggucaccuucacggccaugcgcaaggcccucggguucuccgcccuguucaaccuggaggacgccaagcgcgacggccucaaggggaacgcgaccgccgccgcccugagcaagaaggaccuguucggcccgcucugggccggguucggcaccgcgcugcaggacgagaucgugacccagcugaugacggaggaguccgagccccggcucaucgccuggcugcaggagcacaccggcguggacgaggcccgcgcccaggccaucgcgaacaccgggcugcccgagggcuacgggagccugggccggaccgcccucgcccgcaucguccccgagcugcagcgggacgugaucacguacgacaaggccgugcaggcggccggguucgcccaccacuccgaccugggcuucagcuucgagcacggcgccgacgaggucgagcgcaucggggagcggaccaucgccuccaccggcgagaucaagccgguguucgcguucaagcagcuccccuacuacgggcgcgcccugcagcggcacguggccuucgccaaggacaacccccgcaacgacgaggagcgguacggcaagaucgccaaccccaccguccacaucgggcugaaccaggugcgcgucguggugaacgcgcucaugcggcgcuacggccggccggccgaggucgugaucgagcuggcccgcgaccugaagcagagccgggagcagaagcucgaggcccagcagcgccaggccgacaaccagaagcggaacgcgcgcauccggcgcagcaucgccgaggugcugggcaucuccgaggagcgcguccggacgcuggacauccagaaguggauccucugggaggagcugagccacgacgccgccgaccgccggugccccuacuccggggugcagaucagcgcguccaugcugcucggcgagcgcguggagaucgagcacauccugcccuucagcaugacccuggacgacucccucaacaaccggaccgucgcccugcgcgaggccaaccggaucaagcgcaaccgggcccccugggaggcccgcgcggacuucgaggcccagggguggagcuacgacggcauccugcagcgggccgagcgcaugccgcuccggaagcgcuaccgguucgcccccgacggcuacgagcgcuggcugggggaggacaaggacuuccuggcccgggcgcucaacgacacccgcuaccugucccggguggccgccgaguaccugcgccucgugugccccggcagcgccacgcgcgucauccccgggcagaugaccgcccugcugcggggcaaguucgggcucaacgacgugcugggccuggacggcgagaagaaccgcaacgaccaccggcaccacgcgguggacgccugcgucaucggggugaccgaccagcgcaugaugcagcgguucgcccaggccaacgcccaggcgcgcgaggacggccucacccggcugguggaggacaugccgcugcccuggcccacguaccgcgaccacgucgagcgggccgugcaccacaucugggugucccacaagccggaccacggguucgagggcgccaugauggaggagaccagcuacgggauccuccgcgacggcuccaucaagcagcggcgcaaggccgacggcagcgcggggcgggagaucuccaaccugauccgcaucgccgagcccggccagccccagcggcacggggucgacgccgagggccgcccccugccguacaagggguacgugggcggcagcaacuacugcaucgagaucaccgugaacgacaaggggaagugggagggccaggucaucuccaccuucgacgccuaccggaucgugcgcgagggcgggcuccggcagcugcgccaccccacgcaggggcagaacggccgggcccuggcgaugcgccucgugaucggcgacagcguccgccuggaggccggggagggcucccugcagacccuccggguggccaagaugagcgccgccggccagguguucaugagcgaggucaaccaggcgaacguggacgcccgcaaccggaacggggaccugcccuacguguccaagauggccggcagcuuccagaaggcccgcgcccggcaggucaccaucucccccaucggggagcugcgcgacccgggcuucaagggguga

SEQ ID NO: 1459 - RNA, 3135 nt, Artificial Sequence
  Cas9 variant
augaaguacacccugggccucgaccugggguacaacagcaucggcugggccauccuggagaacgacgagaacgggucccccaucaagcuguucaacgccggcgugcacaucuucgagccgagcaucgaggacaucgagaucgacgggaagggcaagaccaagaacgucaagcgccgggaggcgcgccugcggcgccggcagcuguuccgcaagacgaagcggcucgagaagcugcugaacuucuucauccaggagggcuucuuccagaaccagaaggugcucaucaacgaccccuucgagcgcgccgaguuccuguaccagcuggacaagaagucccggaaccccuacauccuccgccgggaggcccuggacaaccgccugagccucgaggagaucgcccggaucuucuaccacaucgcccagcaccgcggguucaaguccaccaagcgggagcuggcggagaugaacaaggacgagaagaagaagaaggaggacggcaucauccagagcgagaucaacacccugaaggaggagaucaagaagaacuccugccgcacccucggggaguacuucgccaagcuguucgagaacggcgagaagauccgggggcgccacacggaccggaagauguacgaggaggaguuccagaagaucuucaacaagcagaaggaguucuaccccaacaucuucaccgacgaguucaagaagaagcuguacaagcucaucuuccaccagcgcgagcucaagagccagaaggacaaggugggcuucugcucccuggagcggggcaagaagcgcgccccgcucgcccugcuggucagccagcgcuaccgguacaugugcaaggugaacaaccucaacgugaucgacaccgagaccggggagaaccgcgagcugacggucgacgagaagaagaagcuguacgagaagcucgagaacuccgagaagcugagcuucaaggagaucaagaagauccugaaccucuccgagaagcgguacaucuucaaccuggagaaguccgagaaguacaucaucggcaacaagaccaacgugaagaugaagaacaucaucaaggacugggacaacuucgacgaggacaagaagaacuucuucaucaacgaggcgcgcaccguggucaagaucgagacccuggagcggcgcgggaagaagcucggccugagcgacgaggagagcaaggaguucuccaaggugguguucgaggacggcuaccugaacuucagcaagaaggccgucgagaagcuccugcccuaccugaaggaggggaagaaggaguacgaggccaucaagcucgccuaccccgagaacuccgugcagaacgacaaccugaaggagcuggacuuccugcccccgaucaagagcaaggagcucaagaaguacuucgaggugcggaaccccaucgucgagaaggcccugacggagacccgcuaccucgugaacuuccugaucaagaaguacggcaagcccgagaccaucaagaucgagcuggcgcgggagcugaagcucagcaacaagcagaaggagcgcaagcacaaggagaaccaggagaaccggaagaagcgcgaggaggugaucgagaagcugaagaacgaccugaagaucuccgagcccaccgagacgcagauccagaaguaccuccuggccgaggagugcgacugcaagugcccguacaccgggcggagcaucuccauggacagccuguucggcgagcacccccucuucgacaucgagcacaucauccccuucgaccgcucccuggacaacagcuuccugaacaagacccucugcuacuccgaggagaaccggaaggucaagcacaacaagacccccuacgaggccuacuacgggacggagaagugggaggccaucaucgagcgcgugaagaaguucaagagcaacgugcggaacgagaagcugcgccgguuccagaugaccaaggaggacgucgagaacuacauccagaacuucuccacccagaaccugaacgacaccaaguacgccagcaagcucgcgaagaaguaccugggccugcucuacggcuccaucaacgaggacgggaucgacaagaaccgcaagcgccggaucuucgccagcuccggcaaggugacgagcacccugcgcuacgcccuggggcucaacaccauccugaacgacgagaacaucaagacccgggaggaccaccgccaccacgccaucgacgccaucacgaucgcgcugaccgacuccagcaugaucaagaagaucuccgacgccagcaagcgggagaagaacaucaacucccucuucaaggacuuccaggccccgugggagaacuuccgcaaggagguggaggagaucaucgccaagaugaacaucagcauccggaucaacaagaaggucagcggccagauccacgacgagaccuucuacaagaagcccuucaaggaggaggagaaguccuacacccaccagcgcaucaaccuggaggagcugacgaucaaggacgaggacaagaagaagcagagcuccaagcucaucgacaacaucguggacagcaagauccggaacaucaucaucaacucccugaacggggagaagcccaagauccgcuucaaggaccccaaggaccacccguacaucauccagaagaacggcaagaagauccagauccacaaggucaccaucaagaccaagcuggagaccuacaacgagaucggccccgagaaggccaagcgguacgucaagagcuccgacagccaccacaucgagaucuucgaggaccucaagacgaagaagugggacggguacguggugucccugcuggaggcguacgagcgcaagaagaagaagcuccccaucgugaacaagaaccugggcgaggggaagaaguuccuguucagccucgccaagggcgagaucaucgagcuggacaccgagaacgggaagcgggagcuguucgugguccgcaucaucuccgccagcaacaaccagaucaaguucacccggaucaacgacucccgcaagaucaccgacauccccgccaccggccucacggcgugcccgagcucccugaagaagcggaacugcaagaagguggugaucaacauccugggcgagaagcacuacagcaacgacuga

SEQ ID NO: 1460 - RNA, 3135 nt, Artificial Sequence
  Cas9 variant
auggccgagaagaaguucaaguaccgccugggccucgaccuggggaccaacagcaucggcuggugcaugcugcggcucaacaaggacaacgagcccgccgcggugaucaaguccgggguccgcaucuuccacgacggccggaacgagaagaccaaggagccgcuggccguggugcgccggaacgcccgcagcauccggcgcaaccuggaccggaagaucucccgccggaaccaccuccugaacacgcuggucaaguacuuccuccugcccagcaacgagaucgagcgcaaggcccuggccgugcucaaccccuacgagcugcggucccgcgcggugaacgagcggcuggagcuguucgagcucgggcgccugcucaugcaccugagcaagcggcgcggcuucaaguccaaccggaaggucgacaaggaggacagcuccggcaagaucaagcccgccaucgagcgccugaagaacaagaugcaggagaccaacaagaagaccgccggggaguaccucuacagccugaugcagaacggcaagccggugcgggcccgccuggggcgcaucgacggcuccaacggguacgagaucuaccucgaccgggcgcugaucgaggaggaguacaaccugaucaugaacgagcagaagaagcaccacaaggagcucaccgacgacaucaucaacgagaucuucaacaucaucuucuaccagcgcccccugaagaagcagaucaucggcaagugcagccugacgggcgaggacaccaagcucaagaaggcccacgugcuggcccaggacuucauccugcuccagaagguccaggaccugcggguguucgacgacaaccagcuggaguuccgcccccucuccaacgacgagaaggacaucaucaagcgggagcugcgcaagaagaaggaggugagcuacgagaacauccggaagcugcucaagaaguacuacgagaacgucaaguacgggauguucucccacgagacccuguacaagaagcugcagggcaacaagaccaacgcccucaugagcgacaaggagaucaucggggacuccugguacagccugucccccgaggugcaguacgacaucaucgaggagcuguacagcgacaaggacaacgacgagcucagcaagcuguacuccgagaaguucaaccugaacgagagccagaucaacggccuccugaacaaggccaucuaccgccuggacuccggcuacauccgguacgggaagacggcggugaccaaccugaacagcaucauggacaaggacaaccucaaccugcacgacgcccgcgaggaggccggcuacgagaaggagaacaagcaggacgccuccgaguaccuggaguacuacgggaagguccucccggacagcgugguggacccccagaucgagaaccccaagaacgacgaggagcgguacggcaagaucgccaaccccaccguccacgcggcccugaaccagcugcgcaagcucgugaacgagcugaucaagcuguacgggaagccggagcagaucgugaucgagcucgcccgggaccugaagaacucccgcaaggccaaggacgucaucaacaagaagaucgccgagaaccggaagcugaacgaggagguggacaagacccuccaggaguacagcgagaaguacaacacgcacaucgugaagaacaagcugaaccgcgacaaggucaagcuguggcgggagcucggcaaggacccccuggagcgcaagugcaucuacaccggcgagcagaucaacaucgcgaagcuguucuccgacgaggugcagaucgagcacaucguccccuacagcaagacccucgacgacuccuucaacaacaagacccugagcaugaagcaggccaacuacuacaaggggaacaagacgcccuacgaggccuucaaggacuccaaggacggcuacaacuacgacgacaucaucgcccgggccaagcugcucaacaacgacaacaaguucaagcgcuucaccaaggacgcgauggacaucuacaaccgcgacgggaaggacuucaucgcccggcagcugagcgacacccaguaccuguccacccgcgcccucaucuaccugcagagccuguacgagaaggcccaccacuccagcaucuggacgaucccgggccagcucaccgcgcugauccggaacuaccuggggcucaacacccugaucuccaacgacaagaacaagaaccgcaacgaccaccggcaccacgccguggacgccuucguggucgccgugaccagccgcagccugcuccagaagaucuccuacgccgcgagccugcaggaggaccuggacaaccggaacguguccagcuaccgcaacaagcuccuggagaagaugcccgagcccuuccccaacuaccggaagucccuggagcucgccaucgacaacaucaagacgagccacaaggccgaccgcuccaucagcggcaagcugcacgaggacaccgccuacggcaucgucgagaacgacgacaaguacaacguggugacccgguggaccgucgacaaguucaaggagcagaagcacuucgagacgauccgcgacaacgagcugaaggagaucgccugcuccgacaaggagcuguucgcgaagaucguggagacccggaagaucaagagcauccgcaagcucgccaaggagaacccggugaucaagaucaaggacaaguccgggcgggacuacaaggccuucgccggcgggaacaacaucugcgucgagaucuacgagguggacggcgugcgcaagagcgaggucauccagcuguucgacgccgcgcagaagggguucaugcccgaguggaugaagaaguaccccaacggcaagcuccugaugcggcuguucaagggcgacgugaucggguucaucgagaaccgcaaguacaacuacuacaccaucaagggcaucuccaucgccgaccagaaccucaagcugcuggccaucaacaaggccgaggggaucuucaagaagggccucaacauccuguucgacagcaacaacaagaacucccugaacgcgaagcaguucaacaucagcgugaccggcaucgucacgaagaagaagaccgccgacgugaacuucuggaagaaccggaaguga

SEQ ID NO: 1461 - RNA, 3135 nt, Artificial Sequence
  Cas9 variant
augcugcacaagaugcgcuaccggcucgcccuggaccugggcagcaccucccucgggugggccauggugcgccugaacgcgaaccagcagcccugcgccgucaucaaggccggcgugcggaucuucagcaacgggcgcaacccgaaggacggcuccagccuggccgugacccggcgcgaggcccgguccaugcgccggcgccgggaccgccuccugaagcggaaggcgcgcaugaugcggacgcugaucgaguacggguucuuccccgccaacgagacccagcgcaaggcccucgagaaccugaaccccuacgcccugcgggcgaagggccucgacgaggcccugacccccagcgaguucgcccgcgcccuguuccacaucaaccagcggcgcggcuucaaguccaaccggaagaccgacaagaaggacagcgacuccggggcccucaagacggcgaucaagcagcugcacagcguccuggacccgcagggcaacgacgggaagccccgcaccgugggcgagcuccuguacaagcgcuucaccgaccuguccaagcuccccaaggaccggaccgugcgcgcccgguaccgccaggacaagaucgucaaggacgacgggaagacgaagaucgacaaguacuacgaccuguacaucgaccgggccaugaucgagcaggaguucgacgcccuguggaagaagcagagcgagcucaaccccauccuguucaccgagaacgcccgcgcggaccugaaggacgugcuccuguaccagcggucccugaagccggugaagcccggccgcugcaccuucaugagcgaggaggagcgggcgccccucgcccugcccuccacccagcgcuuccggauguaccaggaggucaacaaccugcgcauccuccgggagggccugaaggaggagagccugacgcuccagcagcgcgacgaccugaucaacgcccuggagaagaacaaccggcgcaccuucacccagaucaagaagcuccugggggugggcggguccgugcaguucaacuucgaggacccgaagcgggaggagcugaagggcaacaccacgagcgccauccucggcaaguccgagcacuucggggaggccugguucgccuucaacgaggccaagcaggacgccaucguccugcagcugaucaaggaggagaacgaggccaagcucgugcgcuggcugcaggacgagaccggcaucgacgagaagcgggcggaggugaucgccaacgccgggcugcccgagggcuacgggagccucugcaucgaggcccuggcgcgcauccugcccgagcugcgccgggacgucgugaccuacgacaaggccgugcaggccgccggcuucgagcaccacagcaagcucaaccgcaacgaggagauccccgacaucaccuucaagaucgaguccaucgaccggaacagcggcgagaucaagcaguuccaccuccacaaggagcugccguacuacggggaguaccugcagcgccacgucggcuucggguccggcaagcccgaggacagcaucgagaagcgguacgggaagaucgccaaccccacggugcacaucggccugaaccaggugcgcgucguggugaacgcgcugaucaagcgguacggccaccccuccgagaucaucgucgagguggcccgcgaccucaagcagagcaaggaccggcgcgacgaggagaacaagcggcaggccgagaaccagaagcgcaacgagcggcugcgcaaggacaucgccgacauccuggggaucuccgaggagcggguccgccgggacgacaucgagaagaugauccucugggaggagcugagcuucgacccggccgaccgccggugccccuacuccggcguccaggugagcaccgugaugcugcucuccgacgagguggagguggagcacauccugcccuucagccagacccuggacgacucccucaacaacaagaccgucgcgcugcgccaggccaaccggaucaaggggaaccgcacgcccugggaggccuucggcaccagcaacaucuccggguucgacuacagcggcauccugacccgcgccgagcucaugccgaaggccaagcgguaccgcuucgcggaggacggcuaccagcgguggcugaaggacgacgccggguuccuggcccgcgcccucaacgacacccggcaccuguccaagaucgcgcgcgaguacaugagccugaucugccccaacacgcgggugauccccggccagaugaccgccaugcuccgccggaacuucgggcugaacgacgugcugggccucaacggcgagaagaaccgcaacgaccaccggcaccacgccgucgacgccugcgugaucgccgugaccgaccaggggcugcugcagcgcuucgcggccgccuccgccagcgcccgggagcgccagcucaaccggcuggucgagaacaugccccugccgugggagagcuaccgcgagcacgugcggcgcgcgaucgacggcaucugggugucccaccggcccgaccacagccacgagggggccaugcacaacgacaccgccuacggccuccgcgggaacggccgcgucuccuuccacaagaugguggagggcaagcgggaguacaucgaggacaaccugaaggugaucgagaucacggacaccaaggccaucgaccgccacgggcugcuccccaccggcaagccgcggcccuacaagggguacaagggcgacagcaacuacugcaucgagaucguccgcaacgagaaggggcggugggagggcgagaucaucuccaccuucgacgccuaccagcuggugcgcaaguacggcaucgugcagcugcgguaccccguccucagcguguccgggaagccccuggugaugcgccugauccggaacgacuucguccgccucgagcacgagggcaucacgcggacccugcgcgugugcaagaugcgggaggacgggcaggucgcgcuggccgacgugaccgaggccaacguggacgcccgcacccggaccaaggagaucugcuacguguucaagacgggcgggagccuccagaaggcgaaggcccgccggaucaccaucuccccgaucggcgagcugcgcgaccccggcuucaaggaguga

SEQ ID NO: 1462 - RNA, 3138 nt, Artificial Sequence
  Cas9 variant
augcagaaggagaagccccuggccuaccgccucgcccuggaccugggcagcaccucccucgggugggcggugcugcggcugagcgccccgggcgagcccuccgccgucauccgcgccgggagccggaucuucuccgacggccgcaaccccaaggacgggagcucccucgccgugacccggcgcgcggcccgggccaugcgccggcgccgggaccgccugcugaagcggaaggcccgcaugcucgcggcccuggagcggcacggcuucuucccccaggacgaggccgcccgcaaggcccuggagaagcucaacccguacggccugcgggcgcgcgggcuggagagcgcccucaagcccgaggaguucggccgggcccuguuccaccugaaccagcgccggggguuccaguccaaccgcaagacggaccgcaaggacagcgacuccggcgcccucaagcaggccaucgggacccugcgggcgcagaugcacgagagcggcugccgcaccgugggcgagugguucuggaagguccggauggagcgcaagcccgagggggugaagggccagggggugcgggcccgcuaccgggagacccccuucacgaccgacgagggcaagaagcgcaucgacaagcgguacgaccuguacgucgaccgcgccaugguggcccaggaguucgacgcccucugggcggcccaggccaccuucgccccggcccuguucaacgaggcggcccgggccgagcugcgcgacauccuccugcaccagcggaagcugcgccccgugcagcccggccggugcacccucguccccgaggagccgcgcgcccugcuggcgcuccccuccacgcagcgguuccgcaucuaccaggaggugaaccaccuccgggugcugcacgacgagcugcgcgaggaggcccugacccuggcccagcgcgaccagaucgucgcccuccuggagcggcaggccaaggugaccuucaccgcgaugcgcaaggcccugggguucagcgcccucuucaaccuggaggacgccaagcgggacggccugaaggggaacgccacgaccgcggcccucggcaagaaggaccuguucgggccccugugggccggcuucgacaccgcccuccaggacgagaucgugacccagcugaugacggaggaguccgagccccgccugaucgccuggcuccaggagcacaccggcgucgacgaggcgcgggcccaggccaucgccaacgcggggcugccggagggcuacgggagccugggccgcaccgcccuggcccggaucgugcccgagcuccagcgcgacgugaucaccuacgacaaggccguccaggccgcgggguucgcccaccacuccgaccugggcuucagcuucgagcacgacgccgacgagguggagcggaucggcgagcgcacgaucgccuccaccggggagaucaagcccguguucgccuucaagcagcugcccuacuacggccgggcgcuccagcgccacgucgccuucgccaaggagaacccgcggaacgacgaggagcgcuacgggaagaucgccaaccccaccgugcacaucggccugaaccaggugcgggucguggucaacgcccugaugugccgcuacgggcggcccaccgagguggugaucgagcucgcgcgcgaccugaagcagagccgggagcagaagcuggaggcccagcagcgccaggccgacaaccagaagcggaacgcccgcauccgccggagcaucgcggagguccucggcaucuccgaggagcgcgugcggacgcuggacauccagaaguggauccugugggaggagcucagccacgacgccgccgaccgccggugccccuacuccggcgugcagaucagcgccuccaugcugcugggggagcgcgucgagaucgagcacauccucccguucagcaugacccuggacgacucccugaacaaccggaccguggcccuccgcgaggcgaaccggaucaagcgcaaccggacccccugggacgcccgcacggacuucgaggcccacggcuggagcuacgacgggauccugcagcgggccgagcgcaugccccagcggaagcgccaccgguucgcccccgacggcuacgagcgcuggcugggcgaggacaaggacuuccucgcgcgggcccugaacgacacccgcuaccugucccgcguggccgccgaguaccuccggcuggucugcccggggagcgccacccgcgugauccccggccagaugaccgcgcugcuccgggggaaguucggccugaacgacgugcuggggcucgacggcgagaagaaccgcaacgaccaccggcaccacgccgucgacgccugcgugaucggcgugacggaccagcgcaugaugcagcgguucgcccaggccaacgcgcaggcccgcgaggacgggcugacccggcuggucgaggacaugccccucccguggcccaccuaccgcgcccacguggagcgggccgugcgccacaucugggucucccacaagcccgaccacggcuucgagggggcgaugauggaggagaccagcuacggcauccugcgggacgggacgaucaagcagcgccggaaggccgacggcuccgccggccgcgagaucagccggcugauccgcaucaccgagcccucccagccgcagcggcacgggguggacgccgagggccgcccccuccccuacaagggguacgugggcgggagcaacuacugccuggagaucaccgucaacgacaagggcaagugggagggccaggugaucuccaccuucgacgccuaccggaucgugcgcgagggcgggcugcgccagcuccggcacagcacccaggggcagaacggccaggcgcuggccaugcgccuggucaucggggacuccgugcggcucgagguggacgagcaggagcgcgucaugcggaucgugaagaucaacggcaacaacggccagguguucauggcccccguccacgaggccaacguggacgcccgcaacagcgacaagaacgaggcguucgccuacacgagcaagaucgccggguccuuccagaagaccaaggcccgccaggugaccaucagcccgaucggcgagcugcgggaccccggguucaagggcuga

SEQ ID NO: 1463 - RNA, 3138 nt, Artificial Sequence
  Cas9 variant
augaagccccgcaaccugaacuacauccucggccuggaccuggggaucgccagcgugggcugguccgucguggagaucgacgagaacgaguacccgauccggcucaucgacguggggguccgcaccuucgagcgggccgaggugcccaagaccggcgagagccuggcgcuggcccgccggcucgcccgcuccacgcggcgccugauccggcgccgggccuuccgccugcucaaggccaagcggcugcugaagcaccaccagaucgugaacgcggaggagcucacccagcugcccaaccagugcugggagcugcgcgucaaggggcucgacagccugcuguccaacaccgagugggccgccgugcuccugcaccuccucaagcaccggggcuaccugagccagcgcaagaacgaggcccagaacgcggacaaggagcugggcaagcuccgggaggggauggacaacaacuccaagcugcugcucgagaacaacuaccgcacccccgccgacaucgccgugaagaaguucgccgucgaggagggccacaugcggaaccagcgcggggccuacacgcacaccuucaaccggcuggacauccuggcggagaugcagcuccuguucaagacccagcgcgagcugggcagcaccuacgccaacggggagcucgagcaggccuucugcgagcugcugcucuggcagaagcaggcccugaaccgcucccagaugcugagccucgugggcaagugcacguucgagaaggaggagaagcgggccgcgaaggccuccuacagcgccgagcgcuucguggccauccagaagcugcagaaccugcggauccucgagaacggcgaggagcgcgggcuguucgacuccgaguucagccugcuccuggagaacgccuacaaccugaaguccggccucaccuacaagcagguccggaagauccugagccuguccgagaacgcgaucuucaaggggcugccguaccucagcgacgaccuggagaagcccgagaagacccaguuccuggccuucaaguucuaccaccagcucgccgacauccugaagaacaacggcuucuccgacgaguggcagaagcugagccaggagcccacccuccuggacaagcugggcacggagcucagccugugcaaggaggagaacgaguucaucgcccaguucaacggggagcugcccgaggccaugcucuccacccuguucaaccacaccaacuucgacaaguucauccacaucagccugaaggcgcucaacaacauccugccgcugauggagcagggcaacgacuacaccaaggccuggcgcaagguguaccccgagcccacgaagaaggacgagaagacccugcccccgauccccgccgacgagauccggaaccccgugguccugcgcucccugagccaggcccggaaggugaucaacgcggugauccgccucuacgggucccccgcccggauccacaucgagaccgcccgcgagcugggcaagagcuacgacgaccggcagaagaucaagaagcagcaggacaagaacuccgacgagcgcgaccaggccgucaagaaguuccuggaggagugcccgaacuucgccaacaaggugaaggggaaggacauccucaagauccggcuguacaucaaccaggacggcaagugccuguacagcggcaagccccucgacccccaccgccugcuggagaucggguacguggagaucgaccacgcgcuccccuucucccggaccugggacgacagccagaacaacaagguccuggugcuggccaacgagaaccagaacaagggcaaccagacgccguucgaguggcucgggaaggacgagcaccagugggcccuguucguggcccgcgucaacggcugccgguuccccuacgccaagaagcagcgcauccugaccaagaagcucgacgagcagggguuccugaagcgcaaccugaacgacacccgguacguguccgcguaccucaugaagcacaucaaggagaaccugcaccuggucggcaagggcagcgacaagguguucgccuccaacggccaggugaccaacuuccuccgccggugcugggggcuggagaagaagcgcgaggagggggaccggcaccacgcccuggacgccaucgucguggccugcagcacggcguccaugcgccagaagaucacccucuucaagaaguaccagcgguggaaccugaagaccggcaagcacaucgaccaggagaccggggagaucaucccccugcacuuccccgccccgugggacuucuuccgccaggaggugaugauccggaucuucagcgagaugccccaggaggaccucaucaugcagcugcccgaccgcccccaggccaaccacgaguucguccagccgcuguucgugucccgggcccccagccgcaagauguccggccagggccacgaggcgaagcuccggagcgcccgcaugcuggaggccacgggcaagagcaucaagaaggaguuccugaccgaccucaccaucaagaaccuggagcacauggugaacaaggagcgggagcccgagcuguaccaggcccucgucgagcacuucaagaaguacggggacaagccgaaggagaaguucuucaagaagggcgggguggaggugaaguccauccgcaucagcaagacccagaacaaguccgucaaccugggcaacaagacgaucgccgacaacggggacaucgugcggaccgaccuguuccucaagaacaagaaguacuacuucgugaacaucuacgcguggcaggucagcaagggcauccugcccaaggagaccaccacggggaacauccuggacaacuccuacgaguuccaguucagccucuucaagaacgaccugcuggagaucccccaccccaagaacgagaacgacuccauccucgccuacuucauccgcccggacgacgagcggcgcuggauccugaaguuccacgacaacgccaagauccccgacaucuacggcaagaaggacgagaccagcauccggcuguccauccaggggcagaaguucaucaagaaguaccagguggacgagcucggcaagaacauccgccccugccgccccaccaagcggcagggcgugcgcuga

SEQ ID NO: 1464 - RNA, 3141 nt, Artificial Sequence
  Cas9 variant
augaagaucuacagcuucgacaucggcguggccuccaucgggugggccuucaucgagaacgagguccugcaggacugcggcauccgcaucuucaccaaggcggagaaccccaagaacggggccagccucgcccugccgcggcgcgaggcccggggcgugcgcaagcggcuggcccgccggcgcgggcggcucaacaccaucaagcagcugcugugcaaggaguucggccuccagcuggaggacuaccuguccaacgacggcgagcuccccaaggcguacacggccagcaaggccaacccccugaagucccccuacgagcugcgcacccucgcccugagccagaagcuggacuccaaggaccucgugcgggucauccugcacaucgcgaagcaccgcggguacggcaacaagcacgccaaggacagcaaggacaccgaguccgggaaggugaagaaggccaucgaguucaaccggaagacccuggccgagaagggcuaccgcagcgugggggaguaccucuaccgggaguucuuccagcagucccgcaucagccagaacaacggcgccacggaguucgucaacgugcggaacaagaccggcaacuacgagcacugcguggcgcaggacaugcugaaggacgagcuggagcucaucuuccgcaagcagaaggagcuggggcugcaccucuccgacggcuucgagaagcagcugcuggacaagaucuucgagcagcggccgcucaagagcuucgccgacaaggucgggaagugccaguucaucgccggcgccaagcgcgcccccaaggacuccaucagcgcgaucgaguucguggcccugucccggaucaucaacacccuggccaaccucagcaagaaguccggcgagauguacgacaaggccauggugcugaccauccuggacagcguccucgagaagggggagaugagcuacuacgcccugcgcgaggcgaucaaccuggacgagaagauccgcuucgccgacucccggcucgacuacagcaaggagaucaaggagacggagaaggugaaguucguggagugcaagaaccugaaguccuucaagaagguccugggcaacugcuacaagacccucgagcgcaagcacaucgacagcaucgccgagcggaucgccgugaucaaggacguggagaagcugcacaaggagcuggaguccuacugcgccaccgagcagcucagccugaccuccgagcagauccaggcgcugagccaccucaacuucuccagccacaucucccugagccugaaggcccucgagcagauccugcccuucaugcgcggggagcgggaggcccgcuccagcgacgccgacuacugcaucggcaucgacgaguccggggagagccagugccugcgguacgacgaguccgucgagaaggcgggccugaaggcccucagcaaggacacgcugaagggccagauccugcccccgcucaacgaguucgagcccuaccuggccaaccccgugguggcccgcgcccuggcggaguaccggaagguccucaacgcccugcugaagcaguacgggagcccccacaagauccacaucgaguacgcccgcgaggccaagcucaacaccaccgagcggcagaaguacgagaaggagcagaaggacaacuacgccgcgaaccaggccgcccacaagaagugccaggagcugggccuggagccgagcagcaccaaccuccugaagcugaagcucuggcaggagcagggcgggcugugccuguacuccggggccaagaucacgaucagcuaccuccaggaccccaccgcccuccagguggaccacaucuaccccuacucccgcagcuucgacgacuccuacaugaacaagugccuggugcucaccaaggcgaaccaggagaagggcaaccggacccccuucgaggccuucggcacggacagcgccaaguggggcgucaucaccacccuggcccagaagcugccgcacaagaagcgccggcgcauccucaacaccgcguucaacgacaaggaggccggguucaagcugcggaaccugaacgacacguccuacaucgcccgccucguggccgacuacaccgagaccuaccuggaguuccugagccucgucgaguccgagaacaccacgcuggggaagggccagaaggggagcaagaagcacaucgccaucgugaacggcgcgcugaccuccaccaugcgguacuaccucggcuucgccagcaaggaccgcgacaaccaccuccaccacgcccuggacgccgugaucaucggguucaugaacgacuccgucaucaaggccuucagcgacuucaagaagacccaggagacguccaaggcggccuacuacgcccacacccugagcaagcaggaguacaagaagcagcgcgccuucauccagcugcccuccggcgagaacuuccgggccaacgugcuggagaaggcggagagcguguucgucagcaagccgccccgcaagcgggugcgcggggcccuccacgaggaguccuucuacagccagaacgacaccaagcugcugaaguccuacggcggcgccgaggggaucgagaaggcccuccagcugggcaagauccggcagaucgggaccaagaucgugagcaacggcgcgaugguccgcguggacaucuucaagcaccggaaguccgggaaguucuacggcgugcccgucuacacgauggacuucgcccugggcauccuccccaacaaggccguggugcaggggaaggacaagaacgacgucaucaaggacuggcuggagauggacagcuccuacgaguucaucuucagccuguacaaggacgaccuccugcuggugcagaagaaggagauggccgagcccgagcucugcuacuucguguccuucgacaccagcggcgccuccaucaaggucgcgaagcacgacaacaacuucagcacccugaccgagaaccagaagcugcuguucuccaacgccaccaaggaggaggugguggggaaguccaucggcauccagaaccugaaggucuucgagaaguggcaggucuccgugcugggggaggugaagcgcacgcagagcuacccccgggagaacaucucccucgccagcaaggccaagaaguga

SEQ ID NO: 1465 - RNA, 3144 nt, Artificial Sequence
  Cas9 variant
augaagcugcuccgcuacauccugggccuggaccucgggaucgccagcgugggcugggccaucgucgagaucgacgagaacgacuuccccauccggcugaucgacaucggggugcgcaccuucgacaaggcggagguguccaagaccggcgagagccuggcccucgcccggcgccuggcccgguccacgcgccggcugauccgccggcgcgccuuccggcuccugaaggggaagcgccugcucaagcagcacaacgucaucaacaaggaggcgcugaccacccugccgaccgacugcugggcccuccgggugaagggccuggacgagcgccugagccccacggagugguccgccgugcuccugcaccuccucaagcaccggggcuaccugagccagcgcaagaacgaggccaaguccgcggacaaggagaugggggcccugcucagcggcgucgccuccaaccaccagcugcugguggagaaccaguuccggacccccgccgagaucgccgugaagaaguucgcgcucgaggaggggcacauccgcaaccagcugggcgccuacacccacaccuucaaccggcuggaccuccuggccgagaugaagcugcuguuccagacgcagcgcgagcuggggaacccccacaccagcggccagcuggagcaggaguucugcgagcuccugauguggcagaagccggcccuguccggcgacgccauccucaagaugcuggggaagugcaccuucgagaccaacgaguacaaggcggccaagcacagcuacacggccgagcgguucgucuggcugaccaagcucaacaaccugcgcauccuggagcacggcuccgagcgcgugcucaacaccgacgagcggagccugcugcucaaccagcccuacgagaaggccaagcugaccuacacccaggugcgcaagcugcuggggcucuccgaggaggcccgguucaacggcguccgcuacggcaaggagaaggcggaggacgccacgcugaucgagcugaaggccuaccacgccauccggaaggccguggagaaggcggacaagagcgccugggagacccucaagaaccagaccgcccugcuggacgagaucgggacgaccuucuccaucuacaagaccgacgacgacaucaccgagcagcucaacggcaagcugagcgacacggugcugaacgcccuccuggagaaccugaacuucgacaaguucauccagcucucccucaagagccuguacaacaucgucccccucauggagcaggggcugcgcuacgacgaggcgugccagcagaucuacggcgaccacuucgggaagaaguccggcgagaucaaccggcugcugcccccgauccccgccgacgagauccgcaaccccguggugcugcggagccugacccaggcccgcaaggucaucaacgccgugauccggcucuacggcagccccgcccgcauccacaucgagaccgcgcgggagcuggggaaguccuacaaggaccgcaaggagaucgagaagcggcaggagcagaaccgcgccgagcgggagaaggccaccgcccaguucaagacgcuguucccgaccuucaucggcgagcccaaggggaaggacauccucaugaugcgccuguacgagcagcagaacggccagugccuguacagcgggaagccccucaaccugaaccggcugcucgagaagggcuacguggagaucgaccacucccugcccuucagccgcaccugggacgacucccagaacaacaagguccuggugcucgccggcgagaaccagaacaaggggaaccagaccccguucgaguggcugggcaaggacgagcaccagugggcgcuguucguggcccgcgucaacgggugccgguuccccuacgccaagaagcagcgcauccucacgcagaagcuggacgagcagggcuucaucgagcggaaccugaacgacacccgcuacaucgcccgguuccucgugaacuucguccgcgagaaccugcaccugaccgggaagggcaagaaccggguguucgccagcaacggccagaucaccgcguuccuccgcgggcgguggggccuguccaaggugcgcgaggagagcgaccggcaccacgcccuggacgccgucgugguggccugcuccacggucgcgaugcagcagaagaucacccgcuucgugaaguaccaggaggggaaccuccagaccgccgagcggaucgaccgcgagaccggcgagaucaucccccugcacuuccccgacccguggcacuucuuccggcaggaggugaugauccgcaucuucagcgagaacccccaggaggaccugaucauccagcuccccgaccggcccgaggccaaccacgaguucguccagccgcuguucgugucccgcaugcccacccggaagaugagcggccaggggcacauggagacgaucaaguccgccaagcgccuggacgagggcaucagcguguccaaggucccccucacccagcugaagcugaaggaccucgacaacauggugaaccgggagcgcgagaaggcccuguacgaggcgcugaaggcccgccucaacgccuucaacgacgaccccaccaaggccuucgccgagccguucuacaagaagggcgggcagcaggucaaggcggugcggguggagcagguccagaaguccggggugguggugcgcaacggcaacggcgucgccgacaacgccagcauggugcggguggacgucuucaucaagggcgggaaguacuuccuggugcccaucuacaccuggcaggucgccaaggggauccugcccgaccgcgccgugguggcggccaaggacgagagcgagugggagcucauggacaagacggcccaguuccuguucagcauguucccgaacgaccugauccaggugaagaccaagaaggagaccuucuucggcuacuacaacgggcucgaccgggccaccggcgcgaucaaccugaaggagcccgacuccaacaucaacaagggcaagagcgggcugcaccgcuccaucggcgucaagacggcccucagcguggagaaguaccagguggacgagcuggggaagaacauccggcccugccgccccuccaagcggcaggccguccgcuga

SEQ ID NO: 1466 - RNA, 3147 nt, Artificial Sequence
  Cas9 variant
augaagcgccugggccucgacaucgggaccaacagcaucggcuggugccugaucgaggacgacggggacggcaaggggcggaucaucgacaucggcgcccgcaucuucuccgacggccgggaccccaagagcggggccucccuggcgguggaccgccgggccgcccgcgccaugcggcgccggcgcgaccgguaccucggccgccggaccgccuuccugaaggcgcugaagcgcuucgggcucaugccggccgacgagagcgccgccaagcugcuggcggaccgggaccccuacgagcuccgcgcccgggcccuggacgagcgccuggagccccacgagaucggccgggcccucuuccaccugaaccagcgccggggguucaaguccaaccgcaaggccgagcgcaagacgaaggacgcggaggacggcaagaucgccaacggcgccaaggcccuggaccaggccauggcggagagcggggccgagacccucggccaguuccuguccagccgggacaccaagcgcguccggaugggguccgacgcccagggcuacgacuucuacccccagcgccggcacguggaguacgaguucgacaccaucuggagccgccagcagcagcaccacccggcccugcucacggaggaggcccggaagaagcugcacgacauccuguucuuccagcgcccccucaaggagcaggaggugggcgucugcaccuucgugcacaacgagugccggcugcccaaggcgcacccccuguuccaggagcgccggcucuacgaggaggugaaccagcuggagaucaccaccccgggggcccccaaccgcaagcugacgauggacgagcgggacgcccucauccuggagcugcgcucccggaaggagcgcagcuucgacucccucgccaagcggcugaagcuggcccccggccagagcuucaacaaggcguccgagagccgcacccggcuccgcggggacgaggucuacgccgugauggcccacaagaagcgcuucggcgaccgguggccccaccuggaccgcgaccggcagugggccaucaucaagcgcaucaucgaggaggaggacccggacaagcugcacgcguuccucaccggggaguggggccugaccgacgagcaggcccuggccacggcccgggcgccccuccccgagcuguacggccgccuggggcccaccgccaccgcccggauccucgaggagcugaagaaggacgugaucaccuacgacgaggccguccgccgggccggcuggcaccacuccgacgaccgcacgggggagauccugccgcagcuccccuacuacggcgagcugcugacccgggacaucccgcccgggacccaggaccccaacgacccgcccgagcagcgcuggggcaagaucaccaaccccacggugcacaucggccuccggcagcuggagaagcuggugaacgccaucaucaagguccacgggcgccccgaccagaucgugguggagcuggcgcgggagcucaagcugaacgagaaggacaaggaggagcacaaccgccggauccgccgggacaccgccgccgcccagcugcgcagcgccaagcuccaguccgagggcauccccgacaccggggcgaaccggaugcugcugcgcaucugggaggagcucaaccccggcgagguccuggaccgccggugccccuacugcggggagccggugggcaugcgcaugcuguucgccggcgaggccgacaucgaccacaucauccccuacagccggagccucgacgacuccgccgggaacaagguggucgcgcaccgcagcugcaaccgggccaagggcaaccgcacccccuacgagaagugggugcacgacccggaccggugggacgugaucuccacgcaggucgcccgccugcacaagagcaagcaguggcgguucgggcccgacgccauggcccgcguggagaaggacggcggcuucaucgcgcggcagcugaccgacacccaguaccucucccgccuggccgggcgguaccugagcucccucuaccccaccaaggacgacggcagcguguacgucauccccgggcgcaugacggccaugcugcggcgccgguggggccugaacucccuccugccggaccacaacuucguggacaacgagcacagcaacgcccccaagaaccgccuggaccaccggcaccacgccaucgacgcggccgucguggccgugaccacccgcgcccucaugcaggagaucgcccgcaccgcggggcgggccgaggacaaggaccuggaccgccuguucgaggaccucccccagcccugggagggcuuccgggaggagcugggcgagaagcugguccgcgugacggugucccacaagccggaccacgggcggaagggccucccgcccaagaaccgcgacgucaccgccgggcggcugcacaacgacaccgccuacggccugaccggggacguggcggccgacggcaagacgcccaucgugguccaccgcgugccccucaugagccugaagcccgccgacaucuccgaccccgaccggauccccgacccggcccugcgcagcgcccuccaccgggcgaccgacggccuguccgggaaggccuacgacgccgcccuggccggcuucgcgaagacccacccccaguucgccgggauccgccgggugcgcguccgggagccccucaccgugauccccaucgccgaccgcgacggccggccguucaaggccuacaagggggacgccaacagccgcguggacaucuggcggaugcccgacggcaaguggcuguccgacgucgugaccauguacgaggcgcaccgccgggaccacagcgaccgccgcccccaccccgccgccaagaagcugaugucccuccggcagaacgacaugaucgccguggagcgcgacggcgccccgcggcagaucauggucgugaagcagaucuggcccacgcagaucaaccugguggagcacaaggagaccgggaaccugaaggaccgccacagcaacgagaccgaccccuuccgguucuucgcgccgaccgccggcgggcucaagaagaugaaggcccgccagguccggaucgacccccugggccgcaucuucgaccccgggccccgguga

SEQ ID NO: 1467 - RNA, 3147 nt, Artificial Sequence
  Cas9 variant
auggccaacaucgccgagaaccugguguucggcaucgaccucgggaucggcagcugcgggugggcgguccugaaccagaaggccaaggacgagaacaucguggcccugggcuccuggugcuucgacgugcccgagaccgacaaggagcgcaucccgaccaaccagauccggcgcgccaaccggcuccugcgccgggucauccgccggcgccggaaccgcauggccgagauccggcgccuguucgcgagcaaggggaugcucgacacggccgaccccgacgcccuggccaagaucuccgcggaccccugggagaugcgggccaagggccuggacuaccagcucacgccccaggaguucgccguggcccugggccacaucgccaagcgccggggguucaagagcgcggccaagcgcguguccaccaacgccccgagcgaggacuccaagaugcuggccgcccucgagaagaccaaggagcagagcgcgcaguaccggaccaucggcgagauguucgcccgcgaccccgccuacgccgaccggcgccggaaccgcgacgggugcuucgaccgcaccaugucccgggaggaccuguucaaggagacccagauccuguucgagagccagcgccggcucggcaacuucuccgccaccagcgagacggagcaggcguucaucgacaucgccuuccgccagaagcccaugcaggacuccgagcggcuggucgagaccugccuguucgagcccgacgagaagcgcgccagccgguucgccccguccuucgagcgcuuccggcuccugugccgccuggugaaccuccgggugaccgacgggcuggaggaccgcccccugacccccgaggagcuccggcuggccugcgaggacgcgggcaagacgcgcaagcugagcgucaagaaggugcggucccucaucggccugcgcgacgaccagcgguucaccaccaucccgcccgaccaggagcagcacgacaucgccgcccgcaccggggacgcccugacgggcaccgcgaccuuccgggccauccucggggagagcuucuggcgccagcugcugccccaccccgagcagcucgaccgcgccgccuggaucaucuccuuccacgagcugaccgacacgaucaucagcaagcuggccaccaucggccuccccagcgaggugauggagcugauccggaaggcgcuggaggacggcaaguucuccaaguucaagggggccgccagccucuccgacaaggccgcccgcaagcugaucccguuccugcaggagggccucaccuacgacaaggcgugccagaaggccggguacaaccacgccgccagcaaguucacccacuacgacuccaucgacacgaaggccaaguucaacagccugauggacgacguccgggacuccaucaccaaccccguggcgcgcaaggccaucagcgagggcaugaagcaggucugggccaugcggaaccagugggggcugcccggcgccaucugcaucgagcucgcgcgcgacgugggcaacuccgccgagaagcggcgcgagaucgagagcgggaucaagaagaacaccgcccagcgggagcgcgagcggcaggaggccaaggagcaccugaaccaguccgacaucagcuccgagacccugcuccgcuaccggcuguggaaggagcagggcgggcgcugcugcuacacggaccagcccaucaccccgagccagcugaucgccuccgacaacagcguccagguggaccacauccugcccuggucccgguucggcgacgacagcuaccucaacaaggcgcugugcaccgccaaggccaaccaggagaagaagaaccgcacccccugggaguggauccacaaccagaaggggguggaggccuggaaccacuucacggccgcgguggagucccggaaggagacccgcggccugaagaagcggaacuuccuccucaagagcagcaaggagaccgaggagcgcuuccggucccgcaaccugaacgacacccgcuacgccgcccgggugauggccgaggccguccgccugcuguaccccagcggcaaccgggcggagaagggcggggugaagcgcguguucacgcggccgggggcccugaccgccgcccuccgccacgcguggggcgucgagucccugaagaagaucaacgggaagcggcugaacgacgaccgccaccacgcccucgacgccgccguggucgccgcggugagcgagaaggagauccagaagcugaccaaguccuuccagaucugcgagcagaagggccuggcccggcccaugcgcgacgugcccaugcccugggagggcuuccggcaccagcucgagaccgccuacgccgacauccgcgucgcccggccggagcgccggcgcgcgcgggggaagggccacgacgccaccauccgccagcugcgggaggagaaggacgggcccgugguguacgagcgccgcgccaucagcgaccugaagcucacggaccuggagcggaucaaggaccccgagcgcaacuccgccaucaucagcucccugcggaccuggaucgagaagggcaagccggccgacuacccgccccagagccccaagggcgacgagauccgcaagauccgggucaugucccgcaacaagcccgcggugagcgugcggggcgggaccgccgaccgcggggagaugacccgggucgacguguucacgaagaugggcaagaaggggaagcccgagugguuccucgugcccaucuaccgccaccaggucaucgaccggauccaguggccccagccgcccaaccaggccgccgccaacggcaaguccgagaagaacuggcccaccaugggccuggagcacgaguuccgcuucagccuguacccccgguccuacgugcagaucgugaagcgcgacggggagaucaucgagggcuacuucgcggggcucgaccggaccgucgccgccuucagccugcuguccagcagcgacccgaccuccauccagcgcggcaucggggccaagacgcucgagagcauccggaaguacaacgugaaccgcuucggcgacaucuccaugguggagcaggagacccggaccuggcacggcgacgucugcaucagccccgaccagcccgacuccgcguga

SEQ ID NO: 1468 - RNA, 3147 nt, Artificial Sequence
  Cas9 variant
augguggagaagauccugggcaucgaccucgggaucagcucccugggcugggccgucguggaguacgacaaggacaacgacgagaacaacaagaucaucgacugcggggugcgccuguucaccgccgcggagacccccaaggagaaggagagcccgaacaaggcccggcgcgacgcccggggccuccgccgggucaucaagcgccggcgcgugcggaugaacacgaucaagaaccugcugaucaccuacaagcucaucgacaagacccugcuggacgaggagauggggauguuccacucccagagcaaccgcguggacgucuggaagcuccggcacgacgcccuguaccaccuccuguccggcgacgagcuggcccgcgugcugauccacaucgcgaagcaccggggcuacaaguuccucggggacgacgagagcgacgaggaguccggcaaggugaagaaggccggggccgagcugaagaagaaguuccuggaggccggcugccagagcgucggggaguggcucuggaaggagcgcggccugcagggcaagaagcggaacaaguccggggacuacgagaucagcaucccccgcgacuuccugguggaggagauccagcggaucuucgagacccagcagaaguucggcuccacguucgcgaccagcgagcuccagaaggccuacaccgacaucgccuucuacgugaagcccaugcaguccaucgaggacauggucggguacugcaccuucuaccccaagaucaagagcaagaaccaggacggcgagaagcgcgccccgaaggccucccccagcgcggagcaguucgugauccuguccaagaucuucagcacgaucgugaucgacgagaacaagcaggagaagaagcugaucgagcucaaguccaucgagcagcugauccagaucgcccggagcaaggagacccugaaguacaagcagcuccgcaaggagcugaaccuggccaaggacaucagcuucaaguccaucagcgacgaggagaagaccuggaucaaccucgucggcaacgccaaguucaagaagauccuggggcugaacuacgagaccuuccucaagaacacggagaucuccgacgagaucgccaagauccugaccuacgacaagaccuucgagcagaaggagaccaagcugaagaaccuccuggugaacaucgacuggaucgacaacaaccacaucgcggagcuggccaagcucagcuucucccaguucaaccagcugagccugaaggccaucaagaucaucuccaagaucaugaucgagggcuacgcccgguacgacgaggccgugcaguacgcguucgagaacaaccuccugcccaagcccagccacgagaaguccauccugcucccgccccugaaggagacgaacaucgccauccugaaccccaccgucauccgcgccuucgcccaguuccgccagguggccaacgcgcucgugagcaaguacggguccuucgacaagguccacuucgagcuggcccgggaggugaacaccaaggaggaccgcaagcggugggagaaggaccgcgacaagaacgagaagaugcaccggcagaucaccgagaagcugguggaggagggcgucaagcccagcuacaagaacauccugaaguccaagcuccgcagcgagcagaaggacacgugcccguacugccagaagaaccugcacuaccccaugaucuucgaggacggguacgccgagaucgaccacauccugccccucucccagagccaggacgacuccuacgugaacaagguccuggugcacagcgccugcaaccagaacaagaagaaccggacccccuucgagugguuccaggacgagaagaaggacugggacaccuucaaguccuacauccugauggagagcacccucggcgagaagaagcgcaacuaccugaucaaggagaacuucagcgacccgcagucccggaaggaguucaucagccgcaaccugaacgacacgcgguacauguccaaggcgaucaagaccuacugcgagaaccacuggaagcucagccacgacgacgacaagcugcgcauccaggugcgguccggcaagcugaccagcacccuccgccaccagugggggcuggacaacaagaaccgggagacgcacacccaccacgccauggacgccaucaugaucgccuucuccacccagggcauggucaagaagcugagcgacuacuucgccaagaaggaggcgaagguggagaaggacaagcccgugcucaucacccccaucaagcaguucaaggaggccgucgagcaggccacgacccuggagcgccaggaguccauccagaccaaggccggggacaccaucacgcugaaccggcuccugaucagccggcccccgcgcgccuccgugaccggcgcggcccacgagcagaccgccaagcccuacccccgcaucaagcccaucaagaacaaguacaagcgccggcgcaucccgaucgacgaggacaaguucgagcuguuccggaacgacaagguggccagcgggaacgacaagaacuucuacaacuccagcaccaucccccgcgucgacaucuacaagaaggacgacaaguaccacguggugcccaucuaccucuccgacaugaccaaggccgagguccccaacaagagccugggcacgaacccggagggcauggacgagaaguacuucugcuucuccguguucaagaacgaccugaucgagcucgagaccaaggcgacccccaagaagcccagcaagaagcugcugggguacuucaagcagcucaacggcgccaacuucauccugaacagcauccacaacgggaucaucgacggcuucgugugcuccccgaucacccuguucaagcagcagaaggacaugugcaagaagugccuccccgaggaccgggccaucgggaacugcagccaggagacgcuggaguucugggaggccgagaacaucaagguccccaagaaggacuucgagugcgaccagggcaucaaguucgcgaucgccgugcgcaaguacaccaucgacccccugggcuacuaccacgaggugaagggggagaagcuccugggcaccaucccgcagggggccaagaagcaccccaagcggcagaaguga

SEQ ID NO: 1469 - RNA, 3150 nt, Artificial Sequence
  Cas9 variant
augaucaacgagcgccugaccuucggcaucgaccucgggaucggcagcugcgggugggccgugcugcggcacgccgacgcggccggcgagcccggggucaucgagggccugggcuccuggugcuucgacgugccggagaccagcaaggagcgcauccccacgaaccaggugcggcgcuccaaccggcuccugcgccgggucauccgccggcgccggaaccgcauggccgagauccggcgccuguuccacgcccaggggcuccugcccagcgccgacgaggacgcgcugaagcggccccgccucgacccgugggagcugcgggcccgcggccuggaccagugccucuccgccgaggaguucgccguggcgcuggggcacaucgcccggcaccgcggcuuccggagcuccgccaagcgcaaggccgccaacaccagcggggaggacuccaagaugcugagcgcgcuccuggugacccgcgagcggaccgcccgcuaccggacggucggcgagauguucgcccgcgaccccgaguacuccgcccggcgccggaaccgcgacggcaucuucgaccggaccguggcccgcgacgaccugauccacgagguggggaagcuguucgaggcgcagcgggcccgcggcagcgccuucgccucccccgaccuggaggccgacuucaacgcgaucgccuuccggcaggccgagaugcaggacagcgagcgccuggucgggaacugccccuucgagcgggacgagaagcgcgccgcccggugggcgccguccuucgagcgcuuccggcuccugacccgccugaucaaccuccgcaucgccaccgccgagggcgagcggcgcuucacgcccgaggaccuggcccgggugagcgcggagcugggcgccaccgccaagcuccccgugucccgcguccgggcccugaucgggcugcuccccgacgagcgcuucaccaccauccggguggaggacgaggaccgcgacaucguggcccggacgggcgaggcggccccggggaccuggcgccugcggaagacccugggcgaggcccucugggccgagaugcaggcccgccccgaccagcuggacgcgaucgcccacguccugagcuucuucgaggccaccgccaagauccgguccgagcucgaccgccuggggcugcccgccgcggugaucgaggcccucgaccggggccuggaggacggcgccuucgccaaguucaagggggcgggccacaucagcgccaaggccugccgcaaccugcucccccaccuccagcaggggcaccgguacgaccaggccugccgccuggccggcuacgaccacgcggccagcacgcucucccacaccgcccagguggucagcaaggccggguucaacgcccuggugaccgagcugggcgaguccaucgcgaacccgaucgcccggaaggcccucaccgagggccugaagcagauccgcgccaugugcgcccggugggggcugcccggcgcgauccacaucgagcuggcccgcgagguggggaacagcaucgagaagcgccgggagcucgagucccagcgcgagacgaccaccaagcggcgccagaccgagcgggacgagauccgcggccugcuggcccucgaggacgucgacgacgacacgcugcugcgguaccgccucuggaaggagcagggcgggaagugccuguacaccggcaaggacauccacgugcggcagcugaucgccaccgacaacagcgugcaggucgaccacauccuccccuggucccgcuucggggacgacagcuucaacaacaagacccugugccuggcguccgccaaccagcggaagcgcggccagacgcccugggagugguucagccucaccgggaccccggaggccugggagguguucgccucccgggucgagaccagcaaggaccugcgcggcuucaagaagcggaaccugcuccugaagaacgccgacgagguggcgcagcgcuuccggucccgcaaccugaacgacacgcgguacgccgcccgccuccuggccgaggccgcgaagcuguucuaccccgccggcgaccgccaggagaaggacgggcggcgccgggugcucacccgccccggcccccugaccgccgcccugcggcacgccugggggcucgagagccugaagaaggcggacggcaagcgcgucuccgacgaccggcaccacgcccuggacgcccucgccguggccgcgaucagcgagcgcgaggugcagcggcugacccgcuccuuccaggagugggagcagcaggggcuggcccggccgcuccgccacgucgccccgcccuggcccggcuuccggggcgacgugcuggccgcguacgcccaggccuucguggcccgccccgagcggcgccgggcccgcgggaagggccacgacgcgagcauccggcaggucgugggggagggccccgaggcccagguguucgagcgccgggggcuggccgaccucaaggaggccgaccuggaccgcgucaaggaccccgagcgcaaccaggccaucaucgaggcggugcgggccuggauccuggccggccgcccggccgacgccccgccccggagcccccgcggcgacgugaucgucaagcuccggacggcgcccgccaagaagaucaagcccgccgugcccgugcgcgggggcaccgccgaccgcggggacaugguccggaucgacguguucacccggcccaaccgcaagggccgggacgagugguaccuggugccgaucuacccccaccaggucaugaaccgcaaggcguggccccacccgcccaugcggagcgugguggccuacaaggacgaggccggguggaccgagaucggcgccgagcacagcuuccgcuucucccuguacccccggagcuacguccagcucgugaaguccaacggcgacgugaucgagggguaccuggucagcauggaccgcuccaccggcgccuuccggguguucgugcacaacaaccccgcggagauggccaaggggaucggcgccaagacgcugcucaaccugcgcaaguucaacgucgaccgguucggggugcgcaccgaggugaaguccgagguccgcaccuggcacggcgaggugugcaccucccccgugccgcccgacuga

SEQ ID NO: 1470 - RNA, 3150 nt, Artificial Sequence
  Cas9 variant
augcagcugagcaagcucaacuacauccugggccuggaccucgggaucgccuccgugggcuggagcgucaucgagaucgacgagaccgagaugcccauccgccugaucgacgugggggugcggaccuucgagcgcgccgaggucccgaagacgggcgagucccuggcgcucgcccggcgccuggcccggagcacccgccggcugauccgccggcgcgccuuccggcuccugaaggccaagcgccugcucaagaaccaccagaucguguccgcggacgagcugagcacccugcccaaccacugcugggagcuccgggugaaggggcuggacgagcgccugaccugccaggagugggccgccguccuccugcaccuccucaagcaccggggcuaccugucccagcgcaagagcgaggcccagaacgcggacaaggagaugggcgcccugcucuccgggguggccaacaaccacaagcugcugagcgagaaccacuaccggacgcccgccgagaucgccgugaagaaguucgcgcucgaggagggccacaugcgcaaccagcgcggggccuacacccacaccuucaaccggcuggaccugcucgccgagaugcggcugcuguuccagacccagcgcgagcucggcucccccuacgccagcggggagcuggagcaggaguucugcaagcugcucauguggcagaagccggcccuguccggcgacgcgauccugaagaugcucggcaagugcacgcuggagcccaccgaguacaaggccgccaagaacaccuacaccgccgagcgcuucgucuggcugacgaagcucaacaaccugcggauccuggagaacgggagcgagcgcgcccucaacgcggacgagcgggcccugcugcucaaccagcccuacgagaaggccaaguucaccuacgagcaggcccgcaagcugcugcagcugaacgaggccgcgcgguucaacuccgugcgcuacggcaaggagaacgccgagaaguccacccucauggagaugaaggccuaccacgccauccggaaggcgguggagaccgccgacagcagcgccugggccacgcugaagacccagccccugcuccuggacgagaucgggaccgccuucuccaucuacaagaccgacgaggacaucaagacgcagcugcagggcaagcucgcggacaacgucaucgacgugcugcuggagaaccucaacuucgacaaguucauccagcugagccugaaggcccucuacaagauccugccgcugauggagcagggccuccgcuacgacgaggccugcagccagaucuacggggaccacuucggcaagaaggagcagaagaacgaccggcugcugccccagauccccgccgacgagauccgcaaccccgugguccuccggacccugucccaggcccgcaaggugaucaacgcggugauccggcuguacgggagcccggcccgcauccacaucgagaccgcccgggagcucggcaaguccuacaaggaccgcaaggagaucgagaagcggcaggagcagaaccgcgccgagcgggagaaggccgucgacaaguucaaggagcuguuccccaacuucaucggggagcccaaggcgaaggacauccugaccaugcgccucuacgagcagcagaacggccagugccuguacagcggcaagucccuggaccuccaccgccugcuggagaagggguacguggagaucgaccacgcccuccccuucagccggacgugggacgacuccuucaacaacaaggugcugguccuggccggcgagaaccagaacaagagcaaccagaccccguucgaguggcucgggaaggacgagcagaagugggcccuguucaccgcgcgcgugaacuccugccgguuccccuacagcaagaagcagcgcauccugaccaagaagcucgacgacgagggcuucauccagcggaaccugaacgacacgcgcuacaucgcccgguuccuggugaacuucgucaacgacaaccuccaccugaccgggaagggcaagcgccggguguucgccuccaacggccagaucaccgccuuccugcgcgggcgguggggccucaccaagguccgcgaggagagcgaccggcaccacgcccuggacgcggugguggucgccugcuccacggugagcauccagcagaagaucacccgcuucgugaaguaccaggaggggaaccugcagaccgccgagcggaucgaccgcgagaccggcgagaucaucccccuccacuuccccgacccgugggccuucuuccgggaggaggucaugauccgcaucuucuccgagaugccccaggaggaccuggugaucaagcugcccgaccggccccaggccaaccacgaguucgugcagccgcuguucgucagccgcaugcccacgcggaagauguccgggcagggccacauggagaccaucaagagcgcgaagcgccuggacgagggcaucuccgugagcaaggugccccugacccagcucaagcugaaggaccuggagaacauggucaaccgcgaccgggagaucgcccucuacgaggcccugaaggcccgccugaccgaguucaaggacgaccccgccaaggcguucgccgagccguucuacaagaagggcggggugcaggucaagagcgugcggguggagcagguccagaaguccggggugguggugcgcaacggcaacggcgucgccgacaacgccagcauggugcggguggacgucuucaucaagggcgggaaguacuuccucgugcccaucuacaccuggcaggucgcgaaggggauccugcccgaccgcgccgugaucgccuacacgccggagaacgagugggagcugauggacgacuccgcccaguuccaguucagcaucuaccccaacgaccucaucaagcugaccaccaagaaggccaucuucuucggcuacuacuccggguucaaccggcugaccggcgcgaucaacaucaaggagcacgaccuccagaucagcaagggcgacaagggggugcaccugggccugggggugaagcucgcccugucccuggagaaguaccaggucgacgagcucggcaagaacauccgccccugccggcccacgcagcgccagaacgugcgguga

SEQ ID NO: 1471 - RNA, 3153 nt, Artificial Sequence
  Cas9 variant
augagcuccuaccgcuucagcuucgaccugggcaccaacuccaucgggugggccguguucgagcucgaccccaagacccggccggucgcccuggcggacugcggcgugcgcaucuuccccgacgggcggaaccccaaggacaagcagagccuggccguggcccgccgggaggcccgcgccguccggcgccggcgcgaccgguaccucaagcgccgguccgagcugauggagcgccugguggcgaagggccucaugcccgagagccgggacgaccagaaggcccuggaggggcuggacccguacgcccuccgcgccgcgggccuggacgacgcccugccgccccaccacuucggccgggcccucuuccaccugaaccagcgccggggguucaaguccaaccgcaagaccgaccggggcgagaacagcgagaccgggaucaccaagaucggcaugaagaagcugcacgaggcccuccuguccgaggggugccgcacccugggcgagcuccagcaccgccaccacgaggccaaccagacgcccgcgauggacaccaaccccaagagcgugcgguccaagcugcgcggcgagggggccaaggccgucuacgacuucuaccccagccgggacgccguggaggacgaguucaacaagcugugggacucccagaagcgcuuccaccccgaccuccugaccgacagcgcccgggacgcgauccgcgacgccaucuucuaccagcggaagcugaagacccccgacgccggccgcugcuccuucaacccggccgaggagcggguggcccgcgcgaugcccaucgcccagcacuuccggauccuccaguucgucggggaccugcgccugaucgacaacgaccucgugcggcacccccugaacaacgaccagaagaaggcccuguaccgcgaccuccuggccaagggcaagcugacguucaaggccaugcggaagaccaucggcaucgggagcgaguacgcguucucccacgagagcgagaagcaguccgaguuccgcggcgacgagaccgccgcccggcucgccgggcccaaguacuucggcccgaaguggcgcgagcugagcuucaacgaccagagcgagaucguggaccggcugcuccacgaggagaacgaggagacccugauccaguaccugcaggaccgcuucggguucgaccacgaccgcugcgaggucaucgcggacgcgccccuccccgacggccacacgcggcugggcaagaccgcccuggagacccucguggagaucaugcgcgacgaccaccuccccuacgaccaggccugcaccaaggccggguacgagcacgcccugccgcccgacggcgugauccuggacgaccugcccuacuacgggaucgcccuggagcggcacgucgccuucggcgacgggaaguccgagaaccccgagaagcgcuacggcaagaucgccaacccgacggugcacaucgcccucaaccagcugcggaaggugaucaacgcgcugaucgcccgcuacggccaccccgaccaggucgugauggagaucgcccgggaccugaagcagagcaaggccaagcgcgacgacaucuccaaggagcagaagaagaaccaggaccggaacgaccagcgccggaagaagcuccaggaggcccacaucgcggugaacgccgagaacaugcugcgcaugcggcugugggaggagcucgacgaggacaacgccgccgcgcgcgccugccccuucaccggggagaccaucagcauggcccggcuguucucccccgaggucgagaucgagcacauccugccguucagccgcucccucgacaacagccccgccaacaagacccugugcauggugugggccaaccgggcgaagggcaaccgcacgcccugggaggccuucgggcgggaccgcgagccgggcuucgacuggcccgagaucgccgcccgggccgcgcgccugcccaagaacaaguccuggcgcuucgggcccgacgccauggagcggcucgagcgcgagggcgacuuccuggaccggcagcugaccgacacccaguaccucagccgcaucgcccgggaguacgugaccaagaucugcgacccgaaccaggucugggugacgcccggccgccugaccgccuggcugcggcgcaacugggggcucaacggcauccugcccaccgggaacgccaccaagaaccgggacgaccaccgccaccacgcgaucgacgccaucgucgugggccugacggaccggggcauccucaaccgcgugucccggagcgccgcccuggcggaggccgaggaccuggaccgcuccaucgccgagaugcccgacccguucgacggguuccgggacaacauccgccacauccucgagcagaucaucgucagccacaagcccgacgccggcuucgugcccgggcaccccaagggcaacaccaccccgggggcccugcacaacgacaccgcguacggcaucaucaagacggacgccaagggcauguccgagguggucacccggaaggacgugcugagcuucaaggggaccaaggagaucgaguccauccgcgacgccgccacccggcagagccuccuggacgccguggcgggcguccccuccgggcuggccuucaaggaggcccuccgcgacuggagcgugcgcacgggcaccaagcgggugcgcgucaccuucaacaugagcgugauccccauccaggaccgggacgggaaggccuacaagggcuacaagggcgacgggaaccugugcgccgagaucuacgagcgccccgacggcaaguggggcgacgagaucaucucccgguucgacgcggugcagccgggguucacgccccaguggcagcgcgaccaccccgccgcccaccgggucaugcgccuguuccgggacgacaugaucauggccgagaucgacggggugaugaccgugugccgcaucgucaagaugagccccggcaaggugguguucaccccgcaccacgaggccaacaccgacucccggaaccgcgacaaggacgaccccuucagcuuccacacgugcuccggcgagagccuccggaagcgcaaggcgcagaagcuguucgucgacccccuggggaagauccggggcuaccgcgccaaggagggguga

SEQ ID NO: 1472 - RNA, 3153 nt, Artificial Sequence
  Cas9 variant
augggcgagaacaugaucgacgagagccugaccuucgggaucgaccucggcaucggguccugcggcugggccgugcugcgccggcccagcgccuucgggcgcaagggcgucaucgagggcaugggguccuggugcuucgacgugcccgagaccagcaaggagcggacgcccaccaaccagauccgccgguccaaccgccugcuccggcgcgugauccggcgccggcgcaaccggauggcggccauccgccggcugcugcacgccgccggccuccugcccagcaccgacuccgacgcccugaagcgccccgggcacgacccgugggagcuccgggcgcgcggccuggacaagccccugaagcccgucgaguucgccguggugcucgggcacaucgccaagcggcgcggcuucaagagcgccgcgaagcggaaggccaccaacaucuccagcgacgacaagaagaugcugacggcccuggaggccacccgcgagcgccucggccgguaccgcaccgucggggagauguucgcccgggaccccgacuucgcgucccgccggcgcaaccgggagggcaaguacgaccgcaccacggcccgggacgaccuggagcacgaggugcacgcccuguucgccgcccagcgccggcucgggcagggcuucgcgagcccggagcuggaggaggccuucaccgccuccgccuuccaccagcgccccaugcaggacagcgagcggcuggugggcuucugccccuucgagcgcaccgagaagcgggccgcgaagcucacccccuccuucgagcgcuuccggcugcuggcccgccuccugaaccugcggaucacgaccccggacggggagcgcccccucaccgucgacgagaucgcccuggugacccgcgaccugggcaagacggccaagcucagcaucaagcgggugcgcacccugaucgggcuggaggacaaccagcgguucaccaccauccgccccgaggacgaggaccgggacaucgucgcccgcacgggcggggcgaugaccggcaccgccacccuccggaaggcccugggcgaggcccuguggacggacaugcaggagcgccccgagcagcucgacgcgaucguccaggugcuguccuucuucgaggccaacgagaccaucaccgagaagcugcgggagaucgggcucacccuggccgugcuggacgugcuccugacggcccuggacgccggcguguucgcgaaguucaagggggccgcccacaucagcaccaaggccgcccgcaaccuccugccgcaccuggagcagggccggcgcuacgacgaggcgugcaccauggccggguacgaccacgccgccucccggcucagccaccacggccagaucgucgccaagacccaguucaacgcgcuggugacggagaucggcgagagcaucgccaaccccaucgcccgcaaggcccugaucgaggggcugaagcagaucugggcgaugcggaaccacuggggccuccccggguccauccacguggagcuggcccgcgacgucggcaacagcaucgagaagcggcgcgagaucgagaagcacaucgagaagaacaccgcccugcgggcccgcgagcggcgcgaggugcacgaccuccuggaccuggaggacgugaacggggacacccuccugcgcuaccggcuguggaaggagcagggcggcaagugccucuacaccgggaaggccauccacauccgccagaucgcggccacggacaacuccguccagguggaccacauccugcccuggagccgguucggcgacgacuccuucaacaacaagacccugugccucgccagcgccaaccagcagaagaagcgcuccaccccguacgaguggcugagcgggcagaccggcgacgccuggaacgcguucguccagcggaucgagaccaacaaggagcugcgcggcuucaagaagcggaacuaccuccugaagaacgccaaggaggccgaggagaaguuccgcucccggaaccugaacgacacgcgcuacgccgcccgccucuucgcggaggccgugaagcugcuguacgccuucggggagcggcaggagaagggcgggaaccggcgcguguucacccggcccggcgcccucaccgcggcccugcgccaggccuggggcgucgagagccugaagaagcaggacgggaagcggaucaacgacgaccgccaccacgcccucgacgcccugaccguggcggccguggacgaggccgagauccagcggcugacgaaguccuuccacgagugggagcagcagggccucgggcgcccccugcgccgggucgagcccccgugggagagcuuccgcgccgacguggaggccaccuaccccgagguguucgucgcgcggcccgagcgccggcgcgcccggggcgaggggcacgccgccaccauccgccaggugaaggagcgggagugcacccccaucguguucgagcgcaaggccgucuccagccugaaggaggcggaccucgagcggaucaaggacggcgagcgcaacgaggccaucguggaggccauccgguccuggaucgccacggggcgcccggccgacgcgccgccccggagcccccgcggcgacaucaucaccaagauccggcuggccaccaccaucaaggccgccgugcccguccgcggcgggacggcgggccgcggggagauggugcgggccgacguguucuccaagcccaaccggcgcggcaaggacgagugguaccugguccccguguacccgcaccagaucaugaaccgcaaggccuggcccaagccgcccaugcggagcaucguggccaacaaggacgaggacgaguggaccgaggucgggcccgagcaccaguuccgcuucucccucuacccccggagcaacaucgagaucauccgccccagcggcgaggugaucgagggcuacuucguggggcugcaccggaacaccggcgcccugaccaucuccgcgcacaacgaccccaagagcauccacuccgggaucggcacgaagacccuccuggccaucagcaaguaccaggucgaccgcuucgggcggaaguccccggugcgcaaggaggugcggaccuggcacggcgaggccugcaucagccccaccccgcccggcuga

SEQ ID NO: 1473 - RNA, 3153 nt, Artificial Sequence
  Cas9 variant
augaagauccugggcuucgacaucgggaucgccagcaucggcugggccuucguggagaacggggagcucaaggacugcggcguccgcaucuucaccaaggcggagaaccccaagaccggggacucccuggccaugccgcggcgcgaggcccggagcgugcgccggcgccuggcccggcgcaagggccggcucgagacgcugaagcgccugcucgccaaggagugggaccugugcuacgaggacuacaucgcggccgacggcgagcugcccaaggccuucauggggaagaaccucaacaaccccuacgugcugcgguacgaggcccugcagcgccuccuguccaaggaggagcugguccggguggugcuccacaucgcgaagcaccgcggcuacgggaacaagaacgccaagaucaccaagagcgaggaguccaagcgggagcagggcaagauccugagcgcccuggccaccaacgccuccgcgaucgcccgcuaccggaccgucggggaguacuucuacaaggaguucugcgaggugaucaagaacccccagggccucagcacgaacgagcacuacacccaguccaaggugcgcguccugaagccgauccggaacaagggcggggaguacaccaacugcauccugcaggaggaccuccagcgcgagcugcggugcaucuucgaguaccagaagggcuucggguuccccaucacccaggaguuccaggacaagauccugaagaucgccuucuaccagcgcccccucaaggacuucagccaccuggugggcaagugcacguucuaccccgacgaguuccgcgcccugaagugcucccucagcgccguggaguucaucacccuguccaagaccaucaacguccugaccuacaucagcaaggaguccggcgagguguacagcaaggggcaguacgagcagaugcucgacuccguguucaaggcggucugcgagaagggcagccuguccuucgcccagcugcggaagauccuccacaucgacgagcgcauccgguucaaggagguggacuacauggcccgcaagagcaagaacacgagcggggacuccacccacaagcagaagaccagcaacccggagaccaagaaguucaucgagcacaagaaccugaagaaguucugcgagauccuguccgagaucgccgaggaccgggcccucgcggacagcaucgcccgcgacaugacgcugaucaaggacgaggagaagcuggcccagaagcuccacggcuacgggaaguucucccaggagcagaucacccagcugagcgcccugaacuucucccaccacaucaaccucagccugaaggcccuguccgagauccuccccuucaugcgggagggcaugcgcuacgacgaggcgugcaagcuggccggccugaaggcccggcacaacgacaagaaguccaaguuccucccgcccuucugcgagagcaucuacgccgacgagcugaccaaccccgugguccaccgcgcgaucgccgaguaccggaagauccugaacgcccugaucgccaaguacgggagcgugcacaagauccacaucgagcucacccgcgacgugggcaagaacuuccaggagcgggagaaguacaagaaggagaucgaguccaacuacaaggcccgcguccaggcgaugcaggagugcgagaagcuggggcugacgcucagcgagggcaacauccugaagcugcgccucuuccgggagcagaacgagaucugcguguacuccgggcggaagaucacccuggccaaccugaaggagcagggcgcccucgagaucgaccacauccugcccuacagccgcuccagcgacgacuccuacaugaacaaggugcuggucuucaccaacgagaaccagaacaagggcaacaagacccccuacgaggccuucgggggcgacagccagaaguggggcgagaucgagagccucgcccugcgguccggguaccccaagaagaaggcgaagcgcauccuggacaagggguucggcgaccgcgaggccggcuucaagagccggaacaucguggacuccggguacaucgcccgccucaucgccaacuacacgaaggaguaccugaaguuccugccgcucgacagccacgagaacaccgcccugaucgcgggcgagaaggacuccaagauccacgucgaggccgugaaggggaugcugaccgccaccaugcggcacuucuggggccucggcagcaagaaccgcuacgagcacacgcaccacgccguggacgcgaucaucaucgccuacaucaacgccgccaugauccagcgguucucccaguuccgccagaaccaggagagccugaaggcccgguucuacgcgaaggagcuggccaaggaggaguucaagacccagcgcgccuucuucgagcccuuccggggguuccgcgagcagguccucgccaaggugggccagaucuucgugucccggccgccccgcaagcgggcccgcggggcgcugcacgaggagaccuucuacagcaucgacgacaagaagcuguccgagaccuacggcgggaaggagggcguccagcgggcccucagccugggcaagauccgccagaucgggacgaagaucguggccaacggccccauggugcgggucgacaucuucaagcacaagcagucccgccgguucuacgccgugcccaucuacaccauggacuucgcccuggggauccuccccaacaaggcgguggucagcggcaaggacaccaaguccaaggugaucaaggacuggcuggagauggacagcugcuacgaguucugcuucucccuguucaaggacgaccucaucgaggugcagaaguccgacauggagaagcccgagcuggccuacuucgucagccuggacgccagcgacgggcgcaucaaggugcggcaccacugcaacgacaucaccaagaucaacgagaaccagaagaagcuguucagcgaggccaucgagaaggagguggucggccgcggcuccauccagaaccucaagguguucaagaaguacaaggugagcccgcugggggagaucaaggaggcgaaguacgagccccgccagcccaucgcccucaagacgucccccaagaagcaccggaagcagaacaacgcccaguga

SEQ ID NO: 1474 - RNA, 3156 nt, Artificial Sequence
  Cas9 variant
augaacaacuacauccugggccucgacaucgggaucaccagcgugggcuacgggaucgucgacuccgacacccgcgagaucaaggacgccggcgugcggcuguuccccgaggccaacguggacaacaacgaggggcgccggagcaagcgcggcgcccggcgccugaagcggcgccggauccaccgccucgaccgggucaagcaccuccuggccgaguacgaccuccuggaccugacgaacaucccgaaguccaccaaccccuaccagacccgcgugaagggccucaacgagaagcugagcaaggacgagcuggugaucgcccuccugcacaucgccaagcggcgcgggauccacaacgucaacgugaugauggacgacaacgacuccggcaacgagcugagcaccaaggaccagcucaagaagaacgccaaggcgcuguccgacaaguacgugugcgagcugcagcucgagcgguucgagcaggacuacaagguccgcggggagaagaaccgguucaagacggaggacuucgugcgcgaggcccggaagcugcuggagacccagagcaaguucuucgagaucgaccagaccuucaucaugcgcuacaucgagcucaucgagacccggcgcgaguacuucgagggccccgggaagggcucccccuucggcugggaggggaacaucaagaagugguucgagcagaugaugggccacugcacguacuucccggaggagcugcgcagcgugaaguacuccuacagcgccgagcuguucaacgcccucaacgaccugaacaaccuggucaucacccgggacgaggacgcgaagcucaacuacggggagaaguuccagaucaucgagaacguguucaagcagaagaagacccccaaccugaagcagaucgccaucgagaucggcgugcacgagaccgagaucaagggcuaccgcgucaacaaguccgggaagcccgaguucacgcaguucaagcuguaccacgaccucaagaacaucuucaaggaccccaaguaccugaacgacauccagcugauggacaacaucgccgagaucaucaccaucuaccaggacgccgagagcaucaucaaggagcucaaccagcugccggagcugcucuccgagcgggagaaggagaagaucagcgcccuguccggcuacagcgggacccaccgccugucccucaagugcaucaaccugcugcucgacgaccugugggagagcagccugaaccagauggagcuguucaccaagcugaaccugaagcccaagaagaucgaccucucccagcagcacaagauccccagcaagcugguggacgacuucauccugucccccguggucaagcgggcguucauccagagcauccagguggugaacgccaucaucgacaaguacggccugccggaggacaucaucaucgagcucgcccgcgagaacaacuccgacgaccggcgcaaguuccugaaccagcugcagaagcagaacgaggagacgcggaagcaggucgagaaggugcuccgcgaguacgggaacgacaacgccaagcggaucgugcagaagaucaagcugcacaacaugcaggagggcaagugccuguacagccucaaggacaucccccuggaggaccugcuccgcaacccccaccacuacgaggucgaccacaucaucccccgguccguggccuucgacaacagcaugcacaacaagguccuggugcgcgcggacgagaacuccaagaagggcaaccggaccccguaccaguaccugaacagcuccgagagcucccucagcuacaacgaguucaagcagcacauccugaaccuguccaagaccaaggaccgcaucaccaagaagaagcgggaguaccuccuggaggagcgcgacaucaacaaguucgacgugcagaaggaguucaucaaccggaaccuggucgacacgcgcuacgccacccgcgagcucaccagccugcugaaggccuacuucuccgccaacaaccucgacgugaaggugaagaccaucaacgggagcuucacgaacuaccugcggaaggucuggaaguucgacaaggaccgcaacaagggcuacaagcaccacgccgaggacgcgcugaucaucgccaacgccgacuuccucuucaagcacaacaagaagcugcggaacaucaacaaggugcuggacgcccccuccaaggagguggacaagaagcgcgucaccgugcagagcgaggacgaguacaaccagaucuucgaggacacccagaaggcccaggcgaucaagaaguucgagauccggaaguucagccaccgcguggacaagaagcccaaccggcagcucaucaacgacacccuguacuccacgcgcaacaucgacgggaucgaguacgucguggagagcaucaaggacaucuacuccgugaacaacgacaaggucaagaccaaguucaagaaggacccccaccggcugcucauguaccgcaacgacccgcagaccuucgagaaguucgagaagguguucaagcaguacgagagcgagaagaaccccuucgccaaguacuacgaggagaccggcgagaagauccggaaguucuccaagacggggcagggccccuacaucaacaagaucaaguaccugcgcgagcggcugggccgccacugcgacgugaccaacaaguacaucaacagccggaacaagaucguccagcucaagaucuacuccuaccgcuucgacaucuaccaguacgggaacaacuacaagaugaucaccaucagcuacaucgaccuggagcagaaguccaacuacuacuacaucagccgggagaaguacgagcagaagaagaaggacaagcagaucgacgacuccuacaaguucaucggcagcuucuacaagaacgacaucaucaacuacaacggggagauguaccgcgugaucggcgugaacgacuccgagaagaacaagauccagcuggacaugaucgacaucagcaucaaggacuacauggagcucaacaacaucaagaagaccggggucaucuacaagacgaucggcaaguccaccacccacaucgagaaguacaccaccgacauccugggcaaccuguacaaggccgcgcccccgaagaagccccagcucaucuucaaguga

SEQ ID NO: 1475 - RNA, 3159 nt, Artificial Sequence
  Cas9 variant
auggagaacaagaaccugcacuacauccucggccuggaccuggggaucgccagcgugggcugggccgucguggagaucgacgagaaggagaacccccuccgccugaucgacguggggguccggaccuucgagcgcgcggagacccagaagggcgagucccuggcccucagccggcgcuccgcccggagcgcccgccggcugacgcagcgccggguggcccgccugaagaaggcgaagcggcuccugaaguccgagaacauccugcucagcaccgacgagcgccugccgcaccagguguggcagcugcgggucgaggggcucgaccgcaagcuggagcggcaggagugggccgccgugcugcuccaccugaucaagcaccgcggcuaccugucccagcggaagaacgagagcaaguccgagaacaaggagcucggcgcccugcugagcgggguggcguccaaccacgagcuccugcagcaggccaccuaccgcacccccgccgagcuggccgucaagaaguucgagguggaggagggccacauccggaaccagcagggggccuacacgcacaccuucagccgccucgaccugcuggcggagauggagcuccuguucucccggcagcagcacuucggcaaccccuucgccagcgagaagcugcucgagaaccugaccgcccugcucauguggcagaagcccgcccuguccggggaggacauccugaagaugcucggcaagugcaccuucgaggacgaguacaaggccgcgaagaacacguacaccgccgagcgcuucguguggaucaccaagcugaacaaccugcgcauccaggagaacggccucgagcgggcccugagcgacaacgagcgccugaugcucaucgagcagccguacgagaaggccaagcugaccuacgcccagguccgguccauccugaaccucagcgacgacgcgaucuucaagggggugcgcuacuccggcgaggacaagaaggccaucgagacgaagaccacccugauggagaugaaggccuaccaccagauccggaaggugcuggaggggaacaaccugaaggccgagugggucgcccucaaggcgaaccccacccugcuggacgagaucggcacggccuucagccucuacaagaccgacgaggacaucagcgccuaccuggccggcaagcugucccagcccgugcucaacgcgcugcuggagaaccucagcuucgacaaguucauccagcugucccugaaggcccucuacaagcugcugccccucaugcagcaggggcugcgcuacgacgaggccugccgggagaucuacggcgaccacuacgggaagaagaccgaggagacccaccacuuccugccgcagauccccgccgacgagauccgcaaccccgugguccuccggacgcugacccaggcccgcaaggugaucaacggcgugguccggcuguacgggagccccgcgcgcauccacaucgagaccggccgggaggugggcaaguccuacaaggaccgccacgagcucaagaagcggcaggaggagaaccgcaagcagcgggagaagaccaucagcgagaucaagacgcuguucccgaacuucuccggggagcccaagggcaaggacauccugaagaugcgccucuacuaccagcagaacgccaagugccuguacagcgggaagccccuggagcuccaccggcuguucgagcagaaguacguggaggucgaccacgcccugccccucucccgcaccugggacgacagcuucaacaacaaggugcugguccuggccaacgagaaccagaacaagggcaaccucaccccguucgaguggcuggacgggaagaacaacuccgagcgcuggcggaccuucaaggcccugguggagacgagcgcguuccccuacgccaagaagcagcgcauccucucccagaagcuggacgagaagggcuucaucgagcggaaccugaacgacacccgcuacguggcccgguuccucugcaacuucaucgccgacaacaugcaccugaccggcgaggggaagcgcaaggucuucgccagcaacggccagaucaccgcgcugcuccggcgccggugggggcuggccaagucccgcgaggacaacgaccggcaccacgcccuggacgccgugcucguggcgugcagcacggucgccaugcagcagaagaucacccgcuucgugcgguucaaggccggcgacguguucaccggggagcgcaucgaccgggagaccggcgagaucaucccccugcacuuccccacgccguggcaguucuucaagcaggaggucgagauccgcaucuucuccgacaaccccaagcuggagcucgagaaccggcugcccgaccgcccccaggccaaccacgaguucgugcagccgcuguucgugagccggaugcccacccgcaagaugaccggccaggggcacauggagaccgucaaguccgccaagcggcucaacgagggcaucagcaugaucaagaugccccugaccaagcugaagcucaaggaccuggagcugauggugaaccgcgagcgcgagaaggaccucuacgacgcgcugaagacgcggcuggaggccuucaacgacgaccccgccaaggccuucgccgagccguucaugaagaagggcggggcgaucgucaagagcgugcgcguggagcagguccagaaguccggcgugcucgugcggcaggggaacggcguggccgacaacgccagcaugguccgcguggacguguucaccaaggacgggaaguacuuccugguccccaucuacaccuggcaggucgccaagggcauccugcccaacaaggccgugauccaggggaaggacgaggaggacugggaggacaucgacgacgcgaccuuccaguucucccuccacccgaacgaccugaucagcgugaagacgaagaaggacgaguuccugggcuacuucaacggccucaaccggcacaccgggggcaucaacauccgcacccacgaccuggagaaguccaaggggaagcagggcaucuucgaggggaucggcgugaagaucgcccugagcuucgagaaguaccagaucgacgagcucggcaagaacauccggcugugcaagcccuccaagcgccagcccgugcgguga

SEQ ID NO: 1476 - RNA, 3159 nt, Artificial Sequence
  Cas9 variant
augaagaacaccagccugaacuacgugcucggccuggaccuggggaucuccagcgucggcugggccgugguggagaucgacgagaaggagaacccccucucccugaucgacgucggggugcgcaccuucgagcgggccgagacgcagaagggcgagagccuggcgcucgcccgccggcuggcccgcuccgcccggcgccugacccagcggcgcguggcccggcucaagaaggcgaagcgccugcucaagagcgagaacauccugcuguccaccgacgagugccugccgcaccaggucuggcagcuccggguggaggggcuggagcgcaagcuggagcggcaggagugggccgccgugcuccugcaccugaucaagcaccgcggcuaccucagccagcggaagaacgaguccaagagcgagaacaaggagcugggcgcccugcucuccggggucgcgaacaaccacaagcugcugcagcagaccacguaccgcacccccgccgagcucgccgugaagaaguucgagguggaggagggccacauccggaaccagcaggggagcuacacccacaccuucucccgccuggaccugcucagcgagauggagcugcuguucucccggcagcagcacuucggcaaccccuucacgagcgagaagcuccuggagaaccugaccgcccuccugauguggcagaagcccgcccuguccggggacgcgauccucaagaugcugggcaagugcaccuucgagaacgaguacaaggccgccaagcacaccuacagcgccgagcgcuucaucuggaucacgaagcugaacaaccuccggauccaggagaacggccuggagcgcgcccugaacgacaacgagcgccucgcgcugaugaagcagccguacgagaaggccaagcugaccuacgcccagguccgguccauccucaaccugagcgacgaggccaucuucaaggggcugcgcuacagcggcgaggacaagaagaccuccgagaccaagacggugcugauggagaugaaggccuaccaccagauccggcucgcgcuggagaagaacgaccugaagaccgagugggccgagcucaaggugaacagcucccugcuggacgagaucgggaccgccuucagccucuacaagaccgacgaggacaucuccacgugccuggccggcaagcugagccagcccguccucaacgcccugcuggagaaccucaacuucgacaaguucauccagcugucccugaaggcgcuccacaagauccugccccugaugcagcagggccuccgcuacgacgaggccugcgccgagaucuacggggaccacuacggcaagaagaccgaggagaaccaccuccugcugccccagaucccggccgacgagauccggaaccccguggugcugcgcacccugacccaggcgcggaaggucaucaacgggguggugcgccucuacagcucccccgcccggauccacaucgagacgggccgcgaggucggcaagagcuaccaggaccggcgcgagcuggagaagcggcaggaggagaaccgcaagcagcgggagaaggccaucuccgagaucaagacccuguuccccaacuucagcggggagccgaaggccaaggacauccucaagaugcgccuguacuaccagcagaacgccaagugccuguacuccggcaagccccucgagcugcaccggcugcucgagcagggguacguggagaucgaccacgcgcugcccuucagccgcaccugggacgacuccuucaacaacaaggugcugguccucgccaacgagaaccagaacaagggcaaccugacccccuucgaguggcuggacgggaagaacaacagcgagcgguggaaggccuucaaggcccucguggagacguccgccuucccguacaccaagaagcagcgcauccugagccagaagcuggacgagaagggcuucaucgagcgcaaccucaacgacacccgguacgucgcgcgcuuccugugcaacuucaucgccgacaacaugcaccugaccggggagggcaagcggaagguguucgccuccaacggccagaucacggcccuccugcgcgggcgguggggccuggccaagagccgcgaggacaacgaccggcaccacgcgcucgacgccguggucguggccugcagcaccguguccaugcagcagaagaucacccgcuucguccgguucgaggaggggaacguguucaccggcgagcgcaucgaccgggagacgggggagaucaucccccugcacuuccccgcccccuggaaguucuuccgcgaggagguggagauccggaucuucagcgacaacccgaagcuggagcucgagaaccgccugaucgcgcggccccaggccaaccacgaguucguccagccccuguucgugucccgcaugcccacccggaagaugaccggccagggccacauggagaccaucaagagcgccaagcgccucaacgaggggcuguccgugaucaagaugcugcucaccaagcugcggcugaaggaccucgagagcauggucaaccgcgagcgggagaaggagcuguacgaggcccugaaggcccgccucgaggcguucaacgacgagccggccaaggccuucgccgagcccuucaugaagaagggcggggccaucgugaaguccgugcgcgucgagcagguccagaaguccggcgugcuggugcgggacggcaacgggguggcggacaacgccagcauggugcgcgucgacguguucacgaagggcgggaaguacuuccuggugcccaucuacaccuggcaggucgccaagggcauccuccccaacaaggccgugauccaggggaagaacgaggaggacugggaggugauggacgacgccaccuuccgguucagccugcaccagaacgaccuggucaagcucgugaccaagaagaagacgaucuucggcuacuucaacggccugaaccgcgcgaccgggaacaucgacaucaaggagcacgaccuggagaaguccaaggugaaggacggcauccaccagagcaucgggaucaagcucgcccuguccuucgagaaguaccaggucgacgagcugggcaagaacauccggcucugcaagagcuccaagcgccaggccgugcgguga

SEQ ID NO: 1477 - RNA, 3159 nt, Artificial Sequence
  Cas9 variant
augaucggcgagcacgugcgcgggggcugccuguucgacgaccacuggacccccaacuggggcgccuuccggcuccccaacaccguccgcacguucaccaaggccgagaaccccaaggacgggagcucccuggcggagccccggcgccaggcccgggggcugcgccggcgccuccggcgcaagacccagcggcuggaggaccugcgccggcuccuggccaaggagggcgugcugagccucuccgaccuggagacccuguuccgcgagacgcccgccaaggacccguaccagcuccgggccgagggccuggaccgcccccugagcuuccccgagugggugcggguccucuaccacaucaccaagcaccgcggguuccaguccaaccggcgcaaccccguggaggacggccaggagcggagccgccaggaggaggaggggaagcugcuguccggcgugggggagaacgagcgccuccugcgggagggcggcuaccgcaccgcgggggagaugcuggcccgggacccgaaguuccaggaccaccgccggaaccgcgccggcgacuacagccacacccucucccggagccugcugcucgaggaggcccgccggcuguuccagucccagcgcacgcuggggaacccccacgcgagcuccaaccucgaggaggccuuccugcaccuggucgccuuccagaaccccuucgccagcggcgaggacauccggaacaaggccggccacugcucccucgagcccgaccagauccgcgcgccgcggcgcagcgccuccgccgagaccuucaugcugcugcagaagaccgggaaccuccggcugauccaccgccggaccggcgaggagcgcccccugacggacaaggagcgggagcagauccaccuccuggccuggaagcaggagaaggugacccacaagacccugcgccgccaccucgagauccccgaggaguggcuguucaccgggcugcccuaccaccggagcggcgacaaggccgaggagaagcuguucgugcaccucgcggggauccacgagauccgcaaggcccuggacaagggcccggaccccgccgucugggacacgcuccggucccgccgggaccugcuggacagcaucgccgacacccucaccuucuacaagaacgaggacgagauccugccccgccuggagagccugggccucucccccgagaacgcccgggcgcuggccccgcugagcuucuccgggaccgcccaccucagccuguccgcccugggcaagcuccugccccaccuggaggagggcaagagcuacacgcaggcccgcgcggacgccggguacgccgccccgccgcccgaccggcaccccaagcucccgccccuggaggaggcggacuggcgcaaccccgugguguuccgggcccugacccagacccgcaaggucgugaacgcccucgugcggcgcuacgggccgcccuggugcauccaccuggagaccgcccgggagcugucccagcccgccaagguccgccggcgcaucgagacggagcagcaggcgaacgagaagaagaagcagcaggccgagcgggaguuccucgacaucgugggcaccgcccccggccccggggaccugcugaagaugcgccucuggcgggagcagggcggguucugccccuacugcgaggaguaccugaaccccacccgccuggccgagcccggcuacgccgagauggaccacauccuccccuacagccgcucccuggacaacggguggcacaaccgggugcugguccacggcaaggacaaccgcgacaagggcaaccggacccccuucgaggcguucgggggcgacacggcccgcugggaccggcucguggccugggugcaggccagccaccuguccgccccgaagaagcgcaaccugcuccgggaggacuucggggaggaggcggagcgcgagcugaaggaccggaaccugaccgacacccgcuucaucaccaagacggccgccacccuccugcgggaccgccugaccuuccaccccgaggcccccaaggaccccgucaugacccucaacggccggcugacggcguuccugcgcaagcaguggggccuccacaagaaccggaagaacggggaccugcaccacgcccuggacgccgccgugcucgccguggcgagccgcuccuucgucuaccggcugagcucccacaacgccgccuggggcgagcugccgcgcgggcgggaggccgagaacggcuucagccuccccuaccccgccuuccgcuccgaggugcuggcgcgccugugccccacccgggaggagauccuccugcgccuggaccagggcggggucggcuacgacgaggccuuccggaacgggcuccgcccgguguucgugagccgggcccccucccgccggcugcgcggcaaggcccacauggagacccugcggagccccaaguggaaggaccaccccgaggggccgcgcaccgccagccggaucccccucaaggaccugaaccuggagaagcucgagcgcauggucggcaaggaccgggaccgcaagcuguacgaggcgcugcgggagcgccucgccgccuucgggggcaacggcaagaaggccuucguggcgcccuuccggaagcccugccgcuccggggagggcccgcuggugcggagccugcgcaucuucgacuccggguacagcggcgucgagcuccgggacgggggcgagguguacgccguggccgaccacgaguccaugguccgcguggacguguacgccaagaagaaccgcuucuaccugguccccguguacguggccgacgucgcgcggggcaucgugaagaaccgcgccaucguggcccacaagagcgaggaggagugggaccuggucgacggguccuucgacuuccgguucagccucuuccccggcgaccugguggagaucgagaagaaggacggggccuaccugggcuacuacaaguccugccaccgcggggacggccggcuccugcuggaccgccacgaccggaugccgcgcgagagcgacugcggcaccuucuacguguccacgcggaaggacguccucagcauguccaaguaccagguggacccccugggggagauccgccuggugggcagcgagaagccgcccuucguccucuga

SEQ ID NO: 1478 - RNA, 3162 nt, Artificial Sequence; identical to SEQ ID NO: 1382
  Cas9 variant

SEQ ID NO: 1479 - RNA, 3162 nt, Artificial Sequence
  Cas9 variant
augaagcgcaacuacauccugggccucgacaucgggaucaccagcgugggcuacgggaucaucgacuacgagacccggaacgucaucgacgcgggcgugcgccuguucaaggaggccaacguggagaacaacgaggggcggcgcuccaagcggggcacgcgccggcugaagcgccggcgccggcaccgccuccagcgggucaagaagcugcuguucgaccacaacuuccucaccgacaacagcgagcuguccggcaucagccccuacgaggcgcgcgugaaggggcugaaccagaagaucuccgaggaggaguucagcguggcccuccugcaccuggccaagcggcgcggcguccacaacgugaacgagguggaggaggacaccgggaacgagcucuccaccaaggagcagaucagccggaacuccaaggcccuggaggagaaguacgucgccgagcugcagcucgagcgccugaagguggacggcgaggugcgcggggcggucaaccgguucaagacgagcgacuacgugaaggaggcccagcagauccugaaggugcagaaggccuaccaccaguucgaccaguccuucaucgacaccuacaucgaccuccuggagacccggcgcaccuacuacgagggcccgggcgaggggagccccuucggcuggaaggacaucaaggagugguacgagaugcugauggggcagugcacguacuuccccgaggagcuccgcuccgucaaguacgccuacaacgcggaccuguacaacgcccugaacgaccucaacaaccuggugaucgcccgggacgagaacgagaagcuggaguacuacgagaaguuccagaucaucgagaacguguucaagcagaagaagaagcccacccucaagcagaucgccaaggagauccuggucaacgaggaggacaucaagggcuaccgcgugaccagcaccggcaagccggaguucacgaacuucaagguguaccacgacaucaaguccaucaccagccggaaggagauccuggagaacgccgagcuccugaaccagaucgcgaagauccugaccaucuaccaguccagcgaggacauccagggggagcucgcccgccuguacuccgagcugacccaggaggagaucgagcagaucagcaagcucgccggcuacacggggacccaccggcugagccugaaggccaucaaccucaucaucgacgagcuguggcacaccuccgacaaccagauggagaucuucaaccgccugaagcucguccccaagaagguggaccugagccagcagaaggagauccccaccacgcugguggacgacuucauccucucccccgucgugaagcggagcuucauccaguccaucaaggucaucaacgccaucaucaagaaguacggcuucccgaacgacaucaucaucgagcuggcgcgcgagaagaacagcaaggacgcccagaaguucaucaacgagaugcagaagcggaaccgccagaccaacgagcggaucgaggagaucauccgcaccaccgggaaggagaacgccaaguaccugaucgagaagaucaagcuccacgacaugcaggagggcaagugccuguacucccuggaggccaucccccuggaggaccuccugaacaaccccuucaacuacgagguggaccacaucaucccccggagcguguccuucgacaacagcuucaacaacaagguccuggugaagcaggaggagaacuccaagaagggcaaccgcacgccguuccaguacuucagcuccagcgacuccaagaucagcuacgagaucuucaagaagcacauccucaaccuggccaaggggaagggccggaucuccaagaagaagaaggaguaccugcucgaggagcgcgacaucaaccgguucagcgugcagaaguacuucaucaaccgcaaccuggucgacacccgguacgcgacccgcgagcugaugaaccuccugcgcuccuacuuccgggugaacgaccuggacaucaaggucaagagcaucaacgggggcuucaccagcuuccuccgcaagaaguggaaguucaagaaggagcggaacaagggguacaagcaccacgccgaggacgcccugaucaucgccaacgccgacuucaucuucaaggaguggaagaagcuggacaagacgaacaaggugauggaggaccagaucguggaggagcagcaggcggaguccaugcccgagaucgagaccgagcaggaguacaaggagaucuucaucacgccccaccagauccaggacaucaaggacuucaaggacuacaaguacagccaccgcguggacaagaagcccaaccgggagcucgucaacgacacccuguacuccacccgcaaggacgacaagggcaacacccugaucgugaacaaccucaagggccuguacgacaaggacaacgacaagcugaagaagcucaucaacaagagcccggagaagcugcugauguaccaccacgacccccagaccuaccagaagcucaaggugaucauggagcaguacuccaacgagaagaacccccuguacaaguaccacgaggagaccgggaacuaccugacgaaguacagcaagaaggacaacggccccgucaucaagaagaucaaguacuacgggaacaagcucaacguguaccuggacaucacccgggacuaccugaagucccgcaacaagaucgugaagcucagccugaagccguaccgguucgacgucuaccuggacaacggcguguacaaguucgugaccgucaagaaccucgacaucaucaagaaggaggacuacuacgagguggacuccgacagcuacgaggaggccaagaucgugaagaaggucuccgagcaggcccaguucguggccagcuucuacaacaacgaccugaucaagguggacggggagcuguuccgcgucaucggcgugaacaacgaccuccugaaccggaucgaggugaacauggucgacaucaccuacaaggaguaccuggagaacaucaacgacaagaaguccagccgcaucaucaagaccaucuccagcaagacgcaguccaucaagaaguacagcaccgacauccucggcaaccuguacgaggccaagagcaagcagcggccccagaugaccaugaagggguga

SEQ ID NO: 1480 - RNA, 3162 nt, Artificial Sequence
  Cas9 variant
augaagcgcaacuacauccugggccucgacaucgggaucaccagcgugggcuacgggaucaucgacuacgagacccgggacgucaucgacgccggcgugcgccuguucaaggaggccaacguggagaacaacgaggggcggcgcuccaagcggggcgcgggccgccugaagcggcgccggcgccaccggcuccagcgcgucaagaagcugcuguucgacuacaaccuccugacggaccacagcgagcuguccgggaucaaccccuacgaggcccgggugaagggccucagccagaagcuguccgaggaggaguucagcgccgcccugcuccaccuggccaagcgccgcggggugcacaacgucaacgagguggaggaggacaccggcaacgagcuguccaccaaggagcagaucagccggaacuccaaggcgcucgaggagaaguacguggccgagcugcagcuggagcggcucaagaccgacggggagguccgcggcagcaucaaccgguucaagacguccgacuacgugaaggaggccaagcagcugcugaaggugcagaaggaguaccaccagcucgaccagagcuucaucgacaccuacaucgaccugcuggagacccgccggaccuacuacgagggcccgggggagggcucccccuucggguggaaggacaucaaggagugguacgagaugcucaugggccacugcacguacuuccccgaggagcugcgcagcgucaaguacgccuacaacgcggaccuguacaacgcccucaacgaccugaacaaccuggugaucgcccgcgacgagaacgagaagcucgaguacuacgagaaguuccagaucaucgagaacguguucaagcagaagaagaagcccacccugaagcagaucgagaaggagauccuggucaacgaggaggacaucaagggcuaccgggugaccuccaccgggaagccggaguucagcaaccucaagguguaccacgacaucaaggacaucacggcccgcaaggagaucaucgagaacgccgagcugcuggaccagaucgcggagauccucaccaucuaccaguccagcgaggacauccaggaggagcuggucaagcugaacuccgagcucacccaggaggagaucgagcagaucagcaaccugaagggcuacaccgggacgcacaaccugagccucaaggccaucaaccugauccuggacgagcucuggcacaccaacgacaaccagauggccaucuucaaccggcugaagcuggugcccaagaagguggaccucucccagcagaaggagauccccaccacccuggucgacgacuucauccugagccccguggugaagcgcuccuucauccagagcaucaaggucaucaacgccaucaucaagaaguacggccugccgaacgacaucaucaucgagcucgcccgggagaagaacuccaaggacgcgcagaagaugaucaacgagaugcagaagcgcaaccggcagacgaacgagcgcaucgaggagaucauccggaccaccgggaaggagaacgccaaguaccugaucgagaagaucaagcugcacgacaugcaggagggcaagugccucuacagccuggaggccaucccccuggaggaccuccugaacaaccccuucaacuacgagguggaccacaucaucccccgcuccgucagcuucgacaacuccuucaacaacaaggugcuggugaagcaggaggagaacagcaagaagggcaaccggaccccguuccaguaccucuccagcuccgacagcaagaucuccuacgagacguucaagaagcacauccugaaccuggccaaggggaagggccgcaucagcaagaccaagaaggaguaccuccuggaggagcgggacaucaaccgcuucuccguccagaaggacuucaucaaccggaaccugguggacacccgcuacgccacccgggagcucaugaaccugcugcgcagcuacuuccgggugaacaaccucgacgucaaggugaaguccaucaacgggggcuucacgagcuuccugcgccgcaaguggaaguucaagaaggagcggaacaagggguacaagcaccacgcggaggacgcccugaucaucgccaacgccgacuucaucuucaaggaguggaagaagcucgacaaggccaagaaggugauggagaaccagaccgucgaggagaagcaggcggagagcauguccgagaucgagaccgagcaggaguacaaggagaucuucaucacgccccaccagauccagcacaucaaggacuucaaggacuacaaguacagccaccgcguggacaagaagcccaaccgggagcugaucaacgacacccuguacuccacccgcaaggacgacaagggcaacacccucaucgugaacaaccugaacggccuguaccacaaggacaacgacaagcucaagaagcugaugaacaagagccccgagaagcugcucauguaccaccacgacccgcagaccuaccagaagcugaagcugaucauggagcaguacggggacgagaagaacccccucuacaaguacuacgaggagacgggcaacuaccugaccaaguacuccaagaaggacaacgggcccgucaucaagaagaucaaguacuacggcaacaagcugaacgcccaccucgacaucaccgacgacuaccccaacagccggaacaagguggugaagcugucccugaagccguaccgcuucgacgucuaccucgacaacgggguguacaaguucgugaccgucaagaaccugaacgugaucaagaaggagaacuacuacgaggugaacagcaagugcuacgagaaggccaagaagcugaagaagaucuccgaccaggccgaguucaucgcgagcuucuacaacaacgaccucaucaagaucgacggcgagcuguaccgggucaucggcgugaacaccgaccugaucaaccgcaucgaggugaacauggucgacaucacguaccgggaguaccucgagaacaugaacgacaagcgcagcccccggaucuucaagaccaucgccuccaagacccaguccaucaagaaguacagcaccgacauccuggggacgcuguacgaggugaacuccaagaagcacccccagaugaucaugaagggcuga

SEQ ID NO: 1481 - RNA, 3162 nt, Artificial Sequence
  Cas9 variant
augagcggcaugguguucgggaucgaccugggcaucgccuccugcgggugggccguccuccgccagccccagcgggacggcgacccgggggagaucguggaccugggcagcuggauguucgacgugcccgagaccgacaaggagcgcacccccacgaaccagguccggcgcggcaaccggcugcuccgccgggugauccgccggcgcgcgcagcggaugguggagauccgccggcuguuccacgaccacgggcugcucgccggccacgcccccgaggcccugaagcgcgccgggcuggacccgugggaccuccgggcgcgcucccuggacaagguccuggagcccgccgcccucgccguggcgcugggccacaucgccaagcggcgcggguucaagagcgccgcccggcgcaaggaggccaacaccgcgggcgacgaccagaagaugcugaaggcccucgaggccacccacgagcggcugggccgcuaccgcaccaucggggagauguucgcccgggaccccgacuucgagucccgcaagcggaaccgcgacggcauguucgaccggacgcaggggcgcgacgaccugcuccacgaggugggcgagaucuucaaggcccagcggcgccugggcagcgcgcuggccaccgccgagcucgagcaggccuucaccgccaucgcguuccggcagcugcccauccaggacuccgagcgccuggucgggcucugccaguucgagccgaaggagaagcgggccgcccgcuucgcccccagcuucgagcgguuccgccugcugcagcggcucaccaaccugcgcguggugacggucgagggcgagcggccccugaccgccgacgagaucgcggccgccgccgcggaccucgggcgcaccgccaagcuguccgugaaggaggugcggaagcgcaucggccuggccgccgaccaccgcuucgccgcguucaaggccgacgaggaggaccgggacaucaucgcccgcaccggggaggcccuccacggcacguaccggcugcgcaaggcccugggcgaggggcucugggcggagaugcugcccggccagcuggacgccaucgcccacgcccucagcuucuucgagacccaggacgucauccugaaggagcuggacaagcucgaccugccggccggggugcgggacgcgaucgccaccggccuggacgccggggccuucgcgcgcuucaagggcaccggccacaucuccgcccgggccgcccgcgcccuccugccccaccuggaggcggggcuccgguacgaccaggccugcacgaaggccggcuacgaccacgccgccagccgcugggcgaagcgggagcaggucgccgacaaggccgccuucaaccgccuggugaccgacaugggggccgagaucgcgaaccccaucgcccggaagucccugaccgaggcccugaagcagcucugggccaugcgcaaccgguggggccugcccgacgcgauccacaucgagcuggcccgcgacguggggaacagccucgagaagcggcgcgagaucgagcgggccaucgagaagaacaccgccgcccgcgagcgggagcgcggcgaggcgcgcgaccugcugggcaucgacgacguguccggggacacgcuccugcgguaccgccuguggaaggagcaggccggccggugcccguacaccgacgcccccaucccgcccggggccaucaucgccaccgacaacagcuuccaggucgaccacauccucccguggucccgcuucggcgacgacagcuucgcgaacaaggugcugugcgccaccgccgccaaccagcggaagaagggccagacgcccugcgaguggaucaccgccgcgcagggggaggagggcugggccaccuucguggcccgcaucgaggggaacgccgccuuccggggccccaagaagcgcaacuacguccugaagaacgcgaaggaggccgaggagcgguuccgcgcccggaaccucaacgacacccgcuacgccgcgcggcugcuggccgaggccgugaagcuguucuaccccgagggggagcgccaggacaagggcggcguccggcgcguguucacgcggcccgggggccucaccgccgcccugcgccacgcguggggcguggaggcccucaagaagcgggacgggaagcgcgucgacgacgcccgccaccacgcccuggacgcccuggugguggcggccaucggggagggcgagguccagcggcucacccgcuccuaccaggagugggagcagcagggccuggcccggccccugcgccggguggacccgcccuggggcgacuuccacagcuuccgccgggaggugaaggacgccuacgacgggaucuucgucgcccgccccgagcggcgccgggcgcgcggggagggccacgccgccaccauccgccaggugcgggagcgggacggggccgcgguggucuucgagcgcaaggccaucgccgaccucagcgagaagcggcuggccgacaucaaggaccccgagcgcaaccaggccaucguggaggcgauccggcaguggaucguggacggccgccccgccgaccggcugccgcgcucccccgccggcgacgagauccgcaagguccggcuccgcacgaaggggaagcccgccguccaggugcggggcggggccgcggaccgcggcgagaucgugcggguggacguguucaccaagcccaacaagaaggggaagaacgaguucuaccuggucccgaucuacccccaccaggugaugaacaaggccgaguggcccacgcccccgaugcgcgccguggucgccuacaaggacgagagcgaguggacccugcucgacgagaacuucggcuuccuguucucccuguucccccggagcuacguggaggugaccaagcccggcggggagguccucuccggcuacuuccaggggauggaccgcagcaccggcgccaucucccuguucaaccaccgggacagccgcucccugaccgacgacagcggcaacuccacccgggggaucggcgcgaagacccuccugacgaugaagaaguacagcguggaccgcuucgggaagcgggccgaggugaaguccgagguccgcaccuggcacggcguggccugcaccuaccccaccccgcccggguga

SEQ ID NO: 1482 - RNA, 3165 nt, Artificial Sequence
  Cas9 variant
augaagcugacgccccucaacuacauccugggccuggaccucgggaucgccagcgugggcugggccgucguggagaucgacgagcaggagaacccgcuggggcugaucgacgugggcguccgcaccuucgaccgggcggagguggccaagaccggggagucccucgcccuggcccgccggcuggcccgcagcucccggcgccucgugaagcggcgcgcggaccggaucaagaaggucaagcgccugcucaagagcgagaacauccuccuguccgccgacgagcagcugcccaacgacguguggcagcuccgggugaagggccuggaccagaagcuggagcgccaggagugggccgccguccuccugcaccuccugaagcaccggggcuaccugagccagcgcaagaacgaguccaagagcgagaacaaggagcugggggcgcuccgguccggcguggccgccaaccaccagauccugcagagcgccgaguaccgcacccccgccgagaucgcggugaagaaguuccacgucgaggaggggcacauccggaaccagcgcggcgccuacacccacaccuucucccggcuggaccuccuggccgagaucgagcugcuguucacgcgccagaccgagcuggggaacccccacaccagcgccaagcugcucgagaaccugaccgcccugcucauguggcagaagccggcgcuggccggcgaggccauccugaagaugcucggcaagugcacguucgagcccaccgaguacaaggccgccaagaacuccuacagcgcggagcgguucguguggcugaccaagcugaacaaccuccgcauccuggagcagggggccgagcgcgcccugaccgacaacgagcgguucgcccuccuggaccagcccuacgagaaggccaaguucacguacgcgcaggcccgcaccaugcuggcccuccccgacgaggccaucuucaagggcgugcgguaccagggggaggacaagaaggcggucgagaccaagaccauccugauggagaugaaggccuaccaccagauccgcaaggcccuggagaacgccgaccugaaggccgaguggaacgagcucaagaacaacuccgagcugcuggacgacaucggcacggcguucagccuccacaagaccgacgaggacaucugccgguaccuggacggcaagcuguccgagagcauccucaacgcccugcuggagaaccucaacuucgacaaguucauccagcugucccugaaggcccuccagcagauccugccgcugaugcuccaggggcagcgcuacgacgaggccgugagcgccaucuacggcgaccacuacgggaagaaguccgcggagaucaaccggcugcugcccaccauccccgccgacgagauccgcaaccccgugguccuccggacccugacgcaggcccgcaaggugaucaacgccgugguccggcuguacggcagcccggcccgcauccacaucgagaccgggcgggaggugggcaagagcuaccaggaccgcaagaagcucgagaagcagcaggaggacaaccggaagcaccgcgaguccgcggugcagaaguucaaggaguacuuccccaacuucgucggcgagcccaaggggaaggacauccugaagaugcggcuguacgagcuccagcaggccaagugccuguacagcggcaagucccuggagcuccaccgccugcuggagaagggguacguggaggucgaccacgcccuccccuucagccggaccugggacgacuccuucaacaacaaggugcuggugcuggccaacgagaaccagaacaagggcaaccucaccccguacgaguggcuggacgggaagaacaacagcgagcccuggcagaacuucgucgcgcgcgugcagacguccggcuucagccacaccaagaagcagcgcauccugucccacaagcucgacgagaagggcuucaucgagcggaaccugaacgacacccgcuacgugguccgguuccugugcaacuucaucgccgacaacaugcuccugaccgggaagggcaagcgcaagguguucgccagcaacgggcagaucacggcccugcuccggggccgcugggggcugcagaaggugcgggacgacaacgaccgccaccacgcccuggacgcggucgugguggccugcuccaccgucgccaugcagcagaagaucacccgguucgugcgcuacgaggagggcaacguguucagcggcgagcggaucgaccgcgagaccggggagaucaucccccuccacuuccccuccccgugggccuucuuccgggagaacgucgagauccgcaucuucagcgagaaccccaagcuggagcuggagaaccggcuccccgacuacccccaguacaaccacgaguucgugcagccgcuguucgugucccgcaugcccacgcggaagaugaccggccaggggcacauggagaccgucaagagcgccaagcgccuggacgagggccucuccgugcugaaggugccccugacccagcucaagcugaacgaccuggagcggauggucaaccgcgagcgggagauggcgcucuacgagagccugaaggugcgccuggagcaguucgacaacgaccccgccaaggccuucgccgagccguucuacaagaagggcggggcccucgugaaggcgguccgcguggagcagacgcagaaguccggcgugcugguccgggacgggaacggcguggccgacaacgccagcauggugcgcgucgacguguucaccaaggccgggaaguacuuccuggugcccaucuacaccuggcaggucgcgaagggcauccuccccaacaaggccgugaccgccaacguggacgagaucgacuggcuggagauggacgagagcuaccaguucaucuucaccauguacccgaacgaccuggucaaggugaagcucaagaaggaggaguucuucggcuacuacgggggccuggaccgggccacgggggccaucgugaucaaggagcacgaccuggagaaguccaagggccgccaggggaucuaccggaucggcgucaagcucgcgcugagcuucgagaaguaccagguggacgagcugggcaagaacauccgccccugccggcccaccaagcgccagcacgugcgguga

SEQ ID NO: 1483 - RNA, 3165 nt, Artificial Sequence
  Cas9 variant
augcgcauccugggcguggaccucggggucgccagcgugggcugggcccuggugaacgacaagaacaacaagaucaucgacuccgggguccggaucuucacccagagcaccaaccgcgagggcaagacgcuggcggccgugcggcgcuccuuccgcgggggccggcgggugcucagccgccggaagcagcgccugaaccagcugaagaagcuguucaucgcccacaagcugcuguccaagagcgaguucaagcaccucuucaacuccaagaaccggcuggacaucuggcagcugcgcgccaagggccucgagcagcagcugaacaacaaggagugggcccggguccuguaccacaucgcgaagcgccgggccuaccagagcaaccgcaaguccgaggagagcgggaacaccgacaagaagaaggugcucuccggcaucagcaagaacgagaagaagaugaacgagcugggguacaagaccaucggcgagaugcuguacaccgagaaccgguaccccgacaaccgcauccggcgcaacaagaaggaccaguacaagcacuccaucagccgggaccuccugcgcaaggagaucgacgugcuguucgagucccagcgcgacuucgggaaccaguucgccacggacggccucaaggagcacuacaaggacaucgccuucacccagcggccgaucaaguucaaggcggaccuggucggcaagugcaccuucgagacccaggaguaccgcggggccaagaacugcuucagcguggagaaguccacgcugcucagcaagaucaacaacaccgaccugaucgacaaguccaccggcgagaucaagcggcuguucgagaucagcgaguucgacaagcuccuggacaucuucuacagcaucaaggaggugaaguacaccacgcugcgcaagcagcucaagaucaccgacgccuucaaguucaagcagcuggacuaccaccagaacuucgaguacaagaccaacaucaaggccaagaucgaggacuucuacaagcuggaggacuggcucacccccgagcagaagguccugcuggagaagcagguccucgacgacaagaaggagaaguucaagugcuacaaguacuccagcauccgguccauccugagccuguccgagagccagaaguucaacggggugaaguacgacacgaagguggagaacaccguguucggcaagcucaacggcuaccacuccaucaagaaggagcugaacaaggagguguucgaccuccucuucaucgacaaggacaaguucaacaagaucgccgagauccugagcuaccagaaggacgacaaguccgcgacccaggaccugaagaagcaggucuucaacgacuucaacauggacaagaccaucgugaacgaggccaucaacagccuccugaacaucuccuucagcggguucaacucccugagccucaaggccaucaacaagcugcugcccuaccugugccagggccucaaguaccacgacgccguggcccacuccgaguacaagcaccacagccaguucaaggcggccaacccccagcaguaccugcgcccgcugaacaaggaggagaacuaccagaucacgucccccaccgucaagcggguguucagccaguuccgcaaggugcucaacgccgucauccggaagcacggguccuucgacgccaugcacaucgagauggcccgcgagcugaagaacagcaagaagaucaaguucgagauccagaccggccagaaggaguacgcgcaggagaaggaggccauccgggugaaguuccuggagaucuucaaguacgaggggagcggccgcgaccuccugaagcugcggcucuacgagcagcagcacggcaagugcaucuacuccaagaaggagaucgagaucaacaagcugcuggaggacggguacgucgagaucgaccacauccuccccuggagccgcaccuucgacaacucccugaacaacaaggcccugugccucagcgccgagaaccagaacaaggccaaccagacgcccuucgaguaccugaccaacuccgacaagaacagcaaggacuccaaggaguggcaggaguacaagaacuacgugagcuccuucgcgggcaucaagcaggccaagaagcacaagcugcucaacaccacccugccgccccggcgcgggaacgacuucagcgacgacaucaagaaccccgaguccggcuuccuggcccggaaccucaacgacacggccuacgcgagccgcuucaucaagaacuucgugcagaaccaccuccaguucucccagaacgacaccaucaagcagaaggucaaggugcggagcggggcccugaccaaccagcugcgcuacaacuggggcaucgaggagaagaaccgcgacaacaaccugcaccacgccgaggacgccaucauccuggccuucgcgacccagggcgaggugcagcggauguccacgaucagcgccaagcgcgaggacuucaaguaccagaccgccaaggagcggaagaucaaguucacgcccccguucuccgacuucaagagcguccucgacgagagcgugggggacaucuucguguccuucgcgccccgccggaagaucagcggcgccgcccacaaggccaccaucaagcccaaggacaccgggggcaaguacaaguuccccgucaacaacgggauggccgagaacggcgugauccagcgcguggacgucuucaagaacgccaagaacaaguaccaguucaucguguucuacccggccgacuucuacaaggacgacuuccccgagcuggaccugaagggcaacgagaucgacaagaacgugcaguuccucuucucccuguucaaggacgaccugaucgaguucaagaccaagaagaccaagaccaaggacagcaagcaccuccuggcguacuucaaguacauccgguccgacgggaagaucgccuuccagcagaacuacaaggccgagaucgagcgcaaggagagcgacaacaagaagggcuacaaggacauccugcucgccaccggguccggccuggcgagccugaagaaguaccaggucuccgugcucggcgacaucgccgaggugaagaacgagaagcggcugccccugaucaagcagauguacaagagcaagcccaagaagaaguga

SEQ ID NO: 1484 - RNA, 3165 nt, Artificial Sequence
  Cas9 variant
augaaccagaaguucauccugggccucgacaucgggaucaccagcgugggcuacgggcugaucgacuacgagaccaagaacaucaucgacgccggcguccgccuguuccccgaggccaacguggagaacaacgaggggcggcgcuccaagcggggcagccgccggcucaagcgccggcgcauccaccggcuggagcgcgugaagaagcugcucgaggacuacaaccugcuggaccagucccagaucccgcagagcacgaaccccuacgcgauccgggucaagggccucuccgaggcccugagcaaggacgagcuggugaucgcccuccugcacaucgccaagcgccgggggauccacaagaucgacgugaucgacuccaacgacgacgucggcaacgagcugagcaccaaggagcagcucaacaagaacuccaagcugcugaaggacaaguucgugugccagauccagcucgagcgcaugaacgaggggcagguccggggcgagaagaaccgcuucaagaccgccgacaucaucaaggagaucauccagcugcugaacgugcagaagaacuuccaccagcucgacgagaacuucaucaacaaguacaucgagcugguggagaugcggcgcgaguacuucgaggggcccggcaagggcagccccuacgggugggagggcgacccgaaggcgugguacgagacccugauggggcacugcacguacuuccccgacgagcuccgguccgugaaguacgccuacagcgccgaccuguucaacgcccugaacgaccucaacaaccuggucauccagcgcgacggccuguccaagcucgaguaccacgagaaguaccacaucaucgagaacguguucaagcagaagaagaagcccacccugaagcagaucgcgaacgagaucaacgugaaccccgaggacaucaagggcuaccggaucaccaagagcgggaagccgcaguucaccgaguucaagcuguaccacgaccucaaguccguccuguucgaccagagcauccuggagaacgaggacgugcucgaccagaucgccgagauccugacgaucuaccaggacaaggacuccaucaagagcaagcugaccgagcucgacauccugcugaacgaggaggacaaggagaacaucgcccagcucaccggcuacaccgggacgcaccgccugucccugaagugcauccgccucgugcuggaggagcagugguacagcagccggaaccagauggagaucuucacccaccugaacaucaagcccaagaagaucaaccucaccgccgccaacaagauccccaaggcgaugaucgacgaguucauccugucccccgucgugaagcgcaccuucggccaggccaucaaccugaucaacaagaucaucgagaaguacggggugccggaggacaucaucaucgagcuggcccgggagaacaacagcaaggacaagcagaaguucaucaacgagaugcagaagaagaacgagaacacgcgcaagcggaucaacgagaucaucggcaaguacggcaaccagaacgccaagcgccucgucgagaagauccggcugcacgacgagcaggaggggaagugccuguacucccucgagagcaucccccuggaggaccugcucaacaaccccaaccacuacgagguggaccacaucaucccccgcuccgugagcuucgacaacuccuaccacaacaagguccuggugaagcagagcgagaacuccaagaaguccaaccugaccccguaccaguacuucaacagcggcaagagcaagcucuccuacaaccaguucaagcagcacauccugaaccugagcaagucccaggaccggaucagcaagaagaagaaggaguaccuccuggaggagcgcgacaucaacaaguucgagguccagaaggaguucaucaaccggaaccugguggacacccgcuacgccacccgggagcucacgaacuaccugaaggcguacuucuccgccaacaacaugaacgugaaggucaagaccaucaacgggagcuucaccgacuaccugcgcaagguguggaaguucaagaaggagcggaaccacggcuacaagcaccacgccgaggacgcccucaucaucgccaacgcggacuuccuguucaaggagaacaagaagcugaaggccgugaacuccguccucgagaagcccgagaucgagagcaagcagcuggacauccagguggacagcgaggacaacuacuccgagauguucaucauccccaagcagguccaggacaucaaggacuuccgcaacuucaaguacagccaccggguggacaagaagcccaaccgccagcugaucaacgacacccucuacuccacgcggaagaaggacaacagcaccuacaucgugcagaccaucaaggacaucuacgccaaggacaacaccacgcugaagaagcaguucgacaaguccccggagaaguuccugauguaccagcacgacccccgcaccuucgagaagcucgaggugaucaugaagcaguacgccaacgagaagaacccccuggccaaguaccacgaggagaccggggaguaccugaccaaguacagcaagaagaacaacggccccaucgucaagucccucaaguacaucggcaacaagcuggggagccaccuggacgugacgcaccaguucaaguccagcaccaagaagcucgugaagcuguccaucaagccguaccgcuucgacgucuaccugaccgacaagggcuacaaguucaucaccaucagcuaccucgacgugcugaagaaggacaacuacuacuacauccccgagcagaaguacgacaagcugaagcucgggaaggcgaucgacaagaacgccaaguucaucgccuccuucuacaagaacgaccugaucaagcuggacggcgagaucuacaagaucaucggggugaacagcgacacgcggaacaugaucgagcucgaccugcccgacauccgcuacaaggaguacugcgagcugaacaacaucaagggcgagccccggaucaagaagaccaucggcaagaaggucaacuccaucgagaagcucaccaccgacgugcuggggaacguguucaccaacacgcaguacaccaagccgcagcuccuguucaagcgcggcaacuga

SEQ ID NO: 1485 - RNA, 3165 nt, Artificial Sequence
  Cas9 variant
augaagcugacgccccucaacuacauccugggccuggaccucgggaucgccagcgugggcugggccgucguggagaucgacgagcaggagaacccgcuggggcugaucgacgugggcguccgcaccuucgaccgggcggaggugcccaagaccggggagucccucgcccuggcccgccggcuggcccgcagcgcccggcgccucgugaagcggcgcgcggaccggaucaagaaggccaagcgccugcugaaggccgagaacauccuccuguccgccgacgagcaccuccccaacgacgucuggcagcugcgggugaagggccuggaccagaagcuggagcgccaggagugggcggccgugcuccugcaccuccugaagcaccggggcuaccugagccagcgcaagaacgaguccaagagcgagaacaaggagcugggggcccuccuguccggcgucgagaccaaccaccagauccugcagagcgccgaguaccggacccccgccgagaucgcggugaagaaguuccacguggaggacgggcacauccgcaaccagcggggcgccuacacccacacguucucccgccucgaccugcuggccgagauggagcuccuguuccagcggcagaccgaccuggggaacccgcacaccagcgccaagcuccuggagaaccugaccgcccuccugauguggcagaagcccgcgcuggccggcgaggccauccucaagaugcugggcaagugcacguucgagcccaccgaguacaaggccgccaagaacuccuacagcgcggagcgcuucgucuggcugaccaagcucaacaaccugcggauccuggagcagggggccgagcgcgcccucaccgacaacgagcgcuucgcccugcuggaccagcccuacgagaaggccaaguucacguacgcgcaggcccggaccaugcucgcccugccggacgaggccaucuucaagggcgugcgcuaccagggggaggacaagaaggcgguggagaccaagaccauccugauggagaugaaggccuaccaccagauccggaaggcccuggagaacgccgaccucaaggccgaguggaacgagcugaagaacaacuccgagcugcucgacgacaucggcacggcguucagccugcacaagaccgacgaggacaucugccgcuaccuggacggcaagcucuccgagagcauccugaacgcccugcucgagaaccugaacuucgacaaguucauccagcugucccucaaggcccugcagcagauccugccccucaugcugcaggggcagcgguacgacgaggccgucagcgccaucuacggcgaccacuacgggaagaaguccgcggagaucaaccgccugcuccccaccauccccgccgacgagauccggaacccgguggugcugcgcacccugacgcaggcccggaaggucaucaacgccguggugcgccucuacggcagccccgcccggauccacaucgagaccgggcgcgaggucggcaagagcuaccaggaccggaagaagcuggagaagcagcaggaggacaaccgcaagcagcgggaguccgcggugaagaaguucaaggaguacuuccccaacuucgugggcgagcccaaggggaaggacauccugaagaugcgccucuacgagcugcagcaggccaagugccuguacagcggcaagucccucgagcugcaccggcugcucgagaagggguacgucgagguggaccacgcccugccguucagccgcaccugggacgacuccuucaacaacaagguccuggugcucgccaacgagaaccagaacaagggcaaccugacccccuacgaguggcuggacgggaagaacaacagcgagcacuggcagaacuucguggcgcggguccagacguccggcuucagccacaccaagaagcagcgcauccucucccacaagcuggacgagaagggcuucaucgagcgcaaccugaacgacacccgguacguggcccgcuuccucugcaacuucaucgccgacaacaugcugcugaccgggaagggcaagcggaagguguucgccagcaacgggcagaucacggcccuccugcgcggccggugggggcugcagaagguccgcgacgacaacgaccggcaccacgcgcucgacgccgugguggucgccugcuccaccguggugaugcagcagaagaucacccgcuucguccgguacgaggagggcaacguguucagcggcgagcgcaucgaccgggagaccggggagaucaucccccugcacuuccccuccccgugggccuucuuccgcgagaacguggagauccggaucuucagcgagaaccccaagcuggagcucgagaaccgccugcccgacuacccccaguacaaccacgaguucguccagccgcuguucgugucccggaugcccacgcgcaagaugaccggccaggggcacauggagaccgucaagagcgccaagcggcucgacgagggccuguccgugcugaaggugccccucacccagcugaagcugagcgaccucgagcgcauggugaaccgggagcgcgaggucacgcuguacgagucccugaaggcgcggcucgagcaguucggcaacgaccccgccaaggccuucgccgagccguuccacaagaagggcggggccguggugaaggcgguccgcguggagcagacccagaaguccggggugcugguccgcgacggcaacgggguggccgacaacgccagcauggugcgggucgacguguucaccaagggcggcaaguacuuccuggugcccaucuacaccuggcaggucgccaaggggauccuccccaacaaggcggugaccgccaacguggacgagaucgacuggcuggagauggacgagagcuaccaguucaucuucacgauguacccgaacgaccuggucaaggugaagcucaagaaggaggaguucuucggcuacuacgggggccuggaccgcgccaccggggccaucgugaucaaggagcacgaccuggagaaguccaagggcaagcagggcaucuaccggaucggggucaagcucgcccugagcuucgagaaguaccagguggacgagcugggcaagaacauccgccccugccggcccaccaagcgccagcacgugcgguga

SEQ ID NO: 1486 - RNA, 3165 nt, Artificial Sequence
  Cas9 variant
augaaggagaaguacauccugggccucgaccuggggaucaccagcgugggcuacgggaucaucaacuucgagaccaagaagaucaucgacgccggcguccgccuguuccccgaggccaacguggacaacaacgaggggcggcgcuccaagcggggcagccgccggcucaagcgccggcgcauccaccggcuggagcgcgugaagcugcuccugacggaguacgaccugaucaacaaggagcagaucccgaccuccaacaaccccuaccagauccgggucaagggccucagcgagauccuguccaaggacgagcuggccaucgcccuccugcaccuggccaagcgccgggggauccacaacaucaacgugagcuccgaggacgaggacgccagcaacgagcucuccaccaaggagcagaucaaccgcaacaacaagcugcugaaggacaaguacgugugcgagguccagcuccagcggcugaaggagggccagauccgcggggagaagaaccgguucaagaccacggacauccugaaggagaucgaccagcuccugaaggugcagaaggacuaccacaaccuggacaucgacuucaucaaccaguacaaggagaucguggagacccgccgggaguacuucgagggccccgggcagggcagccccuucggcuggaacggggaccucaagaagugguacgagaugcugaugggccacugcaccuacuucccgcaggagcugcgcuccgucaaguacgccuacagcgcggaccucuucaacgcccugaacgaccugaacaaccucaucauccagcgggacaacuccgagaagcuggaguaccacgagaaguaccacaucaucgagaacguguucaagcagaagaagaagcccacccugaagcagaucgccaaggagaucggggugaaccccgaggacaucaagggcuaccgcaucaccaagagcggcacgccccaguucaccgaguucaagcucuaccacgaccugaaguccaucgucuucgacaagagcauccuggagaacgaggccauccucgaccagaucgcggagauccugaccaucuaccaggacgagcaguccaucaaggaggagcugaacaagcucccggagauccugaacgagcaggacaaggccgagaucgccaagcugaucggguacaacggcacgcaccgccucagccugaagugcauccaccugaucaacgaggagcucuggcagaccucccggaaccagauggagaucuucaacuaccugaacaucaagcccaacaagguggaccugagcgagcagaacaagauccccaaggacauggugaacgacuucauccucagccccgucgugaagcgcaccuucauccaguccaucaacgugaucaacaaggucaucgagaaguacgggaucccggaggacaucaucaucgagcuggcccgggagaacaacagcgacgaccgcaagaaguucaucaacaaccugcagaagaagaacgaggccacccggaagcgcaucaacgagaucaucggccagacggggaaccagaacgcgaagcggaucguggagaagauccgccugcacgaccagcaggagggcaagugccucuacucccuggagagcaucgcccugauggaccuccugaacaacccccagaacuacgagguggaccacaucaucccccgguccgucgccuucgacaacagcauccacaacaaggugcuggugaagcagaucgagaacuccaagaagggcaaccgcacccccuaccaguaccucaacagcuccgacgccaagcugagcuacaaccaguucaagcagcacauccugaaccucuccaagagcaaggaccggaucuccaagaagaagaaggacuaccugcuggaggagcgcgacaucaacaaguucgagguccagaaggaguucaucaaccggaaccucguggacacccgcuacgccacccgggagcugacgagcuaccugaaggcguacuucuccgccaacaacauggacgucaaggugaagaccaucaacgggagcuucaccaaccaccuccgcaagguguggcgguucgacaaguaccgcaaccacggcuacaagcaccacgccgaggacgcccugaucaucgccaacgcggacuuccuguucaaggagaacaagaagcuccagaacaccaacaagauccuggagaagccgacgaucgagaacaacaccaagaaggucaccguggagaaggaggaggacuacaacaacguguucgagacccccaagcuggucgaggacaucaagcaguaccgggacuacaaguucucccaccgcguggacaagaagcccaaccgccagcucaucaacgacacgcuguacagcacccggaugaaggacgagcacgacuacaucgugcagaccaucaccgacaucuacgggaaggacaacacgaaccugaagaagcaguucaacaagaaccccgagaaguuccucauguaccagaacgacccgaagaccuucgagaagcuguccaucaucaugaagcaguacagcgacgagaagaacccccuggccaaguacuacgaggagaccggcgaguaccucaccaaguacagcaagaagaacaacgggcccaucgucaagaagaucaagcugcugggcaacaaggugggcaaccaccucgacgugacgaacaaguacgagaacuccaccaagaagcuggucaagcugagcaucaagaacuaccgcuucgacguguaccucaccgagaagggguacaaguucgugaccaucgccuaccugaacgucuucaagaaggacaacuacuacuacauccccaaggacaaguaccaggagcugaaggagaagaagaagaucaaggacaccgaccaguucaucgccuccuucuacaagaacgaccucaucaagcugaacggcgaccuguacaagaucaucggggugaacagcgacgaccggaacaucaucgagcucgacuacuacgacaucaaguacaaggacuacugcgagaucaacaacaucaagggcgagccgcgcaucaagaagacgaucgggaagaagaccgaguccaucgagaaguucaccaccgacgugcugggcaaccuguaccuccacagcacggagaaggcgccccagcugaucuucaagcggggccuguga

SEQ ID NO: 1487 - RNA, 3165 nt, Artificial Sequence
  Cas9 variant
auggagaacaagaaccugaacuacauccucggccuggaccuggggaucgccagcgugggcugggccgucguggagaucgacgagaaggagaacccccuccgccugaucgacguggggguccggaccuucgagcgcgcggaggugccgaagaccggcgagucccuggcccucagccggcgccuggcccgguccgcccgccggcugacgcagcgccggguggcccgccucaagaaggcgaagcggcugcucaagagcgagaacauccugcuguccaccgacgagcgccugccccaccaggucuggcagcuccggguggaggggcuggaccacaagcuggagcgccaggagugggccgccgugcuccugcaccugaucaagcaccggggcuaccucagccagcgcaagaacgaguccaagagcgagaacaaggagcugggcgcccugcucuccggggucgacaacaaccacaagcugcugcagcaggcgaccuaccggagccccgccgagcucgccgugaagaaguucgagguggaggagggccacauccgcaaccagcagggggccuacacccacacguucucccggcuggaccugcucgccgagauggagcugcuguucagccgccagcagcacuucggcaaccccuucgcguccgagaagcuccuggagaaccugaccgcccuccugauguggcagaagccggcccugagcggggaggccauccucaagaugcugggcaagugcaccuucgaggacgaguacaaggccgcgaagaacaccuacuccgccgagcgguucgucuggaucacgaagcugaacaaccuccgcauccaggagaacggccuggagcgcgcccugaacgacaacgagcggcucgcccugauggagcagcccuacgacaagaaccgccuguucuacagccaggugcgguccauccucaagcugagcgacgaggccaucuucaaggggcugcgcuacuccggcgaggacaagaaggcgaucgagaccaaggccgugcugauggagaugaaggccuaccaccagauccggaagguccucgaggggaacaaccugaaggccgagugggccgagcugaaggcgaaccccacccuccuggacgagaucggcaccgccuucagccuguacaagacggacgaggacaucagcgccuaccucgccggcaagcugucccagcccgugcugaacgcgcuccuggagaaccugagcuucgacaaguucauccagcucucccugaaggcccuguacaagcuccugccgcugaugcagcaggggcuccgcuacgacgaggccugccgggagaucuacggcgaccacuacgggaagaagaccgaggagaaccaccacuuccugccccagauccccgccgacgagauccgcaaccccgugguccugcggacccucacccaggcccgcaaggugaucaacggcgugguccggcuguacgggagcccggcgcgcauccacaucgagacgggccgggaggugggcaaguccuacaaggaccgccgggagcuggagaagcgccaggaggagaaccggaagcagcgcgagaacgccaucaaggaguucaaggaguacuucccccacuucgccggggagcccaaggccaaggacauccucaagaugcggcuguacaagcagcagaacgccaagugccuguacagcggcaagcccaucgagcuccaccgccugcuggagaagggguacguggaggucgaccacgcgcucccguucucccgcaccugggacgacagcuucaacaacaaggugcugguccuggccaacgagaaccagaacaagggcaaccucacccccuucgaguggcuggacgggaagcacaacuccgagcgguggcgcgccuucaaggcccugguggagaccagcgccuuccccuacgcgaagaagcagcggauccucucccagaagcuggacgagaagggcuucaucgagcgcaaccugaacgacacgcgguacguggcccgcuuccucugcaacuucaucgccgacaacaugcaccugaccggcgaggggaagcggaaggucuucgccagcaacggccagaucaccgcgcugcuccgcucccggugggggcuggccaagagccgcgaggacaacgaccggcaccacgcccuggacgccgugguggucgccugcuccaccguggcgaugcagcagaagaucacgcgcuucgugcgguucgaggccggcgacgucuucaccggggagcgcaucgaccgggagaccggcgagaucaucccccuccacuucccgacccccuggcaguucuucaagcaggagguggagauccgcaucuucagcgacaaccccaagcuggagcuggagaaccggcuccccgaccgcccgcaggccaaccacgaguucgugcagccccuguucgucucccggaugcccacgcgcaagaugaccggccaggggcacauggagaccgucaagagcgccaagcggcugaacgagggcaucuccgugaucaagaugccccucaccaagcugaagcugaaggaccucgagcugauggugaaccgcgagcgcgagaaggaccuguacgacacgcucaaggcccggcuggaggcguucaacgacgacccggccaaggccuucgccgagcccuucaucaagaagggcggggccaucgucaagagcgugcgcguggagcagauccagaaguccggcgugcuggugcgggaggggaacggcgucgcggacaacgccagcauggugcgcguggacgucuucaccaagggcgggaaguacuuccucgugcccaucuacaccuggcaggucgccaaggggauccugccgaacaaggccgcgacccaguacaaggacgaggaggacugggaggugauggacaacagcgccacguucaaguucucccugcaccccaacgaccucgugaagcuggugaccaagaagaagaccauccugggcuacuucaacggccucaaccgggccaccgggaacaucgacaucaaggagcacgaccuggacaagagcaagggcaagcaggggaucuucgagggcgucgggaucaagcuggcccucuccuucgagaaguaccagguggacgagcugggcaagaacauccgccugugcaagcccagcaagcggcagcccgugcgcuga

SEQ ID NO: 1488 - RNA, 3168 nt, Artificial Sequence
  Cas9 variant
augaacaacuacauccugggccucgacaucgggaucaccagcgugggcuacgggaucgucgacuccgacacccgcgagaucaaggacgccggcgugcggcuguuccccgaggccaacguggacaacaacgaggggcgccggagcaagcgcggcgcccggcgccugaagcggcgccggauccaccgccucgaccgggucaagcaccuccuggccgaguacaaccugcuggaccugacgaacaucccgaaguccaccaaccccuaccagauccgcgugaagggccucaacgagaagcugagcaaggacgagcuggugaucgcccuccugcacaucgccaagcggcgcgggauccacaacgucaacgugaugauggacgacaacgacuccggcaacgagcugagcaccaaggaccagcucaagaagaacgccaaggcgcuguccgacaaguacgugugcgagcugcagcucgagcgguucgagcaggacuacaagguccgcggggagaagaaccgguucaagaccgaggacuucgugcgcgaggcccggaagcugcuggagacgcagagcaaguucuucgagaucgaccagaccuucaucaugcgcuacaucgaccucguggagacccggcgcgaguacuucgagggccccgggaagggcucccccuucggcugggaggggaacaucaagaagugguucgagcagaugaugggccacugcaccuacuucccggaggagcugcgcagcgucaaguacgccuacuccgccgagcuguucaacgcgcucaacgaccugaacaaccuggugaucacgcgggacgaggaggccaagcucaacuacggggagaaguuccagaucaucgagaacguguucaagcagaagaagacccccaaccugaagcagaucgccaaggagaucggcgucagcgagaccgacaucaagggcuaccgcgugaacaaguccgggaagcccgaguucacccaguucaagcuguaccacgaccucaagaacaucuucgaggacagcaaguaccugaacgacgugcagcugauggacaacaucgccgagaucaucacgaucuaccaggaccccgaguccaucaucaaggagcucaaccugcugccggagcuccugagcgagaaggagaaggagaagaucuccgcccugagcggcuacgcggggacccaccggcucucccugaagugcaucaaccugcuccuggacgaccugugggagagcagccucaaccagauggagcuguucaccaagcugaaccucaagcccaagaagaucgaccugucccagcagcacaagauccccaucaagcuggucgacgacuucauccugagccccguggugaagcgcgccuucauccaguccauccaggucgugaacgccaucaucgacaaguacggccucccggaggacaucaucaucgagcuggcccgggagaacaacagcgacgaccgccggaaguuccugaaccagcuccagaagcagaacgccgagacccgcaagcaggucgagaaggugcugcgggaguacgggaacgacaacgcgaagcgcaucgugcagaagaucaagcugcacaacaugcaggagggcaagugccucuacucccugaaggacaucccccuggaggaccuccugaagaaccccaaccacuacgaggucgaccacaucaucccccggagcguggccuucgacaacuccaugcacaacaaggugcugguccgcgccgaggagaacagcaagaagggcaaccggacgccguaccaguaccucaacuccagcgaguccagccuguccuacaacgaguucaagcagcacauccugaaccucagcaagaccaaggaccgcaucaccaagaagaagcgggaguaccugcuggaggagcgcgacaucaacaaguacgacgugcagaaggaguucaucaaccggaaccucguggacacccgcuacgccacgcgggagcugaccucccugcucaaggccuacuucagcgcgaacaaccuggacgucaaggugaagaccaucaacggguccuucaccaacuaccugcgcaagguguggaaguucgacaaggaccgcaacaagggcuacaagcaccacgccgaggacgcccucaucaucgccaacgccgacuuccuguucaagcacaacaagaagcugcggaacaucaacaagguccucgacgcgcccagcaaggagaucgacaagaagcgcgugacggugcaguccgaggacgaguacaaccagauguucgaggacacccagaaggcccaggccaucaagaaguucgagauccggaaguucagccaccgcgucgacaagaagcccaaccggcagcugaucaaggacacccuguacagcacccgcaacaucgacgggaucgaguacgugguggaguccaucaaggacaucuacagcgucaacaacgacaaggugaagacgaaguucaagaaggacccccaccggcuccugauguaccgcaacgacccgcagaccuucgagaaguucgagaagguguucaagcaguacgaguccgagaagaaccccuucgccaaguacuacgaggagaccggcgagaagauccggaaguucagcaagaccgggcagggccccuacaucaacaagaucaaguaccugcgcgagcggcucggccgccacugcgacgucacgaacaaguacaucaacucccggaacaagaucgugcagcugaagaucuacagcuaccgcuucgacaucuaccaguacgggaacaacuacaagaugaucaccaucuccuacaucgaccuggagcagaaguccaacuacuacuacaucagccgggagaaguacgagcagaagaagaaggacaagcagaucgacgacagcuacaaguucaucggcuccuucuacaagaacgacaucaucaacuacaacggggagauguaccgcgugaucggcgucaacgacagcgagaagaacaagauccagcucgacaugaucgacaucuccaucaaggacuacauggagcugaacaacaucaagaagaccggggugaucuacaagaccaucggcaagagcacgacccacaucgagaaguacaccaccgacauccugggcaaccucuacaaggcggcgcccccgaagaagccccagcugaucuucaagcgggggauggaguga

SEQ ID NO: 1489 - RNA, 3168 nt, Artificial Sequence
  Cas9 variant
augacccccaucagcgagucccuccuguucggccuggacguggggaucagcuccugcggcugggccguccugaagcacagcgacaccacggggcacaucgaggcccucggcuccuggugcuucaacgccccggagaccaagaccgagcgcacccccacgaaccagauccggcgcagcucccggcugcugcgccggguggugcgccggcgccggaaccgcaugaccgagauccggcgccucuucgcccggcacgggcugaucgacaacgaccgccccgacgcccugcggcagcccgccaucgacccgugggagaugcgcggccagggccucgaccggcagcugacccccgaggaguucgccgucgcgcuggcccacaucgccaagcaccgcggguucaagagcuccgccaagcgggucaagagcaacgcgucccccgacgacagcaagaugcucgccgcccuggagaagaccaaggagcuguccgcccaguaccgcacgaucggcgagauguucgcccgggacagcgcguacgugcagcgccgccggaaccgcgacggccucuucgaccggaccaucucccgcgacgaccugaucgacgaggccaagauccuguucgaccggcagcgcaagcucgggaaccccguggccagcaccgagaucgaggaggccuucacccggaucgccuucuggcagaacccgaugcaggacuccggggugcugguggcgagcugccccuucgagcccaaggagaagcgcuccagccgguucagccccuccuucgagcgcuuccggcugcucugccgccugaucaaccugcgggucacggacggcccggaggagcgcccccucaccgaggaggagcugcggcuggccuacgagcacgccggcaagacccgcaagcucaccgccgccgcgauccggaagcugaucgggcugcgcgacgaccagcacuucacgaccaucccgcccgagcaggagaagcaggacaucaccagccggaccggcgagacguucgccgggaccgccaccuuccgcuccgugcucggcgagagccuguggcgccagcugcucccccaccccgaguggcuggacaacgccgccuggaucaucuccuuccacgagcugaccgagacgaucaucaagaagcucggcgagaucgggcugcccguggaggcguacgagcugaucugcgacgcccucaagagcgacaagucccccuucgccaaguucaagggcgccagcucccugagcgacaaggcgguccgggcccugaucccguaccuccagcaggggcugaccuacgacaaggccugccagaaggccggcuacgaccacgccgcgucccgcuucagcgggcgggccaccaucgacaccaaggccaaguucaacgcccugauggccgaggugcgcgacuccaucgcgaaccccaucgcccggaaggcccucagcgagggcaugaagcagcugugggccaugcgcaaccgguggggccugcccggggccaucugcaucgagcucgcgcgcgacgugggcaacucccuggagaagcggaaggagaucgagcgcaaccugaagacgaccgccaagcagcgggcccgcgagcgggaggaggccugcgagcugcucaaccugaaggaggucagcuccgacauccugcuccgcuaccggcuguggaaggagcagggcgggcgcugcugcuacagcgggaaguccaucacccccgacaugcugauggcgcaggacaaccggauccagaucgaccacauccucccguggagccgcuucggcgacgacagcuacuccaacaagggccugugccuggccaaggagaaccaggccaagaagaaccagacccccuacgaguggauccacgggcagggcacgaccgcccagaaggagcagugggacaaguucguggccgacguggagagccggaagaacaccaaggggcucaagaagcgcaacuuccugcugaagggcuccaaggagaucgaggagcgguuccgcagccgcaaccucaacgacacccgguacgcggcccgccugauggucgaggccgcccggcugcucuaccccgccgggcagcgcggcgagaagggcgggacgcggcgcguguucacccggcccggcgcgcugaccgccgcccugcgccacgccuggggcguggagucccucaagaagaucgacggggagcggcugcacgacaaccgccaccacgcccuggacgcggccaucgucgccgccgugagcgaggcggagauccagaagcucaccaaguccuuccaggagugcgagcagaagggccugagccggccgaugcgcgacguggccccgcccugggacggguuccgggaccagcugaaggagaaguacgagaccaucuucgucgcccgccccgagcggcagcgcgcccggggccaggggcacgaggccacgauccgccaggugcgggaggaggagaccggccccgucaucuacgagcgcaaggcgguguccgcccucacccuggccgaccuggccaagaucaaggaccccgaccgcaacgccgggcucaucgcgagccugcggcaguggaucgaggccggcaagcccgccgacaagccgccccgcacccccugccaccaguccgccgccggccacgagauccggaaggugcgccuggcgacgaucaucacccccgccgucccggugcggggcgggauggccaagcgcggggagaugacccggguggacaucuucaaggucaucggcaagaaggggaagcccgagugguacaugauccccaucuacccccaccagaucaugaaccgcagccaguggccggccccgcccaacaaggccgugguggcgggcaaguccgaggccgacuggcccaucaugggcgccgaggcccaguuccaguucagccucuaccccugcuccuacguccggcuguucaaggaggggaccgugaucgagggcuacuucugcgggugccaccgcagccgggcguacaucacgcuggcccucuccaccggcgccgcgccccugcagaaggggaucggcaucaagacccaggagcacauccagaaguucagcgugaaccgcuucggcgagcugagccccgucaagcaggagacccggacguggcacgggguggccugcaccucccccgaccagcacgacuga

SEQ ID NO: 1490 - RNA, 3171 nt, Artificial Sequence
  Cas9 variant
augaaggcccugaacuacauccucggccuggaccuggggaucgccagcgugggcugggcggucguggagaucgaccagaacgagcuccccauccgccugaucgaccugggggugcggaccuucgagcgcgccgaggucccgaagaccggcgacucccucgcccuggcccggcgccuggcccggagcucccgccggcucgugcgccggcgcgcggugcggcugcugaaggccaagcgccuccugaagcaggaggggauccugcaggccgacgacuuccacagcucccaccucaagccccugcccaacaaccccugggagcugcgggucaagggccucaaccaccuccuggaccgcaaggagugggccgcggugcuccugcaccuccugaagcaccggggcuaccugagccagcgcaagaacgaguccaagacggacaacaaggagcugggggcccuccugaagggcgugagcgagaaccggcagcugcuccaggcccaggccuucuccaccccggccgagaucgcgaucaagaaguuccagcaggaggaggggcacauccgcaaccagcggggcgccuacagccacaccuucgaccgcaacgaccugcuggccgagcuccggcugcuguuccagaagcagcgcgaguucaacaaccccuacaccucccagagccucgagcaggccaucgccgagcugcugauguggcagaagcccgcgcucuccggggaggccauccugaagaugcugggcaagugcacguucgagcccagcgaguacaaggccccgaagaacuccuacagcgccgaguacuucgucuggcucaccaagcugaacaaccugcgcauccucgagaacggcgccgaccgggggcugaccgcggaggagcgccagcugcucaucaaccagcccuucgagaaggccaaguucaccuacgcccaggcccggaagcugcuggagcuguccgaccucgccaucuucaagggcgugcgcuacgggaaggacaacgcggagagcgccacgcugauggagaugaaggccuggcacgccauccggaaggcgcuggaguccaacggccucaagaccgaguggaacggccugaagaccaagcccgagcugcucgacaagaucgggaccgccuucagcaucuacaagacggacgaggacaucagccaguaccugaacggcgagcugucccccgccgugcucaacgcccugcuggagaaccucagcuucgacaaguucauccgccugucccugcagagccucgccaagauccugccgcugauggagcaggggcuccgguacgacgaggcgugcaagcaggucuacggcgaccacuacgggaagaaggagcagcuggagcugcgcuuccuccccaagauccccguggaggacauccggaaccccgugguccugcgcacccugucccaggcccggaaggugaucaacggcgugguccgccucuacggcagcccggcccggauccacaucgagaccgggcgcgaggugggcaaguccuucagcgagcggcgcgacaucuccaagcggcaggaggagaaccgcaacgagcggcagcgcgccguggagaaguucaaggaguucuucccccacuucgucggggagcccaaggccaaggacauccugaagaugcgccuguacgagcagcagcacggcaagugccucuacagcgggaaggagcuggaccugaaccggcuccuggagaagggcuacguggagaucgaccacgcgcugcccuucucccgcaccugggacgacagcuucaacaacaaggugcucguccuggccuccgagaaccagaacaagggcaaccagacgccguacgaguggcugaacgggaaggagaacgccgagcgguggaagcuguuccaggcccuggugaacggcagccgcuuccccuacuccaagaagcagcggauccugaccaaguaccucgacgaggacggguuccgcgagcggaaccugaacgacacccgcuacgucgcccgguuccugugcaacuucaucgaggacaacaugcagcucgugggccaggggaagaagcgcguguucgcgagcaacggccagaucaccgcccugcugcggcgcuccuggggcauccagaagguccgggaggacaacgaccgccaccacgccguggacgccguggucguggcgugcagcacgcgggcccuccagaagaagaucaccgacuacgugcgcuacaaggagaugaacgucuucaccggggagaagaucgaccaggagaccggcgagaucaucaaguuccacuuccccgagcccuggaaguucuuccggcaggagguggagauccgcguguucuccgagacgccggccgaggacgucgugaucgcccugcccgaccggccccaggccaaccacgaguucauccagccccuguucgugagccgcgcgccgacccggaagaugaccgggcagggccacauggagaccaucaagagcgccaagcgccucgccgagggccuguccgucagccgcgugccccugacgcagcucaagcugaaggaccuggagaacauggugaaccgggagcgcgagaaggcccucuacgaggcccugaagguccggcuggagaaguucaacaacgaccccgcgaaggccuucgccgacccguucuacaagaagggcgggcagcaggucaaggccgugcgcguggagcagguccagaaguccggggugcucgugcggcaggagaacggcguggccgacaacgcgagcauggugcgcgucgacguguucaucaagggcgggaaguacuuccuggugcccaucuacaccuggcaggucgccaagggcauccugcccaaccgggccgccacccaggggaaggaggaggaguacugggacaucauggacgagaccgcgaucuuccaguucucccucuaccagaacgaccugaucaagcuggugacgaagaagaagaccaucuucggcuacuucaacgggcucaaccgcgccaccagcaacaucaacaucaaggagcacgaccuggacaaguccaagggcaaggacgggaucuaccuggaggugggcgucaagcucgcccugagccuggagaaguaccagguggacgagcucggcaagaacauccagcccugccgguccaugaagaagcgcccgcccgugcgguga

SEQ ID NO: 1491 - RNA, 3171 nt, Artificial Sequence
  Cas9 variant
augcccaagcagaaguccacccgcuaccggcuggcccucgaccugggcagcaccagccuggggugggccgugcuccgccugaacgagcagcacgagccgaacgcgaucauccgggccggcguccgcaucuucuccaacgggcggaaccccaaggacggcagcucccuggccgugacgcgccgggccgcccgcgcgaugcggcgccggcgcgaccggcuccugaagcgcaaggcccggaugaugaacaagcugguggaguacggguucuuccccgccgacgucgccgagcgcaagaagcucgagcggaucaaccccuacgagcugcgcgcgaagggccuggacgccccgcucacccccggcgaguucgcccgggcccuguuccacaucaaccagcgccggggguucaagagcaaccgcaagaccgacaagaaggagaacgacuccggcgcccugaaggcggccaucagccaccuccgccagcagcugcacgagcggaaggcccgcaccgugggggaguggcuguggcagcggcuccaggccggccuggggacgcgcgcccgguaccgcgagucccggguggcgcaggccaacggcaagacccgcaucgagaaguccuacgaccuguacgucgaccggcagaugaucgccgaggaguucgacgcccucugggccgcgcaggccgccuucaacccccagcaguucagcgagcaggcccgcggcgagcugcgggacgugcugcuguuccagcgcgaccugcggcccgugcgcccggggcggugcacccugcuccccgacgaggagcgcgcgccccuggcccugcccagcguccagcgguuccgcauccuccaggaggccaaccaccuccggcugcuccacccggaccugcgcgaggagccccugucccucgcccagcgcgacgccgugguggacgcgcuggagcacaacagcaagcggaccuucgagcagcugcgcaagcuccugaagcugaacggcacggucaaguucaaccucgaggacgagaagcggaaggagcugaaggggaacgccaccuccgccacccugagcaaggacggccucuucggcgagaacugguggaaccuggacgaggcccugcaggacgccaucguguggcagcucguguccgagcagagcgaggagaagcugcagaacuggcugcaggcgaacaccggggucaacgccacgcaggccgagaccaucgccaacgccggccugcccgagggguacggcucccucagcuacaaggcgcuggcccgcaucauccccgcccugcgggggaccgagguggccaacggcaucgacgugccgcgcaccuacgaccaggccguccaggcggccggcuucgcccaccacagcgaccucgacuccggguucgacuucgagcacagccacgacgagguggagcggaucggcgagcgcgugaucgccuccacgggggaggucaagcccguguucgcguucaagcagcugcccuacuacggcaaggcccugcggcgccacguggccuucgccaaggagcacccccggaacgaggaggagcgcuacgggaagaucgccaacccgaccguccacaucggccucaaccagcugcggguggucgugaacgcgcugauccgccgguacggccgccccaccgagguggucguggagcucgcccgggaccugaagcagagccgcgagcagcggcaggaggagcagaagcgccaggccgacuaccagaagcggaacgagcacauccgccgcgagaucgccuccaugcacgggugcgccgaggagcgggugagccacgcggacguccagaaguggauccugugggaggagcucuccuucgacguggccgaccgccggugccccuacagcggcgugcagaucuccgcccagaugcugcugagcaaccaggucgagaucgagcacauccuccccuucucccagacccuggacaacagccugaacaaccgcacgguggccaugcggcaggccaaccgcaucaaggggaaccggaccccguggcaggcgcgcgaggacuucgagcggcagggcugguccuacgacagcauccuccagcgcgccgagcggaugcccaaggccaagcgcuaccgguucucccgcgacggguacgagcgguggcugaaggaggacaaggacuuccuggcccgcgcgcucaacgacacccgguaccugagccgcguggccaagaccuacauggagcuggucugcccccucggcacgcgggugauccccggccagaugaccgcccugcugcgcgccaaguucgggcucaacgacgugcugggccugaacggggagaagaaccgcgacgaccaccggcaccacgccgucgacgcgugcgugaucggcgugaccgaccagggccuccugcagcgcuucgcccaggccuccgccgacgcccgggggaacggccuggagaagcucgucgagaacaugccggugcccugggcgaccuaccgcgaccacgugaagcgggccauccagugcaucugggucagccacaagcccgaccacggguacgagggcccgaugauggaggagacggccuacgggauccgcaaggacggcuccauccggcagaagaccaaggccgacggcagcaccgggcgcgagaucacccaccugauccggaucacggagcccacccagaaccugcgccacggcguggacgcccaggggcagccccucgcguacaagggcuacgucgggggcagcaacgacugcaucgagaucacccagaacgagcagggcaagugggaggggaacgugaucaccacguuccaggccuacgacaucgugcggcgccugggcuccaagcaggggccccggcgccugcggcacccgacccucgcccagacccuggacguguacggcaagcccaagaagcuggucaugcgccucaugaucgacgacugcgugcggcuggagcuggacgggaacaagaagacccuccgcguggucaagaucaccggcaacggccagguguucauggcccccgugcacgaggccaacgucgacaagcggaacagcgacaagacggaccccuucgcguacguguccaaguacgccgggagcuuccagaaggccaaggcccgccggaucaccaucuccccgaucggcgagcugcacgaccccggguucuga

SEQ ID NO: 1492 - RNA, 3174 nt, Artificial Sequence
  Cas9 variant
augagcgacaaguccaagauccugggcuucgacaucgggaucaccagcaucggcugggccuacguggagggggaggagcucaucgacugcggcguccgcaucuucaccaaggccgagaaccccaagacgaaggagucccuggcgcugccgcggcgcgaggcccgcggggugcggcggcgccucgcccggcgcaagggccggcugaacgccaucaagcagcugaucugcaaggaguucggccucaacuaccaggacuacaucgcccaggacggggagcugcccaaggcguacgccggcaagcugaucaaccccuacgagcuccgcagcaaggcccugcgggagaagcuggagaaggaggagcucgcccgcgugauccugcacaucgcgaagcaccggggguacggcaacaagcacgccaaggagaccgacgacgccgaguccgggaagaucaagaaggccaucagcaacaacgagaagauccugaacgagaagggcuaccaguccgccggcgaguaccucuaccaggaguucuuccagaaggagcgccugcaggaggagaagaaggggaacaacaccaccaaggaguucaagaacguccggaacaaggcgggcgacuacgagcacugcaucgcccagacgcagaugcagaacgagcugcgccucaucuucgagaagcagcgggaguucgggcugaacuucagcgaggaguucaagaagaaggugcuggagaccgccuucuuccagcgcccccucaaggacuucuccgacaagaucggcgacugcaccuucaucgagggcgccaagcgggccccgaaggacagccuguccgcgaucgaguucguggcccuggggcgcaucaucaacacccucaagaaccugcagaacacgagcggcgaggucuacucccgggacaagaucaacgagauccugcagaucgugcucgacaagggggagaucagcuacaagaagcugcgcgagauccuggacaucgaguccagcgugcgcuucaaggacuccaagcucgacuacaccaaggagcugaaggaggccgagaagaccaagcuguucgagagcaagaaccuccagaaguucaagaaggcccugggcuccuucgaggggaucagccgggagauccuggacagcaucgccaaggagaucaugaucaccaaggacaaggagaagcucgcgaaggagcugaagaaguucccccuggacgagacgcagauccagaaccucuccaaccugagcuucucccagaccaucaaccugagccucgaggcccugucccagauccugcccuucaugcgcggcgagcgggaggacaagugccuccgcuacgacgaggccgucgagaaggccggccugaaggagguggccaagaacaagagcaaggacgacuuccugcccccgcucgagaacuacgagcccuaccuggcgaaccccguggucgcccgggcccuguccgaguaccgcaaggugcugaacgcccuccugcggaaguacgggaagaugcacaagauccacaucgaguucacccgcgaggugggcaagagcaaggaggagcggaacaagaucgagaaggagcagaaggagaacuucgcgaagaaccaggaggcccagaagcagugcgagauccuggggcuccccaucaacggcgccaacauccugaagaugaagcuguggcgcgagcagcaggaguccugcgucuacagcgggaaggagaucgccaucgacgaccucaagaacccggccauccuccagguggaccacaucuaccccuacucccggagcuucgacgacuccuacaacaacaaggugcuggucuucagcaaggagaaccagaacaagcugaacaagacccccuucgaggcguucggcgagaacaaggacaagugggagaagauccugucccuggccagcaagcuccccaagccgaagcgccagcggaucuacaacaugcaguucaaggacaaggagcagggcuuccugacgcgcaacaucaacgacaccggguacaucgcccggcuggugucccaguggaccaagaacugccucagcuucgagaagcuguccgaggacgaggugagcaucgccggcgagaaggggagcaagguccacguggaggugaucuccggcagccugaccgccaugcuccgccacuacugggggcugggcgacaagaaccgggacaaccaccuccaccacgcggucgacgccaucaucaucgccuacuccaacgagaaggugaucaaggccuucagcgacuacaagaagcaccgcgagcagaacaaggccaaguucuacgcgaaggagaucgccgaguccgaguacaagaagcagaaggucuucuucgagcccacgaaccacuuccggcagaaggugcuggagaagaucgacagcaucuucguguccaagccgccccgcaagcgcgcccggggcgcccugcacgaggagaccuucuacagcuucgagcgccugugcaacgacaaggaguacgcgaagaaggagaagauggacuacgggggcaaggccgggauccagaaggccaucgcccucggcaagauccggcaggucggcaccaagaucguguccaacgggaccauggugcgcgucgacaucuuccagcacaagagcaacggcaaguucuacggggugcccaucuacacgauggacuucgcccugggcgugcugcccaacaaggcggucguguccgggaaggacaagcagggcgugaucaaggacuggcucgagauggacagcaacuacgaguucugcuucucccuguucaaggacgaccugauccucguccagaagaaggagauggagaaggccgagcugugcuacuacaccgacuucaacagcaacaccgccggcaucaaguucgagaagcacaacaaccuguacgugaaccucaacgagaacgagcggaagcuguucaccuccaaggagguggucaagggcgggaagaagaacguguggaaggacaagacgcccaaggagaucgagcagcuggagaagaaccgcaagaucaucgggggcuucgugaccaucgaggaccucaagaccuucgagaaguaccaggucagcccccugggggaggugcagaaggccgacuucgccccgcggcaggcgaucacccugaaguccagccccaagcaccgcaucaacaaguga

SEQ ID NO: 1493 - RNA, 3174 nt, Artificial Sequence
  Cas9 variant
augagcaaccgcgugcccuaccggcuggcccucgaccugggcaccaacuccaucggguggugccugcucgaccugaacggcaacggggacccgugcggcguccgccggaugggggugcgcaucuuccccgacggccgggaccccaagagcaaggagucccuggccgcggaccgccggcucgcccgcagcaugcggcgccggcgcgaccgguaccugcgccggcgcuccgcccugaugaacgcccucguggccgcgggccugaugcccgccgaccgggccacccgcaaggcccuggagagcgaggacccgugcgagcuccgggcgcgcgcccuguucgagccccugacggccgggcaggucggccgggcccucuuccaccugaaccagcgccgcggguucaaguccaaccggaaggccgcgggcgaggagaacgaggccgggaagaucaaggccggcaucagcgcccugaaggccgagaucgaggcguccggcgagaccacccucggggccuggcuggccgcccgccaccggaagcgcgagaccgugcgggcccgccuggacggcgcgggggccaaggccagcuacgaguucuaccccgagcggggccucgugcacgacgaguuccaggccauccgcacggcccaggcgcugcaccaccccgccgucaccgccgagcagugggaccggguggaguccgugaucuuccgccagcggccgcugcgccccguccggcccggcaagugcacccucuuccccgaccaggagcgcgccccgugggcgcugcccguggcccaggaguuccggauccugaccgagaucgggaaccucaagcuguaccgccccggcgaggagccccgggagcugagcgccgaccagcacgcccagcuguucgccaagcucugccgcuccgcggaccugacguucgagaagauccggaaggagcucaagcuggacccggggcugaaggugaaccucgagggcgagaagcgcgaccgccugaagggggacgccgucaccagcgcccuguccgccaagaagcgguucggccccaaguggaacgcccucacccccgacgaccgccgggacaucgugggccgccugaucgaggcggaggacgaggccgagcuggccggguggcucgagagcgugcacggccugcccuccgagaacgccgcccacaccgcggccagcccggggcugcccgacggcuacugccggcucuccgagaaggcccuggucaagcuggugccccucaugcgcgagcagcggcugcgcuacgacgaggccgugcuggcgcugaaccuccaccacagcgacuuccggcccgaggggcugcuggacgagcucccguacuacggcgagccccuggagcgcuucaucgccuucggcagcggggagcccuccgacccgcccgagcagcaccugggccgguuccccaaccccacgguccacaucgggcucaacgagcugcgcaagcuggugaaccggaucguggagcgcuggggcaagccggccgacaucgucguggagcucgcccgggaccugaagcgcagccgggacgagcgcgacaccauccagcgggagcaggcccagaaccagcgcaagaacgaggaccgguucgcgaagaucaaggagcuggggaucgacccccgccccgacuccaugcuccgccugcggcugugggaggagcuccccaaggugggcgucggccacgugugcgucuacaccggggagccgaucggcauccgccggcugcuggagggggacguggacaucgaccacauccuccccuucagccgcacccuguccgacggcgccgacaacaagaucgugugcguccggcgcgccaaccgguucaagcgcgaccggagccccugggaggccuucggcgugacggccguggacggguacgacugggcggccaucgcccagcgcgccgaggagcugcccaagaacaagcgguggcgcuuccucccggacgccauggaccgguucgagggcgagcgcggguuccuggaccggcagcuggucgagacccgccaccucucccggguggcgcgccaguaccuggccagcaucguggaccugaacaagguccggguggcccccggcaagcucaccgccaugcugcgcgcgcgcugggggcugaacaagauccucuccgacggcaaccugaagaaccggagcgaccaccgccaccacgccaucgacgccgccgugcugggcaugaucgaccagcggcucguccagcugguggcccaggcggccgcccgcgccgaggccaacgagcuggagcgccucuucgacgggcugcccgaccccuucgacggccuggcggccaccuccuucggggaccaggugcgggagaagauccggggcaucacggucagccaccgcgccgagcacggguggcagggccggaugcacaacgacaccgccuacggcccgguggaggccgugaacgggguccacaccguggugacccgcaagccccucuccggccugacggcgaaggacuuccccaacauccgggaccgcguccuggccaaggcccucgaggaccacguggccgccgaggcggccgccgggcggagcuucggcgacgcccugggguccuucaaguggggcggccagcccgugcgccggguccgcaugcuggacgugcucgggaacccgauccccauccaggaccccagcggcaccguguucaaggucuacaagggggacuccaacgcgugguacgagauccugcgggacccccgcggccgguggaccgggaagaucgugagcaccuucgaggccuaccgccugcaccgggaguggcucgccgagacgggcggcgacuccgggcgcggcagcgggguguuccuggacugggccgccaagcgcgucgugggcgaggcgggcaccccgcuguuccgccucuucaagggggaccugcuggcccucggcgaggcccccgaccggcggaucgugcgcgucgugaaguucagcgagggccagguggcccuggcccugcaccucgaggcggggaaccugaaggcccgggacgccgacaagggggaccccuucaaguaccaguacugcucccccgacagccugcgcaagcaggccgcccggccggcgggcgucgaccuccugggcuacgugcacgacaaggggccccuggaguga

SEQ ID NO: 1494 - RNA, 3174 nt, Artificial Sequence
  Cas9 variant
augcgccggcugggccucgacaucgggaccaacagcaucggcuggugccugaucgaggacgacaagaagaucguggacaucgggguccgcaucuucuccgacggccgggaccccaagagcggggccucccuggccguggaccgccgggacgcgcgcgccaugcggcgccggcgcgaccgguaccucggccgccggagcgccuuccugcaggcccuggugguccacggccucaugccggccgacgcggacgaggccaagcugguggccgaccgcgaccccuaccagcugcgggccaaggcgcuccacguggcccuggagcccuucgagaucgggcgcgcccuguuccaccucaaccagcggcgcggcuucaaguccaaccggaaggccgaccgcaaggccaacgcgggggaggacggcaagaucgccgagggggccaaggcccuggaccaggccaugagcgaggcgggcgucgacacccugggccaguuccucgcccugaaggagacgaagcgggugcgccugggguccgacggccaggccuacgacuucuacccccagcgccggcacaucgaguacgaguucgaccgcaucuggaaggugcagagcgaguaccacccggcccuccugaccgaggccgcgcgggccgcccugcaccgcauccucuucuuccagcggccccugaaggcccaggaggucggguucugcaccuucgccggcgugaacggcaucgcggccaacgagcgccggcugcccaaggcccacccccucuuccagcagcgccggcuguacgaggaggugaaccagcugcgcaucgucuccgccggggcggccgaccggccgcucacccuggacgagcgcgaccggcugauccuccgccugcaggaccggaagaaggugagcuucgacacgcuggccaagaaggaccuccgccuggccgacggcgagcgguucaacaaggaguccgagaaccgcaaggagcugaucggggacgaggugcgggccgagaugagcgacaagaagcgcuucggcacccgcuggguccacuucgggcucgacgagcagcugcggauccuggcgaagcuccaggacgaggagaaccccgaggcccugcuggacuggcuccgcuccgaguacggccuggacgaggccgccgccgagagcguggcgaacgcccggcugcccgagggcuacgggcgcuucggcgagaccgccacccggcuccugcuggacgcccucaaggccgaggugaucacguacgacaaggcggcccugcgcgccuucgggcaccacuccgacuuccggaccggcgagguccuggaccgccugcccuacuacggggagcuccugacccgggagaucgccccgggcaagcccgaguacggcgacccccuggagcgccaguacgggaagaucaccaaccccacggugcacaucggccuccggcagcuggagaagcuggugaacgcggucaucgccgugcacgggcgcccggaccagaucguggucgagcucgcccgggagcugaagcugaacgagaaggagaaggacgagcacaagcgccggaucaagcgcgacaccgacgccgccaucgcgcggggccgcaagcucgccagcgagggguucaucgacaacggcgccaaccggaugcugaugcgcaucugggaggagcugaaccccgccaacccccucgaccggcgcugccccuacugcgccgagccgaucggcauccgcgcgcuguucuccggggaggccgacaucgaccacaucauccccuacagccggucccuggacgacaacgugggcaacaaggucguggcccaccgcagcugcaaccgggccaaggggaacaagacccccuacgagaaguggggcccccacaucgacccggagcgcugggagcggaucagcgaccagguggcccgccuccacaaguccaagcaguggcgguucggccccgacgcgauggagcgcaucgaccgggacgggggcuuccuggcccgccagcugaccgacacgcaguaccucagccgggucgccgggaaguaccugcgcucccuguaccccaccgcccagagcggccggguggacgugauccccgggcgcaugaccgcgaugcuccggcgcaaguggggccugaacucccugcucccggaccacaacuacgucgagaacgagcacagcaacgcccccaagaaccggcuggaccaccgccaccacgccaucgacgccgccguggcggccgugaccacgcugucccucaugcagcagaucgccgacgccgccggccgggcggaggacaagaaccuggaccgccuguucgaggacaucccccagccguggcccggguuccgcgaggagcucggcgaggcccugcggagcaccaccgucucccacaaggccgaccacgggcgcaagcggcgccccagccgggaccgcgacgugaccgccgcccggcugcacaacgacacggcguacggccucaccggggacguggccgccgacggcaagacccccaucgucgugcaccgcgugccgcuggccucccugaagcccgccgaccucaucgacccccugcggauccccgacccgguccugcgcgacgcgcucuacgccgccacccgggaccgcacgggcaaggaguucgagcaggcccugacccaguucgcgcggcaccacccccuguucaaggggauccgccgggugcgcgugcgggagccccucaacgucauccccauccgcgacgccgccggccgggccuacaaggccuacaagggggacgcgaacgcccgcuucgacguguggcggcugccgaacggcaagugggugagcgacaucgucuccauguucgacgcccacugcauggccgacaagagcgaccgccgcccccaccccgccgcgaagaaggugcugucccuccggcagaacgacaugguggccaucgagcgcagcggggucacccagaucgcccggguggugaaguucuccaccaacggcagcaucgcccuggccgcggacaacgaggccggcgcccugaaggcccgcgacgcggcccccaacgacgucgacccguucaaguacaucuucuccagcgggggcgggcucaagaaccugaaggcccgccaggugcggguggacccccugggccgggucuucgaccccgggccccgcgaguga

SEQ ID NO: 1495 - RNA, 3177 nt, Artificial Sequence
  Cas9 variant
augaagaacagcuacauccugggccucgacguggggaucgccuccgucggcuacgggcugauccacagcgacuccaagagcgugaucgacgccggcgugcgccuguuccccgaggcgaacgucgagaacaacgaggggcggcgcgccaagcggggcucccgccggcucaagcgccggcgcauccaccggcuggaccgcgugaaguaccugcucgcccaguaccaccugaucaucgacgacaagauccccaagagcaccaaccccuacgccauccgggugaagggccuguccagcgcccucuccaagagcgagcuggucaucgcgcugcuccaccuggccaagcgccgggggauccacaacgugaacguggucauggacgagaacgaguccaccaacgagcugagcacgaaggagcagcucaaggagaacgccaagcagcuggagaaccgcuacgugugcgagcugcagcucgaccggcugaacgagcaguacaaggugcgcggcgagcggaaccgcuucaagaccgaggacuucguccgggaggcccgccagauccugaccacccagcagaaguaccacgacaucgacgagcacuucaucgagcaguacacgcaccuccuggagacccggcgcgaguacuacgaggggcccggcaaggggucccaguacggcugggagggcgaccugaagcagugguacgagaugcucauggggcgcugcaccuacuuccccgaggagcugcggagcgugaaguacgcguacaccgccgaccuguucaacgcccucaacgaccugaacaaccuggugaucgcccgcgacgagaacgagaagcucgaguacuucgagaaguaccacaucaucgagaacgucuucaagcagaagaaguccccgacgcugaagcagaucgccaaggagaucgacgugaaggagagcgacaucaagggcuaccggaucaccaagaacgggaagccccaguucaccuccuucaagcuguaccacgaccucaacaagaucuuccuggacaagaagaaccuggagaacaucgagcuccuggacgagaucgcguucauccugacccucuaccaggacccccugagcaucaaggaggcccuggaccagcuccaggaccugcugacggaguccgagaaggaggccaucgcccaccucaacggcuacaccggcacccaccgccugagccugaagugccuccaccuccugaucgacgagauguggcagaccagccggaaccagauggagguguucacggcccugaaccucaagccccagaaguaccagcuguccaagcagaagcagaucccgaagaagauggucgaggaguucauccugagccccguggugaagcgcuccuucauccagagcaucgagaucgucaacaccaucaucaagaaguacgggcuccccgaggagaucaucaucgagcuggcgcgggagaagaacuccgaggaccgccggaaguuccugaaccgcauccagaaggagaacgagaacacccggaagcaggucgaggaggugauccgcgaguacggcaaccggaacgccaaggggcucguggagaagaucaagcugcaccagaugcaggagggcaagugccuguacagccuccagaacaucccccuggacgaccugcuccgcaacccgucccacuacgagaucgaccacaucaucccccggagcguguccuucgacaacagcuucaacaacaagguccuggugaagcaggaggagaacuccaagaaggggaaccgcacccccuaccaguaccugaacagcaacgaguccgugcucagcuacguccaguucaagcagcacauccugaaccuguccaagagcaaggagcggaucuccaagaagaagcgcgaguaccuccuggaggagcgggacaucaacaaguucgaggugcagaaggaguucaucaaccgcaaccugguggacacgcgcuacgccacccgggagcucguccagcugcucaagagcuacuucuccgccaacgaccuggacgugaaggugaagaccaucaacggcagcuucaccaacuaccugcgcaaggccuggaaguucgacaagagccggaacaagggcuucaagcaccacgcggaggacgcccugaucaucgccaacgucuccuaccucuucaagcagagcaaggagcugaaggaggccaacgccauccuggagaacaacaaccucucccugaacaagaacaaggacagcaagaaccugcucacggagcaggacuaccgcaagauguucgagauccccaagcagguccaggacaucaaggacuacaaggacuucaaguacucccaccggguggacaagaagccgaaccgccagcugaucaacgacagccuguacuccacccgggaggugaacgagaaccacuacaucgugcagaccgugaaggacaucuacgcgaaggacaacaccaagaucaaggaccucuuccugaagacgcccgagaagcugcucauguaccagcacgacccccagaccuucgagaagcugaugcuggucaucaagcaguacggggaggagaagaaccccuucgccaaguacuacgaggagaacggcgaguaccucaccaaguacgccaagaacgagaaggggccgaccaucaagcgccugaaguacaucggcaagaagguggggacgcaccuggacaucagcaccaacuucuccggcgccaagcggaaggugguccagcucagcaucaagcccuuccgcuucgacguguuccacuccaaggcgggcuaccacaugcugacccugaccuacauggacaucaagaagaaggagaagcacuaccagauccucaagaacgaguaccaggcccugaaggagcgguacaaggugcccagcgacgcccaguucaucggguccuucuacuacaacgaccugaucagcaucaacgacgagcuguuccgcgucaucggcgugaacaacuccacgcggaacguggucgagcugaacaugguggacaucaacuacaaggacuacugcgaccugauggggaucaagaagaccccgcgcaucuucaagaccaucaccaagaagaccggcaagaucgagaaguacagcacggacauccucgggaaccaguucaaggugaagccguccaagagcccccagcugaucuucaagcggggcguccuguga

SEQ ID NO: 1496 - RNA, 3180 nt, Artificial Sequence
  Cas9 variant
augcgccggcugggccucgacaucgggaccaacagcaucggcuggugccugacccaggggcccggcgacgaggccgacgggaucguggacaucggcguccgcaucuucuccgacggccgggacccgcagagcgggacgucccuggccguggaccgccgggacgcgcgcgccgcccggcgccggcgcgaccgguacaucggccgccggagcgccuuccucgacacccugguggcccacgggcugaugcccgcggacgccgacgaggccaagcucgucgccgcgcuggaccccuacacccugcgcgcccgggcccucgaggcgccccugaccccgcacgagaucggccgcgcccuguuccaccucaaccagcggcgcggguucaaguccaaccggaaggcggagcgcaagacgaacgacgccgacgacggcaagaucgccaccgccgccuacgcgcuggaccgggccaugcuggacggcggguucgacacccucggccaguuccugaacgcccaggagaccaagcgcgugcgcauggacggggaggcccagggcuacgacuucuacccccagcggcgccacguggaguacgaguucgaccggaucuggacggagcaggccaagcaccaccccgcgcugcucaccgagaccgcccgcuacgcccugcaccggauccuguucuaccagcgcccccucaaggcccaggucgugggcaagugcaccuucgugcacagcgaggaccggcuggccaaggcgcacccgcuguuccagcagcgccggcucuacgaggaggucaaccagcuggaggugacgacccccggggaggccaaccgcaagcugacccucgacgagcgggaccgccuggugcgggagcugucccacaagaaggccaucgccuucaccagccucgcggccaagaucaagcuggagcccggccaguccuucaacaaggccagcgagacgcgcacccagcuggccggggacgagguccgggccgugcucggcgacaagaagcgcuucgggcccgcgugggagcacuucgaccgggaccgccaguggaccaucguggagcggcugcuggaggaggaggacccggacgcccuccacgccuuccugacccaggacugcggccuggacgacgagcacgccgccgcgacggccaagaccucccuccccgagggcuacgggcgccugggcgccaccgccaccgcccgcauccuggcggagcuccaggccgaggucaucacguacgacgaggccgugcggcgcugcggguggcaccacagcgaccaccggaccggcgagauccugccccagcugcccuacuacggggagcuccugacccgcgacaucccgcccggcacccaggaccccaacgacccgcccgagaagcgguggggccgcaucacgaaccccaccgugcacaucgggcugaaccagguccggcagcucgugaacgccaucguggcgguccacggccgccccgaccagaucgugguggagcuggcccgggagcugaagcugaacgagaaggacaaggaggagcacaaccgccggauccgccgggacaccgccgccgccaucaagcgcuccgagaagcucacccaggagggguuccccgacacgggcgcgaaccggaugcugcugcgccucugggaggaccugaacccggccaacccccuggaccggcgcugccccuacugcggggcccccaucggcaugcgggcccucuucgccggcgaggcggacgucgaccacaucaucccguacagccgcucccuggacgacagcgccgggaacaagguggucgcccaccgguccugcaaccgcgccaagggcaaccgcacccccuacgagaaguggagcgacgaccccgaccggugggacgccaucaccgcccagguggcccgccugcaccgguccaagcaguggcgcuucgggccggacgccauggcccggguggagaaggacggcggcuuccucagccgccagcugaccgacacgcaguaccugagccggcucgcggggcgcuaccuguccagccuguaccccaccaaggaggagggcuccgucuacgugauccccgggcggaugaccgccaugcuccgccggcuguggggccugaacgacauccucagcgaccacaacaucguggagaacaagcacuccaacgcccccaagaaccgccuggaccaccggcaccacgccaucgacgccgcggucguggccgugagcacccgcucccugaugcagcggaucgcccgcaccgccgggcaggccgaggaccggaaccucgaccgccuguucgagggccuggacccgcccuggcccggcuuccgggaccagcuccgcgaccgccugcuggcggucacggugagccacaaggccgaccacgggcggaccggcacccccgugccggggaaggacgccaccgccggccgccuccacaacgacacggccuacgggcugaccggcgagaccuccgcgaagggccugcccaucgucgugcaccgggugccccucaccagccugaagcccgccgacaucacggacccggaccgcauccccgaccccguccugcgggacgccaucgagcgcgccaccgccgggaagaugggcaaggacuucaccgacgcgcucgccaaguucgggcgguccggcgcccaggagaccgaccgcaagggggagcggcuguuccgcggcacgcggcgcgugcgggugcgcgagccccugggcgucaucccgaucgccgacgcgagcgggcggguguacaaggccuacaagggcgacuccaacgcccgcuucgacguguggcggcuccccgacgggaagugggucagcgacaucguguccauguucgacgcccaccgccccgaccagggcgaccggcgcccccacccggccgcgaagaaggugcugagccugcggcagaacgacaugaucgccaucgagcgcgacggggcgccccgcgagaucguccggguggugaaguucuccaccaucggcagcguccagcucgccgccaccaccgaggccggcccccugaaggcccgcgacgccuccccgcccgacguggaccccuuccgguacaucaacagcagcgccgggggccugaagaagaucaaggcccgccaggugcggaucgacccccucgggcgcaucuucgacccgggcccccgguga

SEQ ID NO: 1497 - RNA, 3180 nt, Artificial Sequence
  Cas9 variant
augaucgagcgcauccugggcguggaccucgggaucagcucccugggcugggccaucgucgaguacgacaaggacgacgaggccgcgaaccggaucaucgacugcggggugcgccuguucaccgccgccgagacccccaagaagaaggagagcccgaacaaggcccggcgcgaggcccggggcauccgccgggugcucaaccgccggcgcguccggaugaacaugaucaagaagcuguuccugcgcgcggggcucauccaggacguggaccuggacggcgagggcgggauguucuacuccaaggccaaccgggccgacgugugggagcugcgccacgacggccucuaccggcugcugaagggggacgagcucgcccgcguccugauccacaucgcgaagcaccggggcuacaaguucaucggggacgacgaggccgacgaggagagcggcaaggugaagaaggccggcgugguccugcgccagaacuucgaggccgccgggugccggacggugggcgaguggcucuggcgcgagcgcggggcgaacggcaagaagcggaacaagcacggcgacuacgagaucuccauccaccgcgaccugcugguggaggaggucgaggccaucuucguggcccagcaggagaugcggagcaccaucgccaccgacgcccucaaggcggccuaccgcgagaucgccuucuucgugcggcccaugcagcgcaucgagaagauggucgggcacugcaccuacuuccccgaggagcggcgcgcccccaaguccgccccgacggcggagaaguucaucgccaucagcaaguucuucuccaccgugaucaucgacaacgagggcugggagcagaagaucaucgagcggaagacccuggaggagcugcucgacuucgccgugagccgcgagaaggucgaguuccggcaccuccgcaaguuccuggaccucuccgacaacgagaucuucaaggggcugcacuacaagggcaagcccaagaccgccaagaagcgggaggccacgcuguucgaccccaacgagcccaccgagcucgaguucgacaagguggaggcggagaagaaggccuggaucagccugcgcggggccgccaagcugcgggaggcgcucggcaacgaguucuacggccgcuucguggcccuggggaagcacgccgacgaggccaccaagauccugaccuacuacaaggacgagggccagaagcggcgcgagcucacgaagcugccgcuggaggccgagauggucgagcggcucgugaagaucggguucuccgacuuccugaagcugagccucaaggcgauccgcgacauccugcccgccauggaguccggcgcccgguacgacgaggccgugcugaugcucggggucccccacaaggagaaguccgccauccugcccccgcugaacaagaccgacaucgacauccucaaccccaccgugauccgcgcguucgcccaguuccgcaaggucgccaacgcccuggugcggaaguacggcgccuucgaccgcgugcacuucgagcuggcgcgggagaucaacaccaagggcgagaucgaggacaucaaggagagccagcgcaagaacgagaaggagcggaaggaggccgccgacuggaucgccgagacgagcuuccaggucccccucacccgcaagaacauccugaagaagcggcuguacauccagcaggacgggcgcugcgcguacaccggcgacgugaucgagcuggagcggcuguucgacgagggguacugcgagaucgaccacauccugccccgcucccggagcgccgacgacagcuucgccaacaaggugcugugccucgcccgcgccaaccagcagaagaccgaccggacgccguacgagugguucggccacgacgcggcccgcuggaacgccuucgagacccggaccuccgcccccagcaaccgcguccggaccgggaagggcaagaucgaccgccugcugaagaagaacuucgacgagaacuccgagauggccuucaaggaccggaaccucaacgacacgcgcuacauggcgcgggccaucaagaccuacugcgagcaguacuggguguucaagaacagccacaccaaggcccccgugcagguccgcuccggcaagcugaccagcgugcugcgcuaccagugggggcucgaguccaaggaccgggagagccacacgcaccacgccguggacgccaucaucaucgcguucuccacccagggcaugguccagaagcugagcgaguacuaccgcuucaaggagacccaccgggagaaggagcgccccaagcuggccgugccgcucgccaacuuccgggacgccguggaggaggcgacccgcaucgagaacacggagaccgucaaggaggggguggaggugaagcggcugcugaucucccgcccgccccgggcccgcgucaccggccaggcccacgagcagaccgccaagcccuacccccggaucaagcaggucaagaacaagaagaaguggcgccucgcccccaucgacgaggagaaguucgagagcuucaaggcggaccggguggccuccgccaaccagaagaacuucuacgagacgagcaccaucccccgcguggacguguaccacaagaagggcaaguuccaccuggugcccaucuaccugcacgagaugguccucaacgagcugccgaaccugucccucgggaccaaccccgaggccauggacgagaacuucuucaaguucagcaucuucaaggacgaccugaucuccauccagacccagggcacccccaagaagccggccaagaucaucaugggguacuucaagaacaugcacggcgcgaacauggugcugagcuccaucaacaacagccccugcgagggguucacgugcacccccgugagcauggacaagaagcacaaggacaagugcaagcucugccccgaggagaaccggaucgccggccgcugccugcagggcuuccuggacuacuggucccaggaggggcuccggccgccccgcaaggaguucgagugcgaccagggcgucaaguucgcccuggacgugaagaaguaccagaucgacccccugggguacuacuacgaggugaagcaggagaagcggcucggcaccaucccccagaugcgcagcgccaagaagcuggucaagaaguga

SEQ ID NO: 1498 - RNA, 3180 nt, Artificial Sequence
  Cas9 variant
augagcaagcgccugcgguaccgccucgcccuggaccugggcaccaacuccaucggguucugccuccuggaccugaacggcgacgggcggcccugcggcgugcgccggauggggguccgcaucuucccggacuucagcaagcuccagcagucccuggccgcggaccggcgccuggcccggagcaugcgccggcgccgggaccgcuaccuccggcgccggaaggcccugaugaacgcccugguggccgcggcccucaugcccgccgaccccaaggcccgcaaggcgcuggaggcccuggaccccuacgagcuccgggccgccgccguggcgggcccgcugcccgcccaccagcugggccgcgcccucuuccaccugaaccagcggcgcggguucaaguccaaccgcaaggccgccggcgacgagaacgaggcggggaaggucaagagcggcaucuccgcccugaaggccgagcucgccgccagcggggcgggcacccugggccaguggcuggccgcccggcacgccaaccgccagcccgugcgggcccgccucacggggaccggcgcgaaggccaccuacuccuucuaccccgagcgggcccuggugcacgaggaguuccaggccauccgcgcggcccaggccccgcaccaccccggggucaccgccgagcagugggaccggaucgagagcgugaucuuccaccagcgcccccugaagcccgugaagccgggcaagugcacgcucuaccccgaggaggagcgggcccccugggcgcugcccaucgcccagcgcuuccggauccugcacgagcuccacaaccugcgcaucguccggccgggccagggggaggagggccugucccccgccgacuucgaccgcuucuucgaccggcucugccgcaagggggaccugaccuucaagacccuggccaaggagcucaagcugccgcccgacgcccggaucaaccuggaggacgacaagcgcgaccggcucaagggcgacgcgaccgccgacgcccugagcgccgagaaggggaagcgccgccggaucggcgccgcguggcacuccuuccccgccgaccgccagcgggagaucgugggccgccugaucgacgccgaggacgagggggagcucgccgcguggcugguggaggagcugggccuccccugggaggucgccauccugacggccgagcggcccgggcugcccgacggcuacugccgccucagcgagaaggcccuggagcaggucgugccgcugaugcacgaggagcaccuccccuacgacgaggccgugcgggcgcucgggcugcaccacuccgaccaccgcaccggcgaguuccuggacgagcuccccuacuacggccugccccuggagcgguucaucgccuucgggaccggcgaggccgacgacccgcccgagcuccgcaucgggcgguuccccaacccgaccgugcacguggcccugaacgagcugcgccgggucgugaaccgcaucauccggcgcuggggcaagcccgaggagaucguggucgagcucgcccgggaccugaagcagagccgcgcggaccgggacaagacgcagcgcgagcaggccgacaaccagaagaagaacuggacccggacccagcagcugcgcgagcucgggauggagcccaccggcgaggcccugcugcgccuccggcugugggaggagcugccccgcaucggcuccgcccacgugugcguguacacggggcagccgaucagcaugacccagcuccugcagggcgacgucgacguggaccacauccugcccuucucccggacccucgccaacggggcggacaacaagaucgucugccaccgccgggccaaccgcaucaagcggaaccgcacccccugggaggccuucggcguggugagcgccgacggcuacgacugggcggccaucgccgagcgggccgagagccugcccaagaacaagcgcuggcgguuccugccgaacgccauggagcgcuucgagacggagcggggguucaucgaccgccagcucgucgagacccggcaccugucccgcguggcgcgggaguaccugggcugcaucgugccccucgagaagguccgcgccgcccccgggcggcugaccgccaugcugcgcggccgcugggggcucaacagcauccuguccgacgccaaccugaagaaccggagcgaccaccgccaccacgcgguggacgccgccgugcucggcgucaucgaccagcggcuggugcagcgcguggccgacgccgcgaagcgggccgaggagaaggagcuggagaagcuguucgacggccugcccgacccguucgaggggcugcccggccccuccuuccgcgaccagguccaggagcgggcccaggggaucaucgugagccacaagcccgagcacggcuggcaggggcgcaugcacaacgacaccgccuacggcccgguggagcggcuccccgacggcacgcaccgcgucgugacccggaagccccuggggucccuggccgagaaggacuucggcaacauccgcgaccgggcgcucgccgccgcccuggagcgccacguggcggagcaggccgcccaggggcggagccugggcgaggcccucuccugcuucaccuggaccgggggcgagguccgccgggugcgcaugcuggacaagcugggcagccccguggccguccaggacgacgacgggcacacguucaagcucuacaagggcgacuccaacgcgugguacgagauccugcgggacgggcgcggccgguggaccgggcgcaucgugagcaccuacgaggccuaccgccugcacgccgaguggcucgccgagcggggcgacggcgggcgcuccgacgccgcguucccggacugggccgcccggcgccugugcgccggcaucgggaagccccuguuccgccucuucaagggcgacaugcuggccuucggcaccgcgcccaaccgggagaucaugaagguggucaaguucagcgaggggcggaucguguucgccggccaccgcgaggccgggaaccugaaggagcgggacgccgacaaggacgaccccuucaaguaccgcacgugcuccccggaggcgcuccggaaggcccaggcccgccccgugggcgucgaccccgccggguucgugcacgaccggggcccgcuggaguga

SEQ ID NO: 1499 - RNA, 3180 nt, Artificial Sequence
  Cas9 variant
augggcauccgcuucgccuucgaccuggggaccaacagcaucggcugggccguguggcggaccgggcccggcgucuucggggaggacacggcggccucccucgacggcagcggcgugcugaucuucaaggacgggcgcaacccgaaggacggccagucccuggccaccaugcggcgcgugccccggcagagccgcaagcggcgcgaccgguucguccuccgccggcgcgaccugcuggccgcccuccggaaggcggggcuguuccccguggacguggaggagggccgccggcuggccgccaccgaccccuaccaccuccgcgccaaggcgcuggacgagucccugaccccgcacgagauggggcgggucaucuuccaccucaaccagcgccggggcuuccgcagcaaccggaaggccgaccgccaggaccgcgagaagggcaagaucgccgagggguccaagcggcuggccgagacgcuggccgcgaccaacugccgcacccucggcgaguuccuguggagccggcaccgcgggacgccccggacccgcucccccacccggauccgcauggagggcgagggcgccaaggcccuguacgccuucuaccccacccgggagauggugcgcgccgaguucgagcggcucuggaccgcgcagagccgcuucgccccggaccugcugacgcccgagcggcacgaggagaucgccgggauccucuuccgccagcgggaccuggccccgcccaagaucggcugcugcaccuucgagcccuccgagcgccggcugccccgcgcccuccccagcguggaggcgcgggggaucuacgagcgccuggcccaccuccgcaucaccaccggccccgucuccgaccgggggcucacgcgcccggagcgggacgugcuggccagcgcccugcucgccggcaagucccugaccuucaaggcggugcgcaagacccugaagauccucccccacgcccuggucaacuucgaggaggccggcgagaaggggcuggacggcgcccucaccgcgaagcugcugagcaagcccgaccacuacggggccgccuggcacggccucuccuucgccgagaaggacacguucguggggaagcugcuggacgaggccgacgaggagcggcucauccgccggcuggugaccgagaaccgccugagcgaggacgcggcccggcgcugcgccuccaucccccucgccgacggcuacggccggcuggggcgcaccgccaacaccgagauccuggcggcccucgucgaggagacggacgagaccggcaccguggugaccuacgccgaggccguccggcgcgccggggagcggacgggccgcaacuggcaccacagcgacgagcgggacggggugauccuggaccgccugccguacuacggcgagauccugcagcggcacgugguccccggcagcggggagcccgaggagaagaacgaggcggcccgcuggggccggcucgccaaccccaccgugcacaucgggcugaaccagcugcgcaagguggucaaccgccucaucgccgcgcacggccggccggaccagaucguggucgagcuggcccgcgagcugaagcucaaccgggagcagaaggagcgccuggaccgggagaaccgcaagaaccgggaggagaacgagcgccggaccgccauccuggccgagcacggccagcgcgacaccgccgagaacaagauccggcuccgccuguucgaggagcaggcgcgggccaacgccgggaucgcccugugccccuacacgggccgcgccaucgggaucgcggagcuguucaccuccgagguggagaucgaccacauccugcccgugagccugacccucgacgacucccuggccaaccggguccugugccgccgggaggccaaccgcgagaagcggcgccagacccccuuccaggccuucggcgccacgccggcguggaacgacaucguggcccgcgccgccaagcucccgcccaacaagcgguggcgcuucgaccccgcggcccuggagcgguucgagcgcgagggcggguuccugggccggcagcucaacgagaccaaguaccugagccgccuggccaagaucuaccucgggaagaucugcgaccccgaccggguguacgucacccccggcacccugaccgggcugcuccgcgcccgguggggccugaacuccauccugagcgacuccaacuucaagaaccgcagcgaccaccggcaccacgccguggacgcgguggucaucggggugcucacgcgcggcaugauccagcggaucgcccacgacgccgcccgcgccgaggaccaggaccuggaccggguguuccgcgacguccccgugccguucgaggacuuccgggaccacgugcgcgagcgggucuccaccaucaccguggcggugaagcccgagcacggcaagggcggggcccugcacgaggacaccagcuacgggcucguccccgacacggaccccaacgccgcccugggcaaccugguggugcgcaagccgauccggucccucaccgccggggaggucgaccgcgugcgcgaccgggcgcugcgcgcccggcugggcgcccucgccgcccccuuccgcgacgagagcggccgggugcgcgacgcgaaggggcuggcccaggcccuggaggccuucggcgcggagaacgggauccggcgcguccggauccucaagcccgacgccuccguggugaccaucgccgaccgccggaccggcguccccuaccgcgccguggccccgggggagaaccaccacguggacaucguccagaugcgggacggcagcuggcgcggcuucgcggccuccguguucgaggugaaccggcccggguggcgccccgagugggaggucaagaagcugggcgggaagcuggugaugcggcuccacaagggcgacaugguggagcugagcgacaaggacggccagcgccgggucaagguggugcagcagaucgagaucuccgccaaccgcguccgccugagcccccacaacgacgggggcaagcuccaggaccggcacgccgacgccgacgacccguuccgcugggaccuggcgacgaucccccugcucaaggaccgggggugcguggccgugcgcgucgaccccaucggcguggugacccugcggcgcuccaacgucuga

SEQ ID NO: 1500 - RNA, 3183 nt, Artificial Sequence
  Cas9 variant
auggccgucaagagccugaacuacauccucggccuggaccuggggaucgccuccugcggcugggcggugguggagauggacgagcaggagaacccccuccgccugaucgacguggggguccggaccuucgaggaggccgagaacccgaaggacggcagcucccuggccgagacccgccggcucgcccgcgcccagcggcgccugaucagccggcgcgcgaaccggaugaacaagcugcgccggcuccugaagcaggagaacgugcugcaggccaacgacuacgacgagaaggggcucaucaucggccugcccaaccaggccugggagcugcgcgcccagggccucgaccggaagcuggagcccaaggagugggcggccgugcugauccaccucgucaagcaccgcggguaccugucccagcggaagaacgagagccagacggccgacaaggagcugggcgcccuccuguccgggaugaaccacaaccaccagcugcuccagagccaguccaaccaguaccgcacccccgccgagcuggcgaucaagcaguucgccacccaggacggccacauccggaaccagcgcggggccuacacccacacguucaaccggcuggaccuccagaacgagcugaaccagcuguucgacgcccagacccgccucggcaacccgcacgugagcggcucccugaagaccgccaucaacgaccugcucaugaaccagaaggcggcccugagcggggacgccauccuggagaugcucggccggugcaccuucgagcccuccgaguacaaggccgccaagaacacguacagcgcggagcgcuucguguggcuggggaagcugaccaaccuccgcauccaggacaacggccuggaguccgcccugagccgggagcagcgcgagcuccugcugaacgagcccuacaacaagaccaagcucaccuaccagcagguccggaagcugcugcgccuccccgagacggccuucuucaagggccugcgguacgggaaggacaacgccgaguccgccacccugauggagaugaaguccuaccacgcgauccgcaagagccuggagaacaagagccucaagagcgagugggagaagcugaagacccagccgaagcugcucgaccugaucggcaccgccuucuccaucuacaagacggacgacgagaucgccgggugccugaagaaccagcuccccgagaacgugaucaucgcccugcaggagcagcugaacuucagcaacuucauggagcucucccugaaggcgcuggagaagcuccugccccugauggagcagggccuccgguacgacgaggccugcacccagaucuacgggaaccgccacgagaagaucgccgacaagaccgagaaguuccugcccaacaucccggccgacaagcugcggaaccccgugguccuccgcacccugacgcaggcccggaaggugaucaacgcgaucauccgccgguacggcagccccgcccgcgugcacaucgagaccggccgggaggucgggaaguccuucagcgaccgcgacaagcugaagaagcagcaggaggagaaccaggagcagcggcgccgggccaucgacgaguggaagcaguucuuccccaacgccgcccacgagccgaaggcgguggacauccucaagcugcgccuguaccagcuccagcagggcaagugccuguacuccgggcugcccaucgacgugcgccggcuccccgagaagggcuacgucgagaucgaccacgcccugcccuucagccgcaccugggacgacuccuucaacaacaagauccuggugcucgccagcgagaaccagaacaaggggaaccagaccccguacgaguaccugcggggcgccgacaacuccgagagcuggcgccuguucguggagaacguccagaacugccaguucucccccaacaagaagcagaagaucauggccaagcagcucgacgagaagggcuuccuggagcggaaccugaacgacacgcgcuacgugagccgguuccucugccaguucaucuccgaguaccugcaccugaccgggaagggcaagaagcgcguguucgcgagcaacgggcagaucaccgcccuccugcggggccgcugggggcuguccaagaaccgggaggagaacgaccgccaccacgccgucgacgccguggucguggcgugcagcaccguggccaugcagcagaagaucacgcaguucguccgguaccagaagggcaacguguucaccggcgagcgcaucgacaaggagaccggggaggugaucuccauccacuuccccacccccugggagcacuuccgggaggaggucaugauccgcguguucgacgacaacccgcuccggacgcugcccgagaagcugcccaaccgccccgaggcccuccacgaguacgugaugccgcuguucgucagccggaugcccacccgcaagaugaccggccaggggcacaaggagaccaucaagagcgccaagcggcuggacgagaagaucuccgugcuccgcgugccccugacgcagcugaagcucaacgaccuggagaacauggucaaccgcgagcgggagccggcccuguacgaggcgcucaaggcccgccuggagcaguucaagaacgaccccgccaaggccuucgccgagcccuucuucaagcagggcggccagcaggucaaggcggugcggguggagaucgugcagaaguccgggaugcugcuccgcaagaucaacggcguggccgacaacgggagcaugguccggguggacguguucgagaaguccggcaaguucuaccugguccccaucuacgccuggcaggucgccgaggggauccugccgaaccacgccguggugcacagcaaggacgagagcgacuggauccucauggacgaguccuaccacuucaaguucgcgcuguacaagaacgaccugcucgaggugcagaccaagaagggcugcaucaugggcuacuucgccagccuggaccgcgccaccggggccaucaccauccgggagcacgaccgcgacaagaagaagugcaaggacggcgagcaccgguccaucggggugaagauggcgagcuccuucaagaagcugcaggucgacgagcucggcaagaacauccacgagacccgcagccggaagcgccccaacaucggguga

SEQ ID NO: 1501 - RNA, 3186 nt, Artificial Sequence
  Cas9 variant
augcacacccugcccuacacccucggccuggacaucgggaucgccagcgugggcgccgcgcugcucuccgacgagagcauccuggggaugcacguccgcacguucuccgccgccgagaccgacaaggagggcgacccgcugaacaagauccggcgcgaggcccggagcgcccgccggcgcauccggcgccgggcgcaccgccuccugcggcugcgccggcuccugaagcgcaccgggcugaucuccgacaccagccucgaggugcugaagacguccaagacccccuggcagcugcggagcgagggccucgaccgccugcugucccccagcgagcucgccgccgcccuguaccacaucgugaagcaccggggcuuccaguccaaccgcaaggcggagcugaagaccgacgccaaggccgggcagaugcucagcggcgucuccgccaaccagcagcugaugcgggacaagagcuaccgcaccaucgccgagauggugugcaaggacgacgcguucaaggaccacaagcggaacaagggcggguccuaccgcaacacguucgcccgcagcgaccuggccgacgagcucaagacccugcugaagaagcagcgggaguacgacaacccccucgccaccccggagcuggaggaggccgugcacacccugcucauggcgcgccggcccgucuucaaggacgacgacaucgagaagcuggugggguucugcacguucgagcacggcgagaagcgcgcccccaaggccgccuucuccagcgagcgguucaucuggcugggcaagcucaacaaccugcgccugaucuaccccggggagcagcggucccucaccccggaggagcgcagccagaucaucaaccugcccuucacccaggccagcgugaaguucucccagauccggaagaagcuggaccuccccgaguacguccgcuucaaccuggugcgguacaagcccggcgaggagaccagcaaguccgagacggcgaccuucuucgaggccaaggccuuccacgagcugcgcaagaccuaccgggagagcgggaucuccgagcucugggagcgcgaccagcacgacccgcagcggcuggaccagaucgccaccgccaucgcgguguaccgcgacgacgagcggauccgcaacgagcugagcccccacacgaucgagaacgaggucguggaggccgugcucaacugcgacuucacccaguucaucaaccugucccugaaggcccucaacaagauccugcccuacauggagcagggccagcgguacgacgaggccugcaccagcgcgggcuaccagcaccacagcccccagcagaacgaggagaaguccgggcgcaucccgccgcccgacaagaacgucauccgcaaccccgugguguaccggucccugaaccaggcccgcaagcugaucaacgccaucaccaagcgguacggcgcccccgccgcgauccaccucgagauggcccgcgaccugagcaagcccuucuccgagcgcaagagcaucgagcgggagcaggagaaguaccggaagcagaagguccagcugcgcaacgaguacaucgagcacuucgggacggagcccaacggccucaaccugcugaaguuccggcucuacaaggagcaggacgcccagugcgccuacacccagaaggcccuggaccugucccgccucaacgaggcgggguacguggagguggaccacauccugcccuacagccgguccuacgacgacagccugcucaacaagacccugguccugaccgaggccaaccgcgacaagggcaaccggacgccguucgaguucaugggcggggacgaccagucccagcacuggcagaaguucgugcgcugggugcagaugaaccccaagauccggcaggccaagcgcaaccgguaccuccgcaaggacuucagcgagaaggccgcccgggaguuccgcgaccggcaccugaacgacacccgcuacaucggccgcgagcugaaggcgaugaucgagagccacguccaguggcaccccgacuccaagagcaaggacugcugcgugguccucuccgggcagcugaccgcccugcuccggggccgcuggggguucaacaaggaccgggccgccggcgaccugcaccacgcgguggacgccgccguggucgccgccgcgacccgcggcaugauccagcggauggcccgccacagcaaguuccacgagcugaagaacgugcggacguccuacgccgaccccgacaccggggagguggucaaccucgccgccgcgcgcgaccuggagaagcacuucccgcugcccugggacaacuuccggaacgacacccucgccuaccugaaccccagcgccaucuccgccgacgagagcgcccaggagggccaccgcggggugcgggugucccgcgcgccgacccggcgcaagcugggcgccgcccaccaggagacgauccggagcaaggggaaggacaacauccuccuggagcagggccuguccgccgucaagacgccccucagcaagcugacccugaagaacaucgagaacauggugggcuacgaggacccccgcaacgcggcccucgugaagguccugcgggagcgccuggaggccuucgggggcgacggggccaaggccuucgcgcccaaccagccgcccguguacaagcccuccaagcccggcaagcaggccccggagauccggagcgugaagauggccuccaagagcaagggcgcccuccacguccgcgaggggcuggccgacuccggccgcaugauccggaucgacaucuacgagaccaagaacggguacgugggcgugcccaucuacgucagcgacaaggcgcgcagcaagcugcccaaggccuaccccaagaagggggaggaccgggccaacuggccggagguggacaccaacgacaacuuccucuucucccuguacagcaccgacuggaucgaggccaagaccaagaaggagaccaucgccggcuacgugaaguccuacgacaucuucgacggccgccugcucgucuacgcgcacgacaacaagaagguggugcggaagcugacccugagcgcccucgccgaccugcagaagcugcacgucuccauccucggggaccuguacaagggcgggacgcccaagugcagcccccugcgcaagggccaggagcucuga

SEQ ID NO: 1502 - RNA, 3186 nt, Artificial Sequence
  Cas9 variant
augcugcgccucggccuggacaucgggagcaccuccaucggcugguuccuguaccggaucaccaacgggaugaucgccgagaucaucgacugcggcgugcgccucuucagcgacgggcgggacgccaagacgggcgucuccagcgcgguggagcgccggaacgcccgcgcccugcggcgccggcgcgaccgguaccugcgccggcgcgccgcccucaugcggcgccuggcggccgccggccugaugcccgaggacccgucccaggccaagccccucgagcugcuggaccccuaccggcuccgcgcggacgcccuggaccggcgccuggagcucaccgagcuggggcgggcccuguuccaccucaaccagcgccgcggcuucaagagcaaccggcagaccgaccgcgggaacaacgagggcgggaagaucaucgacggcuccgcccggcuggaccaggccaugauggcggugggcgcccgcaccuacggggaguuccugcaccuccggcgcagccaggccgaggaccugcggcgcguccccuccgugcggacgcgccugacccuccggagcguggacggcgggaaggccgagaccggcuacgacuucuacccggaccgccggcaccuggaggaggaguucaacaaggucugggccgcgcaggccgcccaccaccccgugcugaccgacucccuccgccacgagguguucgagacgaucuucuuccagcggccccugaaggcccccgccgucggccgcugccuguucuucccggagccccggcucccccgcgcgcacccccugacccagcggcgcgugcuguacgagaccgugaacgcccuccgcauccggaccgagagcggggccgccgucccgcugggcaaggagcagcgcgacaaggugaucaugcugcucgacgggaaggcccccgugaaggcgaucgccuccgccaagcugagccugaaggccaucgcgaagcaccucaagcugcgggacggccagacguucacccuggagaaggggcgcgacuacaucgccugcgaccccguccgggccucccucagccaccccgaccgcuucggcccgcggugguccgugcuggaggccgaggugcaggccgagaucgucggccgcauccgggacgacgacgacaccauggcgcugguggaguggcucaagcagguccacgggcuggacgacgcccacgcccgcgccaccgccgacgcgccccugcccgagggcuacgggcggcucggcgagacggccacccgcaagcugcuggacugccugaaggccgaggugcucaccuacagcgaggccguggggaaggcccuggaccagcaccacuccgaccggcgcaccggcgagauccuggagagccuccccuacuacggcgaggugcugcaggcgcacgucaucccggggacgggcgagccccaccacgacgacaucacccgguucgggcgcaucaccaaccccaccgugcacaucggccugaaccagcuccggcgccuggucaaccggaucaucgcccgcuacgggaagcccgccgagaucgugguggagcuggcccgggaccucaagcagagcacgggccagaagaaggcggccaucgcccugaaccugaagaaccgcaaggccgccgaggcgcgcuccgcccuccugaccgaguggggcgucccggacaccggggccaaccggauguacgugcgccuguggcaggagcuccacgaggaccccaugaugcggcgcugccccuacaccggcacgaucaucagccccucccugcuguucagcggggccaucgacaucgaccacauccucccguacucccggacccuggacgacagcaccgccaaccgcacccugugcaugaaggaggcgaaccggcagaagcgcaacaagucccccagcgaggcccggcgcgacggcaugcggaucugggcccucgaggacgacaaccugcgccacauccccgaguucaagcgguggcgcuucgccgaggacgccauggcgcgguucgagggcgagcgcgacuucgaggcccgggcccugguggacacgcaguaccucucccgcaucagcaaggccuaccuggagacccuguacgacggggcggacggcaagucccacgucuggguggugccggggcggcucaccgagaugcugcgccgccacuggggccugaacgggauccucaccgacccccugcgggacgucacgaaggagaagaaccgcauggaccaccggcaccacgccaucgacgccgccgugguggccgcgaccgaccgcggccugaucaaggccauggccgagcaggcccggaccgacgucgaccagggccgcgaggcccucgcgagcuccaucaugccgcccuggcccggguuccgggaggccguggccgcccagguggaccgcaucaucgucagccaccggcccgaccacggccgcaucgaccugaccacccggaugaaggggcgcgaccagacgaccggcccccugcaccgggacaccgccuacgggcucaccggccaguccgagaagggcgugccccugguggucacgcgcgagccguucgacaaccugacccccaccaugaucgggaagauccgggacgagccccucaaggcggcccuggccgccgugaccgccggcaagaaggacgacgcguucgccgaggcccuggcccacuuccgcgaccggcccgggccguaccacggcauccgccgggugcgccucaucgagcccaucagcgucguggagauccgggacgcguccgggcgcgccuacaagggcuacaagggcaacagcaaccacugcuucgagguguggcgccugcccgggggcgccaucacggagcacaucgucuccaccuucgacgcccaccagcccgggccggagccccggccccaccccgccgcgaagcgccugcuccggcuguucaagagcgacauggugaagcuggacgacagcaaguucggcccggugaucgccaccgucgugauguucgaccgcaacgggaagaucucccucgugccccacaccgccagcaacgcccggaagcgcugcgagaaguacaaggaggaccuguaccugcgguucacggcccgcacccucaucgaggcgggcgcccggcgcaucaucgucgacgagaccggccacuuccgggaccccgggcgcaagggcuga

SEQ ID NO: 1503 - RNA, 3189 nt, Artificial Sequence
  Cas9 variant
auggccgagaagcagcaccgcuggggccuggacaucgggaccaacagcaucggcugggccgugaucgcgcucaucgaggggcggcccgccggccuggucgccaccgggucccgcaucuucagcgacggccggaacccgaaggacggcuccagccuggccguggagcgccgggggccccgccagaugcggcgccggcgcgaccgguaccuccgccggcgcgaccgguucaugcaggcccugaucaacgugggccugaugcccggggacgcggccgcccgcaaggcccucgucacggagaaccccuacgugcugcggcagcgcggccuggaccaggcgcucacccugccggaguucgggcgggcccuguuccaccucaaccagcgccggggcuuccaguccaaccgcaagaccgaccgcgccaccgccaaggagagcggcaaggugaagaacgccaucgcggccuuccgggccgggaugggcaacgcccgcacggucggggaggcccuggcgcggcgccuggaggacggccggcccgugcgcgcccggauggugggccaggggaaggacgagcacuacgagcucuacaucgcccgcgaguggaucgcccaggaguucgacgcccugugggcgucccagcagcgguuccacgccgagguccuggccgacgccgcccgcgaccggcuccgcgcgauccugcuguuccagcggaagcuccugcccgugcccgugggcaagugcuuccuggagccgaaccagccccgcgucgccgccgcccuccccagcgcgcagcgguuccgccugaugcaggagcugaaccaccuccgggugaugacccuggccgacaagcgcgagcggccccuguccuuccaggagcgcaacgaccuccuggcccagcugguggcccgcccgaagugcggguucgacaugcuccggaagaucgucuucggcgccaacaaggaggcguaccgcuucaccaucgagagcgagcggcgcaaggagcugaaggggugcgacaccgccgccaagcuggccaaggugaacgcccucggcacgcgguggcaggcgcugucccuggacgagcaggaccgccucgugugccugcugcucgacggcgagaacgacgccguccuggccgacgcccugcgggagcacuacgggcucaccgacgcccagaucgacacccugcugggccucagcuucgaggacgggcacaugcgccugggccgguccgcgcugcugcgcgugcucgacgcccuggagagcgggcgggacgagcagggccugccccucuccuacgacaaggccguggucgccgcgggcuaccccgcccacaccgccgaccuggagaacggggagcgcgacgcccugcccuacuacggcgagcuccuguggcgguacacgcaggacgccccgaccgcgaagaacgacgccgagcgcaaguucgggaagaucgccaaccccaccgugcacaucggccugaaccagcuccggaagcuggugaacgcccugauccagcgcuacgggaagcccgcccagaucgucguggagcucgcgcggaaccugaaggccggccuggaggagaaggagcgcaucaagaagcagcagaccgccaaccucgagcggaacgagcgcauccggcagaagcugcaggacgccggcguccccgacaaccgcgagaaccgccugcggaugcgccucuucgaggagcuggggcagggcaacgggcugggcacgccgugcaucuacagcggccggcagaucucccuccagcgccuguucagcaacgacguccagguggaccacauccugcccuucuccaagacccucgacgacagcuucgccaacaaggugcuggcgcagcacgacgccaaccgguacaaggggaaccgcggccccuucgaggccuucggggccaaccgggacggcuacgcgugggacgacauccgcgcccgggccgccgugcugccccgcaacaagcggaaccgcuucgccgagaccgcgaugcaggacuggcuccacaacgagaccgacuuccuggcccggcagcugacggacaccgccuaccucagccgcguggcccggcaguaccugaccgccaucugcuccaaggacgacgucuacgugagcccggggcgccugaccgcgaugcuccgggccaaguggggccugaaccgcgugcuggacggcgucauggaggagcaggggcggcccgccgugaagaaccgcgacgaccaccgccaccacgccaucgacgccguggucaucggcgcgacggaccgggccaugcuccagcaggucgccacccuggccgcccgcgcgcgggagcaggacgccgagcgccugaucggggacaugcccacccccuggccgaacuuccucgaggacgugcgggccgccguggcgcgcugcguggugucccacaagcccgaccacggccccgagggcgggcugcacaacgacaccgccuacggcaucgucgccgggccguucgaggacggccgguaccgcgugcggcaccgcgugagccuguucgaccucaagcccggggaccuguccaacguccggugcgacgcgccccugcaggccgagcucgagcccaucuucgagcaggacgacgcccgcgcccgggagguggcccugacggcccuggccgagcgcuaccggcagcgcaagguguggcucgaggagcugaugagcguccugccgauccggccccgcggcgaggacgggaagacccuccccgacuccgcgcccuacaaggccuacaagggcgacagcaacuacugcuacgagcuguucaucaacgagcggggccgcugggacggggagcugaucuccaccuuccgggccaaccaggccgccuaccgccgcuuccggaacgacccggcgcgcuuccggcgcuacaccgccggcgggcggccccuccugaugcgccugugcaucaacgacuacaucgccgugggcacggccgcggagcggaccaucuuccgcguggucaagaugagcgagaacaagaucacccucgccgagcacuucgagggcgggacccugaagcagcgggacgccgacaaggacgaccccuucaaguaccugacgaagucccccggcgcccuccgcgaccugggggcccggcgcaucuucguggaccugaucggccgggugcucgacccggggaucaagggcgacuga

SEQ ID NO: 1504 - RNA, 3189 nt, Artificial Sequence
  Cas9 variant
augaaccugaacuacauccucggccuggaccuggggaucgccagcgugggcugggccgucguggagaucgacgagcaggagaacccccagcgccucaucgacguggggguccggaccuucgaccgcgcggaggugcugaagaccggcgagucccuggcccucgcccggcgccuggcccggagcucccgccggcuggugaagcgccgggccgagcgcaucaagaaggcgaagcggcuccugaaggccgagaaccugcuccugagcgccgacgagauccugccgaacgaggccuggcagcuccgcgucaaggggcuggaccagaagcuggagcggcaggagugggcggccgugcuccugcaccuccugaagcaccgcggcuaccugucccagcggaagaacgagagcaaguccgagaacaaggagcugggcgcccuccugagcgggguggccaucaaccaccagauccugcaguccgccgaguaccgcacgcccgcggagaucgccgucaacaaguuccaggccgaggagggccacauccggaaccagcgcggggccuacacccacaccuucagccggcucgaccugcuggccgagauggagcuccuguuccagcgccaggcgacccugggcaacccccacacguccaccaagcuccuggagaaccugaccgcccuccugauguggcagaagcccgcccuggccggggaggccauccucaagaugcugggcaagugcaccuucgagccgacggaguacaaggcggccaagaacagcuacuccgccgagcgguucguguggcugaccaagcucaacaaccugcgcauccuggagcagggcgccgagcgcgcccucaccgacaacgagcgguucgcgcugcuggaccagcccuacgagaaggccaagcucaccuacgcccaggugcgcacgcugcuggggcugagcgacgaggccaucuucaagggccuccgguaccagggggaggacaagaaggcggucgagaccaagaccacccugauggaggugaaggccuaccaccagauccgcaaggcccuggagggccucgaccugaaggccgaguggaacgagcugaagaacaaccccgcccuccuggacgagaucggcacggcguucucccuguacaagaccgacgacgacauccaccgguaccucgacgggaagcugagcgaguccgugcugaacgcccuccuggagaaccugaacuucgacaaguucauccagcucagccugaaggcccugcagcagauccucccccugaugcugcagggccagcgcuacgacgaggccgucuccgccaucuacggggaccacuacggcaagaaguccgacgagaucgaccggcuccugccgaacauccccaccgacgagauccgcaaccccguggugcugcggacccucacgcaggcgcgcaaggucaucaacgccguggugcggcuguacgggagccccgcccgcauccacaucgagaccggccgggaggucggcaagagcuaccaggaccgcaagaagcuggagaagcagcaggaggagaaccggaagcagcgcgagaacgccgugaagaaguucaaggaguacuucccgaacuucgugggggagcccaagggcaaggacauccucaagaugcggcuguacgagcugcagcaggccaagugccucuacagcgggaagucccuggagcuguaccgccuccuggagaagggcuacgucgagguggaccacgcgcugcccuucagccggaccugggacgacuccuucaacaacaagguccucgugcuggccaacgagaaccagaacaaggggaacgccacccccuacgaguggcuggacggcaagaacaacagcgagggcuggcagcacuucguggcccgcguccagacguccggguucagcuacgcgaagaagcagcgcgugcucauccaggagcuggacgagaaguccuucaucgagcggaaccugaacgacacccgcuacguggcccgguuccucugcaaccacaucgccgacaacaugcugcugaccggcaaggggaagcgcaaggucuucgccagcaacggccagaucaccgcccuccugcgggggugcuggggccugcagaaggugcgcgagaacaacgaccggcaccacgcgcucgacgccguggucguggccugcuccaccaagagcaugcaggacaagaucacgaaguucgugaaguacaaggagggccgccuguucaaggacaagaaggacggggucuacaagggcgagcggaucaaccgcgagaccggggagaucaucucccugcacuucccgacccccuggaaguucuucaaggagaacguggagauccggaucuucagcgagaaccccaagcucgagcuggagaaccgccugcccgacuacccgcaguacaaccacgaguucgugcagccccucuucgucucccggaugcccacgcgcaagaugaccggccagggccacauggagaccgucaagagcgccaagcggcuggacaaggggcuguccgugcucaaggugccccugacccagcugaagcucagcgaccuggagcgcauggugaaccgggagcgcgagauggcccuguacgaggcgcucaaggagugccuggagcaguucggcaacgacccggccaaggccuucgccgagcccuucuacaagaagggcggggcccuggugaaggcgguccggguggagcagacgcagaaguccggggugcucguccgcaacggcaacggcguggccgacaacgccaccgggagcaucgugcgggucgacguguucaccaagggcgggaaguacuuccuggugcccaucuacaccuggcaggucgccaagggcauccugcccaacaaggcggugauccaggggaaggacgagagcgagugggaggagauggacgagaacgccguguuccaguucuccaugcacaagaacgaccucaucaaggucaagaccaagaagggcgagaucuucggcuacuucaacgggcuggaccgcgccacgggcagcaucgagaucgaggagcacgaccuggagaaguccaaggggaagaacggcagccaccgcgggcucggcgugaagaccgccuucuuccuggagaaguaccagguggacgagcugggcaagaacauccggccgugccgccccaccaagcggcagcacguccgcuga

SEQ ID NO: 1505 - RNA, 3192 nt, Artificial Sequence
  Cas9 variant
auggagaaccacaucaacuaccgccugggccucgacaucgggaucgccagcgugggcugguccgucaucaaccuggacaagaagcggaucgaggaccugggggugcgcaucuucaacgccgcggagcaccccaaggacggcagcucccucgcccugccgcggcgcaucgcccgggggcgccggcgccugcuccggcgcaaggccuaccgggugaagcgcguccggaagcugaucguggacuacaacauccugaccaaggaccagcucaacgaccuguucaagcagaagugccagaacagcgugugggagauccgcgucaaggcccuggacaacaaggugaccaacgaggagugggcgcggcuccugaucaaccugugcaagcgccggggcuucaaguccaaccgcaagaacgaggccgacgacaaggagacgaagaaggugaucaacagcaucaaguccaacaucaagggcaugaaggagagcgggucccggaccaucggcgaguacaucuacacccagacccucagcuccggggacaucagcaaguccuuccgcaacaaggacggccaguacaacaacugcgucagccggaagaugaucgaggaggagaucaagauccuguucaagaagcagcgcgagcuggggugcgaguucgccuccgaggagaucgaggagaaguaccucgccaucuucaacagccagcgccccuucuccaaguucgaggaccuggagaagauggugggcuucugcacguucgagaaggcgagcaaggagcggcgcgcccccaagugcuccaucagcgccgaggaguucgugcuguacgacaacaugaacaagcucagcauccugaacaagggcgacacccggaagcugaccaacgaggagcgcaagaucaucgucgagaacgccuucaagaacaaggagaucaaguacuccaagcuccggaagauccugaaccugagcaacgacgagcgcuucuccacccucagcuacuccaacaagacggagcugagcaagaccgagaacuccaaguucguggcccugaagggguaccacgagaucaagagcgcgaucgagaaguccuucggcaaggacaccuggaaccgggugaagaacaaccgcaccaugcucaacgacaucgccuacguccugagcaucgccaagacggacgaggacaucaucaagcagcugucccuccggaacaucccccgcgagaucaucgacgccgugcuggggcugagcuucuccaaguucagcaaccucuccaucaaggccaucgagaagauccugccguaccugaaggacggccagcaguacaacgaggcgugcaagagcgccggcuacgacuucaaggccaccuacaacggggagaaguccuacaagcucccccugaucgacaucgacgagaucgugaaccccgucgugaaccgggcccugagccagacccgcaaggugaucaacgccgucaucgaccgguacggcucccccaucgggaucaacaucgagcucgcgcgcgaccuggccaagaacuucaaggaccggagcaagaucaagaaggagcaggaggagaaccgcgccaacaaggagaagaucaagaacgagcugaagaugcucaugaacaaggagccgaccagcuccgagauccugaaguaccggcuguggaaggagcagcgcgaggagugcgccuacagccaggagcggaucuacaucgaggaccucuucaaggugggccaguacgagaucgaccacaucauccccuucucccgcagcuucgacgacucccugaacaacaaggugcuggucaaggccgcggagaaccagcgcaaggccaaccggauccccuacgaguacuucgggagcgacgaggaccgcugguaccgguucgaggugugggucgagcaguccagccuguccuucaagaagaagaacaaccuccugaagaagcgcuucagccgggaggacuccaucgaguucaaggaccgcaaccugguggacacgcaguacaucagccgguacaucuccaacuucaucaagagccgccucaucuucaaggaguccgacagcaagcagaaggugaucaccaucaacggccgggccaccuccuaccugcgcgccaaguggggccugcucaagguccgggagaacggggacaagcaccacgcgcuggacgccaccgugaucgccguggccacgcagggcaugguccaggagaucagcaaguacagcaaggcccacgagcugaaguacauccgccagggggacgaguucaucgacaucgagaccggcgagaucgugaaggugaaggaccacaagcaccucuccaaggaccggcugcccgagccguggcugggguucagcuccgagcuccgccugcggcugagcgagaaccccaucgaggagcucaagaagucccccaucagcaccuacgacgaggaguucauccgcaagaccguccggcccaucuucgugucccgcgugccguaccggaaggucacgggccgccuguucgaggagaccguguacagccccaaggcguucaucgacgagggcuucaucgccaagaagaagcugcaggaccucacccugaaggacuucgagaacaucuacaacuacaacuccgacaagaagcuguacgacgcccuccgggagcgccuggaggaguacgggggcaacgccaagaaggccuucgcggaggaguuccgcaagcccaccaagacggggaagcugggccccaucgucaagagcaucaaggugaagaccaagaucccguucaaggacgggaucgaccucaacggcggcaaggugaagaaggacgggcuggugcggaucgacaucuacgagaaggagggcaaguacuacgucgugcccguguaccgccuggacauccagcaggggaacauccccaagaaggccgccgucgccaacaaggaggagaaggacuggauccucauggacgaguccuacaacuucaaguucagccuguacaagaacgaccugaucuacaucaaguacgacuccaagggcgaguacuucggcuacuacgacggguucgaccggcacaccggcgccaucacccucgagcgccacgacaacagcgagcgguaccgcgggaucggcaucaagacgggggugaaggagaucuucaaguacaacguggacguccugggccgguacuacaagguggcgaaguga

SEQ ID NO: 1506 - RNA, 3192 nt, Artificial Sequence
  Cas9 variant
auggagaaguuccacuacgugcugggccucgaccuggggaucgccagcgucggcugggccgcgaucgagaucgacaaggagaccgagaccuccaucgggcugcucgacugcggcgugcgcacguucgagcgggccgaggugcccaagaccggggacagccuggccaaggcccgccgggaggcccgcuccacccggcgccugauccggcgccggagccaccgccuccugcggcugaagcgccuccugaagcgggagaucuuccgccagccggagaccuucaaggaccugcccaucaacgcguggcagcuccgggucaagggccuggacucccgccugaacgaguacgagugggccgccgugcuccugcaccuggugaagcaccggggcuaccucagccagcgcaaguccgagaugagcgagacggacuccaagagcgagauggggcggcugcuggccggcgucgcggagaaccaccagcuccugcagcaggagcaguaccgcacccccgccgagcuggcccucaagaaguucgugaagcacuuccggaacaagggcggggacuacgcccacaccuucaaccgccuggaccugcaggccgagcuccaccuccuguuccagaagcagcgcgagcuggggaaccccuucaccuccccggagcuggagcgccagguggacgaccugcucaugacgcagcggagcgcgcugcagggcgacgccauccugaagaugcucggccacugcggguucgagcccgagcaguucaaggccgccaagaacaccuucuccgccgagcgguucaucuggcugaccaagcugaacaaccuccgcauccaggaccagggcaaggagcgggcgcugaccgccgacgagcgcacgaagcugcucgacgagcccuacaagaaguccaagcugaccuacgcccagguccggaagcugcucagccugccccagaccgccaucuucaaggggcugcgcuacgaccucgagcacgacaagaaggccgagaacagcacccugauggagaugaaguccuaccacaacauccggcagacgcuggagaaguccggccugaagaccgaguggcagagcaucgcgacccagccggagauccucgacgccaucggcaccgccuucagcaucuacaagacggacgaggacaucagccacgagcugaagaccugccgccugcccgagaacgugcucaacgagcugcugaagaacaucaacuucgacggguucauccagcucucccugaccgcccugcggaagauccucccccugauggagcagggcuaccgcuacgacgaggccugcacccagaucuacgggaaccaccacagcggcucccugcagcaggagagcaagcaguuccucccccacaucccgaucgacgacgugcggaaccccgucguguuccgcacgcugacccaggcgcggaagguggucaacgccaucauccgccgguacgggucccccgcccgcgugcacaucgagauggcccgggagcugggcaagagcaaguccgaccgcgaccgcaucgagaagcagcagcagaagaacaagaaggagcgggagaacgcgguggccaaguucaaggaggacuuccccgacuucgucggcgagccgcgcgggaaggacauccucaagaugcggcuguacgagcagcagcacggcaagugccuguacagcgggcacgacaucgacaucaaccgccucaacgagaagggcuacguggagaucgaccacgcccugcccuucucccggaccugggacgacagccagaacaacaaggugcugguccucggguccgagaaccagaacaagcgcaaccagacccccgacgaguaccuggacggcgccaacaacagccagcgguggcuggaguuccaggcccgcgugcagacgugccacuucuccuacggcaagaagcagcggauccagcucgcgaagcuggacgacgagaccgagaagggguuccuggagcgcaaccucaacgacacccgguacaucgcccgcuucaugugccaguucgugcaggagaaccuguaccugaccggcaaggggaagcggcucgucuucgccagcaacggcgggaugacggccacccugcgcaaccuguggggccuccggaaggugcgcgaggacaacgaccggcaccacgcccuggacgcgaucgucguggccugcuccaccgccagcaugcagcagaagaucaccaaggccuuccagcgccacgaguccaucgaguacguggacacggagaccggcgaggucaaguuccggaucccccagccgugggacuucuuccgccaggaggugaugauccggguguucagcgaccagcccugcgaggaccuggucgagaagcucuccgcccgccccgaggcgcugcacgacaacgugacgccccuguucgugagccgcgccccgaaccggaagaugagcgggcagggccaccucgagaccaucaaguccgccaagcgccugagcgaggagaacuccauggucaagaagccccugaccacccucaagcugaaggacauccccgagaucgugggguaccccagccgggagccgcagcuguacgccgcgcucaagacccgccuggagacccacgacgacgaccccaucaaggccuucgccaagcccuucuacaagccgaacaagaacggcgagcugggcgcccucgugcgguccguccgcgugaagggggugcagaacaccggcgucauggugcacgacgggaagggcaucgccgacaacgcgacgauggugcgggucgacguguacaccaaggccgggaagaacuaccuggugcccgucuacguguggcaggucgcccagggcauccugcccaaccgcgccgugaccagcggcaaguccgaggccgacugggaccucaucgacgagagcuucgaguucaaguucucccugagccgcggggaccugguggagaugaucuccaacaagggccggaucuucggguacuacaacggccucgaccgggcgaacgggagcaucggcauccgcgagcacgaccuggagaaguccaagggcaaggacggggugcaccgggucggcgugaagaccgccacggccuucaacaaguaccacguggacccccuggggaaggagauccaccgcugcagcuccgagccgcggcccacccucaagaucaagagcaagaaguga

SEQ ID NO: 1507 - RNA, 3192 nt, Artificial Sequence
  Cas9 variant
auggagaaggacuacauccugggccucgacaucgggaucggcagcgugggguacggccugaucgacuacgacaccaaguccaucaucgacgccgggguccgccuguuccccgaggccaacgcggacaacaaccucggccggcgcgccaagcggggcgcccgccggcugaagcgccggcgcauccaccggcuggagcgcgucaagagccuccuguccgaguacaagaucaucagcgggcuggccccgaccaacaaccagcccuacaacauccgggugaagggccucacggagcagcugaccaaggacgagcuggccguggcgcuccugcacaucgccaagcgccgggggauccacaacguggacguggccgccgacaaggaggagaccgcguccgacagccuguccaccaaggaccagaucaacaagaacgccaaguuccucgagagccgcuacgucugcgagcugcagaaggagcggcuggagaacgagggccacgugcgcgggguggagaaccgguuccucacgaaggacaucguccgcgaggccaagaagaucaucgacacccagaugcaguacuaccccgagaucgacgagaccuucaaggagaaguacaucucccugguggagacccggcgcgaguacuacgagggccccggcaaggggagcccguacggcugggacgccgacgugaagaagugguaccagcugaugauggggcacugcacguacuuccccgucgaguuccgguccgugaaguacgccuacaccgcggaccucuacaacgcccugaacgaccugaacaaccucaccaucgcccgcgacgacaaccccaagcuggaguaccacgagaaguaccacaucaucgagaacguguucaagcagaagcgcaaccccacccugaagcagaucgccaaggagaucggcgucaacgacaucaacaucagcggcuaccgggugacgaaguccgggaagccgcaguucaccagcuucaagcuguuccacgaccucaagaagguggucaaggaccacgccauccuggacgacaucgaccuccugaaccagaucgcggagauccugaccaucuaccaggacaaggacuccaucguggccgagcucggccagcuggaguaccugaugagcgaggccgacaagcaguccaucagcgagcucaccggguacacgggcacccacucccugagccugaagugcaugaacaugaucaucgacgagcucuggcacagcuccaugaaccagauggagguguucaccuaccugaacaugcgccccaagaaguacgagcugaagggguaccagcggauccccaccgacaugaucgacgacgccauccucagccccgucgugaagcgcuccuucaagcaggccaucggcguggucaacgcgaucaucaagaaguacggccugccgaaggacaucaucaucgagcuggcccgggagagcaacuccgccgagaagucccgcuaccuccgggccauccagaagaagaacgagaagacgcgcgagcggaucgaggccaucaucaaggaguacgggaacgagaacgcgaagggccuggugcagaagaucaagcugcacgacgcccaggaggggaagugccucuacagccugaaggacaucccccuggaggaccugcuccgcaaccccaacaacuacgacaucgaccacaucaucccccggagcgucuccuucgacgacagcaugcacaacaaggugcuggugcgccgggagcagaacgccaagaagaacaaccagaccccguaccaguaccugaccuccggcuacgccgacaucaaguacagcgucuucaagcagcacgugcucaaccuggcggagaacaaggaccgcaugaccaagaagaagcgggaguaccugcucgaggagcgcaacaucaacaaguacgacgugcagaaggaguucaucaaccggaaccuggucgacacgcgcuacaccacccgggagcugaccacgcuccugaagaccuacuucaccaucaacaaccuggacgugaaggugaagaccaucaacggguccuucacggacuuccuccgcaagcgcuggggcuucaagaagaaccgggacgagggcuacaagcaccacgccgaggacgcccugaucaucgccaacgccgacuaccuguucaaggagcacaagcuccugaaggagaucaaggacgucagcgaccuggcgggggacgagcgcaacuccaacgugaaggacgaggaccaguacgaggagguguucggcggguacuucaagaucgaggacaucaagaaguacaagaucaagaaguucagccaccgggucgacaagaagcccaaccgccagcucaucaacgacaccaucuacuccacccgggugaaggacgacaagcgcuaccugaucaacacccugaagaaccucuacgacaagagcaacggcgaccugaaggagcggaugcagaaggaccccgagucccugcucauguaccaccacgacccccagacguucgagaagcugaagaucgugaugagccaguacgagaacgagaagaacccgcuggccaaguacuucgaggagaccgggcaguaccucaccaaguacgccaagcacgacaacggccccgccauccacaagaucaaguacuacggcaacaagcuggucgagcaccuggacaucaccaagaacuaccacaacccccagaacaagguggugcagcucagccagaaguccuuccgcuucgacgucuaccagaccgacaagggguacaaguucaucagcaucgccuaccugacgcugaagaacgagaagaacuacuacgcgaucucccaggagaaguacgaccagcucaagagcgagaagaagaucuccaacaacgccguguucaucggcagcuucuacaccuccgacaucaucgagaucaacaacgagaaguuccgggugaucggggucaacagcgacaagaacaaccugaucgagguggaccgcaucgacauccggcagaaggaguucaucgagcuggaggaggagaagcaggucaacuacaugaacuccgacagcuaccucaagaacaaccgcaucaaggugaccaucggccggaagaccacgaacaucgagaaguuccacaccgacauccugggcaacauguacaaguccaagcgccccaaggccccgcagcugguguucaagaagggguga

SEQ ID NO: 1508 - RNA, 3195 nt, Artificial Sequence
  Cas9 variant
augagcgagugcgugacccgccggauccugggcaucgaccucgggaucgccuccugcggcuggggcgucaucgaggugggggaggccagcggguccaucaucgcgagcggcgugcgcugcuucgacgcgccccugaucgacaagaccggcgagccgaaguccgccacgcggcgcaccgcccgggggcagcgccggaucauccgccggcgccggcagcgcaugaacgccguccggcgccugcucgccgaguucggcgugcugaccgggcggagccccgacgcccugcaccaggcccuccugcgccugucccagagcguggccggcucccaggucacccccuggacgcuccgggcggccgcccacgagcgcaagcugaccaacgacgagcuggccguggugcucgggcacaucgcccggcaccgcggcuuccggagcaacuccaagaacgacggcggggcgaacgccgccgacgagaccagcaagaugaagaaggccauggagaccacgcgcgagggccuggcccgcuaccacuccuucggggcgaugaucgccagcgaccccaaguucgccgaccggaagcgcaaccgggacaaggacuacucccacaccgccaagcgcagcgaccuggaggacgagguccggaccaucuuccgcucccagacccgguucggcagccucguggccuccgagaagcugagccaggcguucgccgacgccgccuucuuccagcgcccgcugcaggacagcgaggacauggugggcuccugccccuucgagcccgggcagaagcggacggcccgccgggcgcccagcuucgagcuguuccgcuuccucucccggcuggccaaccucaagcugaccgucggccgcgccccggagcggcgccugacccccgacgagaucgcccucgcggccaagggguucggcgagaccaagaaguccaucacguucaagagccugcgggaggcccuggaccucgaccccaacgcccgcuucagcgggguggccaaggagaaggaguccacccuggacguggcggcccggaccggcggcgccgccuacgggaccaagacgcugaaggacgcccucggcgacgcgcccuggcgcagccugucccgcaugccggagaagcuggaccggaucgccgagauccucagcuuccgcgaggacaugaaggccauccggaacgggcuggaggaggucggccuggacgggcucgugguggacgcccugaugcaggccaccgcgaacggcgacuucaaggacuucacccgcgccgcccacaucuccgcccuggcggcccggaacaucauccccggccuccgcgaggggcuggucuacagcgacgccugcacccgggugggcuacgaccacgccgcccgccccgcggugccccugucccagaucgggagcccggucacgcggaaggcccucuccgaggcccugaagcagguccgcgccguggcccgggaguacggccccaucgacuacuuccacaucgagcuggcgcgcagcaucgggaaguccgccgaggagcggaagaagcucaccgacggcaucgaggcccgcaacguggagaaggagaagcggcgcaaggaggccgccgagcaccugggccgggcgcccagcgacgacgagcugcuccgcuacgagcuggccaaggagcagaacuucaagugcaucuacuccggggaccccaucgacccggccggcaucagcgccaacgacacccgguaccagguggaccacauccugcccuggagccgcuucggggacgacuccuacgucaacaagacccugugcacggcgcggagcaaccagaacaagcgcggccgcacccccuucgagugguucgacgccgacaagaccgaggccgaguggauggaguacuccgcccggguggaggaccucaaggaggugaagggccgcaagaagcggaacuacagcaucaaggacgccgcguccgucgaggacaaguucaaggcccgcaaccugaccgacacgcagugggccacccggcugcucgccgacgagcugaagcgcauguucccgccccgggagugcgagcgcguggugaccguccgggccgacgggggcaacgacgggcugagcaucguggaggagcgccggguguucacccgccccggcgcgaucacguccaagcuccggcgcgccugggggcuggagggccugaagaagcaggacggcaagcgggucgaggacgaccgccaccacgccguggacgcccucgugcuggccgcgaccaccgagagccugcucaaccggcugaccgucgaggugcagcagcgcgagcgggaggggcgccaggacgacaucuuccacugcucccagcccuggcccggcuuccgcguggacguccagcggaccguguacgggagcgagacgaugccgggcaucuucgugucccgcgccgagcggcgccgggcccgcgggaaggcccacgacgccaccgucaagcagauccgggacaucgacggcgagcgcaucguguucgagcggaagcccaucgagaagcugaccgacaaggaccucgagcgcauccccgugccggagcccuacggcaaggcggccgaccccaagaagcugcgggacgagcuggucgagaaccuccgcgccuggaucgccgcggggaagcccaaggacaagccgccccggagccccaagggcgacaucauccgcaaggugcggaucgagaccaaggacaagguggccgucgagaucaacgggggcacgguggaccgcggggacauggcccggguggacgucuuccgcaagaagaacaagaagggcgugugggaguucuacgugauccccaucuacccgcaccagaucgucgccuccgcccugccgcccaaccgggcggugaucgccuacaaggccgagagcgaguggaccgccaucgacggcugcuucgaguucgccuggucccugaaccccaugagcuaccucgagcuggugaaguccaacggggagcugaucgagggcuacuuccgcagcauggaccggaccaccggggcgaucaaccucagccccauguccacgaacagcgagaccauccgcuccaucggcgucaagacccugagcuccuuccgcaaguucaccguggaccggcuggggcgcaaguucgagaucccccgggaggugcgcacguggcggggcgaggccugcaccuga

SEQ ID NO: 1509 - RNA, 3195 nt, Artificial Sequence
  Cas9 variant
augaagcgcaccagccugcgggccuaccgccucggcguggaccugggggccaacucccugggcugguucgucguguggcucgacgaccacgggcagcccgagggccuggggccgggcggcgugcggaucuuccccgacgggcgcaacccccagagcaagcaguccaacgcggccggccggcgccuggcccggagcgcccgccggcgccgggaccgcuaccuccagcggcgcgggaagcugaugggccugcucgucaagcacgggcugaugcccgccgacgagccggcgcggaagcgccuggagugccucgaccccuacggccugcgggccaaggcccuggacgaggugcucccccugcaccacgugggccgcgcccuguuccaccucaaccagcggcgcgggcuguucgcgaaccgggccaucgagcagggcgacaaggacgccuccgccaucaaggccgcggccgggcgccugcagaccagcaugcaggccugcggcgcccgcacgcucggcgaguuccugaaccggcgccaccagcugcgggccaccguccgcgcgcggucccccgucgggggcgacgugcaggcccgcuacgaguucuacccgacccgggccaugguggacgccgaguucgaggccaucugggcggcccaggcgccccaccaccccaccaugacggccgaggcccacgacaccauccgcgaggccaucuucagccagcgggccaugaagcgccccuccaucgggaagugcagccucgacccggccaccucccaggacgacguggacggcuuccggugcgccuggagccacccccuggcgcagcgcuuccggaucuggcaggacgugcgcaaccuggccgucguggagaccgggcccacguccagccggcucggcaaggaggaccaggacaagguggcccgcgcccugcugcagaccgaccagcucuccuucgacgagauccggggccugcuggggcuccccagcgacgcccgcuucaaccuggaguccgaccggcgcgaccaccugaagggcgacgcgaccggggccauccucagcgcccgccggcacuucggcccggccuggcacgaccgcucccuggaccggcagaucgacaucgucgcccugcucgagagcgcgcuggacgaggccgccaucaucgccagccuggggaccacgcacucccucgacgaggccgcggcccagcgcgcccugagcgcccugcuccccgacggcuacugccggcugggccugcgcgcgaucaagcgggugcucccccugauggaggccgggcgcaccuacgccgaggccgccuccgcggccggcuacgaccacgcccugcugcccgggggcaagcucagcccgaccggguaccugcccuacuacggccaguggcugcagaacgacguggucggcuccgacgacgagcgggacaccaacgagcgccggugggggcgccuccccaaccccacggugcacaucggcaucgggcagcugcggcgcguggucaacgagcugauccgguggcacggcccgcccgccgagaucaccguggagcucacccgcgaccugaagcugagcccccggcgccucgccgagcuggagcgggagcaggcggagaaccagcgcaagaacgacaagcggaccucccugcuccgcaagcugggccugcccgccagcacgcacaaccuccugaagcugcgccucugggacgagcagggggacguggccuccgagugcccguacaccggcgaggccaucgggcuggagcggcuggucagcgacgacguggacaucgaccaccucauccccuucuccaucagcugggacgacuccgccgcgaacaaggucgugugcaugcgcuacgccaaccgggagaagggcaaccgcacccccuucgaggccuucgggcaccggcagggccgcccguacgacugggccgacaucgcggagcgggccgcccgccugccccggggcaagcgcuggcgguucgggcccggcgcccgcgcccaguucgaggagcugggggacuuccaggcgcggcuccugaacgagaccagcuggcuggcccgcguggccaagcaguaccucgccgccgucacgcacccccaccggauccacgugcugccgggccgccugaccgcgcuccugcgggccaccugggagcugaacgaccuccugcccggguccgacgaccgcgccgccaagagccggaaggaccaccgccaccacgccaucgacgcgcugguggccgcccucaccgaccaggcccugcugcgccggauggccaacgcgcacgacgacacgcgccggaagaucgagguccuccugcccuggcccaccuuccgcaucgaccuggagacccggcucaaggccaugcuggugucccacaagccggaccacggccugcaggcccgccuccacgaggacaccgccuacggcacgguggagcaccccgagaccgaggacggggcgaaccuggucuaccggaagaccuucguggacaucagcgagaaggagaucgaccgcauccgggaccgccggcugcgcgaccucgugcgggcccacgucgccggcgagcgccagcaggggaagacccugaaggccgccgugcuguccuucgcgcagcggcgcgacaucgccggccaccccaacgggauccggcacgugcgccucaccaagagcaucaagcccgacuaccuggucccgauccgggacaaggccggccgcaucuacaagagcuacaacgccggcgagaacgccuucguggacauccugcaggcggaguccgggcgguggaucgcccgcgccacgaccguguuccaggccaaccaggccaacgagagccacgacgcgcccgccgcccagcccaucaugcgcgucuucaagggcgacaugcuccggaucgaccacgccggggcggagaaguucgugaagaucgugcgccugucccccagcaacaaccugcucuaccuggucgagcaccaccaggccggcguguuccagacccggcacgacgacccggaggacuccuuccgcuggcuguucgccagcuucgacaagcuccgggaguggaacgccgagcuggugcgcaucgacacccuggggcagcccuggcggcgcaagcggggccucgagacgggcuccgaggacgccacccgcaucggguggacccggcccaagaaguggcccuga

SEQ ID NO: 1510 - RNA, 3198 nt, Artificial Sequence
  Cas9 variant
augaacaaggacaucaacuacgcccugggccucgacaucgggaucaccagcgugggcugggccgucaucaaccuggaccugaaccgcaucgaggaccucggggugcggaucuucaacgcggccgagaaccugaaggacggcuccagccuggcccucccccgccggcuggcccgcgggcggcgccggcugcuccgccggaaggccuaccgcguggagcggguccgcaagcugauccugaagaacaacauccucaccaaggaggagcuggagggccuguucaagaacaaggaggugaucgacgugugggaggcgcgggucaagggccucgacuacaagcugucccgcgaggagugggccaagauccugaucaacuucugcaagcggcgcggguucaagagcaaccggaagaacgaggccaaggacaaggaggccggccagauccucuccagcaucuccuacaacaucgagaagaugaaggagacgaacagccgcaccaucggggaguacaucuacaacgaggugaagaacuccgaggacagcuacgcgccgcugcggaacaaguucggcgaguacaagaugugcgugucccgcgacgucauccgggaggagauccacacccuguucgagaagcagcgcgagcucgggaacaacuucgccagcgacgagaucgaggacaaguacuucgagaucuucaacucccagcgccccuucagcaacuucgaggaccuggagaagcuggugggcuucugcaccuucgagcggaagaagcacaagcgcgcccccaagcacugcaucuccagcgaggaguucacgcucuacgagggcaucaacaagcuguccaucaucaaggacggggagaagcggaagcugagcgaggaggagcgcacccucguggucaacgaggccuucaacaagaaggagaucaaguacaccacccugcggaagcugcucggccuguccgaggaggagcuguucagcacgcucaccuacagcaucgacaaggacaucuccaagaccgagaacaccaaguucgugagccugaagggguaccacgagaucaagcgcgccaucgagaagggcguguccaagaaggcguggcaggacaucgagaacaaccggaaccugcucaacgacaucgccuacguccugacgcugggcaagaccgacgacgagaucgagaagcagcuccgccugcggaacgugcccgaggagcuguucgagagccuccuggacauguccuucaacaaguucaacaaccugagcaucuacgcccucgagaagauccugccguucaugaaggagggguaccaguacaacgaggccugcgagaaggccggcuacaacuucaaggcgaucuacgagggggugcgcaccaagaagcugcccgucaucgagaucgacgagaucgugaaccccguggucaaccgggcccucgcccagacccgcaaggugaucaacuccgugaucgacaaguacggcagccccguccggaucaacaucgagcuggcccgcgaccuggccaagaacuucaaggaccggaagcugaucgagaaggagcagaaggagaaccgcgcgaaccucgacaagauccgggagaaccugcgcgagcugauggacaaggagccgacgguggucgaggugcucaaguaccggcugugggagcagcagcgcggggagugcgccuacacccagucccagaucccccuggagcgccucuucagccccggcuacugcgagaucgaccacaucauccccuucucccggagcuucgacgacucccugagcaacaagauccuggugcucggcuccgagaaccagcgcaaggggaaccggaccccguacgaguacuucggcgaggacagcgagcgcuggaacuccuucgagaucugggucaaggggagcuaccugaacuacaagaagaaggccaaccugcucaagaagaaguucuccgaggaggagcagcgggacuggaaggcccgcaaccugcaggacaccaaguacaucugccgguacaucagcaacuucgugaacaaccgccuggaguucaaggagagcgagaacaagcagaaggugaucacggucaacggccgggccaccgcguaccuccgcucccggugggggcugaacaaggugcgcgaggacggcgacaagcaccacgcccuggacgccgccguggucggcgugaccacccaggggauggugcagaagaucagcaaguacuccaaggcgcacgagcucuacacgguccggaagaacgacgaguucguggacguggagaccggcgagugcgucgacguggacgaguacaaggagauccgcaaggacauccugccccggcccuggcgcggguucagcgaggagcugaagcuccggcuguccgacaacccccuggaggagcucaagaaguccccgaucgagaccuacaacgaggaguucaucaaggagaacgugaagcccaucuucgucagccgcgugcccuuccggaagaucagcggcaagcuguucaaggagaccaucuacuccgagcgcgccuucaaggacggguacuucgugagcaagaagucccuggucgaccucaagcggggcgaccuggacaacuucuacaacuacgagugcgacaagaagcuguacgacgccaucagcgagcgcaugaaggaguucaacuacaacggcaagaaggccuucgagucccccuuccgcaagccgaccaagagcgggaaggagggccccguggugcgguccgucaagaucaagagcgccgugcccuucaaggacgggauccccaugaacgagggccucguggcgaaggagggcaugguccgcaucgacaucuacgagaaggaggggaaguacuucguggugccggucuaccgguaccagcuggccaagggcaucgugcccaagcgcgccgccaucgccaagaaggacgagcugaaguggcccaucauggaccagacguacaacuucaaguucuccaucuacaagaacgaccucaucgaggugaaguacgacaagaagggggucuacuucggcuacuacgacggguucgaccggaacagcgcgagccugaccaucgagaagcacgacaacuccgagcgcuaccggagcaucggccugaaggugggcgugcucgagaucaacaaguacgaggucgacgugcuggggaacuaccacaaggugaagcugggcgggaacuga

SEQ ID NO: 1511 - RNA, 3198 nt, Artificial Sequence
  Cas9 variant
augaacaaggacaucaacuacgcccugggccucgacaucgggaucaccagcgugggcugggccgucaucaaccuggaccugaaccgcaucgaggaccucggggugcggaucuucaacgcggccgagaaccccaaggacggcuccagccuggcccugccgcgccggcucgcccgcgggcggcgccggcugcugcgccggaaggccuaccgcguggagcggguccgcaagcucaucgugaagaacaacauccugaccaaggaggagcuggagggccucuucaagaacaaggaggugaucgacgucugggaggcgcgggugaagggccuggacuacaagcugucccgcgaggagugggccaagauccucaucaacuucugcaagcggcgcggguucaagagcaaccggaagaacgagacgaaggacaaggaggccggccagauccuguccagcaucuccuacaacaucgagaagaugaaggagaccaacagccgcaccaucggggaguacaucuacaacgaggugaagaacuccgacgacagcuacgcgccccugcggaacaaguucggcgaguacaagaugugcgucucccgcgacgugcuccgggaggagauccacacccuguucgagaagcagcgcgagcuggggaacaacuucgccagcgacgagaucgaggacaaguacuucgagaucuucaacucccagcgccccuucagcaacuucgaggaccucgagaagcuggugggcuucugcacguucgagcggaagaagcacaagcgcgcccccaagcacugcaucuccagcgaggaguucacccuguacgagggcaucaacaagcucuccaucaucaaggacggggagaagcggaagcugagcgaggaggagcgcacccuggucgugaacgaggccuucaacaagaaggagaucaaguacaccacgcuccggaagcugcugggccucuccgaggacgagcuguucagcacccugaccuacagcaucgacaaggacaucuccaagaccgagaacacgaaguucgugagccucaagggguaccacgagaucaagcgcgccaucgagaagggcgucuccaagaaggccuggcaggacaucgagaacaaccggaaccugcugaacgacaucgcguacgugcucacccugggcaagaccgacgacgagaucgagaagcagcugcgccuccggaacgugccggaggagcuguucgagagccugcucgacauguccuucagcaaguucaacaaccuguccaucuacgcccuggagaagauccuccccuucaugaaggagggguaccaguacaacgaggccugcgagaaggccggcuacaacuucaaggccaucuacgaggggguccgcaccaagaagcugcccgugaucgagaucgacgagaucgugaaccccgucgugaaccgggcgcuggcccagacgcgcaaggugaucaacagcgucaucgacaaguacggcuccccggugcggaucaacaucgagcucgcccgcgaccuggccaagaacuucaaggaccggaagcugaucgagaaggagcagaaggagaaccgcgccaaccuggacaagauccgggagaaccuccgcgagcugauggacaaggagcccaccgcggucgaggugcugaaguaccggcucugggagcagcagcgcggggagugcgccuacacccagagccagaucgcccuggagcgccuguucucccccggcuacugcgagaucgaccacaucauccccuucagccgguccuucgacgacagccucuccaacaagauccuggugcugggcagcgagaaccagcgcaaggggaacaagaucccguacgaguacuucggcgaggacuccgagcgguggaacagcuucgagaucugggucaagggguccuaccucaacuacaagaagaaggccaaccugcugaagaagaaguucaccgaggaggagcagcgcgacuggaaggcccggaaccuccaggacacgaaguacaucugccgcuacaucagcaacuucgugaacaaccggcuggaguucaaggagagcgagaacaagcagaaggugaucaccgucaacggccgcgcgaccgccuaccugcggucccgcugggggcucaacaaggugcgggaggacggcgacaagcaccacgcccuggacgccgcgguggucggcgugaccacgcaggggauggugcagaagaucagcaaguacuccaaggcccacgagcuguacaccguccgcaagaacgacgaguucguggacguggagaccggcgagugcgucgacguggacgaguacaaggagauccggaaggacauccucccccgccccuggcggggguucagcgaggagcugaagcugcgccucuccgacaacccccuggaggagcugaagaagcucccgaucgagaccuacaacgaggaguucaucaaggagaacgugaagcccaucuucgucagccgggugcccuuccgcaagaucuccggcaagcuguucaaggagacgaucuacagcgagcgggccuucaaggacggguacuucguguccaagaagucccuggucgaccucaagcgcggcgaccuggacaacuucuacaacuacgagugcgacaagaagcuguacgacgccaucagcgagcggaugaaggaguucaacuacaacggcaagaaggccuucgagagccccuuccgcaagccgaccaaguccgggaaggagggccccguggugcgcagcgucaagaucaaguccgcggcccccuucaaggacgggauccccaugaacgagggccucguggccaaggagggcauggugcggaucgacaucuacgagaaggaggggaaguacuucgucgugccgguguaccgcuaccagcuggccaagggcaucguccccaagcgggccgcgaucgccggcaagagcgagcugaaguggcccaucauggaccagaccuacaacuucaaguucuccaucuucaagaacgaccucaucgagaucaaguacgccaagaaggacggguacuucggguacuacgacggcuucgaccgccacaccgccagccuggugaucgagaaccacgacaacagcgaccgguaccgcggcaucggggugaagacgggcgucguggaguucaacaaguacgagguggacguccuggggaacuaccacaaggugaaccucggcgggaacuga

SEQ ID NO: 1512 - RNA, 3201 nt, Artificial Sequence
  Cas9 variant
augagcgagcgcgugguccggcgcauccugggcaucgaccucgggaucgccuccugcggcuggggcgugguggacaucagcggggccgggggcggcaucaucgcgaccgggguccggugcuucgacgcgccccugaucgacaagaccggcgagccgaaguccgccacgcgccggaccgcccgcgggcagcggcgcaucgugcggcgccggcgccagcggaugaacggcgugcgccggcugcucugcgaguucgggcugcugcccgacccccgccccgacgcccucaaccaggccaugcggcgcaucagcaccgccuccgccgccgcgcaggucaccccguggacgcugcgggccgccgcccaccagcgccugcucagcaacgaggagcuggccguggugcugggccacaucgcgcggcaccgcggcuuccgcuccaacgccaagaacgaggccggggccaacgccgcggacgagaccagcaagaugaagaaggccauggaggccacccgggagggccucgccaaguaccacgccuucggggacaugaucgcgaacgaccccaaguucgccaaccgcaagcggaaccgcgacaaggacuacucccacaccgccaagcggagcgaccuggaggacgagguccgcgccauccugcgggcccagcuccgcuucggcuccgcggccgccacggagacccuggcccagaccuucgcggacguggccuucuuccagcggccccugcaggacagcgaggaccgcgugggcgacugccccuucgagccggggcagaagcgggccgcccgccgggcccccuccuucgagcuguuccgcuuccucagccggcuggcgaaccucaagcuggccgucggccgcucccccgagcggcgccugaccgccgaggagaucgcccucgccgcgaagggguucggcgagacgaagaagaccaucaccuucaagagccugcgggaggcccuggaccucgaccccaacgcccgcuucuccgggaucggcaaggacaaggaggccagccuggacgugguggcccgcaccggcggggcggccuacggcacgaagacccugaaggacgcccucggggacgccccguggcggucccugagccgcacccccgagacccuggaccggaucgcggagauccucagcuuccgcgaggacaucacguccauccggaacggccuggaggaccuggggcucgacagccuggucguggaggcccugaugcaggccgccgccaacggcgacuucaaggaguucacccgcgcgggccacaucuccgcccgggccgcccgcaacaucauccccgggcuccgggagggccugguguacagcgaggccugcgcgcgcgucggguacgaccacgccgcccggcuguccgugccccucgaccaggugggcagcccggucacccgcaaggcccuguccgaggcccugaagcagguccgggcgguggcccgcgaguacgggcccaucgacuacuuccacaucgagcucgcccggagcgugggcaaguccgccgaggagcgcaagcagcugaccgacggcaucgaggcgcggaacguggagaaggccaagcgccggaagcaggccgaggagcaccuggggcgcgcccccagcgacgacgagcuccugcgguacgagcuggccaaggagcagaacuucaagugcaucuacuccggcgacgcgaucgaccccgccggggucgccgccaacgacacgcgcuaccagguggaccacauccugccguggagccgcuucggcgacgacuccuaccucaacaagacccugugcaccgcccggagcaaccagaacaagcgcggccggacccccuucgagugguucgaggcggacaagacggacguggaguggauggaguacgucgcccgcguggagaaccugcaggaggugaaggggcggaagaagcgcaacuacuccaucaaggacgccgccgccaucgaggacaaguucaaggcgcggaaccucaccgacacccagugggccacccgccugcuggccgacgagcucagccggauguucccgccccgcgagugcgagcgggccaucugcggccgcgccgacgggggcaacgacgggcugacgaucgucgaggagcggcgcguguucacccggcccggcgcgaucaccuccaagcugcgccgggccuggggccucgaggggcugaagaagcaggacggcaagcgcguggaggacgaccggcaccacgccgucgacgcccuggugcucgcggccaccacggagagccugcugcagcgccucaccguggagguccagcgccgggagcgcgaggggcggcccgacgacaucuuccacugcgccgagcccuggcgcggcuuccgggccgacgugcgccggaccguguacggguccgagaccaugcccggcaucuucgucagccgcgccgagcggcgccgggcgcgcggcaaggcccacgacgccaccaucaagcagauccgggagaucgagggggagcgccugguguucgagcggaagccgguggagaagcugacggacaaggaccucgagaagauccccauccccaagccguacggccaggucagcgaccccaagcgccugcgggacgagcugguggagucccuccgcgccuggaucgccgcggggaagcccaaggaccggcccccgcugagccccaagggcgacgugauccgcaagguccggauccagaccaacgacaagguguccguggagaucaacgggggcaccgucgaccgcggcgacauggcccgcguggacguguuccggaagaagaacaagaaggccgucugggaguacuacguggugcccaucuacccccaccagaucgucgcccugaacgacccgcccgaccgcgccgugaucgcguacgccgaggacaaggacuggaaggagaucgacagcuccuacgaguuccucuggagccuguucgggcuguccuacguggagaucagcaaggccaacggcgagugcaucgacggguacuuccggggccuccaccgcgggaccggcgccgcguccgucugcaagcacaucagccugggcaaggacgccacgguguccgggaucggccugaagacccucgccagcuucaagaaguucaccaucgaccggcuggggcgcaaguucgagaucccccgggaggugcgcaccuggcggggcgaggccugcacguga

SEQ ID NO: 1513 - RNA, 3201 nt, Artificial Sequence
  Cas9 variant
augagccaccuggugcucggccuggaccuggggcccaacuccaucggcugggcccucgucaacgacgacccggagcaccccguggagagcaagcugguggaccuggggguccgcguguuccccgagggcguggacaacuucgacaccuccaaggagcucagccggaacgaggaccgccgggucgcccgcgggaugcggcgccagauccggcgccgggcgcgccggcgccagcagcugaagcaggcccugaucgacuccaagcucuggcccagcgacccgaacgacgagguggugcuguacaacaccaaccccuacgagcugcgggcccgcgcccucaaggagcggcuggagccccacgaggucggccgcgugcugcuccaccugaaccagcggcgcggcuuccuguccaaccggaagaaggaccgcggggacaaggaggugcagggcaugcucgccgagaucaacgagaacgagcagcagugcaaggacgggggcuucgacacgaucggggcguggcuggccgacaagcaggccaacaucgaccacgccaaccgggaggagaacgaccacguccgcaaccgccaccuggcgcggagccaguacguggacgaguucgaggccaucugguccgugcaggccaagcaccaccccaagcuccugaccgaggagcugaaggucggcaagcucggcaagcagaccuacccggugaagcccaucccccgcuggcacgagcaccggcaggggcugagcccccuggaguccuucggcaucuacgggcucaucuucuuccagcgcccgauguacuggcccaagagcguggucggccugugcgagcuggagcccaaggagcggcgcugccagcgguccgaccgccggcagcagcgcuuccggcuccugcaggaggugaacaaccugaaguacguggaccccgacacccaccucgagcagaagcuggacgacaagcagcgccggcugcuccuggacaagcugagccacacgaaggagaugaccuucgaccagauccgcaaggcccucgacuuccuggaguccgucaaguucaaccuggagcggggcgagcgcagccggcucaagggggugccgaucgacgcccuguucgcggccaaggacgugcugggccaggagugguacgaccgccccgagcagcagaagaccgagaucgucgccgugcuccuggacaacgagcgggacgacgaccgcaucaucgcccgcgccgucgcggagugggggaugaccgccaaggaggccgaggccaugcugggcguggaccuccccgccggguacgcgaaccuguccugcaaggccaucgagaagcugcugccccacauggagcggggccuccuguacauggacgacgacgagagcaacuccgccaugcacgccgccggcuaccugcgccgggaccagcuccgccggcgcaucuucgacgugcugccggaccccgcgcggacgcccaacugccccaucggggacaucccgaaccccgucgugaagcgcacccugaccgagauccggaagguggucaacgccaucgugcgcgaguacggcaagcccgacgccauccaccucgagcuggcccggagcgugcagauggggaaggagaagcgcagcgaguacuccaagaugauccgggaccgcgaggcggagcgggacggcaucgucgagaagcugcgcgagagcggggugcgggugacccgcgacaacauccucaaguaccagcugugggagcagcagaaccaggagugcaucuacuccggcaagcccaucagcuucgagaagcuguucggcgagggcggcggggucgagguggaccacauccucccgcggucccgcagccuggacgacucccaggccaacaagaucgugugccugcggacggccaacgccgggaagggggaccagacccccuacgaguggcucgccgacacccagcccaagcaguacgagcaggucugccagcgcgcgggcaugcugaugcgcagcggccggaugccguacgccaaguaccgccgguucauccagcgcgagcuggagcucgacaaguucaucgcccggcagcuggccgacaccggguacaucacgaaggccaccauggaguaccugcgcuaccucuucgacaaggaccacgacgugcugggccugaaggggcagcucaccgcggagcugcgguaccacuggggccuggagaccauccucgaggagcugcccgacucccccgccuggcacgaggccgacagcggcaagcugcgccccggggagaagaaccgggccgaccaccgccaccacgccaucgacgcgguggucaucgcccucacgaaccggcgccggcuggugcagcuguccgacaucgugaagcgcggcggggcccgggcccacggcgagauccucgaggacccguggcccaacuuccgcgagaacgucgugcaggcgaucaagaagaccaacgugagccaccgggucgagcgcaagguggccgggaagcugcacgaggagacccuguacggccccacccggacgcccggcgagugggugcuccgcaagccggucaucgcccuguccgccaacgagguggagcgcauccgggacgccaccauccgccagaucguggucagcgcgcuggccgacgccgggaucgacgugggccgggggaagaagcccgacgccaagaagaugaaggaggcccucuccaagcugaagaugcccagcggcgugcccauccgcaagguccggcugaccaagccggagcagaccauccagcccgugcgcgcggggcggcccgaccaggccuucgugaagcccggcuccacgcaccaccucugcaucuucgaguucaccgagaacggcaagaccaagcgcgacgccgucuucgugaccaugcuggaggccaugaaccggcugaagcgccgggagccggugauccagcgcacgcaccccgagcggcccgacagccgcuucgucaugucccucagcgcccgggagaugcugcuggcgaacuggaaggacggggagcgccuccugaccuucaagaccgccagcuccacccagggccagaucugguucgccgagcacacggacgcccgcaagagcgcggacuacaagcaguucguggccaacgccaacacccuggacgccaagaaggugaccgucgacccccucgggcggauccggugggccaacgacuga

SEQ ID NO: 1514 - RNA, 3204 nt, Artificial Sequence
  Cas9 variant
augggcacccgccuggggcucgacaucggcaccaacagcaucggguggugccuguucaaccuggacggcuccgggcggcccaucggcauccgcgacaucggcgugcggaucuucagcgacgggcgcgacccgcgguccggcgccagccucgccgucgagcgccggguggcgcgcgccaugcggcgccggcgcgaccgguacauccgccggcgcuccgcccugcuggaggcccucaucaacacggggcugaugcccgccgacgugcaggagagcaaggcgcugaccggcugcgaccccuacguccuccgggcccaggcccuggaccgcgcccuggacgcgcaccuccuggggcgggugcuguuccaccucaaccagcgccggggcuucaaguccaaccgcaaggccgagcgcaaggccggcgacgacaaggagggcgggaagaucgccgacggggccaaggcgcuggaccuggccaugcacgaggccggcgcccggaccuacggcgaguuccucgccgggcgcgacagccggcgcgugcggcugcgcgcggagggcgacggguacgacuucuaccccgagcggcgccaccuggaggccgaguucgacgccaucugggacgcccaggccgcguacaacccggcccuccugaccgacgucgugcgggaccgccugcggcgcaucaucuucuuccagcggccccucaaggcccccaaggugggcgggugcacguucuucaacgaggagccccgccugccgaaggcccacccccuguuccaggagcggcgccucuacgaggaggucaaccagcuggagaucacccgggccggcgcgcccucccgcaagcugacccucgaccagcgggacaagaucauccgcaagcucaagagcgccaagaccgccuccuucagcggccuggcccgccugcugaagcuggcggacggggaguccuucagccgggugacggagaaccgcaccggccucgccggggacgacaucuucaccuccuucagcgacaagcggugcuucggcgaccgcugggcccacuucgaccccggggugcagugguccaucaucgagaccgucacggaggaggaggacccggugcggcugcgcgacuggcugauggccacccacggcgugaccgucgagcaggccgaggcgaucggccgggugcgccuccccgaggggcacggccggcugggggagaccgccagccgccugauccucgcccagcugaaguccggcagcaaggacgggcacccccugacguacaacgaggccguggaggccgcgcucggcaagagccacuccgacuuccggaccggcgagauccuggagcagcugcccuacuacggggagauccucagccgcgagaucccgcccggcucccuggaccccgacgacgacgacgagauccggugggggaagaucaccaaccccaccguccacaucggccugaaccagcugcgccggcuccugaacgcccugaucaaggcccacggccgcccggacgagaucgugguggagcucgcccgggagcugaagcugagcgagaaggacaaggccgagcacaaccgccggaucggggcgaacacgcgcgccgccgaggcccgguccaagaagcuccuggagagcggccagcccgacaccggggcgaaccgcucccugcucaagcugugggaggaccugaaccccaacaacccccucgaccgcugcugcccguucugcggccggcacaucgggcagauggcccuguucagcggcgagaccgagaucgagcacaucauccccuacucccgcagccuggacgacuccgccgccaacaaggucaucgcccaccggagcugcaaccgcgagaagggcaaccggacccccugggaggcgugggggcacacggagcgcugggccaucaucgccgagcaggucucccggcuccacaagagcaagcaguggcgcuucgcccccgacgccaucgagcgguucaaccaggagggcggguucaucgcgcgccagcuguccgacacccaguaccugagccggauggcccgcaccuaccucuccagccuguacccggacaccgccggcguguacgugauccccgggcggaugacggccaugcugcgccggcucuggggccugaacgagcugcuccccgaccacaacuacguggagaacccgcacuccggcgcccccaagaaccgccuggaccaccggcaccacgcgaucgacgccgccgucgugggggugaccacccgcggccugcucaacgagaucagccgggccgcggggcgcgccgagcgccaggaccuggaccggcuguucaucgaccuccccaagcccugggagaccuuccgcgaggaccugcacgagagccuggcccgggucgugggcucccacaaggccgaccacgggcgcaagggcgugccggccaagggcaaggacgcgacggccgcccggcuccacaacgagaccgccuacgggcugaccggccugaccagcgaguccgggcuccccaucgucgugcaccgcgugccccugcugagccucaagcccgacgaccuguccaacccgauccggauccccgacgccgcgcugcagcgcgcccuccgggaggccacggacggcaagagcgggaaggacuuccaggaggcccuggcccaguucuccaagagcgaccccgucuucaagggcauccgccacgugcgggugcgcgagacccugaaggucauccccauccgggacgcguccggccacgccuucaaggccuacaagggggacgccaacgcccgcuacgacguguggcggaugccggacggcaagugggugagcuccuggcgcgaccgggacgggaaggcgcacagcggcaucaucaccauguucgccgcccaccaggccggccagcccguccagcgcccccaccccgcggccaagcgggugcucucccugcgccagaacgaccugguggccgucgagccgcaggggcagccccggaagaucaugcgcguggugaaguucagcuccggcgggcagaucaccuucgccgagcaccaggaggccggcccccucaaggcgcgcgacgccaccagccccgacaucgacccguucaaguacuucuacuccagcgccgggggccugcagaaggcccgggcccgccagauccggaucgacgagcugggccgcaucuucgaccccgggccccgguga

SEQ ID NO: 1515 - RNA, 3207 nt, Artificial Sequence
  Cas9 variant
augaaguacgugcugggccucgacaucgggaucgccagcugcggcugggccgucaucaaccaggagaagcaccgcaucgaggaccugggggugcggaucuucgacaaggcggagaaccccaaggacggcaagucccuggccaccccgcgccgggacgcccgcagcacccggcgcacgcuccggcgcaagaagcaccggaugcagcgcaucaagauccugcuggugaagcacgggcuccuguccaagaccgagaucgaccaccuguacgagagcgccaccgagaucgacgucugguaccuccggcugaacgcccuggagcgccggcucaaccccaaggaguucgcgcgcgugcugauccaccuguccaagcggcgcggcuucaagagcaaccggaaggagaccacgcucuccgagaacggccagauccuggagaacaucagcgagaaccugcagaucauggagcagaagaacuaccgcaccgugggggagaugauccucaaggacaagcgguucgagaaccacaagcgcaacaaggacggcaccuacaucgggaccgucacgcggcagcagcugcaggaggagauccagaugaucuucaacgcccagcgccuguacaagaacaaccacgccaccgagaaguucgaguccagcuaccucgagaucugggccucccagcgccccuacgcgagcaaggaccagaucgagaagaugaucggcuacugcacccuggagcccaaggagaagcgggugccgaaggccuccuggagcuuccaguacuucguggcccugcagaccaucaacaaccuccgccugaucuccaaggaccggaucgaggagcugagcuucgaggagaagaagcgcaucaugaaccucgcccuggagaaguccaucgucaaguacaucgacauccggaagcugcucagcgugcccaaggaguuccaguucaacucccugagcuacagcgccgacaucguggacacgaccgucgagaacaagaagugcaucgagcugaaggaguaccacuccaucaacaagguguacaagcagaucuacgggcagaacgcgcucaaccugcugcccaaggacuacgacaccaucgccuacggccucaccaucuucaaggacgacaaggacauccaggaguaccugcagaacaaguacgugaacgccaagggcaagcccaucagcaaccuggccaacaagacguacgacgacaccuucauccagguccuccugacccugaacuucuccaagauggggcaccucagcuucaaggcccugaagaacaucaucccguuccuggaggagggccucuccuacgacaaggcgugcgagaaggccggguacaacuucaagggcaccagcuacacgaagaagaccaaguaccugcccgugaucccccagaacaccaaccccgugguccaccgcgcccugucccagacccggaaggugaucaacgccaucaucaagaaguacggcagcccgaacgccauccacaucgagacggcgcgcgagcucuccaagaccuuccaggagcggaaggagaucgacagcauguaccaggacaacuccaagaagaacgagcacgccaucugcaagcugaaggagcuggggaacaucaaccccagcggcaucaacaucgugaaguucaagcuguggaacgagcaggacgggcgcugcauguacaccggcaaguacaucgagccccaccgccucuucgaggagggguacaccgaggucgaccacauccugcccuacucccggagccuggacgacuccuacaacaacaaggugcucacgcugggcaccgagaaccagcggaagggcaacaagaccccguacgaguacaugcgcaacaacagcaucugggacgaguucgagacccgggugcaguccaacaagaagaucaacaagaagaagcagcagaagcugcuccugcagaacuucagccacgcccgcgagcaggaguucaucgagcggaaccugaacgacacgcgcuacgccaccaucuaccucuccagccugauccagcagcaccugaucuucagcgaguccagccgggagaagaagguccacaccguguccgggaucaucaccagccaccuccgcucccgcuggggcuucaacaaggaccggaaggaggggcacauccaccacgcccuggacgcggucaucguggccgugacgagcgaccacaugauccagcgcgucaccaaguacuacaagcugaaggagcucaaccggaaccgccaggccaagcggaugcaguuccccgagcccugggagggcuuccgccuggagcuggaggcccggaucucccccaacacccagcaguaccucaaggggauccgcuucaagaacuacgcggacgugaaccugagcgagaucaagccgaucuucgugucccggaugcccaagcgcagcaucaccggcgagcugcaccaggagaccauccggaaguuccucggcuacaacgagaaggggaagguccugacggccaccaagaccaagcuggaggacauccccuucgacgccaacggcgacuuccccauguucgggaaggagaccgaccucuacacguacaacgccaucaaggagcgcuaccugucccacaagaaggacaagagcaaguccuuccaggagccgcuguacaagcccaccaagagcggcgggaucggcccccucaucaaguccaucaagaucauggacacccggaccaucgugaaccccgugaaccagggcaagggggucguguacaacagcaagaucgcccgcacggacguguucaagaagggcgagaaguacuaccugaucccgaucuacaccaucgaccugaugaagaacacccucccccagaaggcgaucaccgccgggaagggcuacgaggacuggacgaccaucgaccccuccuucaccuuccuguucagccuguucccgaacgaccucauccagaucguccccagcaagaacaagaccaucaaggcccggacgaccguguccaagaaggaggugcugcugcccagccucaccggcuacuucaaggggguccacuccggcaccgccgggaucacgguggagacccacgacggcagcaucaucgccaacgugggguccaagcagcugcugagcuucgagaaguaccaggucgacgugcucggccacuacaccaagaucaagaaggagaagcgcaucggcauggcgaucuga

SEQ ID NO: 1516 - RNA, 3207 nt, Artificial Sequence
  Cas9 variant
augaacaaggccguggccuaccgccuggcgcucgaccugggcagcaccucccuggggugggccaucuuccggcucaacgaggcccgcgagcccaccgccaucauccgggccggcguccgcaucuucagcgacgggcggaacgcgaacuccgagccgcuggccgugcaccgccggguggcccgcgccaugcggcgccggcgcgaccggcugcucaagcgcaagaagcggaugcacgaccagcugguccagcacggcuucuuccccgcggagguggccgagcgcaaggagcuggagcggcucaaccccuaccagcugcgcgccaaggggcugcacgaggcccucacgcccggcgaguucgcccgggcgcuguuccacaucaaccagcgccggggcuucaagagcaaccgcaagaccgaccgcaaggacaacgacuccggggcccugaagcaggccaucagcgagcuccggaagcgcauccaggacuccgacugcgccaccgccggcgagugguucuggaaggagcggaugcagcagaagccggagggggugcgcggccaguggguccgggcgcgcuaccggaagacccccagcacgaccgacgaggggaagaagcgcaucggcuacgaccuguacguggaccgggccaugguggagcaggaguucgacgcccugugggccgcccaggcggcccuccagcccggccuguucaccgaggccgcccgcgccgagcugaaggacacccuccuguaccagcgggaccugcgccccgucaagccggggcggugcacgcuccugcccgcggaggagcgcgcgccccuggcccuccccuccacccagcgguuccgcauccugcaggaggugaacaaccugcggcuccuggacgaggcccugcgcgaggugccgcucaaccuggcccagcgggacgccgucgugagcgcccuggagggcaagaaggagcucuccuucgccgccauccgcaagcugcugacccucagcgggaaguucaaccuggaggacgagaagcgcgcggagcugaagggcaacgccaccuccgugauccucgcccggaaggaccuguucggcgacgccugggccggguucgacgcggccguccaggacgagaucguguggcgccuggugagccaggaguccgagggcgcccucaucgccuggcugcagcagcacacgggggucgacggcgugugcgccgaggcgaucgugaacacccggcugcccgacggguacggccgccucagccggaaggcccuggagcgcaucguccccgcccugcagcgggaggugugcaccuacgacaaggccgugcaggcggccggcuucgcccaccacuccgaccugggguucgacuucgacuacgccgaggacgagguccagcaggucggcgagcacaccaucgccagcacgggggaggugcaggcgcaguacgccuucaagcagcuccccuacuacggcaaggcccugcagcgccacguggccuucggguccggcgacgccaaggaccacgaggagaagugcuacggcaagaucgcgaacccgaccgugcacaucgggcugaaccagguccggaccguggugaacgcccucauccgccgguacggccaccccaccgaggucgugguggagcuggcccgcgaccugaagcagagccgggagcagaagcagcagacgcagcgcgagcaggccgacaaccagaagcggaacgaggacauccgcaagcggaucgcccccauccucgagaccagccccgagcgcguccgggaccgcgacaucaagaaguggauccugugggaggagcugaacaagaaggacaucgcggaccggcacugcccguacuccggggagcgcaucagcgccaccaugcuccuguccgaggccguggagaucgagcacauccugcccuucagccgcacccucgacgacucccugaacaaccggacgguggccaugcgccgggcgaaccgcaucaagggcgaccggacccccugggaggcccgcgccgacuucgaggcccagggguggcgguacgaggccauccugcagcgcgcggagggcaugcccccgcggaagcgcuaccgguucgccgaggacggcuaccagcgcuggcucgggaaggaccggaacuuccuggcccgcgcccugaacgacaccagcuaccucucccggcuggccgcgaacuaccugcgccucgucugcccccagggcgugcgggugauccccgggcagaugaccgacaagcugcgcggcaaguucggccugaacagcguccucgggcuggacggcaagaagaaccggaacgaccaccgccaccacgccguggacgccugcgugaucggggucacggaccagggccugaugcagcgcuucgccaacgccuccaagcaggcgcgggagaacgggcucacccgccuggugcaggacaugcugcuccccugguggccgagcuacuacgaccacguggagcgggccguccgccacauccgggugucccaccgccccgaccacggcuucgagggcgccaugaugaaggggaccgcccacggcauccgggaggacgggauccgcgaggacggccggaucaagcagcgccccaaggccaaggggagcgcggaccacaagaccaucacgcugaucccgaucgacgagccccggcagcuggcccgccacggcguggacgccgagggcaagccccuccccuacaagggguacgccuccggcagcaacuacugcaucgagaucaccaagaacgggaagggcaagugggaggggcaggucaucuccaccuucgacgcguaccggaucaaggccgccgccgacgccgcggcccgcgccggccaggugaucagcaccguggaggccgacuccaucguccgcaagagcggcugggagcggcugcgcggggcccagucccagaacggccagccgcuggugaugcggcucgugaucggggacagcguccggauggagguggacggccgcgacgaggugaugcgggucgugaagaugagcgggaaggagaugguguucgcgcccguccgcgaggccaacguggacaagcgcaacaacaugcccgacgagcaggaccccuucacguacaccuacaagcgggccgaccagcugcgcaaggccaaggcccgccaggugaccaucuccccgaucggcgagcugcgggaccccggcuucaagggguga

SEQ ID NO: 1517 - RNA, 3207 nt, Artificial Sequence
  Cas9 variant
augcaguacgugcugggccucgacaucgggaucgccagcugcggcugggccgucaucaaccaggagaaggagcgcaucgaggaccugggggugcggaucuucgacaaggcggagaaccccaaggacggcaagucccuggccgccccgcgccgggacgcccgcagcacccggcgcacccuccggcgcaagaagcaccggaugcugcgcaucaagauccugcucgugaagcaggggcugcuguccaagaacgagcucaaccaccuguacgagagcacgaccgaggucgacguguggaaccugcggcucgacgcccuggagcgcaagcugaaccccaaggaguucacccgggugcucauccaccuggcgaagcgccggggcuucaaguccaaccgcaaggagaccacgcugagcgagaacggccagauccucgaguccaucagcgagaaccagcagaucauggagcagcagaacuaccggaccgucggggagaugauccugaaggacaagaaguucgagaaccacaagcgcaacaaggacggcaccuacaucgggaccgugacgcggcagcagcugcaggaggagauccagaugaucuucaccgcccagcgccucuacaagaacgacuacgccaccgaggaguucgagaucuccuaccuggagaucugggccagccagcggcccuacgcguccaaggaccagaucgagaagaugaucggcuacugcacccuggagcccaaggagaagcgcgugccgaaggccagcugguccuuccaguacuucgucgcccuccagacgaucaacaaccugcgccugaucagcaaggaccggaucgaggagcucuccuucaaggagaagaagcagaucaugaaccuggcccuggagaaguccaucgugaaguacaucgacauccgcaagcuccugagcauccccaacgaguuccaguucaacagccuguccuacagcgccgacaccguggacaccacccucgagaacaagcggugcaucgagcugaaggaguacuacagcaucaacaaggucuacaagcagaucuacgagaagaacgcgcugaaccuccugcccaucgacuacgacacgaucgccuacgggcugaccaucuucaaggacgacaaggacauccucgaguaccugcagaacaaguacgugaacgccaagggcaagcccaucaacaaccuggccaagaagaccuacgacuacaccuucauccaggcccuccugacgcugaacuucaccaagaugggccaccucuccuucaaggcgcugaagaacaucaucccguuccuggaggaggggcucagcuacgacaaggccugcgagaaggccggcuacaacuucaaggggaccuccuacaccgagaagacgaaguaccugcccgugaucccccagaacaccaaccccgucgugcaccgcgcccugagccagacccggaaggugaucaacgccaucaucaagaaguacggcuccccgaacgcgauccacaucgagaccgcccgcgagcugagcaagacguuccaggagcggaaggagaucgacuccauguaccaggacaacagcaagaagaacgagcacgccauccacaagcucaaggagcugggcaacaucaaccccuccgggaucaacaucgucaaguucaagcuguggaacgagcaggacggccgcugcauguacagcgggaaguacaucgagccccaccgccucuucgaggagggcuacaccgagguggaccacauccugcccuacucccggagccuggacgacuccuacaacaacaagacccucacccuggggacggagaaccagcggaagggcaacaagaccccguacgaguacaugggcaacaccagcaucuggaacgacuucgagacccgcgugcacuccaacaagaagaucaacaagaagaagcagcagaagcugcuccugcagcacuucagcuacgcccgggagcaggaguucaucgagcgcaaccugaacgacacgcgguacgccaccaucuaccucuccagccugauccagcagcaccugaucuucuccgagagcagccgcaagaagaagguccacaccguguccgggaucaucaccagccaccuccggucccgcuggggcuucaacaaggaccggaaggaggggcacauccaccacgcgcuggacgccgugaucgucgccgugaccagcgaccacaugauccagcgcgucacgaaguacuacaagcugaaggagcucaaccgcaaccugcaggccaagcggaugcccuuccccgagcccugggagggcuuccgccuggagcucgaggcgcggaucuccccgaacacccagcaguaccugaagggguuccgcuucaagaacuacgccgacgugaaccugagcgagaucaagcccaucuucgugucccggaugcccaagcgcagcaucaccggcgagcuccaccaggagaccauccggaaguucaucggcuacaacgagaaggggaagguccugacggccaucaagaccaagcuggaggacauccccuucgacgccaacggcgacuucccgauguacgggaaggagaccgaccucuacaccuacaacgccaucaaggagcgcuuccugucccacaagaaggacaagcgcaagagcuuccaggagccccuguacaagcccacgaaguccggcgggaucggcccccucaucaagagcaucaagaucaucgacacccggaccaucgugaacccggugaaccagggcaagggggucguguacaacuccaagaucgcgcggaccgacguguucaagaaggacgagaaguacuaccugauccccaucuacacgaucgaccugaugaagaacauccucccccagaaggccaucaccgccggcaagggguacgaggacuggaccaccaucgacccgagcuucacguuccuguucucccuguuccccaacgaccucauccagaucguccccagcaagaacaagaccaucaaggcccgcaccaccguguccaagaaggaggugcugcugcccagccucacgggcuacuucaagggcguccacagcgggaccgccggcaucaccguggagacccacgacggguccgugaucgcgaacgucggcagcaagcagcugcugcucaucgagaaguaccagguggacauccuggggcacuacacgaagaucaaggaggagaagcggaucggcauggccaucuga

SEQ ID NO: 1518 - RNA, 3207 nt, Artificial Sequence
  Cas9 variant
augcccaagagcgccaagccgcagcaggccuacacccugggccucgacaucgggaucgcguccgugggcgccgcccugcuggggcagcagcacaucaucggccuccacguccgcaccuucgaccgggccgagacggccaaggagggggagccccugaacaagauccgccgggacgcgcgccugacccggcgccggcuccagcgccgggcccaccgccugcugcggcuccgccggcuguucaagcgccacaaccugauccccgacaccgacaccagcacguucaucuccggccagagccccugggagcuccgggcccagggccuggaccgccagcugaccuccgccgaguggaccaccgugcucuaccacaucgugaagcaccggggguuccacagcaaccgcaaguccgaggucaagacggacgagaaggcgggccagaugcugagcggggugaaccagaaccaggcccugcucaagcaguccggccugcggaccaugggggagcuggccgcccgccacgaggccuuccgggaggcgaagcgcaacaagaagggcgccuacaaccacaccuucagccgccacgaccucgaggacgagcugcaccuccuguucucccggcagcgcgagcugggcaacccguacgccacccccgagcuggaggacgccgugcacacgcuccugaugcagcggcgccccgcccugagcgggaccaaccuccugaagauggucggccacugcacccuggagcccgacgaguuccgggcgccgaaggccuccuacaccgccgagcgcuucaucuggcucacgaagcugaacaaccugcgggugagcggguccggcgagacccgcccccucaacgagagcgagcggcaggcccugcuguccaagcccuucagccaguccaagcucaccuacaagcagguccgcaagauccuggagcugcccgacaacauccgguucgugggccuccacuaccacccggcccaggacaacggcaagagccccgagaaccgcguguucuucgaggcgaaggccuuccacgcccugcggaacguguacaagaaggccgggcugaaccucgaguggcagcgcgacagccagaaccccgagaagcuggacaacaucaccuacgcccugacggucuucaaggaggacaaggaggcgaagcaguggcucaucgagaaggggguggaggccuccgugaucgaggccguccugaacgagagcuucuccgaguucgugcggcugagcaucaaggcccugcgcaagaucaucccccacauggagaucggccaccgguacgacgaggcggugaagcucgccggguacucccaccacagccaccucccgcagcccuccaagacccccuacaucccccgcuucagcaagcaguccaucgccaacccggucgugagccgggcccugaaccaggcccgcaagcuggugaacgcgaucguccgcgaguacggcccgcccgacgccgugcacaucgagcuggcccgggaccugaacaagcccuucgacgagcgccggaagaucgagaaggaccaggagaaguaccagaaggacaaggcccgcgacaucgagaccuuccaggagaacuucggcuucacccccaaggggcuccagcugacgaaguggcggcuguaccgcgagcaguccggcaagugcgccuacagccucaagccccuggacaucaaccggcuguucgaggacggguacguggagaucgaccacgcgcuccccuacucccgcagcuucaacgacggcaugaacaacaagguccugacccugaccaccgagaaccggaacaaggggaaccagacgcccuacgaguaccucgacggcgccuccaacagcgcccaguggcgcaacuucguggccugggucaacuccaacaagagcuaccgggccuccaagcagcgcaaccugcugcggaaggacuucgcggcccaggccgccaccgaguuccgcgagcggcaccucaccgacacccgcuacaucgcgcgggaguucaagcgcaugguggagacgcaccugaagcugaacaagccgaaccagcggugcguggucgugagcggccagcucaccgccuaccugcgcgcccggugggggcugaucaaggugcgcgagaacggcgaccuccaccacgcccuggacgccgcggucguggccgccugcagccacgccauggugaagcgccuggccgacuacucccggcgcggggagcuccaguacgcgcggggccaccacuucgaccccgagaccggggagaucaucgacaucaacgcccugcgcaagcuggacgaccacuucccccagccguggaccgacuuccggcgcgagcuccuggccuggcugagccccgaccccgcccagcagcucaagaaccuggccuacuacacggacgagcggcugaagcaggucaagcccauccgcgugucccgggcgccgacccgccggggccucggcgccgcccaccaggagaccauccgcagcgccaaguaccugggggagaaccgguccaccgugaagacgccccuggagaagcucaagcugaaggacauccccaacaucgucggcuacgaggacccccgcaaccaccagcugauccaggcgaucagccagcggcucaccgagcacggggacgacggcaagaaggccuucaaggagccgcuguacaagcccggcaacaacaaguccaccgcccccguggugcgcagcgucaagcuguucaccgugcagaaguccgggauccccgugcggggcgggaucgccaacaacggcaacaugguccgcguggacaucuucaccaagaaggagcgguacuucgccgugccggucuacgugagcgacgcggcccgcaacgagcuccccaacaaggccguggcccgcgggaaggacggcuggaucgacaucgacgacuccuucagcuuccuguucucccuguaccccaacgacugggucagcgugguggucaagccccacgaggccccgugcgagggcuacuacgcggggcucgacaucuccacgggcgccauccacaucugggcccacgaccggaaccgcagcguggggaagaacggccugaugcgguccaucgggaucaagaccgcccacagcguggagaaguaccacgucgaccugcucggcaaccuguaccgcguggugcacgagacccggaagccccugcgcgccggcaaguga

SEQ ID NO: 1519 - RNA, 3207 nt, Artificial Sequence
  Cas9 variant
augcaguacgugcugggccucgacaucgggaucgccagcugcggcugggccgucaucaaccaggagaaggagcgcaucgaggaccugggggugcggaucuucgacaaggcggagaaccccaaggacggcaaguccauggccaccccgcgccgggacgcccgcagcacccggcgcacgcugcggcgcaagaagcaccggaugcagcgcaucaagaucauccucgugaagcaggggcugcuguccaagaccgagcucgaccaccuguacgagagcgccaccgaggucgacguguggaaccugcggcucgacgcccuggagcgcaagcugaaccccaaggaguucacccgggugcucauccaccuggcgaagcgccggggcuucaaguccaaccgcaaggagacgacccugagcgagaacggccagauccucgaguccaucagcgagaaccagcagaucauggggcagaagaacuaccggaccgucggcgagaugauccugcaggacaagaaguucgagucccacaagcgcaacaaggacgggaccuacaucggcacggugacccggcagcagcugcaggacgagauccagaugaucuucaacgcccagcgccucuacaagaacaacuacgccaccgccgaguucgagaacagcuaccuggagaucugggcgucccagcggcccuacgccagcaaggaccagaucgagaagaugaucggguacugcacccuggagcagaaggagaagcgcgcccccaaggccuccuggagcuuccaguacuucguggcccuccagacgaucaacaaccugcgccugaucuccaaggaccggaucgaggagcucagcuucgaggagaagaagcagaucaugaaccuggcgcuggagaaguccaucgucaaguacaucgacauccgcaagcuccugagcgugccgaacgaguuccaguucaacucccugagcuacagcgccgacaccguggacaucaccgucgagucccggaagugcaucgagcucaaggaguaccacagcaucaacaagguguacaagcagaucuacgagaagaacgcccugaaccugcuccccaaggacuacgacaccaucgccuacggccugacgaucuucaaggacgacaaggacauccuggaguaccuccagaacaaguacgugaacgccaagggcaagcccaucuccaacuucgcgaacaagaccuacgacgacaccuucauccaggcccugcugaaccucaacuucaccaagauggggcaccugagcuucaaggcccugaagaacaucauccccuuccucgaggagggccuguccuacgacaaggccugcgagaaggccggguacaacuucaagggcacgagcuacaccgagaagaccaaguaccugccggucaucccccagaacaccaaccccguggugcaccgcgcgcucucccagacgcggaaggucaucaacgccaucaucaagaaguacggcagccccaacgccauccacaucgagaccgcccgcgagcuguccaagaccuuccaggagcggaaggagaucgacagcauguaccaggacaacuccaagaagaacgagcacgccaucugcaagcugaaggagcucgggaacaucaacccgagcggcaucaacaucgugaaguucaagcuguggaacgagcaggacgggcgcugcauguacuccggcaaguacaucgagccccaccggcuguucgaggagggguacaccgagguggaccacauccugcccuacagccgcucccucgacgacagcuacaacaacaagacgcugacccugggcaccgagaaccagcggaagggcaacaagacccccuacgaguacauggggaacacguccaucuggaacgacuucgagacccgcguccagagcaacaagaagaucaccaagaagaagcagcagaagcuccugcugcagcacuucuccuacgcgcgggagcaggaguucaucgagcgcaaccucaacgacacccgguacgccacgaucuaccugagcagccugauccagcagcaccucaucuucuccgagagcucccgcaagaagaaggugcacaccgugagcggcaucaucaccucccaccuccggagccgcuggggguucaacaaggaccggaaggagggccacauccaccacgcccuggacgccgucaucguggcggucaccuccgaccacaugauccagcgcgugaccaaguacuacaagcugaaggagcugaaccgcaaccugcaggccaagcggaugccguuccccgagcccugggagggguuccgccucgagcuggaggcccggaucagccccaacacgcagcaguaccugaagggcuuccgcuucaagaacuacgccgacgugaaccucuccgagaucaagccgaucuucgucagccggaugcccaagcgcuccaucaccggcgagcugcaccaggagaccauccggaaguucaucggguacaacgagaagggcaaggugcugaccgccaucaagacgaagcucgaggacauccccuucgacgcgaacggggacuuccccauguacggcaaggagaccgaccuguacaccuacaacgccaucaaggagcgcuuccugagccacaagaaggacaagcggaaguccuuccaggagccgcucuacaagcccaccaagagcgggggcaucggcccccugaucaaguccaucaagaucaucgacacgcgcaccaucgugaaccccgucaaccaggggaagggcgugguguacaacagcaagaucgcccggaccgacgucuucaagaaggacgagaaguacuaccugaucccgaucuacaccaucgaccucaugaagaacauccugccccagaaggccaucacggccgggaagggcuacgaggacuggaccaccaucgaccccuccuucaccuuccuguucagccucuucccgaacgaccugauccagaucgugcccagcaagaacaagacgaucaaggcgcgcaccaccguguccaagaaggagguccugcuccccagccugaccggcuacuucaagggggugcacuccggcacggccgggaucaccguggagacccacgacggcagcgucaucgccaacgugggguccaagcagcugcuccuguucgagaaguaccagguggacguccugggccacuacaccaagaucaaggaggagaagcggaucggcauggccaucuga

SEQ ID NO: 1520 - RNA, 3210 nt, Artificial Sequence
  Cas9 variant
augaagaagcagccccagcgcuacauccugggccucgaccuggggaucgccagcgugggcugggcccugauccucgucgacggggcggagaacccggugggccugcuggacugcggggugcggaccuucgagcgcgccgagguccccaagaccggcgacucccucgcccuggcccggcgccaggcccggagcgugcgccggcugauccgccggcgcgcgcaccggcuccugcgccugcggcgccuccugaagcgggagggcauccuguccgccgccgacuucaacagcgacgggcuccccaaccugcccaucgacgccuggcagcugcgcguggcgggccucgagcggaagcugacgaaccaggagugggccgccguccugcuccaccuggugaagcaccgcggguaccugucccagcgcaagagcgagacccagaccgagaacaaggagcucggccggcugcuggccgggguggccgagaacuccaagcuccugagcgaguccagcgagcaguaccggaccccggcggagcuggccgucaagcuguucgccgagcaguccggccgccugcgcaacaagggcggggacuacacgcacaccuucaaccggcuggaccuccagaaggagcugcaccuccucuucgagcgccagugcgcccugggcaaccccuucgccagcgcggagcugcaguccaagguggacgagcuccugaugacccagcggagcgcccugcagggggaggccgugcucaagaugcugggcaagugcaccuucgagcccuccgaguacaaggccgccaagaacacguacagcgcggagcgcuucaucuggcugaccaagcucaacaaccugcggauccuguacaacggcgaggaccgcgcccucgacgagggggagcggaagcagcugcuggacgagcccuacaagaaggccaagcugaccuacaagcagguccgcuccauccucaaccugccggagagcgccguguucaagggccugcgguacgggaaggacuccgacggccucaaggccgagaacggggcgcugauggagaugaaggccuaccacaagauccgcaccgugcuggagaaggccggccucaagggcgagugggagaaccggauccgcaaccccgagauccuggaccagaucgggacggccuucagcgucuacaagaccgacgaggacaucaaggcggagcuggccgcccuccggcugcccgagaacgugcuggacgcccuccuggccggccugaacuucgacaaguucauccagcucagccugaaggcgcuguccaacauccucccccugauggagcgcgggauccgguacgacgaggccugcaaggagguguacggcgaccaccgcgcccuggccgagagcaagaaccagaugcuccugccgcagauccccgccaacgagauccggaaccccgucgugcugcgcacccucacccaggcgcggaaggugaucaacgccaucauccgccgcuacgggagcccccagcggguccacaucgagacggcccgcgagcugggcaagagcuucaaggaccggaaggagaucgagaagcgccaggaggagaaccggaaggagcgcgagcgggccgccgagcacuucaaggagcuguucccgcgcuucaccggcgagcccaaguccggggacauccucaagcugcggcuguaccagcagcagcagggcaagugccucuacagcgggauccccaucgaccugggccgccugaacgagaagggguacguggagaucgaccacgcgcuccccuucucccggaccugggacgacagcuucaacaacaaggugcugguccugggcuccgagaaccagaagaagcgcaaccagaccccguacgaguaccucgacggcgcccgggacagccagcgcuggcgggaguuccaggcccgcgugcaggggugccgguuccccuacgccaagaagcagcgcauccagacggcgaagcuggacuccaagaccgagcagggcuuccuggagcggaaccucaacgacacccgcuacaucgcccgguuccugugcggguucaucgagaagucccugcaccuccagggcgccggcaagcgccgcgucuucgccuccaacgggcagaucaccgcccugcugcggggccucugggggcugaagaaggugcgcgaggacaacgaccggcaccacgcgcuggacgccaucguggucgccugcagcacgguguccaugcagcagaagaucaccaaggccaugcagcgccgggagacccucgagaccaucaacacggagaccggcgaggugaagacccgcaucccccagcccugggacuucuuccggcaggaggucaugauccgcguguucagcgacgccccgcgggaggagcuggcggagaagcugaacucccgccccgaggcccuccacgacuucgugagcccccuguucgucucccgggcccccaaccgcaagaugaccgggcagggccaccuggagacggucaagagcgccaagcggcucagcgagaacaucuccguggugaagaagccgcugaccgcccugaagcucaaggacaucgagaacaucgugggcuaccccgaccgcgagcccgcgcuguaccgggcccugcaggagcgccuccaggccuacaaggacgacccggccaaggcguucgccgagcccuucuacaagcccgccaaggacgggggccaggggagccuggugaaggccguccggaucaucgagaacaccaagcacggccugaaggugcgcaacgggaucaccgacacgaacggcgacauggugcgggccgacgucuaccagaaggcggacaagaagggcaagcgccaguacuucaucgugcccguguacgccuggcaggucgagaagaacgagcucccgaccguggacugcaagggguacgagaucgacgacaccuacgaguucugcuucucccuguacaaguacgacaucaucgagauccagaaccccgacaacaugagcaaggagcugcgcguguacuacaucaacugcgacuccagcgacggccgguucuggcucgcccaccacgacaaguccgccaaggagcagcaguuccgcaucagcacccagaaccagcccaucaucaagaaguaccaggucgacccccuggggaaggagauccggcugugcaaggccgagaagcgcaccgagcucaacggcaagaagaagaaguga

SEQ ID NO: 1521 - RNA, 3210 nt, Artificial Sequence
  Cas9 variant
augaacuacgacaucggccugcgcaucgggaucaccagcugcggcugguccaucaucaacaaggaccucgagcggaucgaggaccugggggugcgcgucuucgagaaggccgagaaccccgacggcaccgccagcgcggccccgcggcgcgaggcccggaagucccgccggaagcaccgccggaagaagcaccgcaucgagcggaucaagcgccugaucgugcagcacgaccuccugagcaagaaggagcuggacucccucuaccugagccccuucaacaucgacguguggaaccugcgggucgaggcccucgagcgcaagcuggacaaccgggaguucgcccgcgugcugauccaccucgugcagcggcgcggguuccagacgauccggaaguccgucgagauccaggaggagggcaagcugcuggagaacgugagcgagaacgagcgcaucaugaaggugaacggcuacaagaccgucggggagauguucuccaagcacgagaaguucacccaccacaagcggaacaaggacggcagcuacaccuccguggugacgcgcagccuccugcugaaggagaucaagaccaucuucaacucccagcgcauccucgggaacgucuucagcacccagaagcuggaguccgacuaccuguacaucuggggcagccagcggcccacccucacguacgagcagcugauguccaugguggggaacugcaucuacgagaagaaggagaagcgcgcgcccaagaccagcugggccuuccaguacuucucccugcuccagaagaucaacaagcugaaggugagcgacgacaacacccugcggaagcucagcaaggaggagcgcgacaucgucaucgagcuggccuucaagaagaagaacguguccuucguggacauccggaaggcccugaagcucaacgacaacaccaaguucaaccaccugacguacagccacgucguggagaccaagaagguggagaaggcgaccuucaucgagcugaagggcuaccaccucaucaagaagcagcugaaggaccgcaacgucgagcugacccaggagcuccagccgaaggacuacgacgccaucgccgccgccuccacguucuucaagaacgacaucgaguuccgggacuaccugcgcaaccaguaccuggacagcaacggcaagcggaaguccaacaucgcgaacaagguguucgaggacaaggugaucgccgccgucuucgagcucaacuucagcaaggugugccaccuguccuucaagagccuguacaagcucaucccccaccuggagaaggggcuggacuacaaggaggccauccucugcgccggcuacaacuuccgcgacgagaacaagcgggacaagaagcuguuccugcccgucauccagcaggagaccaaccccguggugcaccgcgcgcucacccaggcccggaaggucaucaacgccaucauccgcgaguacggguccccgaacaccauccgguucgugguggccaacgaccuggccaagacguacaagcagcgcaaggagcuggagagcacccugaagaagaaccgggcggagaacgagaagaucaagaccaagcuccuguccaugggcaucaucaaccccaccggcauggacaucgucaaguacaagcugugguacgagcagagcgggaucugccucuacacgggccgccagauggagcuguccagccuguucaagcccggguacuccaucgugaaccacaucauccccuacaaccggagcuucgacgacaccuaccacaaccgcgugcucacccugaccgagacgaaguacgagaagggcaacaagaucccguucgaguacuucggggccgaggagaccugcuggaacgaguacgagaagcgcgucuccaccagcaagaagauccacgacaagaagcgggagaagcugcucauccgcaacuucgacaucgaguacgagaacgagaugaucuccaacaacguguucgacacccacuacaucggcagcuacuucgagaaguacaucgacgagcaccuccaguucaagaaguccacgaagaagcagaagguguucuccauccacggcaacauggucgcccaccuccacagccgguggggguucaacaagaacucccgcgagaucuaccugaaccacgccguggacgccgcgaucguggccguccugaccgaccagcugauccggaacaucgccgacuacuaccgccgggacaacauccuggagcagaagggcagccugaaguuccccgagcccuggaaguccuucagcaucgagcuggaggcccgcaucagcccccaggugcgggaccucaucaagaagcugaaccuggacagcuaccucgacguggacauccugcacaucaagccggucuucaucuccaagaagccccgccggaaggugaacggggaggcgcacaagagcaccauccgcucccugaucggcaucaacgagaucgggaagaccgugacgugcaucaagacccggcucgaggacauccccuucgacgagaacggcgacuuccccauguacggcaaggacaccgacaaguacaccuacaccgccaucaaggagcgcuaccuggaguucaacaaggacaaggagaaggccuucagcacgccgcuguacaagcucaagcggaacggggagcccggcaaccagaucaaguccgucaagaucaucgacacccgcaacaucgugaacaaggugaaccaggggaagggcaucgccuacaacagcaacaucauccgggucgacguguucucccgcgaccagaaguacuacgugguccccaucuaccugcgggacuucaucaaggggagccugcccaacaagaucaucaccgccgcgaagggcuucaugcaguggccggagaccgacaacuccuacacguuccucuucagcaucuuccccaacgaccugaucaagguggugcccaaggagggcaaguucaucaaggccaagaacgagaacaaggagaacaucaaccugaccgagauccucggguacuucaagggccuggacagcuccaccggggccuucacccuggagagccacgacggcucccuccuggcccgcggcaucgggacgaagaaccugcuccugaucgagaaguaccaggucgacgugcugggccgguacaacaagguggggaacgaggagcgccaggacaucaagauccagcagaacuga

SEQ ID NO: 1522 - RNA, 3210 nt, Artificial Sequence
  Cas9 variant
augaacuacgacaucggccugcgcaucgggaucaccagcugcggcugguccaucaucaacaaggaccucgagcggaucgaggaccugggggugcgcgucuucgagaaggccgagaaccccgacggcaccgccagcgcggccccgcggcgcgaggcccggaagucccgccggaagcaccgccggaagaagcaccgcaucgagcggaucaagcgccugaucgugcagcacgaccuccugagcaagaaggagcuggacucccucuaccugagccccuucaacaucgacguguggaaccugcaggucgaggcccucgagcggaagcuggacaaccgcgaguucgcccgggugcugauccaccucgugcagcgccggggguuccagacgauccgcaaguccgucgagauccaggaggagggcaagcugcuggagaacgugagcgagaacgagcggaucaugaaggugaacggcuacaagaccgucggggagauguucuccaagcacgagaaguucacccaccacaagcgcaacaaggacggcagcuacaccuccguggugacgcggagccuccugcugaaggagaucaagaccaucuucaacucccagcgcauccucgggaacgucuucagcacccagaagcuggaguccgacuaccuguacaucuggggcagccagcgccccacccucacguacgagcagcugauguccaugguggggaacugcaucuacgagaagaaggagaagcgggcgcccaagaccagcugggccuuccaguacuucucccugcuccagaagaucaacaagcugaaggugagcgacgacaacacccugcgcaagcucagcaaggaggagcgggacaucgucaucgagcuggccuucaagaagaagaacguguccuucguggacauccgcaaggcccugaagcucaacgacaacaccaaguucaaccaccugacguacagccacgucguggagaccaagaagguggagaaggcgaccuucaucgagcugaagggcuaccaccucaucaagaagcagcugaaggaccggaacgucgagcugacccaggagcuccagccgaaggacuacgacgccaucgccgccgccuccacguucuucaagaacgacaucgaguuccgcgacuaccugcggaaccaguaccuggacagcaacggcaagcgcaaguccaacaucgcgaacaagguguucgaggacaaggugaucgccgccgucuucgagcucaacuucagcaaggugugccaccuguccuucaagagccuguacaagcucaucccccaccuggagaaggggcuggacuacaaggaggccauccucugcgccggcuacaacuuccgggacgagaacaagcgcgacaagaagcuguuccugcccgucauccagcaggagaccaaccccguggugcaccgggcgcucacccaggcccgcaaggucaucaacgccaucauccgggaguacggguccccgaacaccauccgcuucgugguggccaacgaccuggccaagacguacaagcagcggaaggagcuggagagcacccugaagaagaaccgcgcggagaacgagaagaucaagaccaagcuccuguccaugggcaucaucaaccccaccggcauggacaucgucaaguacaagcugugguacgagcagagcgggaucugccucuacacgggccggcagauggagcuguccagccuguucaagcccggguacuccaucgugaaccacaucauccccuacaaccgcagcuucgacgacaccuaccacaaccgggugcucacccugaccgagacgaaguacgagaagggcaacaagaucccguucgaguacuucggggccgaggagaccugcuggaacgaguacgagaagcgcgucuccaccagcaagaagauccacgacaagaagcgcgagaagcugcucauccggaacuucgacaucgaguacgagaacgagaugaucuccaacaacguguucgacacccacuacaucggcagcuacuucgagaaguacaucgacgagcaccuccaguucaagaaguccacgaagaagcagaagguguucuccauccacggcaacauggucgcccaccuccacagccgcuggggguucaacaagaacucccgggagaucuaccugaaccacgccguggacgccgcgaucguggccguccugaccgaccagcugauccgcaacaucgccgacuacuaccggcgcgacaacauccuggagcagaagggcagccugaaguuccccgagcccuggaaguccuucagcaucgagcuggaggcccggaucagcccccaggugcgcgaccucaucaagaagcugaaccuggacagcuaccucgacguggacauccugcacaucaagccggucuucaucuccaagaagccccggcgcaaggugaacggggaggcgcacaagagcaccauccggucccugaucggcaucaacgagaucgggaagaccgugacgugcaucaagacccgccucgaggacauccccuucgacgagaacggcgacuuccccauguacggcaaggacaccgacaaguacaccuacaccgccaucaaggagcgguaccuggaguucaacaaggacaaggagaaggccuucagcacgccgcuguacaagcucaagcgcaacggggagcccggcaaccagaucaaguccgucaagaucaucgacacccggaacaucgugaacaaggugaaccaggggaagggcaucgccuacaacagcaacaucauccgcgucgacguguucucccgggaccagaaguacuacgugguccccaucuaccugcgcgacuucaucaaggggagccugcccaacaagaucaucaccgccgcgaagggcuucaugcaguggccggagaccgacaacuccuacacguuccucuucagcaucuuccccaacgaccugaucaagguggugcccaaggagggcaaguucaucaaggccaagaacgagaacaaggagaacaucaaccugaccgagauccucggguacuucaagggccuggacagcuccaccggggccuucacccuggagagccacgacggcucccuccuggcccggggcaucgggacgaagaaccugcuccugaucgagaaguaccaggucgacgugcugggccgcuacaacaagguggggaacgaggagcggcaggacaucaagauccagcagaacuga

SEQ ID NO: 1523 - RNA, 3213 nt, Artificial Sequence
  Cas9 variant
auggccacccgccugggccucgacaucgggaccaacagcaucggcuggugccuguacgacggggacuccauccgggacaucggcgugcgcaucuuccuggacgggcgggagcccagcaagcucacggucuccggcagcggcaccccgcuggccgugaagcgccgggacgcgcgcggggcccggcgccggcgcgaccgguacaucggccgccgguccgccaugcugcgcgagcuccggaagcacgggcugcugcccgccgaccccaagcaggccaaggugcucgagacccaggaccccuacgcgcugcgcguccgggcccuggacgagaagcucgagccgcaccagaucggccgcgcccuguuccaccugaaccagcggcgcggguucaagagcaaccggaaggccgagcgcgcguccaaggccggcgaggacggcaagaucgccaccgccacgaagcuccuggacgaggagaugcagcgccugggggcccggacccucggcgaguuccuggugaagcgcgacagcgaguucgacggggaggcgggcaagcgggugcgcaugcgggccgacuccaaggccuacgacuucuaccccgaccgccggcacguccuggacgaguuccgcgccaucuggaacgcccagaagguguggcaccccgagcuccugaccgagcaggcguggaacgacaucuuccgggugaucgaguaccagcgcgagcugaagccccaggucgugggccacugcaccuucgccgggaucaacggcgugccggccgacgagaagcggcuccccaaggcccacccccuguuccagcagcgccggcuguacgaggaggucaaccagcucaaggugguggcccccggggaggcgggccgcccgcugacgcgggacgagcgcgacgcccugauccucaagcugcaggacaagaaguccgucagcuucgagacccuggggaagacccucaagcugaaggacggcgagcgguucaacaaggagagcgagaaccgcaaggcccuggacggcgacgaggugcgggccgcccucuccgggaagaagcuguucggcacccgcugguuccacuucagcgcggaggagcaguggaugaucaucgagcgccugcucgaggaggaggacuccgagacgcugcugaccuggcucaagaucggguaccggcuggacgacgaggccgcccuggccguggcgaacgccaagcuccccgagggccacgggcgcuucggccugagcgccaccaccgcccugcucaaggagcugaaggccgacgucugcacguacgcggaggccgccaagcgggccggcuuccaccacuccgacuuccgcaccggggagguguucgaccagcugcccuacuacggcgagauccuggcccgggagaucgcgcccgggaagccggaguacggcgacgagaacgagcgccgguucgggaagaucaccaaccccaccgugcacaucggccucaaccagcugacgaagcuggucaacgccaucauccgccuccacggcaagcccgacuacaucuucguggagcuggcccgggagcugaagcucaacgagaaggagaagaucgccuacaaccgccagcugaaggagaacaccgacgccgcgcgggaccgcggggccaagcugggcaccaugggggugcgggacaccggccgcaaccggcucauccugcgccuguggacggagcucaaccccggcgacgcccugaaccggcgcugcccguucugcggggagcagaucagccagcggaugauccagaacggcgaggucgagaucgagcacaucauccccuacucccagugcuucgacgacgggaucggcaacaaggugcugagccacguccgcugcaaccggcagaagggggaccagacccccugggagcgcuggggccacgaccccgaccgcuggagcaucauccaggagcaggucgcccaccuccaccgguccaagcaguggcgcuucggcccggacgcgcgggaccgcuacgccgccgaggaggacagcuuccugccccggcagcugaucgacacccaguaccucacccgcaucgccgccaaguaccuggcgugccuguaccccgagcgcggggagcggcacguguucgccgugcacggcgggaugacggccaugcuccggcgccugugggaccugaacuccauccuccuggaccacaacuggguggagaaccugaacagcaacgcccccaagaaccggcucgaccaccgccaccacgccaucgacgcggccguggucggcaucaugaccccggggcugaucgccgagaucgccaaggccgcggcccgggccgagaagcagaaccuggaccgccucuucgaggagcugcccaugcccugggcccagcacccgaacgaccggcgcuuccgggacgagcugcgcgagaagauccucgcggccaccgugucccacaaggccgaccacggccggcagggcaagcccgagcgcgggcgcgacaucaccgccggcaagcugcacaacgacacggccuacggguucaccggccugaccagcgacaccgggcuccccguggucgugcaccgggugccccugacgucccugaccccgaaggacaucgcggaccccgaccgcauccccgacaccacccuccggggcagccuguggcaggccacccgcgaccuguccggcaaggaguucgagaaggcccuccuggacuucagccggacgcacgcccaguucaaggggauccgccggguccgcgugcgggagggccugacccucauccccauccgcaaccacgccgggaagccguacaagggcuaccugggggacuccaacgcgcgguacaacguguggcagaugcccgacggccgcuggguccaccaggugaucagcaccuucgaccugcaccagcccggcuucaucgagcagcggccccacccggccgccaagaaggugcucucccugcgccagaacgaccugaucgccaucgagcgggacggggcccuccgccagaucaugcggguccagaaguacggccagaacgggcagaucuuccugaucgagcacaacgaggcgggcaacauggccgagcgcaacaagaacaccgacgaccccuucaaguucuacggccccggggccagcgcccugcggaacaugaaggcccgccaggugcggaucgacgagcucggccgcaucuucgaccccgggccgcgcuga

SEQ ID NO: 1524 - RNA, 3213 nt, Artificial Sequence
  Cas9 variant
auggccaaggacuucgaguacauccugggccucgaccugggggagaccagcaucggcugguccgugguccgccugaacgagggggugcccgagcaccucgagcggcugggcgugcgcaucugcagcgacgggcgggacgcccagucccacgagccgcugagcgucgcgcgccggaucgcccgcggccuccggcgccggcgcgaccgguacauccaccgccggauccgccugaccgacgugcuggugaaguacggccucaugcccgaggacaucaaggagcggaagaagcugcaggcccugaaccccuaccgccuccgguccgaggcccuggaccgcaagcuggagcccuacgagcucgggcggguccuguuccacaucaaccagcgccggggcuucaagagcaacaugaagacggaccgcaaggacuccgagagcggggccaugaagcaggcgauccugaagacccgcgccaagauggaggccuccggcgcccggacccucggggaguuccuguacuuccugaacaaggacaagaccagcacgcaggaguacgugccggugcgcaugcggucccacagcgagaagaacaagaccgucuacgagauguaccccgaccgcgcgauguacgaggacgaggugcacaagaucuucgagcagcaggagcucucccccgaggcccagaccgagaucuucaacaccaucuucuuccagcggccccugaagccgguggagcugggcuucugcgaguucgaggacggcgagcgccgggccuacacggccagcgucguguuccagaaguuccgcgcccuccagcagaucaaccagaucuacgugcaggacgacuacgagcggcgcccccugaccaaggaggagaaggacauccugaagcacuuccuccuggaggacuucuccgcgcuggacaagaacgggcuccugaccugggccaagguccggacccugcucaagcugcagaagaagaaguucaaccuggagagcgagcgccggaagggccucaacgccgacgugacguccuggaagcugagcaacgccgccugcuucgggcgcgagugguucuccuucagcgacgcgaagaaggaggagaucguggcccugaucaccggcgccgagaaggaggaggagcucaucgccgagcugaagaccaaguacggccugagcgacgagcgggccaagaacaccgcgaacgucucccuccccgacgggguggccagccuguccgccaaggccaugaagaagcugauccccuuccucgaggagggcaugcuguacgacgacgccgugaagcaggcgggguacgucuucagcuccagcuucaagggcgugcugccggagaaguacgagacguucaucgagcccgaguccggggagugcuucgacgagcuccccuacuacggccaggugcugcgccgguacguccugggcggggugcccagcgaggagaacaagcuguucccggagaaguacuacggcaagaucaacaaccccaccguccacaucgugcucaaccagcugcgcaagcugaucaacucccucguggccaaguacgggcacccccggaagaucgucguggagauggcccgcgaccugaagcugagcaagaagcagaaggacgccaucgcgaaggagcaggcccucaacgagcgcgagaacaagcggaucggcgccgagcuggagcgccuggacauccggaacaacuacgacaaccgcaugaaguacaagcucugggaggaccuguccaccgaccccaccaagcggagcugcccguucugcgggaagcagaucucccagcaggacaucuucagccccgaguucgagaucgagcaccugauccccuucucccgcagcuucauggacggccgguccaacaaggugcucagcugccgccggugcaaccgcgagaagggcaacaagacgcccuucgaggccuucgggaacgacuccacccgguggaacgccaucaugggccgcgucgagagccugccggagaacaagcgguggaaguucgcgagcgacgccaugucccgcuucgagcgggacggggaccugcucgcccgcaugaugaccgacacccaguacauggcccggaucgcccgccgguaccugugcugcgcggccaaccccaaccagguguacggcauccccgggcagcugacggccaagcuccgcgagcacuggggccugaacagcauccuguccgaccagaaggagaaggaccggagcgaccaccgccaccacgccaucgacgccuucguggucgcgugcaccgaccgcggcacccuccagaaguacuccaccgagcggcgcgacuacgccaagcccgagaugccgagcgagaaggcgccccacauccccuucgccgacuuccggcuguccgacaucaagcgcguguucgacgagaucaucgugagccacaagccggaccgggggaacgcccgcgccgccauccugaagggcgggacggucgccaagcuccacgaggagaccuacuacggcaugggcggggagggcuccaagaaggggaccuggaagcugauccagcggauccccgugagcgagaucaagaaggccuccgaccuggacugccucaucgaccagaagggcaccgcgaacccccugcgcgugcugcucgucggggccagcgaguccgagcaggagcagaucaucgccagcuacuucgcccggcgcggcacgcacaaggugcggaccuaccgcgagcggaacaaggacgugauccugcccuucaaggacaaggacggcaagcuguaccgcuacgccgucuacggguccaacgcguacgccgagaucuacugcccggaccggggcaagaacgccgggaaguggcaggucgagaucauccccaacuacugcgcccaccagaagggcuucauccccaaguggcgccacaccgacgcccacgcgaagcucaucaugcggcuguaccgcaacgacaugguggccuacgagaaggaggggaagaccgugaucgcccgggugaagaagaugggcggcaacggggugaucgucuuccgcaaccaccugaucgccaaggaggagggcgaccgccucagcuggcaggcggugguguccgggaugcagagcgccaaccugcggaagaucuacgucgacgugcugggccgcgugaucgaccccaagcggccgaugacgcagaacgagaccgacgggcaggacaacuga

SEQ ID NO: 1525 - RNA, 3213 nt, Artificial Sequence
  Cas9 variant
augagccacuuccgccugaagcagcucaacuacauccugggccuggaccucgggaucgccuccgugggcugggccgucguggagaucgacaccgaggagaaccccacccggcugaucgacguggggguccgcacguucgagcgggcggaggugccgaagaccggcgacagccuggccgccgcccgccggcaggcccgcuccgcgcggcgccucauccggcgccggacccaccgccugcugcgggcccgccggcuccugaagcgcgaggggauccugcacgccgacgaccucaacgccgagggccuggugaaggagcugcccaacacccccuggcagcuccgggucgacggccuggaccgcaagcugaugcccaaggagugggcggccgugcuccugcaccuggugaagcaccggggguaccucagccagcgcaagaacgaguccgagggcgccgacaaggagcuggggcggcugcucgccggcguccacgagaaccaccaggcccugcagagcuccgaguaccgcacgccggcggagcuggccgugaagaaguuccaggcccagagcgggcacauccgcaaccagcggggcgacuacacccacaccuucgaccgcaaggaccuccagcaggagcugcaccagcuguucgccgcccagcagaaguacggcaaccccuucguguccgacgggcucaagcagggcaucgagacccugcugaugcagcagcggcccgcgcucagcggggacgccguccagaagaugcugggccgcugcacguucgagaccgaggaguucaaggccgccaagcacaccuacuccgccgagcgguucaucuggcugaccaagcucaacaaccugcgcauccaggagaacggcaacgagcggugccugacggcgcaggagcgcgggcagaucaucgaccuccccuacaagaaggccaagcugaccuacgcccaggugcggaaggagcugagccucccggagaacgccuucuucaagggccugcgcuacgggaaggagaacgccgagaccgcggcccugauggagaugaaggccuaccacgccauccggaaggcgcucgagaaggccggccugaagaccgaguggcaggggcuggccugcaagcccgagcuccuggacgccaucggcacgguguucucccuguacaagaccgacgaggacaucagcacccgccugcagggccagcucuccgaggacgucaucaacgcccugcuggcggggcucaacuucgacaaguucauccagcugagccugaaggcccucuccaagauccugccccugauggagcagggccagcgguacgacgaggcccacgccgcccucuacgugcgcagcacgccccagccgcagcggcugcugccccagaucaccgcggacgagaucugcaaccccgugguccuccgcacccugucccaggcccggaaggugaucaacgccaucgugcgccgguacgggagccccgcccgcauccacaucgagaccggccgcgaggucggcaagagcuucaaggaccggcaggagauccagaagcgccaggaggacaaccacaaggagcggaagcaggccgcggagaaguuccuggaguacuucccgaacuucguggggcagcccaaggccaaggacauccucaagcugcgccuguaccagcaccagcacggccagugccucuacuccgggaagacccuggacaucugccggcugaacgagaagggcuacgccgagaucgaccacgcccuccccuucagccgcacgugggacgacuccuucaacaacaaggugcugguccuggcgggggagaaccagaacaagggcaaccagacccccuacgaguggcucgggggcgccagcaacuccccgcgguggcaggaguucguggcccgcgucggcagcucccgguuccaccacagcaagaagcagcgcauccugcugcggcagcucgacgaggagggguucaaggagcgcaaccugaacgacacccgguacguggcccgcuuccugugcaaguucaucgaggagaacaugcuccugcugggccgggggaagcgccggguguucgccuccaacggccagaucaccagcuuccuccgcucccgguggggccugcgcaagguccgggaggagaacgaccgccaccacgcgcuggacgccgugguggucgccugcagcacgguggccauccagcagcgcaucaccuacuucgugcggcagcgcgagaugaacaucuucgacggggagcucaucgacaaggagaccuccgaggucagccggcccuacuucccccagcccugggacuucuuccgccaggaggugaugaugcggguguucggcaagccggacggggaccccuccuuccccgaggccgacaccaaggagacgcugugcacccugcucgagacccgccugagcucccggccccaggcgguccacgaguacgugaccccgcuguucgugagccgcgcccccacgcggaagauguccggccaggggcacaaggagaccgucaagagcgccaagcuccugcacgagggcaagagcgugcugcgcgugccccucacccagcugaagccgaaccugcucgagaagauggucaaccgggaccgcgagccccagcuguacgaggcccugaaggagcggcucgccgcguacggcaacgaccccgccaaggccuucgccaccgaguuccgcaagaagggcgggcagcuggugaaggcggugcgggucgaggacacccagaaguccggggugcugcuccacaagggcacggggguggccgacaacgccaccaugguccgcguggacguguucgagaaguccggcaaguacuaccugguccccaucuacagcuggcaggucgcccagggcauccugccgaacaaggccgugauccaggggaaggacgagaagaacugggacgagauggacgagaccuacaccuucaaguucagcauguaccccaacgaccucguggagaucaacacgggcaagcagcggcuguucggguacuacaucggccuggaccgcgcgaccggggccaucuccauccgggagcacgaccucgacaacuucaagggcaagaacggcaucuaccgcgugggggugaagaccgccaucagcuucaagaaguaccagaccgacgagcugggcaaggucguggugcccugccgccccaagaagcggcugccgguccgcuga

SEQ ID NO: 1526 - RNA, 3216 nt, Artificial Sequence
  Cas9 variant
augcgccugggccucgacaucgggaccaacagcaucggcugguggcuguaccagaccgacgacgggacgaucaccgacgugcuggacggcgggguccggaucuucuccgacggccgcgacccccagagcaaggagucccucgccguggaccggcgcguggcccgggcgcagcgccggcgccgggaccgcuaccugcggcgcaaggccgcccugaugaagcggauggccggcgccgggcucaugccgaccgaccaggcgcacgccaagaagcuggagagccuggaccccuacgcccuccgcgccgagggccuggacugcgagcugccccucacccaccuggggcgggcgcuguuccaccucaaccagcgccggggcuucaaguccaaccgcaagacggaccgcggggacaacgagagcggcaagaucaaggacgccaccgcccggcuggacugggccaugcgggacgccaaggcgcgcaccuacggcgaguuccugcacacccgccagcagaaggccgacgaccccaagcggaugccgacgguccgcacccggcucaccguggcccgccgggacaacgccgagaaggaggaggccggguacgacuucuaccccgaccgccggcaccuguccgaggaguucgacgcgcugugggccgcccaggccgacuaccacgaggcccucagcgacgaccugcgcgaccagaucaagaccaucaucuuccaccagcggccccugaagacgcccgaggugggccucugccuguucaccgacgagcgccggaucccguccgcgcacccccugaaccagcgccggauccuccuggagaccgucaacgcccugcgcaucguggcccgcggggaggccgcccggcggcucacccuggaggagcgcgaccagaucgugcacgcgcuggacaacaagaaccacacgaagacccucagcggcauggccaugaagcugaaggcccugggcaaggucauccggcuccgcuccgaccagaccuucacccuggagacggccaaccgcgacgcgaucgccugcgaccuggugcgggccagccucucccaccccgaccgcaugggcgggguguggaccacccuggacgagggggcccagugggaggucgugcagcggauccgcgccgugcagagcgacuccgaguucgacgcgcuggucguguggcucgagcagaaccacggccuggacaacgcccacgcccaggccaccgccaacgcgccccugccggagggguacggccggaugggccucauggccacgcgccggauccuggccgcccugcagagcgacgugaugcccuacuccgacgccgucgcggccugcggguggagccacuccggcgggcccaccggcgaggugcucgagaagcugcccuacuacgggaagauccuggaccgccacgugaucccgggcaccuacgacgagaacaacgaggacgucaagcgguacggccgcaucaccaaccccacggugcacaucgggcugaaccagauccggcgccucgugaaccggaucaucugcauccacggcaagcccgacgagaucgucguggagcuggcccgcgaccugaagaacagcgaggaccagaagcgggagauccagaagaucaucaagaagaacaccgacgccgcgaucaagcgcggggagaagcucaucaacgagcugggccagaaggacaccggggccaaccggcugguccuccgccugugggaggaccugggccacgacgugaugacccggaacugccccuacagcggcaagcgcaucuccgccgggaugcuguucgacggcagcugcgacguggaccacauccucccguacucccggacgcuggacgacgggaucgccaacaagacccucugccugaaggaggccaaccgccagaaguccaacaacacccccugggaggucuggggcgagaccgagcagugggacacgaucgcggccaaccugaagaaccuccccgacaacaaggccuggcgcuucgccagcgacgccaugcagcgguucgagggcgagaacgacuucagcgcgcgcgcccugaaggacacccaguaccugucccggaucgcccgcgccuaccucgacgcccuguacgacgggggcgacgggaacagccacgugugggugguccccggccggcugaccgagaugcuccgccggcacugggggcugaacggccuggaggcgcucaccgacuccgacgagaacaccgugaaggccaagaaccgcauggaccaccggcaccacgccaucgacgccgcgguggucgccgccacggaccgcggccugauccagcggaucagcaagaucgccaagcgcgacgagcaggccggggcggaggagguggcccgguccgugagcccgcccugggacggcuuccgcgacgacaucgccgcccagcugucccggaucaucgucagccaccgcgccgaccacgggcggaucgacucccaggcgaagcagcagggcgaggacgccaccgccgggcagcuccacauggacaccgccuacggcgugguggacgccggccgcgucgugagccggaagccccugcugucccucagcgaguccgacaucaagaagauccgcgaccccgaccugcagcgccaccugacccgggugacgaaggggcucgacaagaaggaguucgagcacgcgcugagcgacuucgccaacgcccgcaagcugccggaccagagcgagaaccccuacuucggcaugcggcgcguccggcucaucgacgcccugcaggacuccgcccgcgugagcgugcgggaccgcgacgggcacaucuacaaggcguacaaggccggcuccaaccacugcuacgaggucuggcggcugcccgacgggaagaucaagccgugggccaucagcaccuucgaggcccaccagaccggcaccgaguccaagccccaccccgcggccaagcgccuccugcggguguucaagcgcgacaugguggccaucgagcgggacggcgagacgcugaugugcuacguccagaagauggacaucgccaacggccucuuccuggugccccacaccgaggggaacgccgacgcgcgcaaccgggacaaggacgacagcuucaaguucauccagauguccgccgugagccugauccgcgccaagauccggcgcauccacgucgacgagauggggcggcuccgcgaccagggcccgccccgguga

SEQ ID NO: 1527 - RNA, 3216 nt, Artificial Sequence
  Cas9 variant
augcgcuacaccaucggccuggacaucgggaucgccagcgugggcugggccgucaucaacgaggacaagucccggaucgaggaccucggggugcgcguguucaagaaggcggaggagcccgacggcaagagccugaaccuggcccggcgcgaggcccgggggucccgccggcgcauccggcgccgggccacccgcaugcagaaggucaaggagcuccuggugaaguacaaccuggugagcgagaaggagcucgagacgcuguacaucaucaccgagaccaccccggacgucuacgagcugcgggccaagggccucgaccgccugcugucccggcaggaguucgcgcgcgugcucacgaacaucgccaagcggcgcggcuacaagagcaaccggaagaucgacgaggaggacaaggagguggggaagcuguccaagggcaccaucgagaacaagcgcauccugcaggagaagggguaccggaccaucggcgagauguucuacaaggacgagaaguucgaguacaacaagcgcaacaaggccggggaguacaacagcaccguccuccgcuccaugcugaucgacgaggugcacacgcuguucgagaugcagcggaaguucaagagcgaguucgccaacgaggaguucgagaaggaguacguggaggucaugaccuaccagaagcccuacaucacccccgagcuccuggagaagaugcugggcaagugcaccuucgagaagggcgagccccgcgcgccgaagaacuccuacacguucgagcgguucaugcuccugcagaaggugaacaaccugaacaucuacaucaacggggagaagguggagaucccccaggagaagaagaaggagaucaucgagcucgccuacaagcagagcgagaucaaguacacccagcugcgcaagaagcuggagcuccccaucgaggcccgguucgccgaccugaacuaccagaucaagcgcaccgaggacgaguccgaggaggcccuggucaagaagaucgaggacaagaaguucgugaagcucgagggcuggcacaagauccggcuggcgcugaaggagaacaaggacaaguucgagaagaucgagaagaaccccgagcuccagaacaucaucgccgacgcccuggugcgcaacaagaccgacgagacgaucaagaacuaccuggagaaguccgacaucgacgaggagaucaucaacgccauccucaacaucaacuucaccaaguucgggcaccugagcuacaaggccaugaacaagaucaucccggagcuggagaagggccucaccuacgacaaggcgugcgagaacgucggcuacgaguucaaggggcggaagaacgagcugcaguacaagcugccgcccgugaccgagcucgaggacgagauccugaacagcgugguccugcgcgccgugucccagacgcggaaggugaucaacgccaucaucgacaaguacggcagccccaccgccaucuacaucgagaccgcccgcgagcucuccaagcccuacgacgagcggaugaagaucgagaagcgccagaaggagaacgcggccaacaacgaccagaucaaggaguacaucaaggagaccuucggguucgaccccaagcccuucgacaucgucaagaugaagcuguggcgggagcagaacggcaagugcgccuacagcagcaagcccaucccggccgagcgccuguacgaggagaacuucgugcaggucgaccacaucauccccuucucccggugcuucgacgacagcuaccagaacaaggugcucgugcugacggacgagaaccagaagaagaaggagcgcacccccuucgaguacuucggggaggacaaggagcgguggcaccaguucgaggaguucgucaaccugaccuacaaguucaacacccgcaagaaggagaaccugcucaucaagaacuucaacgaggagaaguccaaggaguggauccagcgcaacaucaacgacacgaaguacaucagcaaguucauguacaacuacaucgccaacaaccugaaguucgcggacuccgagagcaagcggaagguguacaacaucaacggccaggccaccuccauccugcgccacuacuggggccucaagaaggaccgggaggagagcgacaagcaccacgcccaggacgccgugaucaucgcgugcgccaccaacaagaacaucaagaaggucuccgacuacagccgccggaagcugcuguacaagaacaacgagaucaucgacgaggagaccggggagaucaucgacaagaaguacaacaucgacaucuccaucaaggagcccuggccgaaguuccgcgaggagguggaggcccggauggaggacgccgacaacaacggccagcucuacgcccugaucaacgggaacuucacgaacuacgacgacguggacaucacccacaucaagcccaucuucaccagccgcaugcccgagcggaagaucaccggccgcgcgcacaaggacacgaugcggucccagaaguucauccagcaggggcagaacuucaccgucgugaagaagccccugaaggccaucagcaagcaggagaucgagggcaucaucaacaacccggacuucaagaaccucuaccuguccgacaagaagcuguacgacgacaucuaccagaagaugaaggaggccgacuucaaggccgagaaggccuucgcgaacgaguaccgcaaguacagcaagaacggcaacucccccaucgugcggagcaucaaggucgccuccgccggggccaccggcgugcagcucaagaacggggccaucgcggagaacgccaacauggugcgcgucgacguguucgagaaggacaacaagaacuaccuggugcccaucuacgucagcgacuucgccaagaacgagcugcccaacaaggccaucugcgcgaacaaggacgagaaggaguggaucgagaugaccgagaaguacaaguucaaguucagccucuacccgaacgaccuggugaagaucaagcggaagaacgagaaggaguucuacgccuacuacugcuccacccaccgcggcacggggaacaucaaccugcuccuggugaacggcgaggcccggaaggacggcgucgggaucaagaacaccgagaucuucgagaaguaccagguggacgugcugggcaacaucagcaaggucaacaaggagaagcgcgagggggugaaguga

SEQ ID NO: 1528 - RNA, 3216 nt, Artificial Sequence
  Cas9 variant
auggacuaccgcaucggccuggacaucgggaccaacagcaucggcugguccaucaucgagcucaccacggugcagagcaagcuggacgggaaguaccggcugaaggccgucggccucaucgacgccggggugcgcauguucgaccgggcggaggugcccaagaccggcgccucccuggcccugccgcgccggcucgcccgcagcucccggcgccggcugacccgccggagcgcccgcaagaaggcgauccggaaccugcucgucaaggaggacauccugaaccagaucgagcuggaccaccucuaccgcaccuccgagcugguggacaucuggcagauccggguggagggccuggagcgccggcucgggcgccaggagugggcccggcugcugauccaccucggccagaagcgcggguaccggagcacgcgcaaggccgaggagggcgccgacaccgaggggcgcgcgguccuguccagcaucaaggagaaccaggagacccugaagcaguaccggaccgugggcgagaugugggccacggacgacaaguucaagggccgcgugcggaacuccaccaacgaguucaucuucaacgucagccgcgacaaccucgaggaggagauccgguuccuguuccagcagcagcgcgagcugggguccauguacgccagcaagcuccuggaggaguccuacauggagguguggggccaccagcugcccuucgccagcggggaguccauccucaagaacguggggaccugcagccuguacgagaaggagaagcgggccgcgaaggccaccuacacguuccaguacuucauggcccuggacaagcucaacaacguccgcauccugcccuccaugcggacccugagcgaggaggagcgcggccucgcccugaaggccauguucgagcgggacaagcugcccaagaacccgcccaaguucaccuacagccaccuccgcaaggcgaucaagcuggaggaggacgagaccuuccagacgaucuccuacgacguggagaagacccuggccaccaacgagagcgccguguucgucaaccucgccgccuacuaccagaucaagaaggugugcgacgagcacaacgagaacuacgacuacguggacuacaacaccaucgggcacgcgcugacggucuacaagaccgacgaggacaucaacaaguaccuggccuccaagaacaacaucgccaagcggguguacgccaacgacuucaucgacagcgugcucaagcacuccuacaccaccuucggccaccugagccugaaggcccucucccgcaucaucccccugauggaggagggggaggucuucgcgaaggccaaggagaaggccggcuucaaggaggagagcuaccuggagaucaaguccaagcuccugacgaacauccccgacgccaucaagaacccgguggugaugcggagccugacccaggcgcgcaaggucaucaacgccaucaucaagcggaugggggagcagcccgccuccauccagaucgagcuggcccgcgagcucagcaaggacguguccgagcggaagaagaucaccaacggcuucgccgagaaccgcagccgcaaccaguucgcgaucaagacccuggaggagaaccacaucacgaacauccggggccaggacaucgucaaguucaagcuguggcaggagcagggcggccgcugcgccuacucccucaagcccaucaagcuggaggagcugaucagcuuccucaagaaggagcggcgcuacgagcacaaccuggacguggaccacaucauccccuacuccaagaccuucgacgacagcuacaccaacaaggugcuggucuucuccgacgagaaccggaagaagggggaccagaucccggccgaguaccucggcaucgggaccaagcgcugggagaaguacaaggaguucgugaucacgagcaaguuccccgccagcaagaagaagcggcugcugaaggagcagcucguggagcgcgaggagcuguucaugaaggagcggcaccugaacgacacccgcuacgccucccgguacuucaugaacuuccuccgcgagaaccugcugcggaaggagaccguccuccacgagacccagugggugacggcgguggccggccgcgucaccagccacauccggaagcgccugggcuucgggaaggaccgggaggagacccaccuccaccacgcccuggacgccaucaucguggccugcaccgacaaguggaugaucgacugcgugaccaacuacuacaagucccgcgagggcgggagcaucaagcggaaggagauccgcuuccccucccccuggaacggcuucuggcacgacguccagacgaagcuggcgcagcugccgcagcccgaggugaucaacgagagcaucuccaaggggaaccccgacgccguggacuacaugcucgucagccggaugccccgcaaguccaucaccggcgccgcccacaaggagaccaucagcaaguggggcggguacgacgacaagggcaaggcgcugcuggugaagaagguggcccucuccgagcugaaguucaagaacgacgacuucccgauguacaacaaggagaccgacccccugcucuacgaggccaucaagaaccgcuacgucgagagcgggcgggacgugaagcgcgccuucgccacgccccuguacaagcccuccaagagcggcaagcggaacgaggugaagcgcgucaaggugaucgcggagaagaaggccauggugcgggaggucaacggcgggaucgccgagaacggcgggcuggugcgcuccgacaucuuccucaaggagaagaaguacgugauggucccgguguacaccuucgacaccaucaagcagcagcugcccaacaaguacguggucagcggccggggguacgagcaguggcccgagcugaccgccgagcacguguuccaguucuccguguaccccuacgagcucguccacgugggcacgaacaagggcgacaacagcuucuacuacuucgccagccugaacaucuccagcaacgugcugaaguucuccgagugcaaccgcccgaccaaggacuacaucgagaucgggcucaacagcaucauccugcuggagaaguacgagaucgacguccucggccggaucaccgggcaguccaagaagggcauccgccagagcuucaagaacaacaagucccagaugaaggaguga

SEQ ID NO: 1529 - RNA, 3219 nt, Artificial Sequence
  Cas9 variant
augcgccugggccucgacaucgggaccaacagcgugggcugguggcuguacaagaccgacggggaggccgccuccgcgcggaucgucgaggugaucgacggcggggugcgcaucuucagcgacggccgggaccccaaguccaagacgagccuggccgucgaccgccggguggcccgcgccgcccggcgccggcgcgaccgguaccuccgccggcgcgcgucccugaugaagcugcucgcccggaccggccugaugccggccgaccccguggaggccaagaagcuggagcgccucgaccccuacgagcugcggagcaccgggcuggacgacgcgcucccccugacccacuucggccgcgcccuguuccaccucaaccagcggcgcggguucaaguccaaccggaagacggaccgcggcgacaacgagaacgggaagauccgcgaggccaccgcccggcuggaccuggagaugaugaccagcggcgcccgcuccuacggcgaguuccuccacaugcggcgccagcgggcgagcgacccgcgccacguccccuccgugcggacccgccugagcguggccgcccgcgggggccccgacgccaaggccgaggcgggguacgacuucuaccccgaccggcaccaccuggaggaggaguuccacgcccucugggccgcccaggccacgcaccaccaggcgcugaccgacgaccugcgggaccucgucuucgagaagaucuucuaccagcgcccgcugaaggagcccaagaucggccugugccucuucaccgccgaggagcggaucgccaaggcccacccccugacccagcgccgggugcuguucgagacgaucaaccagcuccgcgugaccgccgacggccgguccacccgcccccugacccuggaggagcgggacacgcucguccacgcgcuggacaacaagaagccgaccaagagcaugaccuccaugaacaugacccugaaggcccucgccaagcugcugaagcuccgcgacggggagcgcuucacgcuggagaccggcgugcgggagaacaucagcugcgaccccgugcgcgccugcauggcgcaccccgcccgguucgggccccagugguccagccuggacugggaggcccagugggacgucaucucccgcgugcgccaggugcagagcgagggcgaguucaucgagcucaccgacuggcugauccaggggcacggccuggacgccgaccacgccaaggcggucggcaacgccccgcuccccgagggguacgcccggcugggcuucagcgccaccgagcggauccuggaccagcucaaggccgaggugugcacguacuccgacgcgguggccaagugcggguggcaccacagcgaccagcgcaccggcgccugccuggagguccugcccuacuacggggaggugcuggaccggcacgugauccccggcaccuacgacgccaccgacgacgagaucacgcgcuacggccggaucaccaacccgaccguccacaucgggcucaaccagcugcgccggcuggugaacaagaucaucgagguccacggcaagcccgaccagaucgugguggagcucgcccgcgagcugaagcaguccgagccccagaagaaggacgcgaugaagcggcugcgcaacaccacggccgacgccauccggcgcagcgagcagcucgagcagcuggggcagcccaacaccggccacaaccggaugcugcuccgccugugggaggaccuggggccggccaucggcccccggugcugccccuacaccggcaagaccaucuccgucacgaugguguucgacgggagcugcgacguggaccacauccuccccuucucccgcacccuggacgacagcuucgcgaaccgcacccugugccucaaggaggccaaccgggagaaguccgaccgcaccccgugggaggccuggggcgggaccgaccagugggacgacaucgccgccaaccugaagaaccugcccgagaagaagcggaagcgcuucggccccgacgcgauggagugguucgagggcgagaacgacuuccucgaccgggcccuggucgacacgcaguaccuggccaagaucagccgcauguaccucgacacccuguucaccaagggcgggcacguguggguggucccggggcggaugaccgagaugcugcgccggcacuggggccucaacgcccugcugaacgacaaggaccgcggggccgugaaggcgaagaaccggacggaccaccgccaccacgccaucgacgccgccguggucgccgcgaccgacuaccggcucaugcagaagaucucccgcgccgccggccagggcgagaacgccgggcagagcgcggagcugaucgcccgggacaccgacgcccccugggagcacuuccgcgccgacaucgccucccagcuggagaagaucaucgugagccaccgggcggaccacggccgcaucgacguggaggggcggaagaccggccgcgacuccacggccgggcgccuccacaacgacaccgccuacggcgucaucgacgaccugaccguggccagccggacgccccugaugucccucaagcccagcgacaucgccaucaccgagcgcggcaagaacauccgggacccgcagcugcagaacgcgcuguacguggccaccaaggggaaggagggcaagauguucgagcaggcccucgucgacuucgccuccaaggaggggcccuaccagggcauccgccgggugcgccugguggagacccugcagaaggccgcgcgggucgagaucgggaagaccgagagcggccagccccucaaggccuacaagggcgacagcaaccacugcuacgagcuguggaagcugcccgacgggaagaucgugccccagguggucacgaccuacgaggcccacgccggcuccgcgccccgcccccaccccgccgccaagcggauccuccgcguguucaagaaggacauggugaagcugaccaaggacggggaggagaucgucggcuacgugcagagcaugcacaucaagaacgggcuguucguggcccagcaccucgaggccaacgcggacgcccggaaccgcgacaagaccgacccguucaaguuccugcagaugggcgccggcacgcuggucaagaccgggcuccggcgcgugcugguggacgagaucggccggcugcgcgaccccgggccgcccaagcucuga

SEQ ID NO: 1530 - RNA, 3225 nt, Artificial Sequence
  Cas9 variant
augcagaccaagaaccugcccuacacccucggccuggacaucgggauggccagcgugggcgccgcgcugcuccugccggaccaggagcgcauccuggcccuccacguccggacguucgacaaggccgagaccgccaaggagggggagucccugaacaagauccgccgggacagccgccugacccggcgccggauccgccggcgcgcccaccggcucgugcgccuggcgcggcugaugaagcgcgugggccucaucgccgacgccaaccccgaggccuucgcgcugcccggggucucccccuggcaccuccgggccgacggccucgaccgccugcuggagccgaaggagugggccggcgugcucuaccaccuggugaagcaccggggguuccagagcaaccgcaaguccgaggccaaggccgacgagaaggcgggccagaugcugagcggggucggccggaaccaggcccuccugaaggaggccggguaccgcaccgugggcgagcuggccgcccggcacgaggacuucaaggaggcgaagcgcaacaagggcggguccuacagccacacguucgcccgcgccgaccucaacgccgagcugaaccugcuguucgagcggcagcgcgcccugggcucccggcuggcgagcgccgacuuccaggagaacgugcgcgaccuccugauggcccggcgccccacccuguccggggccaaccuccugaagauggucggcaagugcaccuucgagaaguccgaggaccgggcccccaaggcgggcuaccgcgccgagcgguucguguggcuggggaagcucaacaaccugaagaucgugggcagcggggacgcccgcccccugaccgacgccgagcaccggaucgucaucgaccucccguucacgcaggcgaagcugaccuucaagcagguccgcaaggcccuggagcucgagacccaccagcgguucaaccugcugagcuaccgccccgaccccaagggcaaggacaaggaccccgaggaguccaccuucuucgaggccaagagcuuccacacgcuccggaaggccuacgagggggccggccugaagaaggaguggcagcgcgacgcgcuggacccggaccggcucgacgcccuggccuacgcccugaccugcuacaaggacgacaccgagucccgccaguggcugguggcccagggcaucgggacccccaucaucgaggcggugcucgccgagagcuucgacaaguucauccaccugucccagaaggcccugaaggccauccucccccacauggaggccggccagcgguacgacgacgcggccaagagcgccggguacgaccacagccagcccgacgccggcacggggaagcgcgcgacccugccgccgcccgacaaggacaccauccgcaaccccgugguguaccgggcccugaaccaggcccgcaagcucgucaacgccaucguggccgaguacggcccgcccgcggccgugcacaucgagcuggcccgggaccuguccaagcccaucgacgagcgccgggacaucgagaagggccagaaggaguuccaggcccucaaggagaagcuggccgcggccuucgaggagaccuuccaccgcaagcccagcgggcuggaccuccugaaguaccggcuguuccgcgagcagcucgaccagugcccguacugccagaaggcccuggucguggaccggcuguucgagcccggcuacgcccagaucgaccacgcccuccccuacucccgcagcuucgacgacgggaugaacaacaagguggucgugcacgucgcgugcaaccaggacaagggcaaccggacgcccuacgaguuccuggacggggccggcgacuccgagcgcuggcagcgguucguggccugggugcagggcaacaaggccauccgccaggcgaagcggaaccgccugcuccgggucaacuucgggaccgacgaggccaaggaguucagcaagcgcaaccuguccgacacccgguacaucugccgcgaguucaagcggaccaucgagacgcaguucgccuggcacagcgacgccgagggcaacgagcgcugcguggugcuguccgggcagcucaccagccugcugcgcgcccgguggggccucaucaagguccgcgaggacggcgaccugcaccacgcgcuggacguggccgugaucgccgccgccucccggagccucgucaagcgcauggcggacuacucccggcgcaacgagcuggagauggugcggaaccgcuacguggacccggccaccggggaggucguggacguggccgcccugcggcagaucgaggaccacuuccccaagcccuggccccucuuccgcgaggagcugcuggcccggcucgcgcccgagcccaagcugcagcugaccugcgucagcuccuacgacgagggccuccgcgagagcauccggcccauccgcgugucccgggccccgacgcgccgggggcugggcgccgcccaccaggagaccauccgcagccugcgggacgggucccagagcgccaucaagacgccccuccgcgaccugaaccugaaggaccucgagaacaucgugggcuucgagcgcgacaccgcgcugaucgacgccauccggacccgccuggaggccuucggcggggagggcaagaaggccuucgacgacaagcagccgccccuccggaagcccagcaaggaccccgacaaggcgcccaucauccgcuccgucaagcugcuggugacccagaaguccgggauccccauccggggcgggaucgccaacaacggcgccaugcuccgcagcgacaucuucaccaaggccggcaaguucuacgccgugccgaucuacgucgcggacgccgugcgcggggagcugccccaccgggccguggcccaggccaagcccgagcuggaguggcccaugauggacgagagcuaccaguuccucuucucccugcacccgaacgacuggaugaccauccggcugaagaacgagguccgcgagggcuacuacgcggggcucgaccgggccacgggcaacaucagccuguggcugcacgaccgcaaccagaacguggggcagaagggccuccugaccggcaacgggaucaagaccgcccuggccguggagaaguaccacgucgaccuccugggcaagcugcaccgggugcacaaggaggagcgccagcccauccacaucaagcccgggaagcgguga

SEQ ID NO: 1531 - RNA, 3234 nt, Artificial Sequence
  Cas9 variant
augaaguacagcaucggccuggacaucgggaucgccuccgugggcugggccgucaucaacgaggacaucgagcgcaucgaggaccucggggugcggaucuucgacguggcggagcagcccaagaccggcgccagccuguccaccccgcgccggcuggcccgcagcacgcggaagcgccuccggcgccggcgccaccgggucgagcgcgugcggaaguucaugauccagaaggggcugcugacccaggugcagauggagcagcucuacgacuggaaggacggcgaccuggacaucuggcugguccgcgugaacgcccucgagcggaagcuguccgaccgcgaguucgcccggauccuggugcacuucgcgaagaaccgcggcuuccagagcaaccggaaguccgagcuccaggaggaggacaacggggccguccugagcgccgugcaggagaacaagcgccugauggaggagaagggcuaccagaccaucuccgagaugcuccuguacgacgagaaguucgaggggaccaagcggaacaagggcggggaguacacgcacguggucgcccgcagcgaccugaagcgcgagauccagcucaucuucgagaagcagcgggcguacggccacgccuucgccaccauggagaacgaggacaaguuccugcagaucugguccagccagcgccccuucgccaccaaggacgacaucgccaagaagaucggcaacugcaccuucgagcccaaggagaagcgggcgcccaaguccacguacaccuucgagcgcuuccgggcccuggacaagcucaaccgccugcggauccugagcgggaccuccccggcccgcagccucacccaggaggagcgggaccugauccugaacucccucuucagcaagaaggaggugaaguacaaggagcugcgcaagcugcucaagcugaacgacgagcagcgguucaacgagaucuucuacgaccccaacgagaagaucgagaagaacgagaaccgcacguuccugucccucgagagccaguacaagauccggaagauccugcagaagaucgagggcaagagccugaacgacaccuaccgccccguggaccucgacaccaucgccuacgcccugaccgucuucaaggacgaccaggacauccgggacuaccugcagaaccaguacguggcguccaacgggaagaaggagcucaaccuggccaaccgcaaguacaacgacgagcugaucgaggagcuccugcaccugagcuucacgaaguucggccaccucucccugaaggcccugcggaacauccuccccuucauggagcagggcaucccguaccaccaggccugcgagaaggccggguaccaguucaacaagaaggugaaccgcgagaagcagaagcugcugccgcccguccccgcgaaggacaucgugaaccccguggucauccggagccugucccaggugcgcaaggugaucaacggcaucaucaagcgcuacgggagccccuccagcaucuacaucgagcucgcccgggagaugggccgcggguacaaggagcggaaggaccuggagaagcaguacaacaagaaccgccagaugaacgagggcgccaagaagcacauccuggagcuccggcccgaguucggcgacccccgcgggcacgacauccugaaguacaagcuguggcaggagcaggacugccggugcgccuacuccuucaagagcaucccgaucaagcagcuguucgagaucggcuacgccgaggucgaccacaucauccccuacucccgcagcuucgacgacuccaacaacaacaaggugcucguccuggcggccgagaaccagaacaagcagaaccggacccccuacgagugguucgggcacgacgagaccaaguggcaggaguucaccagccucgugacgaccaugaagguguccaagaagaagaagucccugcugcucaagaagaacuucgacgaggagcaggccgaggaguuccgcagccggcaccugaacgacacccgcuacaucacccgguacaucaagacguucaucgaggacaaccugcaguuccgcaucgaggagggcaagaagaccuacguccacaccgugaacggggccuacaccagccucaugcggaagcgcuggggcuucaacaagaaccggcaggagaacgcgcugcaccacgcccuggacgccgugaucgucgccgugucccuccccuucaagcacaaggugcgcgccuacuucaagcggcgcgaggaguacgcgcacaaccagcugaagcgggagggcgaguucuucccggagcccuggcccggguucauccacgagcuggagauccgcaugaugcaggacagcgagaacaucaagcucgccauggagagccugaaccugaagacguacgacgaguccuucaucaaggagcucaagcccaucuucgucagccgcaugccgaagcgggccaugaagggccagauccacgaggagacccugaagcgcgugcgggggcgcaccgacgacggcuacauccggaccgugaagaaggucaagcuggaccagauccccuucgacaagaacggggacuuccccauguucggcaaggagacggacaugaagaccuacgaggccaucaagucccgcuaccucgagagcggcaaggacaagaagaaggccuucaacacgccccuguacaagccggcgaagaaccccgagaacgcccccaucauccgguccaucaagaucgaggagaaggccaaccgcguggugaugcuggacgagaagaccgccgccgacaacgcgagcaucguccggaccgagguguuccgccacaaggagaccgggaacuacuuccucaccccgguguacgucgccgacgugcuggccaagaaggugcccgaccggcugaucaccaccaagaagcccuacuccgaguggcgcaagaucacggacgaguacgaguuccucuucagccuguaccccaacgaccugauccgggucaagaugccgaaggagaaggagaccaagacccacaccggcgagaagcacguguggcaggagaacuucauguacuucaagggggugcacuccggcagcgccggcguccgcaugaucgaccacaugaacuccuucgaggacgagaucggggugcggaagcucguggucuucgagaaguaccagguggacccccugggccgcaugaacaaggugcacggggagaagcggcacggcaucuga

SEQ ID NO: 1532 - RNA, 3234 nt, Artificial Sequence
  Cas9 variant
augaaguacagcaucggccuggacaucgggaucgccuccgugggcugggccgucaucaacgaggacaucgagcgcaucgaggaccucggggugcggaucuucgacguggcggagcagcccaagaccggcgccagccuguccaccccgcgccggcuggcccgcagcacgcggaagcgccuccggcgccggcgccaccgggucgagcgcgugcggaaguucaugauccagaaggggcugcugacccaggugcagauggagcagcucuacgacuggaaggacggcgaccuggacaucuggcugguccgcgugaacgcccucgagcggaagcuguccgaccgcgaguucgcccggauccuggugcacuucgcgaagaaccgcggcuuccagagcaaccggaaguccgagcuccaggaggaggacaacggggccguccugagcgccgugcaggagaacaagcgccugauggaggagaagggcuaccagaccaucuccgagaugcuccuguacgacgagaaguucgaggggaccaagcggaacaagggcggggaguacacgcacguggucgcccgcagcgaccugaagcgcgagauccagcucaucuucgagaagcagcgggcguacggccacgccuucgccaccauggagaacgaggacaaguuccugcagaucugguccagccagcgccccuucgccaccaaggacgacaucgccaagaagaucggcaacugcaccuucgagcccaaggagaagcgggcgcccaaguccacguacaccuucgagcgcuuccgggcccuggacaagcucaaccgccugcggauccugagcgggaccuccccggcccgcagccucacccaggaggagcgggaccugauccugaacucccucuucagcaagaaggaggugaaguacaaggagcugcgcaagcugcucaagcugaacgacgagcagcgguucaacgagaucuucuacgaccccaacgagaagaucgagaagaacgagaaccgcacguuccugucccucgagagccaguacaagauccggaagauccugcagaagaucgagggcaagagccugaacgacaccuaccgccccguggaccucgacaccaucgccuacgcccugaccgucuucaaggacgaccaggacauccgggacuaccugcagaaccaguacguggcguccaacgggaagaaggagcucaaccuggccaaccgcaaguacaacgacgagcugaucgaggagcuccugcaccugagcuucacgaaguucggccaccucucccugaaggcccugcggaacauccuccccuucauggagcagggcaucccguaccaccaggccugcgagaaggccggguaccaguucaacaagaaggugaaccgcgagaagcagaagcugcugccgcccguccccgcgaaggacaucgugaaccccguggucauccggagccugucccaggugcgcaaggugaucaacggcaucaucaagcgcuacgggagccccuccagcaucuacaucgagcucgcccgggagaugggccgcggguacaaggagcggaaggaccuggagaagcaguacaacaagaaccgccagaugaacgagggcgccaagaagcacauccuggagcuccggcccgaguucggcgacccccgcgggcacgacauccugaaguacaagcuguggcaggagcaggacugccggugcgccuacuccuucaagagcaucccgaucaagcagcuguucgagaucggcuacgccgaggucgaccacaucauccccuacucccgcagcuucgacgacuccaacaacaacaaggugcucguccuggcggccgagaaccagaacaagcagaaccggacccccuacgagugguucgggcacgacgagaccaaguggcaggaguucaccagccucgugacgaccaugaagguguccaagaagaagaagucccugcugcucaagaagaacuucgacgaggagcaggccgaggaguuccgcagccggcaccugaacgacacccgcuacaucacccgguacaucaagacguucaucgaggacaaccugcaguuccgcauggaggagggcaagaagcaguacguccacaccgugaacggggccuacaccagccucaugcggaagcgcuggggcuucaacaagaaccggcaggagaacgaccugcaccacgcgcuggacgccgugaucgucgccgugucccuccccuucaagcacaaggugagcgccuacuucaagcgccgggaggaguacgcccacaaccagcugaagcgcgagggcgaguucuucccggagcccuggcccggguucauccacgagcuggagauccggaugaugcaggacagcgagaacaucaagcucgcgauggagucccugaaccugaagaccuacgacgagagcuucaucaaggagcucaagcccaucuucgucucccgcaugccgaagcgcgccaugcggggccagauccacgaggagacgcugaagcgcgugcgggggcgcaccgacgacggcuacauccggaccgugaagaaggucaagcuggaccagauccccuucgacaagaacggggacuuccccauguucggcaaggagaccgacaugaagacguacgaggccaucaagagccgcuaccucgaguccggcaaggacaagaagaaggccuucaacacgccccuguacaagccggccaagaaccccgagaacgcgcccaucauccggagcaucaagaucgaggagaaggccaaccgcguggugaugcuggacgagaagaccgccgccgacaacgccuccaucguccggaccgagguguuccgccacaaggagaccgggaacuacuuccucaccccgguguacgucgcggacgugcuggccaagaaggugcccgaccggcugaucaccaccaagaagcccuacagcgaguggcgcaagaucaccgacgaguacgaguuccucuucucccuguaccccaacgaccugauccgggucaagaugccgaaggagaagggcacgaagacccacaccggggagaagcacguguggcaggagaacuucauguacuucaagggcgugcacagcggcuccgccgggguccgcaugaucgaccacaugaacagcuucgaggacgagaucggcgugcggaagcucguggucuucgagaaguaccagguggacccccuggggcgcaugaacaaggugcacggcgagaagcggcacgggaucuga

SEQ ID NO: 1533 - RNA, 3234 nt, Artificial Sequence
  Cas9 variant
augcagcagaagccccagcgcuacauccugggccucgaccuggggaucgccagcgugggcugggccugcgucugggcggacgagaacgagcacccgaccgggcugcucgacugcggcgugcggaccuucgagcgcgccgaggugcccaagacgggggacucccuggcccuggcccggcgccaggcccggagcguccgccggcucauccgccggcgcgcgcaccggcugcugcgccuccggcgccugcugaagcgggagggcgugcuccuguccgccgacuucaacgagaacggccuggugcgcgggcuccccaucgacgccugggcccugcgggucgcgggccuggaccgcaagcucagcaacaaggagugggccgccgugcugcugcaccucgugaagcaccggggguaccugucccagcgcaagaacgagacccagagcaaggacaaggagcugggccggcuccuggccggggucaacggcaaccgcgaggcccugcagaaccgcuccgacgaguaccggaccgcggccgagcucgccgugaagaaguucgccgccgagaacaacggcagccugcgcaacaagggcggggacuacucccacaccuucgaccggaaggaccugcagcgcgagcuccaccuccuguucgagcggcagcgcgcgcuggacaaccccuucacgagcuccgagauggaggccgccguggacgagcugcugaugaagcagcggagcgcccuccagggggaggccguccugaagaugcugggccgcugcaccuucgagccguccgaguacaaggcggccaagaacaccuacagcgccgagcgguucguguggcucaccaagcugaacaaccugcgcauccaguacaacggcgaggagcgggcccucuccgaggccgagcgccggcugcugcucgacgagcccuaccagaaggcgaagcugacguacaagcagguccgcaccauccuggagcuccccgagagcgccguguucaaggggcugcgguacggccacggggaggacggccugaaggccgaguccgggacccugauggagaugaaggccuaccacgcggugcgcaaggcccucaaggacgccggccuggagggcgagugggagaaccggauccgcaaccccgagcugcucgacgccaucgggaccgccuucagccuguacaagacggacgaggacauccgggcgaaccuggccgccuuccgccucuccgagaacgugcuggaggcccugcucgccggccugaacuucgacaaguucguccaccugagccucaaggcgcuggccaagauccugccgcucauggagcaggggaugcgcuacgacgaggccugcaaggaggccuacggcgaccacuacggggccaaggagcaggaggaccaccggcugcugccgcccuucguggcggacgacauccgcaaccccguggucuuccggacccucacccaggcccgcaagaucgugaacgagaucgugcggcgcuacggcagcccccugcggguccacaucgagaccggccgcgagguggggaaguccuucagcgaccggaaggagaucgagaagcgccaggaggagaaccggaaggagcgcgagcgggccgccgcgcacuucaaggagcuguuccccaacuucgccggcgagcccaaggcccaggacauccucaagcugcgccuguacgagcagcagcacgggaagugccucuacuccggcaaggagaucgaccugcggcgccugcccgagaagggguacgucgagaucgaccacgcccucccguucagccggacgugggacgacuccuucaacaacaaggugcuggugcugggcaaggagaaccaggacaagcgcaaccggacccccuacgaguaccucgacggcaaggggaacagcggcgccuggcgcgcguucgccgagcgggucuccgggugccgcuuccccuacgccaagaagcagcgccugcugacccagaagcucgacgagaagaccgagcagggcuuccuggagcggaaccugaacgacacgcgcuacguggcccgguuccucugccaguucaucgaggagaagaugcaccuggagggcgccgggaagaagcgcguguucgcgagcaacggccagaucaccgcccugcuccggggguucuggggccugaagaagguccgcgaggagaacgaccggcaccacgcccuggacgccgugguggucgccugcuccagcguguccaugcagcagaagaucacccgccacuuccgguaccgcgaggagcucgagcacaucgaccgggagaccggggaggugauccacggcuucccccagccgugggaguucuuccgccaggaggucaugacgcggguguucagcgacgaccccguguccgagcuggcggagaagcuggacagccgccccgaggccguccacgaguucgugacgccccucuucgugucccgggccccgcaccgcaaggucaccggccaggggcaccuggagaccauccggagcgccaagcgccuggacgagaagaucuccguggugaagcucccccugacccagcugaagaccaaggacaucgagcggaucgucggcuaccccaaccgcgagcccgcgcucuacgacgcccuggccgcccgccuggccgcguucaaggacgacccggccaaggccuucagcgagcccuucuacaagaccgggaaggacggcaagugcggggugcucgugaaggccguccggguggagaacgugcagaaguccggccugcugguccgcaaggacgagagcggcaagaugcaggggguggccgacaacgcgaccauggugcgggucgacguguucggcaagaacgggaagaacuaccucgugcccgucuacgccuggcaggucgagaagggcgagcugccgaaccgcgccgugguggccuacgccgacgaggaggacugggacgagauggacgacagcuucgaguucaaguucucccuguaccccaacgaccucguggagguggucacgaagaaggacaaguucuucggguacuacagcggcuucaaccgggcgaccggcgccaucaacaucaaggagcacgaccuguccaagagcaaggugaagaacgggguguacgagggcaucggggucaagaccgcccaguccuuccagaaguaccagguggacacccugggcaagacgauccgccucugcaagcccgagaagcggaugggguucaagaagaaguga

SEQ ID NO: 1534 - RNA, 3237 nt, Artificial Sequence
  Cas9 variant
augcgcuacgugcugggccucgacaucgggaucgccagcugcggcugggccgucaucaaccaggagaaggagcggaucgaggaccugggggugcgcaucuucgacaaggcggagaaccccaaggacggcaagucccuggccgccccgcggcgcgacgcccggagcacccgccggacccuccgccggaagaagcaccgcaugcagcggaucaaggugcugcuggucaagcacgggcuccuguccaagacggagcuggaccaccucuacgagagcgccaccgagguggacguguggaaccugcgccuggacgcgcucgagcggaagcuguaccccaaggaguucgcccgcauccugauccaccucgccaagcggcgcggcuucaaguccaaccggaaggagaccacccugagcgagaacggccagauccuggaguccaucagcgagaaccagcagaucauggagaagcagaacuaccgcacggucggggagaugauccucaaggacaagaaguucgagaaccacaagcggaacaagaacggcaccuacguggggaccgugacccgccagcagcugcaggacgagauccagaugaucuuccacgcccagcggcuguacaagaacgacuacgcgacggaggaguucgaguccagcuaccucgagaucugggccucccagcgccccuacgccagcaaggaccagaucgagaagaugaucggcuacugcacccuggagcccaaggagaagcgcgccccgaaggccuccuggagcuuccaguacuucgucgcgcugcagaccaucaacaaccuccggcugaucuccaaggaccgcaucgaggagcugagcuucgaggagaagaagcagaucaugaaccucgcccuggagaaguccaucgugaaguacaucgacauccggaagcugcucagcgugcccaacgaguuccaguucaacucccugagcuacagcgccgacaccgucgacacggccguggagucccgcaagugcaucgagcugaaggaguaccacagcaucaacaagguguacaagcagaucuacggggagaacgcccucaaccugcugcccaaguacuacgacaccaucgcguacggccucaccaucuucaaggacgacaaggacauccuggaguaccugcagaacaaguacgucaacgccaagggcaagcccaucuccaacuucgccaacaagaccuacgacgacacguucauccaggcccuccugaaccugaacuucaccaagauggggcaccucagcuucaaggcccugaagaacaucaucccguuccuggaggagggccucuccuacgacaaggcgugcgagaaggccggguacaacuucaagggcaccagcuacaccgagcagacgaaguaccugcccgugaucccccagaacaccaaccccgugguccaccgggcccugucccagacccgcaaggugaucaacgccaucaucaagaaguacggcagcccgaacgccauccacaucgagaccgcgcgggagcucuccaagacguuccaggagcgcaaggagaucgacagcauguaccaggacaacuccaagaagaacgagcacgccauccacaagcugaaggagcuggggaacaucaaccccagcggcaucaacaucgugaaguucaagcuguggaacgagcaggacgggcggugcauguacuccggcaaguacaucgagccccaccgccucuucgaggagggguacaccgaggucgaccacauccugcccuacagccggucccuggacgacagcuacaacaacaagacccucacccugggcacggagaaccagcgcaagggcaacaagaucccguacgaguacauggggaacaccuccaucuggaacgacuucgagacccgggugcagagcaacaagaagaucaacaagaagaagcagcagaagcugcuccugcagcacuucuccuacgcccgcgagcaggaguucaucgagcggaaccugaacgacacccgcuacgccacgaucuaccucagcagccugauccagcagcaccugaucuucuccgagagcucccggaagaagaaggugcacaccgucagcggcaucaucaccucccaccuccgcagccgguggggguucaacaaggaccgcaaggagggccacauccaccacgcgcuggacgccgugaucgucgccgugaccuccgaccacaugauccagcgcgugacgaaguacuacaagcugaaggagcucaaccggaaccugcaggccaagcgcaugcccuuccccgagcccugggagggguuccggcuggagcucgaggcccgcaucagcccgaacacccagcaguaccugaagggccugcgguucaagaacuacgcggacgucaaccucuccgagaucaagagcaucuucgugucccgcaugcccaagcacagcaucaccggcgagcugcaccaggagaccauccggaaguucaucggguacaacgagaagggcaaggugcugaccgccaucaagacgaagcucgaggacauccccuucgacgccaacggggacuuccccauguacggcaaggaguccgaccuguacaccuacaacgccaucaaggagcgcuaccugagccacaagaaggacaagcggaaguccuuccaggagccgcucuacaagcccaccaagagcgggggcaucggcccccugaucaaguccaucaagaucauggacacccgcacgaucgucaaccccgugaaccaggggaagggcguggucuacaacagcaagaucgcccggaccgacguguucaagaaggaggagaaguacuaccugaucccgaucuacaccaucgaccucaugaagaacauccugccccagaaggcgaucaccgccgggaagggcuacgaggacuggacgaccaucgaccccagcuucaccuuccuguucucccucuucccgaacgaccugauccagaucgugcccagcaagaacaagaccaucaaggcccgcacgaccgucuccaagaaggaggugcugcuccccagccugaccggcuacuucaagggggugcacuccggcaccgccgggaucacggucgagacccacgacggcagcgugaucgccaacgugggguccaagcagcugcuccugaucgagaaguaccaggucgacgugcugggcaacuacaccaagaucaaggaggagaagcggaucggccucaccacguacaacgacaacaagaagaucgcggccugcuga

SEQ ID NO: 1535 - RNA, 3237 nt, Artificial Sequence
  Cas9 variant
augaagcagcagccccagcgcuacauccugggccucgaccuggggaucgccagcgugggcugggcccugauccucgucgacgaggaggggaacccgaucggccugcuggacugcggggugcggaccuucgagcgcgcggaggugcccaagaccggcgacucccucgcccuggcccggcgccaggcccggagcguccgccggcugauccgccggcgcgcccaccggcuccugcgccugcggcgccuccugaagcgggagggcgugcuguccgcggccgacuucaacagcgacgggcuccccaaccugcccaucgacacguggcagcugcgcguggccggccucgagcggaagcugaccaaccaggagugggccgcgguccugcuccaccuggugaagcaccgcggguaccugucccagcgcaagagcgagacccagaccgagaacaaggagcucggcugccugcuggccuccguggccaagaacagcaagcuccuguccgagaacgccaaccaguaccggacgccggccgagcuggcgguccggcuguucgccgagcagagcgggcaccuccgcaacaagggcggcgacuacacccacaccuucaaccgccuggaccuccagaaggagcugcaccuccuguucgagcagcagcggaccuucgggaaccccuucgccuccgccgagcugcagagcaagguggacggccugcucaugaugcagcgcuccgcccugcagggggaggcggugcugaagaugcucggcaagugcacguucgagcccagcgaguacaaggccgccaagcacaccuacuccgccgagcgguucaucuggcugaccaagcugaacaaccuccgcauccuggagaacggcaccgagcgggcccugaacgaggcggagcgcaagcuccugcuggacgagcccuacaagaaggccaagcugacguacagccaggcccggaagcuccuggacaugucccacgacgccaccuucaaggggcugcgcuacggcaaggacagcgaggggcucaacgccgagaacggcgcgcugauggagaugaaggccuaccacaagauccggaccguccuggacaaggccgggcucaagggcgagugggagaaccgcauccggaacccggagauccuggacaagaucggcaccgccuucucccuguacaagacggacgaggacauccaggcggcccucgccgaccugcgccugcccgagaacgugcucaacgcccugcuggccgggcucaacuucgacaaguucauccagcugagccugaaggcgcucagcaacaucaugccccugauggagcggggcauccgcuacgacgaggccugcaaggagguguacggggaccaccgggcccuggccgaguccaagaaccagaugcuccugcccccgauccccgccaacgagauccgcaaccccgucgugcugcggacccucacccagacccgcaaggugaucaacgcgaucauccggcgcuacggcagcccccagcgcguccacaucgagacggcccgggagcuggggaaguccuucaaggaccgcaaggagaucgagaagcggcaggaggagaaccgcaaggagcgggagcgcgccgccgagcacuucaaggagcuguucccgcacuucgccggcgagcccaagggcggggacauccucaagcugcggcuguacgagcagcagcagggcaagugccucuacagcuccauccccaucgaccuggggcgccugaacgagaagggcuacguggagaucgaccacgcgcuccccuucagccggaccugggacgacuccuucaacaacaaggugcugguccuggggagcgagaaccagaagaagcgcaaccagaccccguacgaguaccucgacggcgccuccaacagccagcgguggcgcgaguuccaggcccggcugcagggcugccgcuucuccuacgccaagaagcagcggauccagaccgcgaagcuggacagcaagacggagcagggguuccucgagcgcaaccugaacgacacccgguacaucgcccgcuuccugugcggcuucaucgaggagaaccuccaccuccagggggagggcaagcggcgcguguucgccuccaacggccagaucaccgcccugcugcgggggcuguggggccugaagaaggugcgcgaggagaacgaccgccaccacgcccucgacgcgaucgucguggccugcagcaccgucuccaugcagcagaagaucacgaaggccaugcagcggcgcgagacccuggagaccguggacaccgagacgggggaggugaagacccggaucccccagcccugggacuucuuccgccaggaggucaugaugcggguguucagcgacacgccccacgaggagcuggccgagaagcucuccggccgcccggaggcccugcacgacuucgugagcccccuguucgucucccgggcgcccaaccgcaagaugaccgggcagggccaccucgagaccgucaagagcgccaagcggcugagcgagaacaucuccguggugcgcaagccccugaccgcccucaagcugaaggacaucgagaacaucgugggcuacccggaccgggagcccgcccuguaccaggcccuccgcgagcggcugcaggcguacaaggacgaccccgugaaggccuucgccgagccguucuacaagcccgccaagaacgggggccaggggagccuggucaaggcggugcgcgugaaggacguccagaagaccggcgugauggugcggaaggaccgcgggggcaucgcccggggcaucgccgacaacgccaccaugguccgcguggacguguucgggaagaagggcaagaacuaccucguccccguguacgccuggcaggucgcgaaggggauccugcccaaccgggccgugguggccuacgccgacgaggccgacugggacgagauggacgacuccuacgaguucaaguucacccuguacccgaacgaccucguggagaucaucagcaagaagggccgcaucuucggguacuacuccggccugaaccgcgcgacgggcgccaucgacaucaaggagcacgaccugagcaaggagaaggccaagaacgggauccaccaguccgucggcgugaagaccgugcucagcuuccagaaguaccaggucgacccccuggggaaggagaucugccugugcaagguggagaagcaccccgagcucaacuccaagaagaagaaguga

SEQ ID NO: 1536 - RNA, 3237 nt, Artificial Sequence
  Cas9 variant
augggcuaccugaucgggcucgacaucggcaucaccagcgugggguacgccguccugcagaccgacuucaagggcaaccccuacaagauccugcucaugaacacggugaucuucccgguggccgaggcgcccaagaccggggagucccuggccgcccccguccgccagaagcggagcucccgccggaccaaccgccggaccaaguuccgcaagcugcgggugcagaagcuguucgugcgcuucggccugcuggagagcgccgacgucgccacguuccucaaccagaaggugccccaccaggacaucuggcagcugcggaaggacgcgcugaaccgcaagcucuccaaccgggagcuguucgagauccuguacuucuucgugggccaccgcggguucaagagcaaccggcgcuccgaggucaccggcaagcagccgaaggacaaccagguggugcucaccagcauccacgaccgggggaacacccugaacgacuucgacucccugggcgagaugaugcaggagcuccccgaguucaagacgaucaagcacaacaaggccuaccgccccgacaacaccaucuacccccugcgggccuggaucgagcacgagcugagcgccaucuucuccguccagcagaagaacaaccgccagaucaccgacaacuucaucacccaguaccucgacaucuuccggagccagcgcgacuucgaccaggggccggcggcccccucccgguucggcggcaacaugaucgagcgcaugguggggcccgacagccuggacgcccacgagaagcgcgccgccaagcugacgaacaccuucuuccgguucaacuuccucuccacccugaacaaccugaagauccagcucacccugggcgcggaguuccacccccugacgaccccgcagcgcgagaucgugcuccaggccgccacccucaagagccugaacuacaagcagauccggcacaagcuccagcugcccgacuccgcccgcuucaaccugguccccuaccagagcaacgaggaccccaucaagaccgaguccaagcacuaccucuucaagcggaaggcccugacgcagaucgaggcggugaccgacaacccgcagcugaucgacaagaucgggaccauccucgccuacuucaagggcgacaagacccgccaggagaagcugagcgcccugaaccucagccgggccgagaucaagcagcugcugcccaucaaccagcccggcuucgggaaccucucccugaagacgaugcacaagauccugcccuaccucgagcagggccaccuguaccacgaggccgcgcagcuggccggguacgacuuccagaacaaccugguggaccgccaguaccuccgggacaaccugaagaacccggucgugaaccgcgccaucggcaagaccaucaagguggucaacgccaucaucaagaaguacggggaccccgacgccauccacaucgagcugacccgggagaucaagcacagccacgaggagcgccagaagaucgcgcggcagaugaacaccaacauggaccagaacgacaagguggccgagcaccuccgcgagaacggcauccccgugaacggccagaacaucaucaaguccaagcuguucuacgagcagaaggggaucgaccuguacagcggccagcagaucaacgagcaggaccucuacacggaggaccacuaccaggucgaccacaucauccccuacuccaucagcuucaacgacuccuucaccaacaagaccgugacccggacgagcaacaaccagaacaaggccaaccgccugccgcuggaguaccucuccgaggagaagcaggacgccuuccgggcgcgcgucaugagcaacaucuccaacuaccggaagcgccagaaccugcugaaggaggggaucaccgaggacaaccgccagcaguggaagacccggaacaucaacgacaccggcuacaucaaccgccuccugagccaguaccugcggaacaacgugcaguucacgaagaagucccacaaccccguguucaccgucaacggggccaccaccgccuacauccgcaagcgguacggcaucaucaagaaccgccaggccaccgaccuccaccacgccguggacgcggugaucaucggcugcaucagcaacacguucgucucccggcuggccaaguacagcgaggcccaggaggcccgcuaccacaagcagcuguggcagaucacccaguaccggcaggagcacaaggaccucuccaccaucgaguaccaggagcugaucaagcaguucccccugcccuggccggacuuccgccacgagcucauggcccggcugagcaccgaccccgcgaagaugauggcccaccacacgugggagcacuacaccgacgaggagaucucccagcugaagcccgccuucgugauccgcagcgccaaccacaaggugaccgggagcgcccacgacgacaccaucuacuccaagaagcucuacgaccagcggggcgucgggcugcugcgcacgagccuccagaaccugaaguacgacuccaagaaggacggcaucaagaacuacgagcggcugaaggacgggagcaacucccucguguacgacagccugcugcgcgcgcucaaggagcacgacggcaacgccaagaaggccuucccggacaaccagcugcugaucuccaccggcaaccaccagcagaucaucacccacgugaagaccgucaagaagaucacgcaccccaucgaggugaaccgggacaccgccaucgcgaucgggggccgcaugauccggguggacaucuucaagcaggccaaggcccagaagcucaucgggauccccgucuacgugaacgacaccgugaagcccacccugccgaaccgcgccugcacgagcggcaagcgguacuccgacugguaccagcugacccgccaggaccaguuccucugcagccuggucuccaacgaccuggugcucguggagaccgccagcccccugaaggucaccaacaacaucacgaacgaggaggugcagaccacccagcugcucugcuacuucuccagcuucaacaucgcgaacgcccagaucaacuuccacuccaucaacaacgacagcuccaucaaccccaucgugcugaacaaggucaccuaccugacgaaguaccagcucgacuaccugggcaacuacuuccccgugaagcacgagagccgcaagaccuucaaccggaagcgcuga

SEQ ID NO: 1537 - RNA, 3237 nt, Artificial Sequence
  Cas9 variant
augcacacccgccuggcccucgacaucggcaccacgagcaucggguggauccuguacgagcuggugaacggccagcccgccuccauccucgacgggggcacccggaucuucagcgacgggcgcgaggcgaagaccggccacucccuggccgucggccggcgcaccgcccgggggaugcgccggcgccgggaccgcuaccugcggcgccgggccgcccucaugaagcgccuggcggccaucggccugaugccggagagccccgaggccgccgcgcagcucgccacgcuggaccccuacgagcugcgggcccgcgggcucgaccacccccugccgcccgagcaccugggccgggcccucuuccaccugaaccagcgccggggguucaaguccaaccgccggaccgacaagggcaacaacgagggcgggaugaucgccgacgcgagcgcccgccuggagcaggccaugauggccgccggcgcgcgcuccuacggggaguuccuccacaagcggcgcgccgaggccaccgcgccccgggccacccccgccgugcgcacgcggaucaacccgcaccugaccggcgaggacggcaaggagcagcccggguacgacuucuaccccgaccgcaagcaccuggaggacgaguuccaccggcucugggaggcccaggcccgccacaaccccgaccugaccccggccaugggcgaccuccuguuccagaccaucuuccaccagcggccccugaaggcccccgcgguggggcgcugccuguuccucgacgagccccggcugccgaaggcccacccccugacgcagcagcgcacccucuacgagaccgucaacaugcugcggaucgccccgcccggccagcccaagcgccggcugagccgcgugcagcgggaccagaucgugcacgcccucaacaaccgcaagauccuggcgucccccgggaagaacguccugacccucgccgccaucggcaagcugcugaagcuccggcccggcgaggccuucagccuggacacggccaaccgcgacgcgaucgccugcgaccccgugcgcaugucccuggccuacgaggggcgguucggcccgcaguggagcgcccucuccguggagagccagugggagcugauccagcgccugcgggacgaccaggacggggccgcgcucgucgacuggaucauggaccgcuacggcuucgaccgggaccgcgcccgggccaucgccgacgcgccccugcccgagggguucggccgccugggcgagaccgccacccgggccgugcucgccgugcugaucgggggcaccacggagcaggagguccugaccuacuccgaggccguggcggccugcgggugggaccacagccgccugggcaccggggaggugcucgaccggcugcccuacuacggccagguccuggaccgccacgugcucccgggcaccgggcggcccgaggacgacgagaucacgcgcuucggccggaucaccaaccccaccgugcacaucgggcugggccaggucaagcgccuggugaacaaggugaucgacgccuggggccggccgcacgagauggucguggagcucgcccgcgaccugaagauguccgaggaccagaagcggaaccuggccaaggugaacgcgcagaaccagcgcgccgccgagaugcggagcgccaagcucaucggggaccugaagaucgaggacaacggccgcaaccgcgggauccugcgggucugggaggaguccgccgcggacgugcuccaccgcugcugccccuacaccggcgcccagaucagcgccagcaugcuguucgacggguccugcgacaucgaccacauccugcccuacagccggacgcucgacgacggcuucaacaaccgcgucaucugccugaaguccgccaaccgggagaagcgcaaccugacccccugggaggccuggggcaacaccccgaagugggcggccaucgaggccaaccucaagaaccugccgcccgccaaggcguggcgguucgcccccgacgccaugcugcgcuacgagggggagcgggacuucaccgcccgcgcccucguggacacgcaguaccugagccggcuggcgcgcgaguaccucgagugccuguacgccgaggacaucgaccccggcccccacuccgggaagaagccccggcgccccaucuggguggucaccggcaagcugaccgagcuccugcggcgccacugggggcugaacagccuccugccggacgcccaccggggcaccgccaaggccaagaaccgccuggaccaccggcaccacaugaucgacgcggccguggugggcgccacggaccacgccaccguccagcgcaucgccaacauggcgaaggggaacguggagaacggccucgaggaccuggccgggaccauccugccgcccuggcccggccuccgcgacgaccugaaggcccggcuggagcgcaccaucgugucccaccgggggaaccacggcgccaucgaccccgccgcgcgcaagcagggccgggacaccacgagcgggcagcuccacaacgacaccgccuacggccugaccggggagacccugaagggcgucccccucguggugaaccgcaagcccaucgacaugcugacgcccgccaugaucgacaagauccgggacccgcaccugucccgcuggcucaccgccgucaccaaggggaaggagggcaaggacuucaaggcggccguggaggccuuccgggcccaccccggccccuaccgcgggauccggcgcgugcggcugaucgagcccgucgaggugauccgcaucaaggaccggaacggccgcccguacaagggguacaagggcgacagcaaccagugcuacgagguguggugccugcccgaccggacccucacgcaccacgucguguccaccuucgccgcgcaccagggccagaccgggaagccccacccggccgccaagcgccuggcccggcuguacaagggcgacauggugcgccucgaccggagcaaguucggguccgucaucgccaccguggagaaguucgaccgcaacggccagcuggagcuggugccccacaacgaggggaacgcggaccagcgcuaccggaaggacaagagcgacuccgucuucauccgccuccgggccgccacguucaucgccagcggcgcccgccgggugaucguggacgagaugggccgcauccgggaccccgggcccggcaagcacuga

SEQ ID NO: 1538 - RNA, 3240 nt, Artificial Sequence
  Cas9 variant
augaaguacggcaucgggcuggacugcggcaucaacagcgugggguacugcaucauggagcucaacuccgacgacgagcccaagcgcaucguccggcugaacagccgcaucuucaccgaggccgagaacccgaaggacggcuccagccuggccgcgccccggcgcgaggcccgggggcuccgccggcgcauccggcgccacaagcaccggcuggagcgcauccgggcccugcucgugcgcgagaacaucgugacccaggccgagcuggacaacauguucuccggcacgcugagcgacaucuacgagcuccggaccgccgcgcuggacgcgccccugaacaacaucgaguucgcccgcguccucaucaaccuggcccagcggcgcggcuucaaguccaaccgcaagagcgagaaguccagcuccgacaaggagaccgggaagcugcucagcgcgaucaagaagaacaaggaguccaucgaggccggcggguaccggaccgugggcgagaugcuguucaaggacgagcgguacgccaagcacaagcgcaacaagggggaggccuaccugaacacggugagccgcgacaugaucgaggccgagauccacgcggucuucgccucccagcggaacuucggcaugcccuucgccaacgagaagaucgagaacgaguacaccgacaucgcccucagccagcgcccguucgaccugggccccggggagggccccgagaacugcaagucccccuacgccgggaagcagaucaagaacaugaucggccagugcaccuucuucccggaggagaagcgggcggugaaggccagcuacuccuuccagcuguucagccuccugcagggcaucaacaacaucacccuggugagcuccgacgggaacacguucccccucagccaggagcagcgcaagacccugaaggacuacugcuucaagaccgccaacgucaccuacgccuccauccggaaggugcugcagaucccccaggaguacacguucaagaacaucaccuacaccgacgacggcaucgagaaguccgagaagaagaccaaguuccagcaccucaagcccuaccacgagaugaagaaggugcuggggagcgccauccagacgcugaccccggaggagcucgacgagaucggcgagaucuucaccuucuacaaggacgagaccaucaucaucaagcagcuggaggagacggagaucgacaagagccuguacgaccuccugcugcagcuccccaccuucgagaaggcggggcacaucuccaccaaggccugcaagaugaucauccccuuccuggaggagggcaagaccuacgacaaggccugcgagugcgccggccugaacuucaaggcccacacgaacaugcagaagcagaugcuccugcccgccaagagcgacgagcugaacgacgucgugaacccggugguccgccgggccaucucccagaccaucaagguggugaacgccaucauccgcgagauggggaccagccccaccuacaucaacaucgagcucgcccgggagcuguccaagagcaagaaggagcgcgacgagaucaacaagaaguacaagcugaaccaggcggagaacgagcggcucaagaacgagaucaucgacaacuucaagaucaagcccaacggccaggacaucaucaagcugaagcuguggcacgagcaggacgacgggaucugccccuacacgggcguccgcaucaaguacgagaaccucuucgacgacggguacgccgagaucgaccacaucaucccguacucccugagcuucgacgacuccuucaacaacaagauccugaccaccgccacccagaaccggcagaagggcaaccgcaucccccuggaguaccuccccgagagcgagaaggacggcuuccgggugugggugaacuccaacauccgcaaccaccggaagcgccagaaccugcugaaggagcacuucacggaggccgacaagaaggaguucaagagccggaaccucaacgacacccgcuaccugaacaagcugcuccugaacuacaucaacgacaaccuccuguucaccgacuucuacaacgggaagaagaagcacgucaccuccgugaacggcgccgugacggcguacauccgcaagcggugggggaucaacaagaaccgcgaggacggcgaccugcaccacgccgucgacgccgccgugaucgccugcgucacccaggggaucaucaaccggaucaccgcguacagcgcccgcaacgaggcccccuacgaccugaacaccgagaccggcgagaucaaggagcgguucccgcuccccuaccccaacuucaagaaggagcuggacgcccgcacgaccaucgaggacgagaagcggcugaagcgcgugcucaugagcuucuccaacuacagcuacgacgacguggagaaggccaagcccugcuucgucucccggaccccgcaccgcaaggugaccggcgcggcccacgaggagacgauccggagcgggaagguggagggcuucaccgucuccaagaccgagcugaccaagcugaagcucacgaacggggagaucgagggcuacuacgagcccgagagcgacacccugcuguacaacgcccuccugcagcgccugaacgaguucggcggggacgccaaggcggccuucgccgacgaguuccacaagcccaaggccgacggcaccccggggcccguggugaagaaggucaagaccaucaagcgguccagcuccaacgugaaggcccgcaacaagaacggccucgggguggcggacaacggcagcaugauccggaucgacgucuucuacguggagaacgagggcuacuacuucgugcccaucuacgucgccgacacggugaaggagaugcccaacgaggccugcccguucgggaaggacaagaagaagaucaugaccgacgacgacuuccuguucucccuguaccccaacgaccucaucaagaucaccgccaagaaggacaugaaguucagccuggccaacaaggaguccggccugcccaagaacaaguacgcgaacgaggugcucgucuacuacagcgccgccgacaucuccaacgccagcaucuccgugaucaugcacgacaacgccuacaaguuccgcgggugcggcaucaagagccuggugaagcuggagaaguacaccgucgacccccucgggaacgugagcaaggugaaccgggagaagcgcauguacuucaaguga

SEQ ID NO: 1539 - RNA, 3240 nt, Artificial Sequence
  Cas9 variant
augcgccugggccucgacaucgggaccagcuccaucggcugguggcuguacgagaccgacggggccggcagcgacgcccggaucacggggguggucgacggcggcgugcgcaucuucuccgacgggcgggaccccaagagcggcgcgucccuggccguggaccgccgggccgcccgcgccaugcggcgccggcgcgaccgguaccuccgccggcgcgcgacccugaugaagguccuggccgagaccgggcucaugccggccgaccccgccgaggcgaaggcccuggaggcccuggaccccuucgcccuccgggccgcgggccuggacgagccccugccgcucccccaccuggggcgcgcccuguuccaccucaaccagcggcgcggcuucaagagcaaccggaagaccgaccgcggcgacaacgaguccgggaagaucaaggacgccacggcccggcuggacauggagaugauggccaacggcgcgcgcaccuacggggaguuccugcacaagcgccggcagaaggccaccgacccccgccacgugcccagcgugcggacccgccucuccaucgccaaccggggcggcccggacgggaaggaggaggccggcuacgacuucuaccccgaccgccggcaccuggaggaggaguuccacaagcugugggccgcgcagggggcccaccaccccgagcucacggagacccugcgcgaccuccuguucgagaagaucuucuuccagcggccccugaaggagccggaggucggccugugccucuucagcgggcaccacggcgugccgcccaaggacccccgccugcccaaggcccacccccugacccagcggcgcgugcucuacgagaccgucaaccagcugcgggugacggccgacggccgcgaggcccggccccugacccgcgaggagcgggaccaggugauccacgcgcucgacaacaagaagcccaccaagucccugagcuccaugguccugaagcucccggcccuggccaaggugcugaagcuccgcgacggggagcgguucacccuggagacgggcgugcgcgacgccaucgcgugcgacccccugcgcgccagccccgcccaccccgaccgguucgggccgcgcugguccauccucgacgccgacgcccagugggaggucaucagccggauccgccgggugcaguccgacgcggagcacgccgcccugguggacuggcugaccgaggcccacggccucgaccgcgcccacgcggaggccaccgcccacgcgccccugcccgacggguacggccggcugggccucaccgccacgacccgcauccuguaccagcugaccgccgacgucgugaccuacgccgacgccgugaaggccugcggguggcaccacagcgacggccggacgggggagugcuucgaccgccugcccuacuacggcgagguccucgagcggcacgugaucccgggguccuaccaccccgacgacgacgacaucacccgcuucggccggaucaccaaccccaccgugcacaucggccugaaccagcugcgccggcucgucaaccgcaucaucgagacgcacgggaagccgcaccagaucguggucgagcuggcgcgggaccugaagaaguccgaggagcagaagcgcgccgacaucaagcggauccgcgacaccaccgaggccgccaagaagcggagcgagaagcucgaggagcuggagaucgaggacaacggccgcaaccgcaugcugcuccggcugugggaggaccugaaccccgacgacgccaugcgccgguucugccccuacaccgggacgcgcaucagcgcggccaugaucuucgacggcagcugcgacguggaccacauccuccccuacucccggacccuggacgacagcuucccgaaccgcacccugugccuccgggaggccaaccgccagaagcggaaccagacccccuggcaggccuggggcgacacgccccacuggcacgccaucgcggccaaccugaagaaccugcccgagaacaagcgcuggcgguucgccccggacgccaugacccgcuucgagggggagaacggcuuccucgaccgggcccugaaggacacccaguaccuggcgcgcaucucccggagcuaccucgacacccuguucaccaagggcgggcacgugugggucgugcccgggcgcuucacggagaugcugcggcgccacuggggccucaacucccugcugagcgacgccggccgcggggccgugaaggccaagaaccggaccgaccaccgccaccacgcgaucgacgccgccgucaucgccgccaccgaccccggccuccugaaccggaucucccgcgcggccgggcagggcgaggccgccgggcagagcgccgagcugaucgcgcgggacacgcccccgcccugggagggcuuccgcgacgaccuccgggugcgccuggaccggaucaucgugucccaccgcgccgaccacggccggaucgaccacgccgcccgcaagcaggggcgggacagcaccgccggccagcugcaccaggagaccgcguacuccaucgucgacgacauccacguggccagccgcaccgaccuccugucccugaagcccgcccagcuccuggacgagcccgggcggagcggccaggugcgcgacccgcagcugcggaaggcccuccgcgucgccaccgggggcaagacgggcaaggacuucgagaacgcgcugcgguacuucgccuccaagcccgggcccuaccaggccauccgccgggugcgcaucaucaagccccugcaggcccaggcgcgggugccgguccccgcccaggaccccaucaaggccuaccagggcgggagcaaccaccucuucgagaucuggcgccugcccgacggcgagaucgaggcccaggugaucaccuccuucgaggcccacacccuggagggggagaagcgcccgcaccccgcggccaagcggcuccugcgcgugcacaagggcgacauggucgcccuggagcgggacggccgccgggugguggggcacguccagaagauggacaucgccaacggccucuucaucgugccccacaacgaggccaacgcggacacccgcaacaacgacaagagcgacccguucaaguggauccagaucggggcccggcccgccaucgccagcggcauccgccggguguccgucgacgagaucggccgccugcgggacgggggcacgcgccccaucuga

SEQ ID NO: 1540 - RNA, 3240 nt, Artificial Sequence
  Cas9 variant
auggacgaggaggccaagauccagcugagcaaggaguccuacgaggaggagcucgagagccugcuggagaaguccggcgaggaguuccgcgacguguuccuccaggccaagaaggucuacgacgcgauccugcugagcgacauccucuccaccaagaagcagaacagcaaggccaagcugucccuggggaugaucgagcgguacgacagccacaagaaggaccucgaggagcugaagcaguucgugaaggccaaccugcccgagaagaccgccaucuucuucaaggacuccagcaagaacggcuacgccggguacaucgacggcaagacgacccaggaggacuucuacaaguuccucaagaaggagcugaacgggaucgcgggcuccgagcgcuucauggagaagguggaccaggagaacuuccugcucaagcagcggaccaccgccaacggcgucaucccgcaccaggugcaccugacggagcugaaggccaucaucgagcgccagaagcccuacuaccccuuccucgaggaggcccgggacaagaugauccgccugcugaccuuccggauccccuacuacguggggccgcucgcgcagggcgaggagaccagcuccuucgccuggcuggagcgcaagacccccgagaaggucacgcccuggaacgccaccgaggugaucgacuacagcgccuccgccaugaaguucauccagcggaugaucaacuacgacaccuaccugcccaccgagaaggugcucccgaagcacagcauccuguaccagaaguacacgaucuucaacgagcugaccaaggucgcguacaaggacgagcgcgggaucaagcaccaguucuccagcaaggagaagcgggagaucuucaaggagcuguuccagaagcagcgcaaggugaccgugaagaagcugcagcaguuccuguccgccaacuacaacaucgaggacgccgagauccucggcgucgacaaggccuucaacagcagcuacgccaccuaccacgacuuccuggaccuggcgaagcccaacacggagcggguggccgagcuccuggagcagcccgagaugaacgccauguucgaggacaucgugaagauccugaccaucuucgaggaccgcgagaugauccggacccagcucaagaaguaccaguccguccugggggacggcuucuucaagaagcuggugaagaagcacuacaccggcugggggcgccucagcgagcggcugaucaacggcauccgcgacaagaagacgaacaagaccauccuggacuaccucaucgacgacgacgacuuccccuacaaccggaaccgcaacuucaugcagcugaucaacgacgacucccugagcuucaaggaggagcucgccaacgagcuggcccuggcggggaaccagucccuccuggagguggucgaggcccugccgggcagccccgccaucaagaagggcaucuggcagacccugaagaucguggaggagcucaucgagaucaucggguacaaccccaagaacaucguggucgagauggcccgggagaaccagcgcaccaaccgcuccaagccccggcugaaggcccuggaggaggcgcucaagagcuucgacuccccgcugcugaaggagcagcccguggacaaccaggcccuccagaaggaccgccuguaccuguacuaccuccagaacggcaaggacauguacacgggggaggcccuggacaucgaccggcugagcgaguacgacaucgaccacaucaucccccgcuccuucaucguggacaacagcaucgacaacaagguccucguguccagcaaggagaaccggcugaagauggacgacguccccgaccagaagguggugauccgcaugcggcgcuacugggagaagcugcuccgggccaaccugaucuccgagcgcaaguucgcguaccugaccaagcucgagcugaccccggaggacaaggcccgguucauccagcgccagcuggucgagacccggcagaucacgaagcacguggccgccauccucgaccaguacuucaaccagcccgaggagagcaagaacaagggcauccgcaucaucacccugaaguccagccuggugucccaguuccggaagaccuucgggauccacaagguccgcgagaucaacaaccaccaccacgcccacgacgcguaccucaacggcgugguggccaucgcccugcugaagaaguaccccaagcucgagcccgaguucgucuacggcaacuacaccaaguucaaccuggccacggagaacaaggccaccgcgaagaaggaguucuacagcaacauccugcgguucuucgagaaggaggaguacagcuacgacgagaacggggagaucuucugggacaaggcccgccacaucccgcagaucaagaaggugaucuccagccaccaggugaacaucgucaagaagguggaggugcagaccggcggguucuacaaggagaccgucaaccccaagggcaagcccgacaagcucauccagcggaaggccgggugggacguguccaaguacggcggcuucgggagccccguggucgccuacgccguggcguucaucuacgagaagggcaaggcccgcaagaaggccaaggccaucgaggggaucacgaucaugaagcagucccuguucgagcaggacccgaucggcuuccugagcaacaagggguacuccaacgugaccaaguucaucaagcucagcaaguacacccuguacgagcuggagaacggccgccggcgcauggucgcgucccacaaggaggcccagaaggccaacagcuucauccuccccgagaagcuggugacccuccucuucuacgcccagcacuacgacgagaucgcccacaaggaguccuucgacuacgugaacgaccaccugagcgaguuccgggagauccuggaccaggucaucgacuucuccaaccgcuacaccaucgcggccaagaacacggagaagaucgccgagcuguucgagcagaaccaggagagcaccgugcagucccucagccaguccuucaucaaccugaugcagcucaacgccaugggcgcccccgcggacuucaaguucuucgacgugaucaucccgcggaagcgcuaccccagccugaccgagaucugggagagcaccaucaucuaccaguccaucacggggcugcgggagacccgcacccggauggccacccucugggacggcgagcaguga

SEQ ID NO: 1541 - RNA, 3240 nt, Artificial Sequence
  Cas9 variant
auggacgaggaggccaagauccagcugagcaaggaguccuacgaggaggagcucgagagccugcuggagaaguccggcgaggaguuccgcgacguguuccuccaggccaagaaggucuacgacgcgauccugcugagcgacauccucuccaccaagaagcagaacagcaaggccaagcugucccuggggaugaucgagcgguacgacagccacaagaaggaccucgaggagcugaagcaguucgugaaggccaaccugcccgagaagaccgccaucuucuucaaggacuccagcaagaacggcuacgccggguacaucgacggcaagacgacccaggaggacuucuacaaguuccucaagaaggagcugaacgggaucgcgggcuccgagcgcuucauggagaagguggaccaggagaacuuccugcucaagcagcggaccaccgccaacggcgucaucccgcaccaggugcaccugacggagcugaaggccaucaucgagcgccagaagcccuacuaccccagccucgaggaggcccgggacaagaugauccgccugcugaccuuccggauccccuacuacguggggccgcucgcgcagggcgaggagaccuccagcuucgccuggcuggagcgcaagacccccgagaaggucacgcccuggaacgccaccgaggugaucgacuacuccgccagcgccaugaaguucauccagcggaugaucaacuacgacaccuaccugcccaccgagaaggugcucccgaagcacuccauccuguaccagaaguacacgaucuucaacgagcugaccaaggucgcguacaaggacgagcgcgggaucaagcaccaguucagcuccaaggagaagcgggagaucuucaaggagcuguuccagaagcagcgcaaggugaccgugaagaagcugcagcaguuccugagcgccaacuacaacaucgaggacgccgagauccucggcgucgacaaggccuucaacagcuccuacgccaccuaccacgacuuccuggaccuggcgaagcccaacacggagcggguggccgagcuccuggagcagcccgagaugaacgccauguucgaggacaucgugaagauccugaccaucuucgaggaccgcgagaugauccggacccagcucaagaaguaccagagcguccugggggacggcuucuucaagaagcuggugaagaagcacuacaccggcugggggcgccucuccgagcggcugaucaacggcauccgcgacaagaagacgaacaagaccauccuggacuaccucaucgacgacgacgacuuccccuacaaccggaaccgcaacuucaugcagcugaucaacgacgacagccuguccuucaaggaggagcucgccaacgagcuggcccuggcggggaaccagagccuccuggagguggucgaggcccugcugggcuccccggccaucaagaagggcaucuggcagacccucaagaucguggaggagcugaucgagaucaucggguacaaccccaagaacaucguggucgagauggcccgggagaaccagcgcaccaaccgcagcaagccccggcugaaggcccucgaggaggcgcugaaguccuucgacagcccccugcucaaggagcagccgguggacaaccaggcccugcagaaggaccgccuguaccucuacuaccugcagaacggcaaggacauguacacgggggaggcccuggacaucgaccggcucuccgaguacgacaucgaccacaucaucccccgcagcuucaucguggacaacuccaucgacaacaagguccuggugagcuccaaggagaaccggcugaagauggacgacguccccgaccagaagguggugauccgcaugcggcgcuacugggagaagcuccugcgggccaaccugaucagcgagcgcaaguucgcguaccucaccaagcuggagcugacccccgaggacaaggcccgguucauccagcgccagcucgucgagacccggcagaucacgaagcacguggccgccauccuggaccaguacuucaaccagccggaggaguccaagaacaagggcauccgcaucaucacccucaagagcucccucgugagccaguuccggaagaccuucgggaucaacaagguccgcgagaucaacaaccaccaccacgcccacgacgcguaccugaacggcgugguggccaucgcccugcucaagaaguaccccaagcuggagcccgaguucgucuacggcaacuacaccaaguucaaccuggccacggagaacaaggccaccgcgaagaaggaguucuacagcaacauccuccgguucuucgagaaggaggaguacuccuacgacgagaacggggagaucuucugggacaaggcccgccacaucccccagaucaagaaggugaucagcucccaccaggugaacaucgucaagaagguggaggugcagaccggcggguucuacaaggagaccgucaacccgaagggcaagcccgacaagcugauccagcggaaggccgggugggacgugagcaaguacggcggcuucgggucccccguggucgccuacgccguggcguucaucuacgagaagggcaaggcccgcaagaaggccaaggccaucgaggggaucacgaucaugaagcagagccuguucgagcaggaccccaucggcuuccucuccaacaagggguacagcaacgugaccaaguucaucaagcuguccaaguacacccuguacgagcucgagaacggccgccggcgcauggucgcgagccacaaggaggcccagaaggccaacuccuucauccugccggagaagcuggugacccuccuguaccacgcccagcacuacgacgagaucgcccacaaggagagcuucgacuacgugaacgaccaccuguccgaguuccgggagauccucgaccaggucaucgacuucagcaaccgcuacaccaucgcggccaagaacacggagaagaucgccgagcuguucgagcagaaccaggaguccaccgugcagagccugucccagagcuucaucaaccucaugcagcugaacgccaugggcgcccccgcggacuucaaguucuucgacgugaucaucccccggaagcgcuacccgagccugaccgagaucugggaguccaccaucaucuaccagagcaucacggggcuccgggagacccgcacccggauggccacccugugggacggcgagcaguga

SEQ ID NO: 1542 - RNA, 3243 nt, Artificial Sequence
  Cas9 variant
augaagaccagcuucgccuucgacaucggcaccaacagcaucggguggugcgugcuggcccucgacaacgcgaaccugcccuaccgcauccuggacgccggcguccggaucuucagcgacgggcgcgagccgaaguccggcacgagccucgccgaggggcggcgccuggcccggggcaugucccgccggcgcgaccgguacaagcgccggcgcaaggccgugauccggacccugaucgaguacggccucaugcccgacgaccccgcggcccgccgggcccugguggccgagaccaacgacaaggcgcccgggaagaucgccagcgacgucuacgcccugcgcgcccgggcccucgacgacaagcugccgcugcaccacaucggccgcgcccucuuccacaucaaccagcggcgcggguucaaguccaaccggaagaccgacaagcgcgacaacgaccagggcaagaucgccagcgggaucucccgccugcgggacaagcuggccagcgagggcaugcgcacgcucggcgaguaccugaaccaccggcaccaggccgggaacugggugcgcgugcggcccucccgcguccccggcaaggacgacaaggaggaggacggguacggcuucuaccccgagcgggcccugcuccaggacgaguucaacgcgaucuggaccgcccaggccgcccacuacccggacgugcugaccgaggagcgccggacccaccuggagacgaucaucuucuuccagcgcccccucaagcccgugcaggucggcaagugcagcuucaaccccggggaggagcggcugccgcgcgcccacccccuguuccaggaguuccggcucuacaaggaggugaacgagcuggagcugguggaccgcaaccaggaccaccacaagcucucccuggaccagcgggacgcgcugaucgcccagcucaagacccagcgcgaggccgccuacagcgcccugcggaagaccgcgcgcgcgccccugggcacccgguucaacaaggagacggagucccgcaccaagaugaagggggacgaggucgccgccgagcucagcgcgaagacccgcuucggccaggccuggaucuccaugccccuggaggagcgguggaucaucguggacacccugcgccggguggaggacccgcucgagcugacggccuggcuggagcagcacuacgggcucgacggcgagcacaucgacgccauccuggccgcgcgccugcccgagggcuacgggcggcucggcgagaccgcccugaccgagauccuggucgagcucaaggccgccgugaucagcgaggccgaggcggcccgccgggccggguacgaccacgcccugcugcagcgcggcgccgggcucgaggcgcugcccaaguaccaggaggugaucgcccggcgcaucccgcccggcaccggcaaccccgacgaccccuacgacgucgagaaggggcggaucacgaaccccaccgugcacaucggccugaaccagcugcagaaggugcucaacgcccugauccgccgguacgggaagccggagcagaucgccaucgagcuggcgcgcgagcucaagcugaacgacgagcagaagcgggagaagaacaucgagaucgcccgcaacacccgggccgccgagcagcgcuccgccaagcuggucgagcucggcgugcccgacaccggguacaaccgggugcugcugaagcucugggaggagcugaaccugcgcgcgcccgagaaccgggucugcaucuacugcggcgagcccaucaacaucgagacccucuucagcagcgccguggacaucgaccacauccugccgugguccaagacgcuggacgacagccaggccaaccgccucgucugccacguggccugcaaccgccagaaggccaacuacgcgcccgccgaggugccccaguggcagggccgguacgacgacauccuggcccgcgccaacacccugccgcucaacaagcgguggcgcuucgggcgggacgccaugaagaaguucgcggacgaggagaccuuccuggcccgccagcugacggacacccaguaccucucccggcuggcccacgccuacauggcggcccuguaccccgacgaggagcccgacgcccagggcguccucgcccgcaagaaccacgugcgggugaucaccgggcgcaugaccgagaugcugcggcgccaguggggccugaacagccuccuggccgaccacaaccagaagaaccggaacgaccaccgccaccacgcgaucgacgccgccgucgugggcgugacgacccgggcccugcuccagcgcaucgccaccgucgccgggggccgggaggcccaggcccuggaggagaccaucgggaagaucgagcccccguggcccggcuuccgcgacgagcugcaggccgugaucaagcggaucguggucucccacaagcccgaccacgggacgcuccccaagccgggccagggcgggcagaccgccggccagcugcacaacgacaccgcguacgggcugaccggcgagaccgacagccgcgggacgcccaucguggugcgccggaagcccuucaccucccucaccgagaaggaccugcccagcauccgcgaccggcagcuggcccaggcccucggcuccgccaucgccggccgcagcgggaaggagcugcaggcggcccuggagcaguuccgggaccgcgacgacuacaaguccauccggcacguccgcgugguggagccgcucaacgucauccccauccgggacggcaccgggcgcgccuacaaggccuacaagggcgacgcgaacuaccgguacgacgugugggagcugcccaacgggaaguggaugcacgagguggucagcauguucgacgcccacgaccgcuccuggacgagcgccgugcacauccaccaccccgccgcccggcgcgugcugucccucaagcagaacgacauggucgcguacgaccacccgcaggacggccccaccaucggccggguggugaaguucagccaguccgggcagaugaccuucgcgccccacaaggaggccggcgcccugaaggcccgcgacgcggaccccgaggaccgguuccgcuacuucuacaagagcggguccgccaugaaggacaucggccugcggcagguccgcguggacgagaucgggcggguguucgacccgggcccccgcgacaaggaggcccgcaacgcccggaagaagaaguccaccgacuga

SEQ ID NO: 1543 - RNA, 3243 nt, Artificial Sequence
  Cas9 variant
auggccaagagcuucgccuucgacaugggcaccaacuccaucgggugggcggugcugggccucgacagcgccggggaccccgacuccaucgagggcgccgggguccgcaucuucagcgacggccgggagccgaaguccggcgccagccuggccgaggggcgccggaucgcgcgcggcaugucccggcgccgggagcgcuacaaggcccggcgcaaggcccugauccggacccucggggacuacggccugaugccccuggagcgcgccgcgcggcgcgcccucguggccgagacgaacgaccggagcuucgggcugguggcccaggacgucuacgcccugcgcgcgcgggcccucguggagaagcugccgcccuaccaccugggccgcgcccucuuccaccugaaccagcggcgcggcuucaaguccaaccggaagaccgacgggcgcgacaacgagcugggcaugaucgccaccgggaucgccgcgcucgacgcccagcugaacggccgcacccugggccaguaccuccacgagaugcgcggggccgacccccggcagcggggccaggugcgcguccggccccaccuggagaucaacgacaaggggcgcgagaucgccgccuacggcuucuacccccagcgggcgaugcuggagcgcgaguucaacgccaucugggccgcccaggcgccccaccacccggagcuccugagcgaggagcggcgcgcccaccuguuccaggugaucuucuaccagcggccccucaagcagcccgaccccgggcgcugcuccuucaacccggccgagccccggcuggccaaggcccacccccuguuccagcgcuuccggcucgugaaggagaucaacgagcugcgcaucgucacgggcagcaacucccagggcgugccccugacccucgagcagcgggacauccugcugacccuccugcgcgacaagaaggcgagcuccuucaagacccugcucgccaagaucaucaaggggcagccggaggcccgguucaacaaggccagcgacucccgcgacaagaugaagggcgacgagcuggccgcgacgaugagcgacaagacccgcuucgggcaggccugguucgccaugcccgaggccgagcaguggcggaucaucgccaagcugcgcgacaucgacgacccccucgagcugaacgcguggcuggaguccgaguacggccucgcccccgagcggcgcgacgccguggccaacgcccugcugccgcagggguacggccggcucggcgagaccgcgcugcgcaccaugcuggacuaccucgaggccgccgucaucagcgaggccgaggcggccgcccaggccggguacgaccacgcccuggcgcggcgcggcgccgggcuggaccagcugcccaaguaccaggaggugcucggccggcgcaucccgcccgggagcggcgagcccaacgaccccuacgacauccggaugggccgcaucuccaaccccacggugcacaucgcccugaaccagcugcggcgcgucgugaacgcccucauccggaaguacgggaagcccgccgagaucgcgaucgagcuggcccgcgaccugaagcucagcgaggagcagaagcgggaggugaacgccaccaucgccaagaacacccgcgacgccgagcggcgcgcgguccggcuggccgacgagggcaucgacaacaccgggcacaaccgcgcccugcuccgcuucugggaggagcuggccgcggacccgcuggaccgggugugcguguacugcggcggcgggaucggcgccgccucccucuucaacgggagcgucgacaucgaccacauccugcccuggucccgcacgcuggacgacagccgggccaaccgcauccucgugcacaacuccugcaaccggcugaagcgcaacuucgcccccuucgaggugccggaguggcgggagaucuaccaggacauccugguccgcgcggccaagcuccccgccaacaagagcuggcgguucgcccccgacgccauggaccgcuucgagggcgagaaggacuuccuggcgcggcagcugaccgacacccaguaccucgcccgcauggcccacgaguaccuggccgcccuguaccccgacgaggagccggacgaguggggcguguucgcgcgggggaaccacguccgcguggugcccggccggcucaccgagaugcugcgccgggccugggggcugaacgccauccucuccgacgacaaccgcaagaaccggaacgaccaccgccaccacgccaucgacgccgucguggugggcgucacgacccgcgacaugcugaacaagaucagccaggcggccgggcggggcgccgacaugggggccgcggacgcccugcgccgguucgacccgcccuggcccuccuuccaccaggccgugcgcgccgccguggagcggauccucgucagccaccgcgcggaccacggcacccugcccggcaccgacgggcagggcuccacggccgggcagcugcacaacgacaccgccuacggccucaccggggagacccggaagggccuggccguggugguccgccggaagcccuaccugagccucgagccccgcgacaucgagacgauccgggacccgcagcugcgcgaccaccuggccaccgagaccuacggccucgcgggggccgaguucaccgccgcccugaagcggcugcagcagacggacaaguucuacgccggcauccgccgggugcgcgugaccgaggcgcucuccgucauccccauccgggacgccaccgggcacgccuacaaggccuacaagggcgacgcgaacuuccgcuacgacgugugggagcugcccaacgggaagugggugcccgaggucaucagcauguucgacgcccacgaccggggcugggugucccaggugcacgccgccaacccggccgcgcgccggguccugagccuccgccagaacgacaugguggccuaccagcaccccgagcagggccugguguacgggcgcgucgugaaguucggccaguccgggcagaugaccuucgccgcccaccacgagggcggcagccucaagagccgggacgccgaccgcgacgaccccuucaaguacuucuacaaguccgcggggacgaugaaggacaucggccugcggcagauccgcguggacgagaucgggcggguccaggaccccggcccgcaggaccgcgacagcaagcgggugcgcaaguccgaccgguga

SEQ ID NO: 1544 - RNA, 3246 nt, Artificial Sequence
  Cas9 variant
auggccgccuucaagcccaacccgaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccauggcccgccggcuggcgcgcagcgugcggcgccugacccggcgccgggcccaccgccuccugcgggcccgccggcugcucaagcgcgagggggugcugcaggccgcggacuucgacgagaacggccugaucaagucccuccccaacacgccguggcagcugcgggccgccgcccuggaccgcaagcucacgccccuggaguggagcgccguccugcuccaccugaucaagcaccggggcuaccugucccagcgcaagaacgagggggagaccgcggacaaggagcucggcgcccugcugaaggggguggccgacaacgcccacgcccuccagaccggcgacuuccggacccccgcgaagcuggcccugaacaaguucgagaaggagagcgggcacauccgcaaccagcggggcgacuacucccacaccuucagccgcaaggaccuccaggccgagcugaaccuccuguucgagaagcagaaggaguucggcaacccccacaucuccgacgggcugaaggagggcaucgagacccugcucaugacccagcgcccggcccugagcggggacgccgugcagaagaugcugggccacugcacguucgagcccaccgagcccaaggcggccaagaacaccuacaccgccgagcgguucgucuggcucacgaagcugaacaaccugcgcauccucgagcagggcuccgagcagccccugaccgacacccagcgggccaagcugauggacgagccguaccgcaagagcaagcucaccuacgcccaggcgcggaagcugcuggggcucgaggacacggccuucuucaagggccugcgcuacgggaaggacaacgccgaggccuccacccugauggagaugaaggcguaccacgccaucagccgggcccucgagaaggagggccugaaggacaagaaguccccgcugaaccugagccccgagcuccaggacgagaucgggaccgccuucucccuguucaagaccgacgaggacaucacgggccgccugaaggaccgggugcagcccgagauccucgaggcccugcugaagcacaucagcuucgacaaguucgugcagaucucccucaaggcgcugcgccggaucgucccccugauggagcagggcaagcgcuacaacgaggccugcgccgagaucuacggggaccacuacggcaagaagaacaccgaggagaagaucuaccucccgcccauccccgccgacgagauccggaaccccguggugcugcgcgcccugagccaggcgcggaaggucaucaacgggguggugcgccgguacggcagccccgcccgcauccacaucgagaccgcccgggaggucgggaaguccuucaaggaccgcaaggagaucgagaagcgccaggaggagaaccggaaggaccgcgagaaggccgccgcgaaguuccaggaguacuuccccaacuucgugggcgagcccaagagcaaggacauccucaagcugcggcuguacgagcagcagcacggcaagugccucuacuccgggaaggagaucaaccugggccgccugaacgagaagggguacguggagaucgaccacgcccucccguucagccggaccugggacgacuccuucaacaacaagguccuggugcugggcagcgagaaccagaacaaggggaaccagacgcccuacgaguacuucaacggcaaggacaacucccgcgaguggcaggaguucaaggcccggguggagaccagccgcuucccccgguccaagaagcagcgcauccuccugcagaaguucgacgaggacggcuucaaggagcggaaccugaacgacacccgcuacgucaaccgguuccucugccaguucguggccgaccgcaugcggcugaccgggaagggcaagaagcgcgucuucgcgagcaacgggcagaucacgaaccugcuccggggcuucuggggccugcgcaaggugcgggccgagaacgaccgccaccacgcccuggacgccguggucguggccugcuccaccguggcgaugcagcagaagaucacccgguucguccgcuacaaggagaugaacgccuucgacgggaagaccaucgacaaggagacgggcgaggugcuccaccagaagacccacuucccccagccgugggaguucuucgcccaggaggugaugauccgcgucuucgggaagcccgacggcaagcccgaguucgaggaggccgacaccccggagaagcugcggacccugcucgccgagaagcugagcucccgccccgaggcggugcacgaguacgugacgccccuguucgucagccgggcccccaaccgcaagauguccgggcagggccacauggagaccgucaagagcgccaagcggcucgacgagggcguguccgugcugcgcgugccgcugacccagcucaagcugaaggaccuggagaagauggugaaccgggagcgcgagcccaagcucuacgaggcccugaaggcccggcuggaggcgcacaaggacgaccccgccaaggccuucgccgagcccuucuacaaguacgacaaggcggggaaccgcacccagcaggucaaggccgugcggguggagcagguccagaagaccggcgugugggugcgcaaccacaacgggaucgccgacaacgccacgaugguccggguggacguguucgagaagggcgacaaguacuaccucgucccgaucuacagcuggcaggucgccaaggggauccugcccgaccgcgcggugguggccuacgccgacgaggaggacuggaccgugaucgacgaguccuuccgguucaaguucgugcuguacagcaacgaccucaucaagguccagcugaagaaggacagcuuccugggcuacuucuccggccucgaccgcgccaccggggccaucagccugcgggagcacgaccuggagaaguccaagggcaaggacgggaugcaccgcaucggcgugaagaccgcgcucagcuuccagaaguaccagaucgacgagauggggaaggagauccggcccugccgccugaagaagcggcccccggugcgcuga

SEQ ID NO: 1545 - RNA, 3246 nt, Artificial Sequence
  Cas9 variant
auggccgccuucaagcccaaccccaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccgccgcgcgccggcuggcccgcagcgugcggcgccugacccggcgccgggcccaccgccuccugcgggcccgccggcugcucaagcgcgagggggugcugcaggcggccgacuucgacgagaacggccugaucaagucccuccccaacacgccguggcagcugcggagcgccgcccuggaccgcaagcucacgccccuggagugguccgccguccugcuccaccugaucaagcaccggggcuaccugagccagcgcaagaacgagggggagaccgcggacaaggagcucggcgcccugcugaaggggguggccgacaacgcccacgcccuccagaccggcgacuuccggacccccgcggagcuggcccugaacaaguucgagaaggaguccgggcacauccgcaaccggcgcggcgacuacagccacaccuucucccgcaaggaccuccaggccgagcuggaccuccuguucgagaagcagaaggaguucggcaacccccacaucagcgacgaccugaaggaggggaucgagacccugcucaugacccagcggccggcccuguccggcgacgccgugcagaagaugcuggggcacugcacguucgagcccaccgagcccaaggcggccaagaacaccuacaccgccgagcgcuucgucuggcucacgaagcugaacaaccugcggauccucgagcagggcagcgagcgcccccugaccgacaccgagcgggccacccugauggacgagccguaccgcaaguccaagcucacguacgcccaggcgcggaagcugcuggagcucgacgacaccgccuucuucaagggccugcgcuacgggaaggacaacgccgaggccagcacccugauggagaugaaggcguaccacgccaucucccgggcccucgagaaggagggccugaaggacaagaaguccccgcugaaccugagccccgagcuccaggacgagaucgggaccgccuucagccuguucaagacggacgaggacaucaccggccgccugaaggaccgggugcagcccgagauccucgaggugcugcugaagcacaucuccuucgacaaguucguccagaucagccucaaggcccugcgccggaucgugccccugauggagcaggggaagcgcuacgacgaggcgugcgccgagaucuacggcgaccacgacggcaagaagaacaccgaggagaagaucuaccucccgcccauccccgccgacgagauccggaaccccgugguccugcgcgcccugagccaggcccggaaggugaucaacgcggugguccgccgguacgggucccccgcccgcauccacaucgagaccgcccgcgaggugggcaagagcuucaaggaccggaaggagaucgagaagcgccaggaggagaaccggaaggaccgcgagaaggccgccgcgaaguuccgggaguacuuccccaacuucgugggggagcccaaguccaaggacauccucaagcugcgccuguacgagcagcagcacggcaagugccucuacagcgggaaggagaucaaccugggccggcugaacgagaagggcuacgucgagaucgaccacgcccucccguucucccgcacgugggacgacagcuucaacaacaaggugcuggugcugggguccgagaaccagaacaagggcaaccagacccccuacgaguacuucaacgggaaggacaacagccgggaguggcaggaguucaaggcccgcgucgagaccucccgguucccccgcagcaagaagcagcggauccuccugcagaaguucgacgaggagggcuucaaggagcgcaaccugaacgacacccgguacgugaaccgcuuccucugccaguucgucgccgaccacaugcugcugacggggaagggcaagcggcgcguguucgcguccaacggccagaucaccaaccuccugcggggguucuggggccugcgcaaggugcgggccgagaacaaccgccaccacgcccucgacgccgucgugguggccugcagcaccgucgcgaugcagcagaagaucacccgcuucgugcgguacaaggagaugaacgccuucgacgggaagacgaucgacaaggagaccggcgaggugcugcaccagaagacccacuucccccagccgugggaguucuucgcccaggaggucaugauccgcguguucggcaagcccgacgggaagcccgaguucgaggaggccgacaccccggagaagcugcggacgcuccuggccgagaagcuguccagccgccccgaggcggugcacgaguacgucacgccccucuucgugucccgggcccccaaccgcaagaugagcggccaggggcacauggagaccgugaaguccgccaagcggcuggacgagggcgucagcgugcugcgcgugccgcucacccagcugaagcugaaggaccucgagaagauggucaaccgggagcgcgagcccaagcuguacgaggcccugaaggcccggcucgaggcgcacaaggacgaccccgccaaggccuucgccgagcccuucuacaaguacgacaaggcggggaaccgcacccagcaggucaaggccgugcggguggagcagguccagaagaccggcgugugggugcgcaaccacaacggcaucgccgacaacgccaccauggugcggguggacgucuucgagaaggccgggaaguacuaccuggugccgaucuacuccuggcaggucgcgaagggcauccugcccgaccgcgccgugguggccuacgccgacgaggagggguggaccgugaucgacgagagcuuccgguucaaguucguccucuacagcaacgaccugaucaaggugcagcugaagaaggacuccuuccucggcuacuucagcgggcuggaccgcgccaccggcgcgaucucccugcgggagcacgaccucgagaaguccaagggcaaggacgggaugcaccgcaucggcgugaagacggcccugagcuuccagaaguaccagaucgacgagauggggaaggagauccgccugugccggcucaagaagcgcccgcccguccgguga

SEQ ID NO: 1546 - RNA, 3246 nt, Artificial Sequence
  Cas9 variant
augaccgccuucaagcccaaccccaucaacuacauccugggccucgacaucgggaucgccagcgugggcugggcgauggucgagaucgacgaggaggagaaccccauccgccugaucgaccugggggugcggguguucgagcgcgccgagguccccaagaccggcgacucccucgccgccgcccggcgccuggcgcggagcgugcgccggcugacgcgccggcgcgcccaccggcuccugcgcgcccggcgccugcucaagcgggagggggugcugcaggccgcggacuucgacgagaacggccugaucaagucccuccccaacaccccguggcagcugcgcgccgccgcccuggaccggaagcucacgccccuggaguggagcgccguccugcuccaccugaucaagcaccgcggcuaccugucccagcggaagaacgagggggagaccgcggacaaggagcucggcgcccugcugaaggggguggccgacaacgcccacgcccuccagaccggcgacuuccgcacccccgcggagcuggccgugaacaaguucgagaaggagagcgggcacauccggaaccagcgcggcgacuacucccacaccuucagccgcaaggaccugcaggccgagcucguccugcuguucgagaagcagaaggaguucggcaacccccacaucuccgacgggcucaaggagggcaucgagacccugcugauggcccagcggccggcccucagcggggacgcggugcagaagaugcugggcuacugcacguucgagcccaccgagcccaaggccgccaagaacaccuacaccgccgagcgcuucaucuggcugacgaagcucaacaaccugcggauccuggagcagggcuccgagcgcccccucaccgacaccgagcgggccacccugaucgacaugccguacaagaacaagcugacguacgcgaaggcccgcgagcuccuggggcuggacgacaccgccuucuucaagggccuccgguacgggaaggacaacgccgagagcgcgacccugauggagaugaaggccuaccacgccauccgccgggcccuggagaaggagggccucaaggacaagaaguccccgcugagccugucccccgagcugcaggacgagaucgggaccgccuucagccucuucaagacggacgaggacaucaccggccgccugaagggcugccugcagcccgagauccucgacgcgcugcugaagcacaucaacuucgacaaguucgugcagaucucccucaaggcccugcggcgcaucgucccccugauggagcaggggaagcgguacgacgaggccugcgccgagaccuacggcgaccacuacggggagaagaacagcgaggagaugcucuaccugccgcccauccccgccgacgagauccgcaaccccguggugcugcgggcgcucucccaggcccgcaaggucaucaacggcguggugcggcgcuacgggagccccgcccggauccacaucgagaccgcccgcgaggucggcaagagcuucaaggaccgcaaggagaucgagaagcggcaggaggagaaccgcaaggaccgggagaaggccgcggccaaguuccgcgaguacuuccccaacuucgugggcgagcccaaguccaaggacauccugaagcugcggcucuacgagcagcagcacgggaagugccuguacagcggcaaggccaucgacauccgccggcugaacgggaagggcuacguggagaucgaccacgcccucccguucucccgcacgugggacgacagcuucaacaacaagguccuggugcugggguccgagaaccagaacaagggcaaccggacccccuacgaguaccucaacggcaaggacaacagccgcgaguggcuggaguucaaggcgcggguggagaccucccgcuucccccacagcaagaagcagcggguccugcuccagaaguucgacgagaagggguucaaggagcgcaaccugaacgacacccgguacgugaaccgcuuccugugccaguucgucgccgaccacaugcagcucacgggcaaggggaagcggcgcguguucgccuccaacggccagaucaccaaccugcugcggggcuucugggggcuccacaaggugcgcgccgagaacgaccggcaccacgcccuggacgcggucgugguggccugcagcaccgucgccaugcagcagaagaucacgugcuucgugcgcuacaaggagaugaacgccuucgacggcaagaccguggacaaggagaccggggagguccugcaccagaagacccacuucccccagccgugggaguucuucgcccaggaggugaugauccgcguguucggcaagcccgacgggaagcccgaguucgaggaggcggacaccccggagaagcuccgggcccugcuggccgagaagcucuccagccgccccgaggccguccacgaguacgugacgccccuguucgugucccgggcccccaaccgcaagaugagcggcgcgcacaaggacacccugcgguccgccaagcgcuucgucaagcacaacgagaagaucagcgugaagcggguguggcucaccgagaucaagcuggccgaccuggagaacauggucaacuacaagaacggccgcgagaucgagcucuacgaggcccugaaggcgcggcugggggccuacggcgggaacgccaagcaggccuucgacccgaaggacaaccccuucuacaagaagggcgggcagcucgugaaggccgugcgcgucgagaagacccaggaguccggcgugcugcugaacaagaagaacgcguacaccaucgccgacaacggcgacauggugcgggucgacguguucugcaagguggacaagaaggggaagaaccaguacuucaucguccccaucuacgccuggcaggucgccgagaacauccuccccgacaucgacugcaagggcuaccgcaucgacgacagcuacacguucugcuucucccugcacaaguacgaccugaucgccuuccagaaggacgagaaguccaagguggaguucgcguacuacaucaacugcgacagcagcaacgggcgguucuaccucgccuggcacgacaagggcagcaaggagcagcaguuccgcaucuccacccagaaccuggugcugaugcagaaguaccagaucgacgagcucgggaaggagauccggccgugccgccugaagaagcggccgcccgugcgcuga

SEQ ID NO: 1547 - RNA, 3246 nt, Artificial Sequence
  Cas9 variant
auggccgccuucaagcccaaccccaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccgccgcgcgccggcuggcccgcagcgugcggcgccugacccggcgccgggcccaccgccuccugcgggcccgccggcugcucaagcgcgagggggugcugcaggcggccgacuucgacgagaacggccugaucaagucccuccccaacacgccguggcagcugcggagcgccgcccuggaccgcaagcucacgccccuggagugguccgccguccugcuccaccugaucaagcaccggggcuaccugagccagcgcaagaacgagggggagaccgcggacaaggagcucggcgcccugcugaaggggguggccaacaacgcccacgcccuccagaccggcgacuuccggacccccgcggagcuggcccugaacaaguucgagaaggaguccgggcacauccgcaaccagcggggcgacuacagccacaccuucucccgcaaggaccuccaggccgagcugauccuccuguucgagaagcagaaggaguucggcaacccccacgugagcgggggccugaaggaggggaucgagacccugcucaugacccagcgcccggcccuguccggcgacgccguccagaagaugcugggccacugcacguucgagcccgcggagcccaaggccgccaagaacaccuacaccgccgagcgguucaucuggcucaccaagcugaacaaccugcgcauccucgagcaggggagcgagcggccccugacggacaccgagcgcgccacccugauggacgagccguaccggaaguccaagcucaccuacgcgcaggcccgcaagcugcugggccucgaggacacggccuucuucaaggggcugcgguacggcaaggacaacgccgaggcgagcacccugauggagaugaaggccuaccacgccaucucccgcgcccucgagaaggaggggcugaaggacaagaaguccccgcugaaccugagccccgagcuccaggacgagaucggcaccgccuucagccuguucaagaccgacgaggacaucacgggccggcugaaggaccgcauccagcccgagauccucgaggcgcugcugaagcacaucuccuucgacaaguucgugcagaucagccucaaggcccugcggcgcaucgugccccugauggagcaggggaagcgguacgacgaggccugcgccgagaucuacggcgaccacuacgggaagaagaacaccgaggagaagaucuaccucccgcccauccccgccgacgagauccgcaaccccgucgugcugcgggcgcugagccaggcccgcaaggugaucaacggcgucgugcggcgcuacgggucccccgcccggauccacaucgagaccgcccgcgaggugggcaagagcuucaaggaccgcaaggagaucgagaagcggcaggaggagaaccgcaaggaccgggagaaggccgcggccaaguuccgcgaguacuuccccaacuucgucggcgagcccaaguccaaggacauccucaagcugcggcuguacgagcagcagcacgggaagugccucuacagcggcaaggagaucaaccuggggcgccugaacgagaagggcuacguggagaucgaccacgcccucccguucucccggaccugggacgacagcuucaacaacaaggugcugguccugggguccgagaaccagaacaagggcaaccagacgcccuacgaguacuucaacggcaaggacaacagccgcgaguggcaggaguucaaggcccggguggagaccucccgcuucccccggagcaagaagcagcgcauccuccugcagaaguucgacgaggacggguucaaggagcggaaccugaacgacacccgcuacgugaaccgguuccucugccaguucgucgcggaccgcaugcggcugaccggcaaggggaagaagcgcguguucgccuccaacggccagaucacgaaccugcuccggggcuucugggggcugcgcaagguccgggccgagaacgaccgccaccacgcccuggacgccgugguggucgcgugcagcaccguggccaugcagcagaagaucacccgcuucgugcgguacaaggagaugaacgccuucgacggcaagaccaucgacaaggagacgggggagguccuccaccagaagacccacuucccccagccgugggaguucuucgcccaggaggugaugauccgcguguucggcaagcccgacgggaagcccgaguucgaggaggccgacaccccggagaagcugcggacccugcucgcggagaagcuguccagccgccccgaggccguccacgaguacgugacgccccuguucgugucccgggcccccaaccgcaagaugagcggccagggccacauggagaccgucaaguccgccaagcggcucgacgagggggugagcgugcugcgcgucccgcugacccagcucaagcugaaggaccuggagaagauggugaaccgggagcgcgagcccaagcucuacgaggcccugaaggcgcggcuggaggcccacaaggacgaccccgccaaggccuucgcggagcccuucuacaaguacgacaaggccggcaaccgcacccagcaggucaaggccgugcggguggagcagguccagaagaccggggugugggugcgcaaccacaacggcaucgccgacaacgccacgauggugcgggucgacguguucgagaaggcggggaaguacuaccucgugccgaucuacuccuggcaggucgccaagggcauccugcccgaccgcgccgugguggccuacgccgacgaggagggcuggaccgucaucgacgagagcuuccgguucaaguucgugcuguacagcaacgaccucaucaaggugcagcugaagaaggacuccuuccugggguacuucagcggccucgaccgcgcgaccggggccaucucccugcgggagcacgaccuggagaaguccaagggcaaggacgggaugcaccgcaucggcgucaagaccgcccucagcuuccagaaguaccagaucgacgagaugggcaaggagauccgccugugccggcugaagaagcgcccgcccgugcgguga

SEQ ID NO: 1548 - RNA, 3246 nt, Artificial Sequence
  Cas9 variant
augcugaagcgcgugcucggcaucgacgucgggaucagcuccaucggcugggcccugcuggaguuccagggggacaucgacaacaaggaccuccccagcggcaagauccuggccuccggggugcggguguucacccaggcggagaacccgaagaacggcgagagccuggccaagccccgccgggacgcccgccucgcccggcgccggacccgccggcgcgcccagcggcugacggacaucaaggaccuguucuucaaguacaagcucgucaccggcaucucccgcaacaagaucaacagcaucuacaagaccgaggagaacaagaaggaccccuggacccugcggaaggaggcgcuguaccgcaagcucgacggggaggaguucgcccgggugcugacgcacaucgccaagcaccgcggcuucaaguccaugcgcaagagcgaggaggagggguccgacaccaaggccaaggagacccagcgggugcugaccgagaucggcaagaacaaggacacgcucaagaccgggaucuggcagaccgcgggcgagaugaucgccagccggcccaagggcgacgcccgccggaacaagaccgacuccuacaagaacagcaucucccgcgagcugcugcaggacgagacgaagaucaucuucgagaagcagcgcgggaugaacagccaguucaccuccgccgaccucgagaaggaguacagcgacaucgccuuccaccaggcgccgauccaguccaugcugaagauggucggcgggugcaccuucgagaaggacgaggagggcaagcggcugaagcgcgcccccaagaacagcuacuccgccgagguguucaccgcccucacgaagaucaacaaccuggugcugaagaccaagaccgccaacaucaacgaccgguuccucaccacggaggagcgcaagaaggcgcuggagcugugccacagcaacgccaaggucaccuucaagcagcuccggggcgagcuggggcugcccgaggacuggaucuucaacaccguggacuacgccaagaagcccaagaagaccgccgugaaggagacggagccggagagcgccugcuucuuccagaugcgcggcuacaacgagauccggaaguccgucgggaaggaccucuggaccgagaucagcaugaagaaggagauccugaacuccaucgugaccacccuggcgacggagaaguccgacgaggccaucaaggcccagcucaagaaguccgaggugcccgacgagaucgccgagaagguccugggccugaacuuccgcggguuccuccaccugagcaucaaggcccuggacaagaucauccccuucaugauggcgggcgacaaguacaccgacgccugcgacaaggccggcuacaaggagcagaucagcgggaucaagaagaucuuccuccggaagcugaacgacgaggagaacgagcagaucaccaaccccguggccaagcgcgcgaucacccaguuccggaaggugaucaacgccaucauccgcgaguacggcaaguucgaccagaugaacaucgagcuggcccgggaccucgccaagagcuacgacgaccgcaagaagaucaaggaggggcaggaggacuuccgggccgagaaggaccgcgcggcccagcggugcaaggacaacggccuggacccgaacuccaaggacaaccugagcaaguaccgccucugggagcagcaggacaacggguucugcaucuacugcggcaagcccaucgagcugcagcggcuggccgagcagggcuacugcgaggucgaccacauccuccccuacucccgcagccuggacgacucccagcacaacaaggugcuggcccacauccacgacaaccagcagaagaagaaccagauccccuucgagcacuucgggggcgacgggccgaagugggaggaguucgugggccgccugaacagccaguucaagaaccuccccaaguccaagcugaaccggcuggucaagcgcaaguucgacgagaaggacauggagggguucaaggagcggaacaucaacgacacgcgcuacaucagccgguucaucaagaacuucguggagaaccaccucgaguucgccgaguccgcgcagaagcagaagguguucguccgcagcggcucccugaccgccuuccugcggcaccaguggggccucaucaagaagcgcgacgagagcgaccggcaccacgcccuggacgcccuggugaccgccugcgcgacccaggccauggucaagagcacggccaucaccgcccagaagauggaguccuacaacuggaucaacaaggagaagccccgcaugccccucccguggcugaacuuccgggacgacgugcagaagucccuggacgcgguguucgucagccgcgcgccccggcacaaggucgggggcgccgcccacaaggagaccauccgcagcauccggaagugcggggaggagaaccucaucaucgagaagacgccccugguggacaucgccaccaaguccggcaucaagcugaaggacaucgagaagcucuacaagaaggagcagaaccgcaagcuguacgagacccugaaggagcggcucgagcagaacggcaacgaccccgugaaggccuucgggaacccggacgaccccgugcgcaugcccaccaacgaccugaccaagaccggccccaucaucaagagcaucaagcugaucacgaacaagaaguccgggcucaacgugcgggccggcaucgccgacaacggggagaucgcccgccuggacgucuacgagcggaagggcaaguucuaccugaucccgaacuacguggccgacuucgcgaacaaggagcuccccaagaaggccaucaaggccaacacccccgagaccgaguggccgaucaucgaccgcaacuacaacuucaaguucagccuguucaaggacgaccugaucuccaucaagcagaagcucgacagccccgaggaguucuacuacuacaagggccccgacguguccaccgccagcaucacggucgaguccguggaccgcaagcggcugugggaggagaagaagaaggggaagaucgagaacguguuccacacccgcaucggcaccaagacccucaagagcuuccggaaguucaaccuggacauccuggggacgaaggcccccgucgagaucaagaaggagaccugggugggcgugauccgcaagaacggggucgcgaacaacaccggcaacaaggccauguga

SEQ ID NO: 1549 - RNA, 3249 nt, Artificial Sequence
  Cas9 variant
auggccgccuucaagcccaacccgaugaacuacauccugggccucgacaucgggaucgcgagcgugggcugggccauggucgagaucgacaaggaggagaaccccauccgccugaucgaccugggggugcggguguucgagcgcgccgagguccccaagaccggcgacucccucgccauggcccggcgccuggcgcggagcgugcgccggcugacccgccggcgcgcccaccggcuccugcgcgcccggcgccugcucaagcgggagggggugcugcaggacgccgacuucgacgagaacggccuggucaagucccuccccaacacgccguggcagcugcgcgcggccgcccuggaccggaagcucaccugccuggaguggagcgccgugcugcuccaccugaucaagcaccgcggcuaccugucccagcggaagaacgagggggagaccgccgacaaggagcucggcgcgcugcugaaggggguggccgacaacgcccacgcccuccagaccggcgacuuccgcacgcccgccgagcuggcgcugaacaaguucgagaaggagagcgggcacauccggaaccagcgcggcgacuacucccacaccuucagccgcaaggaccuccaggccgagcugaaccugcucuucgagaagcagaaggaguucuccaacccccacgucagcgacucccugaaggagggcaucgagacccugcucauggcccagcggcccgcccugagcggggacgccgugcagaagaugcugggccacugcaccuucgagccggcggagcccaaggccgccaagaacacguacaccgccgagcgcuucaucuggcucaccaagcugaacaaccugcggauccucgagcagggguccgagcgcccccugaccgacacggagcgggccacccugauggacgagcccuaccgcaagagcaagcucaccuacgcgcaggcccggaagcugcugggccucgaggacaccgccuucuucaagggccugcgcuacgggaaggacaacgccgaggcgccgacgcugauggagaugaaggccuaccacgccaucucccgggcccucgagaaggagggccugaaggacaagaagagcccccugaaccuguccaccgagcuccaggacgagaucgggaccgccuucagccuguucaagaccgacaaggacaucacgggccgccugaaggaccgggugcagcccgagauccucgaggcgcugcugaagcacaucuccuucgacaaguucguccagaucagccucaaggcccugcgccggaucgugccccugauggagcaggggaagcgcuacgacgaggccugcgccgagaucuacggcgaccacuacugcaagaagaacgccgaggagaagaucuaccucccgcccauccccgcggacgagauccggaaccccgugguccugcgcgcccugagccaggcccggaaggugaucaacugcgugguccgccgguacggcuccccggcccgcauccacaucgagaccgcccgcgagguggggaagagcuucaaggaccggaaggagaucgagaagcgccaggaggagaaccggaaggaccgcgagaaggcggccgccaaguuccgggaguacuuccccaacuucgugggcgagcccaaguccaaggacauccucaagcugcgccuguacgagcagcagcacgggaagugccucuacagcggcaaggagaucaaccugguccggcugaacgagaagggguacguggagaucgaccacgcccuccccuucucccgcaccugggacgacagcuucaacaacaaggugcugguccugggcuccgagaaccagaacaagggcaaccagaccccguacgaguacuucaacgggaaggacaacagccgggaguggcaggaguucaaggcgcgcguggagacgucccgguucccccgcagcaagaagcagcggauccuccugcagaaguucgacgaggagggcuucaaggagcgcaaccugaacgacacccgguacgucaaccgcuuccucugccaguucguggccgaccacauccugcugaccgggaagggcaagcggcgcguguucgccuccaacgggcagaucaccaaccuccugcggggcuucuggggccugcgcaagguccgggccgagaacgaccgccaccacgcccucgacgcggugguggucgccugcagcacgguggccaugcagcagaagaucacccgcuucgugcgguacaaggagaugaacgccuucgacgggaagaccaucgacaaggagaccggcgagguccugcaccagaaggcccacuucccccagcccugggaguucuucgcgcaggaggugaugauccgcguguucgggaagccggacggcaagcccgaguucgaggaggccgacacgcccgagaagcugcggacccuccuggccgagaagcuguccagccgcccggaggccguccacgaguacgugaccccccucuucgugucccgggcccccaaccgcaagaugagcggccaggggcacauggagaccgucaaguccgcgaagcggcuggacgagggcaucagcgugcugcgcgugccccucacgcagcugaagcugaaggggcucgagaagauggucaaccgggagcgcgagccgaagcuguacgacgcccugaaggcccagcucgagacccacaaggacaaccccgccaaggcguucgccgagcccuucuacaaguacgacaaggccggcaaccggacccagcaggugaaggccgugcgcaucgagcagguccagaagaccggggugugggugcggaaccacaacggcaucgccgacaacgcgaccaugguccgcguggacguguucgagaagggcgggaaguacuaccugguccccaucuacuccuggcagguggccaagggcauccugccggaccgggccguggucgccuucaaggacgaggaggacuggacggugauggacgacagcuucgaguuccgcuucgugcucuacgccaacgaccugaucaagcugaccgcgaagaagaacgaguuccucggguacuucgucagccugaaccgggccaccggcgccaucgacauccgcacccacgacacggacuccaccaaggggaagaacggcaucuuccagagcgugggcgugaagaccgcccuguccuuccagaagaaccagaucgacgagcucgggaaggagauccggcccugccgccugaagaagcgcccccccguccgguga

SEQ ID NO: 1550 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggaggagaaccccauccgccugaucgaccugggggugcggguguucgagcgcgccgagguccccaagaccggcgacucccucgccauggcccggcgccuggcgcggagcgugcgccggcugacccgccggcgcgcccaccggcuccugcgcgcccggcgccugcucaagcgggagggggugcugcaggccgcggacuucgacgagaacggccugaucaagucccuccccaacacgccguggcagcugcgcgccgccgcccuggaccggaagcucaccccccuggaguggagcgccguccugcuccaccugaucaagcaccgcggcuaccugucccagcggaagaacgagggggagaccgcggacaaggagcucggcgcccugcugaaggggguggccaacaacgcccacgcccuccagaccggcgacuuccgcacgcccgcggagcuggcccugaacaaguucgagaaggagagcgggcacauccggaaccagcgcggcgacuacucccacaccuucagccgcaaggaccuccaggccgagcugauccugcucuucgagaagcagaaggaguucggcaacccccacguguccgggggccugaaggaggggaucgagacccugcucaugacccagcggccggcccugagcggcgacgccguccagaagaugcugggccacugcacguucgagcccgcggagcccaaggccgccaagaacaccuacaccgccgagcgcuucaucuggcucaccaagcugaacaaccugcggauccucgagcagggguccgagcgcccccugacggacaccgagcgggccacccugauggacgagccguaccgcaagagcaagcucaccuacgcgcaggcccggaagcugcugggccucgaggacacggccuucuucaaggggcugcgcuacggcaaggacaacgccgaggcguccacccugauggagaugaaggccuaccacgccaucagccgggcccucgagaaggaggggcugaaggacaagaaguccccccugaaccugagcuccgagcuccaggacgagaucggcaccgccuucagccuguucaagaccgacgaggacaucacgggccgccugaaggaccgggugcagcccgagauccucgaggcgcugcugaagcacaucuccuucgacaaguucgugcagaucagccucaaggcccugcgccggaucgucccccugauggagcaggggaagcgcuacgacgaggccugcgccgagaucuacggcgaccacuacgggaagaagaacaccgaggagaagaucuaccucccgcccauccccgccgacgagauccggaaccccguggugcugcgcgcgcugagccaggcccggaaggucaucaacggcguggugcgccgguacggguccccggcccgcauccacaucgagaccgcccgcgaggucggcaagagcuucaaggaccggaaggagaucgagaagcgccaggaggagaaccggaaggaccgcgagaaggccgcggccaaguuccgggaguacuuccccaacuucgugggcgagcccaaguccaaggacauccucaagcugcgccuguacgagcagcagcacgggaagugccucuacagcggcaaggagaucaaccuggugcggcugaacgagaagggguacgucgagaucgaccacgcccuccccuucucccgcaccugggacgacagcuucaacaacaaggugcuggugcugggcuccgagaaccagaacaaggggaaccagacgccguacgaguacuucaacggcaaggacaacagccgggaguggcaggaguucaaggcccgcgucgagaccucccgguucccccgcagcaagaagcagcggauccuccugcagaaguucgacgaggacggcuucaaggagugcaaccugaacgacacccgcuacgugaaccgguuccucugccaguucgucgcggaccacauccugcugaccgggaagggcaagcgccggguguucgccuccaacgggcagaucacgaaccuccugcgcggcuucuggggccugcggaaggugcgcgccgagaacgaccggcaccacgcccucgacgccgucgugguggcgugcagcaccgucgccaugcagcagaagaucacccgcuucgugcgcuacaaggagaugaacgccuucgacgggaagaccaucgacaaggagacgggcaaggugcugcaccagaagacccacuucccccagcccugggaguucuucgcccaggaggucaugauccggguguucgggaagccggacggcaagcccgaguucgaggaggccgacacccccgagaagcugcgcacccuccuggcggagaagcuguccagccggccggaggccgugcacgaguacgucacgccccucuucgugucccgcgcccccaaccggaagaugagcgggcagggccacauggagaccgugaaguccgccaagcgccuggacgagggcgucagcgugcugcgggugccccucacccagcugaagcugaaggaccucgagaagauggucaaccgcgagcgggagccgaagcuguacgaggcccugaaggcgcgccucgaggcccacaaggacgaccccgccaaggccuucgcggagcccuucuacaaguacgacaaggccgggaaccggacccagcaggugaaggccgugcgcgucgagcaggugcagaagaccggcguguggguccggaaccacaacgggaucgccgacaacgccacgauggugcgcguggacgucuucgagaagggcgacaaguacuaccuggugcccaucuacuccuggcagguggcgaaggggauccugccggaccgggccgucgugcagggcaaggacgaggaggacuggcagcucaucgacgacagcuucaacuucaaguucagccugcaccccaacgaccugguggaggucaucaccaagaaggcccgcauguucggcuacuucgccuccugccaccgggggaccggcaacaucaacauccgcauccacgaccucgaccacaagaucgggaagaacggcauccuggaggggaucggcgugaagaccgcccugagcuuccagaaguaccagaucgacgagcucggcaaggagauccggcccugccgccugaagaagcgccccccggugcgguga

SEQ ID NO: 1551 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccauggcccgccggcuggcgcgcagcgugcggcgccugacccggcgccgggcccaccgccuccugcgggcccgccggcugcucaagcgcgagggggugcugcaggccgcggacuucgacgagaacggccugaucaagucccuccccaacacgccguggcagcugcgggccgccgcccuggaccgcaagcucacgccccuggaguggagcgccguccugcuccaccugaucaagcaccggggcuaccugucccagcgcaagaacgagggggagaccgcggacaaggagcucggcgcccugcugaaggggguggccgacaacgcccacgcccuccagaccggcgacuuccggacccccgcggagcuggcccugaacaaguucgagaaggagagcgggcacauccgcaaccagcggggcgacuacucccacaccuucagccgcaaggaccuccaggccgagcugauccuccuguucgagaagcagaaggaguucggcaacccccacguguccgggggccugaaggaggggaucgagacccugcucaugacccagcgcccggcccugagcggcgacgccguccagaagaugcugggccacugcacguucgagcccgcggagcccaaggccgccaagaacaccuacaccgccgagcgguucaucuggcucaccaagcugaacaaccugcgcauccucgagcagggguccgagcggccccugacggacaccgagcgcgccacccugauggacgagccguaccgcaagagcaagcucaccuacgcgcaggcccggaagcugcugggccucgaggacacggccuucuucaaggggcugcgguacggcaaggacaacgccgaggcguccacccugauggagaugaaggccuaccacgccaucagccgcgcccucgagaaggaggggcugaaggacaagaaguccccgcugaaccugagccccgagcuccaggacgagaucggcaccgccuucucccuguucaagaccgacgaggacaucacgggccggcugaaggaccgcauccagcccgagauccucgaggcgcugcugaagcacaucagcuucgacaaguucgugcagaucucccucaaggcccugcggcgcaucgugccccugauggagcaggggaagcgguacgacgaggccugcgccgagaucuacggcgaccacuacgggaagaagaacaccgaggagaagaucuaccucccgcccauccccgccgacgagauccgcaaccccgucgugcugcgggcgcugagccaggcccgcaaggugaucaacggcgucgugcggcgcuacgggagccccgcccggauccacaucgagaccgcccgcgaggugggcaaguccuucaaggaccgcaaggagaucgagaagcggcaggaggagaaccgcaaggaccgggagaaggccgcggccaaguuccgcgaguacuuccccaacuucgucggcgagcccaagagcaaggacauccucaagcugcggcuguacgagcagcagcacgggaagugccucuacuccggcaaggagaucaaccuggggcgccugaacgagaagggcuacguggagaucgaccacgcccucccguucagccggaccugggacgacuccuucaacaacaaggugcugguccuggggagcgagaaccagaacaagggcaaccagacgcccuacgaguacuucaacggcaaggacaacucccgcgaguggcaggaguucaaggcccggguggagaccagccgcuucccccgguccaagaagcagcgcauccuccugcagaaguucgacgaggacggguucaaggagcggaaccugaacgacacccgcuacgugaaccgguuccucugccaguucgucgcggaccgcaugcggcugaccggcaaggggaagaagcgcguguucgccagcaacggccagaucacgaaccugcuccggggcuucugggggcugcgcaagguccgggccgagaacgaccgccaccacgcccuggacgccgugguggucgcgugcuccaccguggccaugcagcagaagaucacccgcuucgugcgguacaaggagaugaacgccuucgacggcaagaccaucgacaaggagacgggggagguccuccaccagaagacccacuucccccagccgugggaguucuucgcccaggaggugaugauccgcguguucggcaagcccgacgggaagcccgaguucgaggaggccgacaccccggagaagcugcggacccugcucgcggagaagcugagcucccgccccgaggccguccacgaguacgugacgccccuguucgugagccgggcccccaaccgcaagauguccggccagggccacauggagaccgucaagagcgccaagcggcucgacgaggggguguccgugcugcgcgucccgcugacccagcucaagcugaaggaccuggagaagauggugaaccgggagcgcgagcccaagcucuacgaggcccugaaggcgcggcuggaggcccacaaggacgaccccgccaaggccuucgcggagcccuucuacaaguacgacaaggccggcaaccgcacccagcaggucaaggccgugcggguggagcagguccagaagaccggggugugggugcgcaaccacaacggcaucgccgacaacgccacgauggugcgggucgacguguucgagaagggggacaaguacuaccucgugccgaucuacagcuggcaggucgcgaagggcauccugcccgaccgcgccguggugcagggcaaggacgaggaggacuggcagcugaucgacgacuccuucaacuucaaguucagccuccaccccaacgaccuggucgaggugaucaccaagaaggcccggauguucggguacuucgccagcugccaccgcggcaccgggaacaucaacauccggauccacgaccuggaccacaagaucggcaagaacgggauccucgagggcaucggcgugaagaccgcccuguccuuccagaaguaccagaucgacgagcugggggaggagauccgccccugccgccucaagaagcggccgcccguccgcuga

SEQ ID NO: 1552 - RNA, 3249 nt, Artificial Sequence; identical to SEQ ID NO: 1390
  Cas9 variant

SEQ ID NO: 1553 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccgccgcgcgccggcuggcccgcagcgugcggcgccugacccggcgccgggcccaccgccuccugcgggcccgccggcugcucaagcgcgagggggugcugcaggcggccgacuucgacgagaacggccugaucaagucccuccccaacacgccguggcagcugcgggccgccgcccuggaccgcaagcucacgccccuggaguggagcgcgguccugcuccaccugaucaagcaccggggcuaccugucccagcgcaagaacgagggggagaccgccgacaaggagcucggcgcccugcugaaggggguggccgacaacgcccacgcgcuccagaccggcgacuuccggacccccgccgagcuggcccugaacaaguucgagaaggagagcgggcacauccgcaaccagcggggcgacuacucccacaccuucagccgcaaggaccuccaggccgagcugauccuccuguucgagaagcagaaggaguucggcaacccccacguguccgggggccugaaggaggggaucgagacccugcucaugacccagcgcccggcccugagcggcgacgcgguccagaagaugcugggccacugcacguucgagcccgccgagcccaaggccgccaagaacaccuacaccgccgagcgguucaucuggcucaccaagcugaacaaccugcgcauccucgagcagggguccgagcggccccugacggacaccgagcgcgcgacccugauggacgagccguaccgcaagagcaagcucaccuacgcccaggcccggaagcugcugggccucgaggacacggccuucuucaaggggcugcgguacggcaaggacaacgcggaggccuccacccugauggagaugaaggccuaccacgccaucagccgcgcccucgagaaggaggggcugaaggacaagaaguccccgcugaaccugagccccgagcuccaggacgagaucggcaccgcguucucccuguucaagaccgacgaggacaucacgggccggcugaaggaccgcgugcagcccgagauccucgaggcccugcugaagcacaucagcuucgacaaguucgugcagaucucccucaaggcccugcggcgcaucgucccccugauggagcaggggaagcgguacgacgaggccugcgccgagaucuacggcgaccacuacgggaagaagaacaccgaggagaagaucuaccucccgcccauccccgcggacgagauccgcaaccccguggugcugcgggcccugagccaggcccgcaaggucaucaacggcguggugcggcgcuacgggagccccgcccggauccacaucgagaccgcccgcgaggucggcaaguccuucaaggaccgcaaggagaucgagaagcggcaggaggagaaccgcaaggaccgggagaaggcggccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacguggagaucgaccacgcccucccguucagccggaccugggacgacuccuucaacaacaagguccuggugcuggggagcgagaaccagaacaagggcaaccagacgcccuacgaguacuucaacggcaaggacaacucccgcgaguggcaggaguucaaggcgcggguggagaccagccgcuucccccgguccaagaagcagcgcauccuccugcagaaguucgacgaggacggguucaaggagcggaaccugaacgacacccgcuacgucaaccgguuccucugccaguucguggccgaccgcaugcggcugaccggcaaggggaagaagcgcgucuucgccagcaacggccagaucacgaaccugcuccggggcuucugggggcugcgcaaggugcgggccgagaacgaccgccaccacgcccuggacgcgguggucguggccugcuccaccguggccaugcagcagaagaucacccgcuucguccgguacaaggagaugaacgccuucgacggcaagaccaucgacaaggagacgggggaggugcuccaccagaagacccacuucccccagccgugggaguucuucgcccaggaggugaugauccgcgucuucggcaagcccgacgggaagcccgaguucgaggaggcggacaccccggagaagcugcggacccugcucgccgagaagcugagcucccgccccgaggccgugcacgaguacgugacgccccuguucgucagccgggcccccaaccgcaagauguccggccagggccacauggagaccgucaagagcgccaagcggcucgacgaggggguguccgugcugcgcgugccgcugacccagcucaagcugaaggaccuggagaagauggugaaccgggagcgcgagcccaagcucuacgaggcgcugaaggcccggcuggaggcccacaaggacgaccccgccaaggcguucgccgagcccuucuacaaguacgacaaggccggcaaccgcacccagcaggucaaggccgugcggguggagcagguccagaagaccggggugugggugcgcaaccacaacggcaucgccgacaacgcgacgaugguccggguggacguguucgagaagggggacaaguacuaccucgucccgaucuacagcuggcaggucgccaagggcauccugcccgaccgcgccguggugcagggcaaggacgaggaggacuggcagcugaucgacgacuccuucaacuucaaguucagccuccaccccaacgaccugguggaggugaucaccaagaaggcccggauguucggguacuucgccagcugccaccgcggcaccgggaacaucaacauccggauccacgaccuggaccacaagaucggcaagaacgggauccucgagggcaucggcgucaagaccgcgcuguccuuccagaaguaccagaucgacgagcuggggaaggagauccgccccugccgccucaagaagcggccgcccgugcgcuga

SEQ ID NO: 1554 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggaggagaaccccauccgccugaucgaccugggggugcggguguucgagcgcgccgagguccccaagaccggcgacucccucgccauggcccggcgccuggcgcggagcgugcgccggcugacccgccggcgcgcccaccggcuccugcgcacgcggcgccugcucaagcgggagggggugcugcaggccgccaacuucgacgagaacggccugaucaagucccuccccaacacccuguggcagcugcgcgcggccgcccucgaccggaagcugaccccgcuggaguggagcgccguccuccugcaccugaucaagcaccgcggcuaccucucccagcggaagaacgagggggagaccgccgacaaggagcugggcgcgcugcucaaggggguggccggcaacgcccacgcccugcagacgggggacuuccgcacccccgccgagcuggcgcucaacaaguucgagaaggagagcggccacauccggaaccagcgcggcgacuacucccacaccuucagccgcaaggaccugcaggccgagcugaaccuccuguucgagaagcagaaggaguucgggaacccccacaucuccgacggccugaaggaggggaucgagacccuccugaugacgcagcggcccgcccugagcggcgacgccgugcagaagaugcucggccacugcaccuucgagccgaccgagcccaaggccgcgaagaacaccuacacgaccgagcgcuucaucuggcugaccaagcugaacaaccuccggauccuggagcagggguccgagcgcccccugaccgacacggagcgggccacccucauggacgagcccuaccgcaagagcaagcugaccuacgcccaggcccggaagcugcucgagcuggacgacaucgccuucuucaagggccugcgcuacgggaaggacaacgcggaggccuccacccucauggagaugaaggccuaccacgccaucagccgggcgcuggagaaggagggccugaaggacaagaaguccccgcugaaccucagccccgagcugcaggacgagaucgggacggccuucucccuguucaagaccgacgaggacaucaccggccgccucaaggaccggauccagcccgagauccuggaggcccugcucaagcacaucaacuucgacaaguucguccagaucagccugaaggcccugcgccggaucgugccccucauggagcagggcaagcgcuacgacgaggccugcgcggagaucuacggggaccacuacggcaagaagaacaccgaggagaagaucgaccugccgcccauccccgccgacgagauccacaaccccgugguccugcgggcccucucccaggcccgcaaggugaucaacggggugguccggcgcuacggcagcccggcccggauccacaucgagacggcgcgcgaggugggcaagagcuucaaggaccgcaaggagaucgagaagcggcaggaggagaaccgcaaggaccgggagaaggccgccgccaaguuccgcgaguacuuccccaacuucgugggggagcccaaguccaaggacauccugaagcugcggcucuacgagcagcagcacggcaagugccuguacagcgggaaggagaucaaccugggccgccucaacgagaagggguacgucgagaucgaccacgcccugcccuucucccggaccugggacgacagcuucaacaacaaggugcuggugcucggcuccgagaaccagaacaaggggaaccagaccccguacgaguacuucaacggcaaggacaacagccgcgaguggcaggaguucaaggcgcgggucgagaccucccgcuucccccggagcaagaagcagcgcauccugcugcagaaguucgacgaggacggcuucaaggagcggaaccucaacgacacgcgcuacgugaaccgguuccugugccaguucguggccgaccgcaugcggcugaccgggaagggcaagaagcgcgucuucgccuccaacgggcagaucaccaaccuccugcggggcuucuggggccugcgcaaggugcgggccgagaacgaccgccaccacgcgcucgacgccgucgugguggccugcagcaccgucgccaugcagcagaagaucacgcgcuucgugcgguacaaggagaugaacgccuucgacgggaagaccaucgacaaggagaccggcgaggugcugcaccagaagacccacuucccccagcccugggaguucuucgcgcaggaggucaugauccgcguguucgggaagccggacggcaagcccgaguucgaggaggccgacacgcccgagaagcugcggacccuccugaccgagaagcuguccagccgcccggaggccgugcacgaguacgucacgccccucuucgugucccgggcccccaaccgcaagaugagcgggcagggccacauggagaccgugaaguccgccaagcggcuggacgagggcaucagcguccugcgcgugccccucacccagcugaagcugaaggaccucgagaagauggugaaccgggagcgcgagccgaagcuguacgaggcgcugaaggcccggcucgaggcccacaaggacgaccccgccaaggccuucgcggagcccuucuacaaguacgacaaggccgggaaccgcacccagcaggucaaggccaugcggguggagcagguccagaagaccggcgugugggugcgcaaccacaacgggaucgccgacaacgcgaccauggugcgggucgacguguucgagaagggcgacaaguacuaccuggugcccaucuacuccuggcaggucgccaaggggauccugccggaccgcgccguggugcagggcaaggacgaggaggacuggcagcucaucgacgacagcuucaacuucaaguucucccugcaccccaacgaccuggucgaggugaucacgaagaaggcccggauguucggcuacuucgccagcugccaccgcgggaccggcaacaucaacauccggauccacgaccucgaccacaagaucgggaagaacggcauccuggaggggaucggcgugaagaccgcgcugagcuuccagaaguaccagaucgacgagcucggcaaggagauccgccccugccgccugaagaagcggcccccgguccgcuga

SEQ ID NO: 1555 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggacgagaaccccaucugccugaucgaccugggggugcgcguguucgagcgggccgagguccccaagaccggcgacucccucgccauggcccgccggcuggcgcgcagcgugcggcgccugacccggcgccgggcccaccgccuccugcgggcccgccggcugcucaagcgcgagggggugcugcaggccgcggacuucgacgagaacggccugaucaagucccuccccaacacgccguggcagcugcgggccgccgcccuggaccgcaagcucacgccccuggaguggagcgccguccugcuccaccugaucaagcaccggggcuaccugucccagcgcaagaacgagggggagaccgcggacaaggagcucggcgcccugcugaaggggguggccgacaacgcccacgcccuccagaccggcgacuuccggacccccgcggagcuggcccugaacaaguucgagaaggagagcgggcacauccgcaaccagcggggcgacuacucccacaccuucagccgcaaggaccuccaggccgagcugaaccuccuguucgagaagcagaaggaguucggcaacccccacaucuccgacgggcugaaggagggcaucgagacccugcucaugacccagcgcccggcccugagcggggacgccgugcagaagaugcugggccacugcacguucgagcccgcggagcccaaggccgccaagaacaccuacaccgccgagcgguucaucuggcucaccaagcugaacaaccugcgcauccucgagcagggcuccgagcggccccugacggacaccgagcgcaccacccugaucgacgagccguaccgcaagagcaagcucacguacgcccaggcgcggaagcugcuggagcucgacaacaccgccuucuucaaggggcugcgguacggcaaggacaacgccgaggccuccacccugauggagaugaaggcguaccacgccaucagccgcgcccucgagaaggaggggcugaaggacaagaaguccccgcugaaccugagccccgagcuccaggacgagaucggcaccgccuucucccuguucaagacggacgaggacaucaccgggcggcugaaggaccgcguccagcccgagauccucgaggcccugcugaagcacaucagcuucgacaaguucgugcagaucucccucaaggcgcugcggcgcaucgugccccugauggagcagggcaagcgguacgacgaggccugcgccgagaucuacggcgaccacuacgggaagaagaacaccgaggagaagaucgaccucccgcccauccccgccgacgagauccgcaaccccgucgugcugcgggcccugagccaggcgcgcaaggugaucaacggcgucgugcggcgcuacgggagccccgcccggauccacaucgagaccgcccgcgaggugggcaaguccuucaaggaccgcaaggagaucgagaagcggcaggaggagaaccgcaaggaccgggagaaggccgccacgaaguuccgcgaguacuuccccaacuucgucggggagcccaagagcaaggacauccucaagcugcggcuguacgagcagcagcacggcaagugccucuacuccggcaaggagaucaaccuggggcgccugaacgagaagggcuacguggagaucgaccacgcgcucccguucagccggaccugggacgacuccuucaacaacaaggugcugguccuggggagcgagaaccagaacaagggcaaccagacccccuacgaguacuucaacgggaaggacaacucccgcgaguggcaggaguucaaggcccggguggagaccagccgcuucccccgguccaagaagcagcgcauccuccugcagaaguucgacgaggagggcuucaaggagcggaaccugaacgacacgcgcuacgugaaccgguuccucugccaguucgucgccgaccacaugcugcugaccggcaaggggaagcgccggguguucgccagcaacggccagaucaccaaccuccugcgcggguucuggggccugcggaagguccgcgcggagaacgaccggcaccacgcccucgacgccgugguggucgccugcuccaccguggccaugcagcagaagaucacgcgcuucgugcgcuacaaggagaugaacgcguucgacggcaagaccaucgacaaggagaccggggagguccugcaccagaagacccacuucccccagccgugggaguucuucgcccaggaggugaugauccggguguucggcaagcccgacgggaagcccgaguucgaggaggccgacacgccggagaagcugcgcacccuccuggccgagaagcugagcucccggcccgaggccguccacgaguacgugacgccccucuucgugagccgcgcgcccaaccggaagauguccggccaggggcacauggagaccgucaagagcgccaagcgccuggacgagggcguguccgugcugcgggucccgcucacccagcugaagcugaaggaccucgagaagauggugaaccgcgagcgggagcccaagcuguacgaggcccugaaggcccgccucgaggcccacaaggacgaccccgcgaaggccuucgccgagcccuucuacaaguacgacaaggccggcaaccggacccagcaggucaaggcggugcgcguggagcagguccagaagaccggggugugggugcggaaccacaacggcaucgccgacaacgccaccauggugcgcgucgacguguucgagaagggggacaaguacuaccuggugccgaucuacagcuggcaggucgccaagggcauccugcccgaccgggccguggugcaggggaaggacgaggaggacuggcagcucaucgacgacuccuucaacuucaaguucagccugcaccccaacgaccuggucgaggugaucaccaagaaggcgcgcauguucggcuacuucgccagcugccaccggggcacggggaacaucaacauccgcauccacgaccucgaccacaagaucggcaagaacgggauccuggagggcaucggggugaagaccgcccuguccuuccagaaguaccagaucgacgagcucggcaaggagauccggcccugccgccugaagaagcgcccgcccguccgguga

SEQ ID NO: 1556 - RNA, 3249 nt, Artificial Sequence
  Cas9 variant
auggccgccuucaagcccaacccgaugaacuacauccugggccucgacaucgggaucgcgagcgugggcugggccaucgucgagaucgacgaggaggagaaccccauccgccugaucgaccugggggugcgcguguucgagcgcgccgagguccccaagaccggcgacucccucgccgccgcgcggcgccuggcccggagcgugcgccggcugacccgccggcgcgcccaccggcuccugcgcgcccggcgccugcucaagcgggagggggugcugcaggcggccgacuucgacgagaacggccugaucaagucccuccccaacacgccguggcagcugcgcgccgccgcccuggaccggaagcucacgccccuggaguggagcgcgguccugcuccaccugaucaagcaccgcggcuaccugucccagcggaagaacgagggggagaccgccgacaaggagcucggcgcccugcugaaggggguggccgacaacacccacgcccuccagaccggcgacuuccgcacccccgcggagcuggcccugaacaaguucgagaaggagagcgggcacauccggaaccagcgcggcgacuacucccacaccuucaaccgcaaggaccuccaggccgagcugaaccuccuguucgagaagcagaaggaguucggcaacccccacgugagcgacgggcugaaggagggcaucgagacccugcucaugacgcagcggccggcccuguccggggacgccguccagaagaugcugggccacugcaccuucgagcccaccgagcccaaggcggccaagaacaccuacacggccgagcgcuucguguggcucaccaagcugaacaaccugcggauccucgagcagggcagcgagcgcccccugaccgacaccgagcgggccacgcugauggacgagccguaccgcaaguccaagcucaccuacgcccaggcgcggaagcugcuggaccucgacgacaccgccuucuucaaggggcugcgcuacggcaaggacaacgccgaggccagcacccugauggagaugaaggcguaccacgccaucucccgggcccucgagaaggaggggcugaaggacaagaaguccccgcugaaccugagccccgagcuccaggacgagaucggcacggccuucagccuguucaagaccgacgaggacaucaccgggcgccugaaggaccgggugcagcccgagauccucgaggcccugcugaagcacaucuccuucgacaaguucguccagaucagccucaaggcgcugcgccggaucgugccccugauggagcagggcaaccgcuacgacgaggccugcaccgagaucuacggcgaccacuacgggaagaagaacacggaggagaagaucuaccucccgcccauccccgccgacgagauccggaaccccgugguccugcgcgcccugucccaggcccggaaggugaucaacggcgugguccgccgguacgggagccccgcgcgcauccacaucgagaccgcccgcgaggugggcaagagcuucaaggaccggaaggagaucgagaagcgccaggaggagaaccggaaggaccgcgagaaguccgccgccaaguuccgggaguacuuccccaacuucgugggggagcccaagagcaaggacauccucaagcugcgccuguacgagcagcagcacggcaagugccucuacuccggcaaggagaucaaccuggggcggcugaacgagaagggcuacgucgagaucgaccacgcccucccguucagccgcaccugggacgacuccuucaacaacaaggugcuggcgcuggggagcgagaaccagaacaagggcaaccagacccccuacgaguacuucaacgggaaggacaacucccgggaguggcaggaguucaaggcccgcguggagacgagccgguucccccgcuccaagaagcagcggauccuccugcagaaguucgacgaggacggcuucaaggagcgcaaccugaacgacacccgguacaucaaccgcuuccucugccaguucgucgccgaccacaugcugcugaccggcaaggggaagcggcgcguguucgccagcaacggccagaucaccaaccuccugcggggguucuggggccugcgcaagguccgggcggagaacgaccgccaccacgcccucgacgccgugguggucgccugcuccacgaucgccaugcagcagaagaucacccgcuucgugcgguacaaggagaugaacgcguucgacggcaagaccaucgacaaggagaccggggaggugcugcaccagaaggcccacuucccccagccgugggaguucuucgcccaggaggucaugauccgcguguucggcaagcccgacgggaagcccgaguucgaggaggccgacacgccggagaagcugcggacccuccuggccgagaagcugagcucccgccccgaggcggugcacaaguacgucacgccccucuucaucagccgggcccccaaccgcaagauguccggccaggggcacauggagaccgucaagagcgccaagcggcuggacgagggcaucuccgugcugcgcgugccgcucacccagcugaagcugaaggaccucgagaagauggugaaccgggagcgcgagcccaagcuguacgaggcccugaaggcccggcucgaggcgcacaaggacgaccccgccaaggccuucgccgagcccuucuacaaguacgacaaggcgggcaaccgcacccagcaggucaaggccgugcggguggagcagguccagaagaccggggugugggugcacaaccacaacggcaucgccgacaacgccaccaucgugcgcgucgacguguucgagaagggcgggaaguacuaccuggugccgaucuacagcuggcaggucgccaaggggauccugcccgaccgggcgguggugcagggcaaggacgaggaggacuggaccgucauggacgacuccuucgaguucaaguucgugcucuacgccaacgaccugaucaagcugacggccaagaagaacgaguuccucggcuacuucgugagccugaaccgcgccaccggggccaucgacauccggacccacgacaccgacagcacgaagggcaagaacgggaucuuccaguccgucggcgugaagaccgcgcugagcuuccagaaguaccagaucgacgagcucgggaaggagauccgccccugccggcugaagaagcggcccccggugcgcuga

SEQ ID NO: 1557 - RNA, 3249 nt, Artificial Sequence
  Cas9 variant
auggccgccuucaagcccaacagcaucaacuacauccugggccucgacaucgggaucgcguccgugggcugggccauggucgagaucgacaaggaggagaaccccauccgccugaucgaccugggggugcggguguucgagcgcgccgagguccccaagaccggcgacagccucgccgccgcgcggcgccuggcccgguccgugcgccggcugacccgccggcgcgcccaccggcuccugcgcacgcggcgccugcucaagcgggagggggugcugcaggccgcgaacuucgacaagaacggccugaucaagagccuccccaacacccuguggcagcugcgcgccgccgcccucgaccggaagcugacgccccuggagugguccgccguccuccugcaccugaucaagcaccgcggcuaccucagccagcggaagaacgagggggagaccgcggacaaggagcugggcgcccugcucaaggggguggccggcaacgcccacgcccugcagaccggggacuuccgcaccccggcggagcuggcccucaacaaguucgagaaggaguccggccacauccggaaccagcgcggcgacuacagccacaccuucucccgcaaggaccugcaggccgagcugaaccuccuguucgagaagcagaaggaguucgggaacccccacaucagcggcgggcugaaggagggcaucgagacccuccugaugacgcagcggcccgcccuguccggcgacgccgugcagaagaugcucgggcacugcaccuucgagcccaccgagccgaaggcggccaagaacaccuacacgaccgagcgcuucaucuggcugaccaagcugaacaaccuccggauccuggagcagggcagcgagcgcccccugaccgacacggagcgggccacccucauggacgagcccuaccgcaaguccaagcugaccuacgcccaggcccggaagcugcucagccuggaggacaccgcguucuucaaggggcugcgcuacggcaaggacaacgccgaggccuccacgcucauggagaugaaggccuaccacaccaucagccgggcgcuggagaaggaggggcugaaggacaagaaguccccgcugaaccucagccccgagcugcaggacgagaucggcaccgccuucucccuguucaagaccgacgaggacaucacgggccgccucaaggaccggauccagcccgagauccuggaggcccugcucaagcacaucagcuucgacaaguucguccagaucagccugaaggcccugcgccggaucgugccccucauggagcaggggaagcgcuacgacgaggccugcgcggagaucuacggcgaccacuacgggaagaagaacaccgaggagaagaucuaccugcccccgauccccgccgacgagauccggaaccccgugguccugcgcgcccucucccaggcccggaaggugaucaacggcgugguccgccgguacgggagccccgcccgcauccacaucgagaccgcgcgcgaggugggcaaguccuucaaggaccggaaggagaucgagaagcgccaggaggagaaccggaaggaccgcgagaaggccgccgccaaguuccgggaguacuucccgaacuucgugggcgagcccaagagcaaggacauccugaagcugcgccucuacgagcagcagcacgggaagugccuguacuccggcaaggagaucaaccugguccggcucaacgagaagggguacguggagaucgaccacgcccugcccuucagccgcaccugggacgacuccuucaacaacaaggugcugguccucggcagcgagaaccagaacaaggggaaccagacgcccuacgaguacuucaacggcaaggacaacucccgggaguggcaggaguucaaggcgcgcguggagaccagccgguucccgcgcuccaagaagcagcggauccugcugcagaaguucgacgaggacggcuucaaggagcgcaaccucaacgacacccgguacgugaaccgcuuccugugccaguucgucgccgaccacauccugcucaccgggaagggcaagcggcgcguguucgccagcaacgggcagaucacgaaccugcugcggggcuucuggggccuccgcaagguccgggccgagaacgaccgccaccacgcgcuggacgccgugguggucgccugcuccaccguggccaugcagcagaagaucacccgcuucgugcgguacaaggagaugaacgccuucgacgggaagaccaucgacaaggagacgggcgagguccugcaccagaagacccacuucccccagcccugggaguucuucgcgcaggaggugaugauccgcguguucgggaagcccgacggcaagccggaguucgaggaggccgacacccucgagaagcugcggacccugcucgccgagaagcugagcucccgccccgaggccguccacgaguacgugacgccccuguucgugagccgggccccgaaccgcaagauguccgggcagggccacauggagaccgucaagagcgcgaagcggcucgacgagggcguguccgugcugcgcgucccccugacccagcucaagcugaaggaccuggagaagauggugaaccgggagcgcgagcccaagcucuacgaggcccugaaggcccggcuggaggcccacaaggacgaccccgccaaggcguucgccgagccguucuacaaguacgacaaggccgggaaccgcacccagcaggucaaggccgugcggguggagcagguccagaagaccggcgugugggugcgcaaccacaacgggaucgcggacaacgccacgauggugcgggucgacguguucgagaagggcgacaaguacuaccucgugcccaucuacagcuggcaggucgccaaggggauccugcccgaccgcgccguggugcagggcaaggacgaggaggacuggcagcugaucgacgacagcuucaacuucaaguucucccuccaccccaacgaccuggucgaggugaucaccaagaaggcccggauguucggcuacuucgcgagcugccaccgcgggaccggcaacaucaacauccggauccacgaccuggaccacaagaucgggaagaacggcauccucgaggggaucggcgugaagaccgcccuguccuuccagaaguaccagaucgacgagcugggcaaggagauccgcccgugccgccucaagaagcggccgcccguccgcuga

SEQ ID NO: 1558 - RNA, 3249 nt, Artificial Sequence
  Cas9 variant
auggccgccuucaagcccaacccgaucaacuacauccugggccucgacaucgggaucgcgagcgugggcugggccauggucgagaucgacgaggaggagaaccccauccgccugaucgaccugggggugcggguguucgagcgcgccgagguccccaagaccggcgacucccucgccauggugcggcgccuggcccggagcgugcgccggcugacccgccggcgcgcgcaccggcuccugcgcgcccggcgccugcucaagcgggaggggguccugcaggccgccgacuucgacgagaacggccugaucaagucccuccccaacacgccguggcagcugcgcgcggccgcccuggaccggaagcucacgccccuggaguggagcgccgugcugcuccaccugaucaagcaccgcggcuaccugucccagcggaagaacgagggggagaccgccgacaaggagcucggcgcgcugcugaaggggguggccgacaacgcccacgcccuccagaccggcgacuuccgcacccccgccgagcuggcgcugaacaaguucgagaaggagagcgggcacauccggaaccagcgcggcgacuacucccacaccuucagccgcaaggaccuccaggccgagcugauccuccuguucgagaagcagaaggaguucggcaacccccacaucuccgggggccugaaggaggggaucgagacccugcucaugacccagcggccggcccugagcggcgacgccguccagaagaugcugggccacugcacguucgagcccgccgagcccaaggcggccaagaacaccuacaccgccgagcgcuucaucuggcucaccaagcugaacaaccugcggauccucgagcagggguccgagcgcccccugacggacaccgagcgggccacccugauggacgagccguaccgcaagagcaagcucaccuacgcccaggcgcggaagcugcugggccucgaggacacggccuucuucaaggggcugcgcuacggcaaggacaacgccgaggccuccacccugauggagaugaaggcguaccacgccaucagccgggcccucgagaaggaggggcugaaggacaagaaguccccgcugaaccugagccccgagcuccaggacgagaucggcaccgccuucucccuguucaagaccgacgaggacaucacgggccgccugaaggaccggauccagcccgagauccucgaggcccugcugaagcacaucagcuucgacaaguucgugcagaucucccucaaggcgcugcgccggaucgugccccugauggagcaggggaagcgcuacgacgaggccugcgccgagaucuacggcgaccacuacgggaagaagaacaccgaggagaagaucuaccucccgcccauccccgccgacgagauccggaaccccgucgugcugcgcgcccugagccaggcgcggaaggugaucaacggcgucgugcgccgguacgggagccccgcccgcauccacaucgagaccgcccgcgaggugggcaaguccuucaaggaccggaaggagaucgagaagcgccaggaggagaaccggaaggaccgcgagaaggccgccgcgaaguuccgggaguacuuccccaacuucgucggcgagcccaagagcaaggacauccucaagcugcgccuguacgagcagcagcacgggaagugccucuacuccggcaaggagaucaaccuggggcggcugaacgagaagggcuacguggagaucgaccacgcccucccguucagccgcaccugggacgacuccuucaacaacaaggugcugguccuggggagcgagaaccagaacaagggcaaccagacgcccuacgaguacuucaacggcaaggacaacucccgggaguggcaggaguucaaggcccgcguggagaccagccgguucccccgcuccaagaagcagcggauccuccugcagaaguucgacgaggacggguucaaggagcgcaaccugaacgacacccgguacgugaaccgcuuccucugccaguucgucgccgaccggaugcgccugaccggcaaggggaagaagcggguguucgcgagcaacggccagaucacgaaccugcuccgcggcuucugggggcugcggaagguccgcgccgagaacgaccgccaccacgcccuggacgccgugguggucgccugcuccaccguggcgaugcagcagaagaucacccgguucgugcgcuacaaggagaugaacgccuucgacggcaagaccaucgacaaggagacgggggagguccuccaccagaagacccacuucccccagccgugggaguucuucgcccaggaggugaugauccggguguucggcaagcccgacgggaagcccgaguucgaggaggccgacaccccggagaagcugcgcacccugcucgccgagaagcugagcucccggcccgaggcgguccacgaguacgugacgccccuguucgugagccgcgcccccaaccggaagauguccggccagggccacauggagaccgucaagagcgccaagcgccucgacgaggggguguccgugcugcgggucccgcugacccagcucaagcugaaggaccuggagaagauggugaaccgcgagcgggagcccaagcucuacgaggcccugaaggcccgccuggaggcgcacaaggacgaccccgccaaggccuucgccgagcccuucuacaaguacgacaaggcgggcaaccggacccagcaggucaaggccgugcgcguggagcagguccagaagaccggggugugggugcggaaccacaacggcaucgccgacaacgccacgauggugcgcgucgacguguucgagaagggggacaaguacuaccucgugccgaucuacagcuggcaggucgccaagggcauccugcccgaccgggcgguggugcagggcaaggacgaggaggacuggcagcugaucgacgacuccuucaacuucaaguucagccuccaccccaacgaccuggucgaggugaucaccaagaaggcccgcauguucggguacuucgccagcugccaccggggcaccgggaacaucaacauccgcauccacgaccuggaccacaagaucggcaagaacgggauccucgagggcaucggcgugaagaccgcccuguccuuccagaaguaccagaucgacgagcuggggaaggagauccgccccugccggcucaagaagcgcccgcccguccgguga

SEQ ID NO: 1559 - RNA, 3249 nt, Artificial Sequence
  Cas9 variant
augcgcgugcugggccucgacgccgggaucgccagccugggcugggcgcugaucgagaucgaggaguccaaccgcggggagcucagccagggcaccaucaucggggccggcaccuggauguucgacgcccccgaggagaagacgcaggccggcgccaagcugaaguccgagcagcggcggaccuuccgcgggcagcggcgcgucgugcggcgccggcgccagcggaugaacgaggugcgccggauccugcacagccacggccuccugccguccagcgaccgcgacgcgcugaagcagcccgggcucgaccccuggcggauccgcgccgaggcccuggaccggcugcucggccccgucgagcuggccguggcgcuggggcacaucgcccgccaccggggcuucaaguccaacagcaagggcgccaagaccaacgacccggccgacgacaccuccaagaugaagcgcgccgugaacgagacgcgggagaagcucgcgcgcuucgggagcgccgccaagaugcuggucgaggacgaguccuucgugcugcgccagacccccaccaagaacggcgccagcgagaucgugcggcgcuuccggaaccgcgagggggacuacucccggagccuccugcgcgacgaccuggccgcggagaugcgggcccucuucaccgcccaggcccgcuuccaguccgccaucgcgacggccgaccugcagaccgccuucaccaaggccgccuucuuccagcggccccugcaggacagcgagaagcucgucggccccugcccguucgagguggacgagaagcgcgcgcccaagcggggcuacuccuucgagcuguuccgcuuccugagccggcucaaccacgugacccugcgcgacgggaagcaggagcggacgcugacccgcgacgagcucgcccuggccgccgcggacuucggcgccgccgccaaggucuccuucaccgcccugcggaagaagcucaagcugcccgagaccacgguguucgugggggucaaggcggacgaggagagcaagcuggacgugguggcccgcagcggcaaggccgccgaggggaccgcccggcuccgcuccgucaucguggacgcgcugggcgagcuggccuggggcgcccuccugugcagccccgagaagcuggacaagaucgccgaggugaucuccuuccgcagcgacaucgggcggaucuccgagggccucgcccaggcggggugcaacgccccgcuggucgacgcccugaccgccgcggccagcgacggccgcuucgaccccuucaccggggccggccacaucuccagcaaggccgcccggaacauccucuccggccugcgccaggggaugacguacgacaaggcgugcugcgccgccgacuacgaccacaccgccagccgggagcgcggcgccuucgacgugggcgggcacgggcgggaggcgcugaagcgcauccuccaggaggagcggaucucccgcgagcuggugggcagccccaccgcccggaaggcccugaucgaguccaucaagcaggucaaggccaucguggagcgcuacggcguccccgaccggauccacguggagcuggcccgcgacgugggcaagagcaucgaggagcgggaggagaucacccgcgggaucgagaagcggaaccgccagaaggacaagcuccgggggcuguucgagaaggaggucggccgcccgccccaggacggcgcgcgggggaaggaggagcugcuccgcuucgagcugugguccgagcagaugggccgcugccuguacacggacgacuacaucagccccucccagcucguggccaccgacgacgccgugcaggucgaccacauccugcccuggagccgguucgccgacgacuccuacgcgaacaagacccugugcauggccaaggccaaccaggacaagaaggggcgcaccccguacgagugguucaaggccgagaagacggacaccgagugggacgccuucaucgugcggguggaggcgcucgccgacaugaagggcuucaagaagcgcaacuacaagcugcggaacgccgaggaggccgccgcgaaguuccgcaaccggaaccugaacgacacccgcugggccugccggcuccuggccgaggcccugaagcagcucuaccccaagggggagaaggacaaggacggcaaggagcgccggcgcgucuucagccggcccggcgcccugaccgaccgccugcggcgcgcgugggggcuccaguggaugaagaaguccacgaagggcgaccggauccccgacgaccgccaccacgcccuggacgccaucgugaucgccgccaccaccgagagccugcuccagcgggcgacccgcgaggugcaggagaucgaggacaaggggcugcacuacgaccuggucaagaacgugacgccgcccuggcccggcuuccgcgagcaggccguggaggccgucgagaagguguucguggcccgggcggagcgccggcgcgcccgggggaaggcccacgacgccaccauccgccacaucgccguccgggagggcgagcagcgcguguacgagcggcgcaagguggcggagcucaagcuggccgaccuggaccgggucaaggacgccgagcgcaacgcccggcucaucgagaagcugcgcaacuggaucgaggccggcagccccaaggacgacccgccccugucccccaagggggacccgaucuucaaggugcggcucgugaccaagagcaaggucaacaucgcgcuggacaccggcaaccccaagcgccccgggaccguggaccggggcgagauggcccgcguggacgucuuccggaaggccuccaagaaggggaaguacgaguacuaccuggugcccaucuacccgcacgacaucgccacgaugaagaccccgcccauccgcgccgugcaggcguacaagcccgaggacgaguggcccgagauggacagcuccuacgaguucugcuggagccucguccccaugaccuaccuccaggugaucuccagcaagggcgagaucuucgagggcuacuaccgggggaugaaccgcuccgugggcgccauccagcugagcgcccacuccaacagcuccgacgucgugcaggggaucggcgcccgcacccugacggaguucaagaaguucaacguggaccgguucgggcgcaagcacgaggucgagcgggagcugcgcaccuggcggggcgagaccuggcgcggcaaggcguacaucuga

SEQ ID NO: 1560 - RNA, 3255 nt, Artificial Sequence
  Cas9 variant
augaagaacacccuguacggcaucgggcucgacaucggcguggccagcgucgggugggccguggugggccugaacgggaccggcgagcccgucggccugcaccgccucggggugcggaucuucgacaaggcggagcagccgaagacgggcgagucccuggccgcgccccgccggauggcccgcgggaugcggcgccggcugcgccggaaggcccuccgccgggcggacguguacgcccugcuggagcgcagcggccucuccacccgggaggcccuggcccacauguucgaggccgggggccuggaggacaucuacgcccuccgcacccgggcccuggacgagcccgucggcaaggccgaguucagccgcauccugcuccaccuggcccagcggcgcggguucaaguccaaccggcgcaccgcgagcgacggcgaggacgggcggcugcucgccgccgugaacgagaaccgccgccggauggcccagggcggcuggcgcacggugggggagaugcuguaccggcacgaggccuucgcgcugcacaagcgcaacaaggccgacgaguaccucuccaccgucggccgggacaugguggccgaggaggccagccugcuguuccagcgccagcgggagcucgggugcgccugggcgacccccgagcugcaggccgaguaccuguccauccuccugcgccagcggagcuucgacgagggccccgggggcaacuccccguacggcgggaaccagguggagaagauggucggccgcugcaccuucgagcccgacgagccccgggccgccaaggccgcguacagcuucgaguacuucucccugcuccagaagaucaaccacauccgccugguggagaacggggagacgcggccgcugacccagcagcagcgccagcagcuccugagccuggcccacaagacccccgacgugucccucgcccggauccgcaaggagcuggcccugcccgagaccguccaguucaacggcgugcggugccgcgcgaacgagacgcucgaggagagcgagaagaaggagaaguucgccugccugcccgccuaccacaagaugcggaaggcccuggacgggguggucaagggccgcaucuccagccucuccaucagccagcgcgacgccgcggccaccgcccugagccuguacaagaacgaggacacccuccgggccaagcugaccgaggccggcuuccaggcgccggagaucgacgcccuggccgggcucacgggcuucuccaaguucgggcaccugagccugaaggccugccgcaagcugaucccccaccucgagcagggccugaccuacgaccaggccugcuccgcggccggguacgacuucaagggccacggcgccggggagcgggccuucacccugcccgcggccgcccccgagauggagcagaucaccagcccgguggugcgccgggccgucgcccagacgaucaagguggugaacggcaucauccgcgagauggacgcgucccccgccuggguccggaucgagcucgcccgcgagcugagcaagaccuucggggagcggcaggagauggaccgcuccaugcgggagaacgccgcccagaacgagcgccugaugcaggagcuccgggacaccuuccaccuccugagccccaccggccaggaccuggugaaguaccgccuguggaaggagcaggacggcgucugcgcguacucccugcggcgccucgacguggagcggcuguucgagcccggguacguggacgucgaccacaucgugccguacagccuguccuucgacgaccgccggagcaacaaggugcucguccuguccagcgagaaccgccagaagggcaaccggcugccccuccaguaccugcaggggaagcgccgcgaggacuucaucguguggacgaacuccagcgugcgggacuaccgcaagcggcagaaccugcuccgcgagaagcuguccggcgacgaggccgagggguuccggcagcgcaaccugcaggacacccagcacauggcccgguuccucuacaacuacaucagcgaccaccuggccuucgcccaguccgaggcgcugggcaagaagcgcgucuucgccgugagcggcgccgugaccagccaccuccggaagcgcugggggcuguccaagguccgggccgacggcgaccugcaccacgcgcucgacgccgccgugaucgccugcaccacggacgggaugauccgccggaucagcggcuacuacgggcacaucgagggcgaguaccugcaggacgccgacggcgcggggucccagcacgcccgcaccaaggagcgguuccccgcccccuggccgcgcuuccgggacgagcugaucgugcgccucagcgagcagcccggcgagcaccuccuggacaucaaccccgaguucuacugcgaguacgggaccgagcacauccggcccgucuucgugucccgcaugccgcgccggaaggugaccggccccgggcacaaggagacgaucaagggcgccgccgcggccgacgagggccugcugaccguccgcaaggcccugaccgagcucaagcuggacaaggacggggagaucaaggacuacuacaugcccagcuccgacacccugcucuacgaggcccugaaggcccagcugcggcgcuucggcggggacagcaagaaggcguucgccgagccguucuacaagcccaaggccgacggcacgcccgggccccucgugcggaaggugaagaccaccgagaaggccacccugaccgucccggugcacggcggcgccgcguccaacgacacgauggugcgcgucgacguguuccuggugcccggggacggcuacuacuggguccccguguacaccgccgacacccucaagcccgagcugccgaaccgggccgugguccaggggaagcccuacagcgaguggaaggagaugcgcgaggaggacuucaucuucucccuguaccccaacgaccucguguacguggagcacaagagcggccugaaguucacccugcagaacgccgacuccacgcucgagaagacccggacccagaccagcgcguucgucuacuucgugggcggguccaucagcacggccuccaucaccauccgcacccacgacaacgccuacggcauccccagccugggggugaagacccugaagacguuccacaaguaccaggucgacgugcucggcaacguguucccgguccacaaggagacccggcagaaguuccgcuga

SEQ ID NO: 1561 - RNA, 3255 nt, Artificial Sequence
  Cas9 variant
augaagaacacccuguacggcaucgggcucgacaucggcguggccagcgucgggugggccguggugggccugaacgggaccggcgagcccgucggccugcaccgccucggggugcggaucuucgacaaggcggagcagccgaagacgggcgagucccuggccgcgccccgccggauggcccgcgggaugcggcgccggcugcgccggaaggcccuccgccgggcggacguguacgcccugcuggagcgcagcggccucuccacccgggaggcccuggcccagauguucgaggccgggggccuggaggacaucuacgcccuccgcacccgggcccuggacgagcccgucggcaaggccgaguucagccgcauccugcuccaccuggcccagcggcgcggguucaaguccaaccggcgcaccgcgagcgacggcgaggacgggcggcugcucgccgccgugaacgagaaccgccgccggauggcccagggcggcuggcgcacggugggggagaugcuguaccggcacgaggccuucgcgcugcacaagcgcaacaaggccgacgacuaccucuccaccgucggccgggacaugguggccgaggaggccagccugcuguuccagcgccagcgggagcucgggugcgccugggcgacccccgagcugcaggccgaguaccuguccauccuccugcgccagcggagcuucgacgagggccccgggggcgacuccccguacggcgggaaccagguggagaagauggucggccgcugcaccuucgagcccgacgagccccgggccgccaaggccgcguacagcuucgaguacuucucccugcuccagaagaucaaccacauccgccuggccgagaacggggagacgcggccgcugacccagccccagcgccagcagcuccugagccuggcccacaagacccccgacaugucccucgcccggauccgcaaggagcuggcgcugcccgagaccgugcaguucaacggcgugcggugccgcgccaacgagacgcucgaggagagcgagaagaaggagaaguucgccugccugccggccuaccacaagaugcggaaggcccucgggggcgucgugaagggccgcaucuccagccuguccaucagccagcgcgacgcggccgccaccgcccugagccuguacaagaacgaggacacccuccgggccaagcugaccgaggcgggguuccaggcccccgagaucgacgcccuggccggccucacgggguucuccaaguucggccaccugagccugaaggccugccgcaagcugaucccccaccucgagcaggggcugaccuacgaccaggcgugcuccgccgccggcuacgacuucaagggccacggggccggcgagcgggcguucacccugcccgccgccgccccggagauggagcagaucaccagccccgugguccgccgggccguggcgcagacgaucaagguggucaacgggaucauccgcgagauggacgccucccccgccugggugcggaucgagcucgcccgcgagcugagcaagaccuucggcgagcggcaggagauggaccgcuccaugcgggagaacgccgcgaagaacgagcgccugaugcaggagcuccgggacaccuuccaccuccugagccccaccggccaggaccuggugaaguaccgccuguggaaggagcaggacggggucugcgccuacucccugcagcggcucgacguggagcagcuguucgagccgggcuacgucgacguggaccacaucgugcccuacagccuguccuucgacgaccgccggagcaacaagguccucgugcuguccagcgagaaccgccagaaggggaaccggcugccccuccaguaccugcagggcaagcgccgggaggacuucaucguguggacgaacuccagcguccacgacuaccgcaagcgccagaaccugcuccgggagaagcuguccgacgacgaggccgagggguuccgccagcggaaccugcaggacacccagcacauggcccgcuuccucuacaacuacaucagcgaccaccuggccuucgcgcaguccgaggcccugggcaagaagcggguguucgccgugagcggcgccgucaccagccaccuccgcaagcggugggggcuguccaaggugcgcgcggacggcgaccugcaccacgcccucgacgccgccguggucgccugcaccacggacgggaugauccggcgcaucagcggcuacuacgggcacaucgagggcgaguacuuccaggacgcggacggcgccgggucccagcacgcccggaccaaggagcgcuuccccgccccguggccccgguuccgcgacgagcugaucgugcggcugagcgagcagcccggcgagccccuccuggacaucaacccggccuucuacugcgaguacgggaccgagcacauccgccccguguucgucucccggaugccccgccggaaggugaccggcccgagccacaaggagacggugaagggggcggccgccgccgacgagggccugcucaccguccgcaaggcccugaccgagcugaagcucgacaaggacggcgagaucaaggacuacuacaugcccuccagcgacacccugcuguacgaggcgcucaaggcccagcugcgccgguucgggggcgacgggaagaaggccuucgccgagcccuucuacaagcccaaggccgacggcacgccggggccccuggugcgcaaggugaagaccaccgagaaggcgacccucaccguccccgugcacggcggcgccgccuccaacgacacgauggugcggaucgacgucuucuucaugcccggggacggcuacuacugggugccgcuguacguggccgacacccugaagcccgagcuccccaaccgcgcggucguggcccacaagcccuacagcgaguggcaggagaugcgggaggaggacuucguguucucccuguacccgaacgaccuggucuacguggagcacaagagcgagcucaaguucaccgugcagaacgccgacuccacccuggagaagacgcgcacccaggccagcgccuucgucuacuucguguccgggggcaucagcggcgggaccaucaccgugcggacgcacgacaacuccuacggcauccccagccuggggcucaagacccucaagagccugugcaaguaccaggucgacgugcugggcaacguguuccccguccacaaggagacccgccagaaguuccgguga

SEQ ID NO: 1562 - RNA, 3255 nt, Artificial Sequence
  Cas9 variant
augaagaacacccuguacggcaucgggcucgacaucggcguggccagcgucgggugggccguggugggccugaacgggaccggcgagcccgucggccugcaccgccucggggugcggaucuucgacaaggcggagcagccgaagacgggcgagucccuggccgccccgcgccggauggcccgcgggaugcggcgccggcugcgccggaaggcccuccgccgggcggacguguacgcccugcuggagcgcagcggccucuccacccgggaggagcuggcccagauguucgaggccgggggccuggaggacaucuacgcgcuccgcacccgggcccuggacgagcccgucggcaaggccgaguucagccgcauccugcuccaccuggcccagcggcgcggguucaaguccaaccggcgcaccgccagcgacggcgaggacgggcggcugcucgcggccgugaacgagaaccgccgccggauggcccagggcggcuggcgcacggugggggagaugcuguaccggcacgaggccuucgcccugcacaagcgcaacaaggcggacgacuaccucuccaccgucggccgggacaugguggccgaggaggccagcauccuguucgagcgccagcgggccauggggugcuccugggccgcgcccgagcugcaggccgaguaccucagcauccugcugcgccagcgguccuucgacgagggccccgggggcaacagccccuacggcgggaaccagguggagaagauggucggccgcugcaccuucgagcccgacgagccccgggccgccaaggccgcguacuccuucgaguacuucagccuccugcagaagcugaaccacauccgccucgccgagaacggggagacccggccgcugacgcagccccagcgccagcagcugcucucccuggcccacaagacccccgacaucagccuggcccggauccgcaaggagcucgcgcugcccgagaccgugcaguucaacggcgugcggugccgcgccaacgagacccuggaggaguccgagaagaaggagaaguucgccugccucccggccuaccacaagaugcggaaggcccuggacggggucgugaagggccgcaucagcucccugagcaucagccagcgcgacgcggccgccacggcccucucccuguacaagaacgaggacacccugcgggccaagcucaccgaggcgggcuuccaggcccccgagaucgacgcccuggccgggcugaccggcuucagcaaguucgggcaccucucccugaaggccugccgcaagcugaucccccaccuggagcagggccucacguacgaccaggcgugcaccgccgccggguacgacuucaagggccacggcgccggggagcgggcguucacccugcccgccgccgccccggagauggagcagaucaccagccccgugguccgccgggccguggcgcagacgaucaagguggucaacggcaucauccgcgagauggacgccucccccgccugggugcggaucgagcuggcccgcgagcucagcaagaccuucggggagcggcaggagauggaccgcuccaugcgggagaacgccgcgcagaacgagcgccugaugcaggagcugcgggacaccuuccaccuccugagccccaccggccaggaccuggugaaguaccgccucuggaaggagcaggacggcgucugcgccuacucccugcggcgccuggacguggagcggcuguucgagccgggguacgucgacguggaccacaucgugcccuacagccuguccuucgacgaccgccggagcaacaagguccuggugcucuccagcgagaaccgccagaagggcaaccggcugccccugcaguaccuccaggggaagcgccgcgaggacuucaucguguggacgaacuccagcguccacgacuaccggaagcgccagaaccugcugcgggagaagcucuccggcgacgaggccgagggguuccgccagcggaaccugcaggacacccagcacauggcccgcuuccuguacaacuacaucagcgaccaccucgccuucgcgcaguccgaggcccugggcaagaagcggguguucgccgugagcggcgccgucaccagccaccuccgcaagcggugggggcucuccaaggugcgcgcggacggcgaccugcaccacgcccuggacgccgccguggucgccugcaccacggacgggaugauccggcgcaucagcggcuacuacgggcacaucgagggcgaguaccuccaggacgcggacggcgccgggucccagcacgcccggaccaaggagcgcuuccccgccccguggccccgguuccgcgacgagcugaucgugcggcugagcgagcagcccgccgagccccuccuggacaucaacccggaguucuacugcgaguacggcaccgagcacauccgccccguguucgucucccggaugccccgccgcaaggugaccgggccgggccacaaggagacgaucaagggggcggccgccgccgacgagggccugcucaccgugcggaaggcccugaccgagcugaagcucgacaaggacggcgagaucaaggacuacuacaugcccagcuccgacacccugcuguacgaggcgcucaaggcccagcugcgccgguucgggggcgacgggaagaaggccuucgccgagcccuucuacaagcccaaggccgacggcacgccggggccccugguccgcaaggugaagaccaccgagaaggcgacccucaccgugcccguccacggcggcgccgccagcaacgacacgauggugcggguggacgucuuccuggugcccggggacggcuacuacugggugccggucuacaccgccgacacccugaagcccgagcuccccaaccgcgcgguggugcaggggaagcccuacuccgaguggaaggagaugcgggaggaggacuucaucuucagccuguacccgaacgaccuggucuacguggagcacaaguccggccucaaguucacccugcagaacgccgacagcacgcuggagaagacccgcacccagaccuccgccuucgccuacuucgugagcggcuccaucagcacggccuccaucaccauccggacccacgacaacgcguacgggauccccagccucggcgucaagacccugaagacguuccacaaguaccagguggacgugcuggggaacgucuuccccgugcacaaggagacccgccagaaguuccgguga

SEQ ID NO: 1563 - RNA, 3255 nt, Artificial Sequence
  Cas9 variant
augcgccugggccucgacaucgggaccaacagcaucggcugguggcuguacgggaccgagggcgggcggaucacggagguggucgacggcggcgugcgcaucuucuccgacgggcgggacccccagagcaaggccucccuggccguggaccgccgggcggcccgcagccagcggcgccggcgcgaccgguaccuccgccggaaggccgcccugaugaagcgcauggcccaggucggccugaugccggcggaccccgccgaggccaaggugcucgaggugcugaaccccuacgagcugcgggccuccgggcucgacggcccccugccgcugacccacuucgggcgcgcccucuuccaccugaaccagcggcgcggcuucaagagcaaccggaagaccgaccgcggcgacaacgaguccgggaagaucaaggacgccaccgcccggcuggaccaggccaugauggccaagggcgcgcgcacguacggggaguuccuccacaugcgccgggccgccgcccuggaccccaagagcguccccuccgugcgcacccggcugaccguggcccgccgggacgacgcggagaaggaggaggccggcuacgacuucuaccccgaccgcaagcaccucagcgaggaguucgacaagcugugggccgcccaggcccggcacgcgccggacguccugaccgaggaccuccgcgacgagaucgccacgaucaucuuccaccagcggccccugaagacccccgaggugggccugugccucuucaccgggcagcacggcgugcccgagcgcgacaagcggaucccguccgcccacccccugaaccagcgccggauccugauggagaccgucaacaaccucaagguggccgcccagggggagcccagccgcccccugacgcgggaggagcgcgaccagaucgugcacgcgcuggacaacaagaagcacaccaagucccucagcggcaugaccaugaagcugaaggcccuggggaaggucaucaagcuccggccggagcagggcuucacccuggagacggccaaccgcgacgccaucgcgugcgaccccgugcgggccucccugagccaccccgaccgcuucggcgcccgcugguccacccucgagagcgccgggcagugggacgugguccagcggauccgcgccgugcaguccgacgcggagcacgccgaccuggugggcuggcugauggacguccacgggcucgaccgggaccacgccgaggagaccgccaacgcgccccugccggagggcuacgggcgccugggccucaccgcgacgacccggauccuggccgcccuggaggccgacgugcucaacuacagcgccgcgguggccgccugcggcuggcaccacagcgacgggcgcaccggcgagguccuggagucccugcccuacuacggggagauccucgagcggcacgugauccccggcaccggggaccccaacgacgacgacgucaagcgcuacggccggaucacgaacccgaccgugcacaucggccugaaccagcugcgccggcuggugaaccgcaucaucaccgucuacgggcggcccgacgagaucgugguggagcucgcccgcgaccugaagcugagcgaggaccagaagaaggacguccagcgggacaucaagaagaacaccgaggcggccauccgccggggcaagaagcucgaggagaugggggugcccaacacgggcgccaaccgcauggugcugcggcugugggaggaccucggcgacgacgucaugacccgcaacugccccuacaccgggaagcggaucuccgccggcaugcuguucgacgggagcugcgacguggaccacauccugccguacucccgcacccucgacgacagcuucgccaaccgcacgcugugccugaaggaggcgaaccggcagaagaccgacaagacccccugggaggccuggggcgagaccgagcagugggaggccaucgccgccaaccucaagaaccugcccgcgaacaaggccuggcgcuucgccccggacgccauggagcgguucgagggggagaaggacuucuccgcccgcgcgcuggccgacacgcaguaccucagccggaucgcccgcgccuaccuggacgcgcuguacgacggcgacgacggcaagucccacgugugggucgugcccgggcggcucaccgagaugcugcgccggcacuggggccugaacgggguggccgcccucaccgacagcgacaagcagaccgucaaggccaagaaccgcaccgaccaccggcaccacgccaucgacgcggccgugguggccgccacggaccgcggccugaucaagcggaucgccgacauggcgaagcgcgacgaguucaacggggccgaggaggucgcccgguccaucccgccgcccugggagggcuuccgcgacgacgugagcgcccaggugacccggaucaucgucucccaccgcgccgaccacggccggaucgaccccgcggcccgcaagagcgggcgcgacuccaccagcggccagcugcacaacgacaccgccuacgggaucggccgggacgggacgguggugucccgcaagccccucgccagccugucccccaacgacaucgucgugaccaagcggggcgccaacauccgcgacguggaccugcagaagcaccucgcgcgggucacccacggccuggacgggaaggccuucgaggccgcccugcucgcguucgccgccagccccauccugcccgacaacaccgacaaccccuacuucggccugcgccgggugcgccucgaggagacgcugcaggagagcgcccggguggaggucgccgaccaggaggggcgccccuacaaggcguacaagggcgacuccaaccacugcuacgagaucuggugccugccggacgggaagaucaagccccagguggugaccaccuacgaggcccaccagagcggcgccgagaagaagccccaccccgccgccaagcggcucaugcgcaucuucaagcgggacauggucaugcuggagcgcgacggcgagaccaucaucggguacgugcagaagaugaagcagaacggcuccaucuucguggcgccgcacacggaggccaacgccgacgcccgggaccgcgaccccaaggacgacuucaagcugauccagcucggggccggcagccuggucaaggcgaaggcccggcgcgugaucguggacgagaugggccggcugcgcgaccccgggcccccgcucuga

SEQ ID NO: 1564 - RNA, 3258 nt, Artificial Sequence
  Cas9 variant
auggacaagggcaccaacagcaucgggugggccgcccugcgccucgacgagcagggcgagcccguggggaucaucgaggcgggcguccggaucuacgccgacgggcgcgagccgaaguccggcaccagccuggccgagggccggcgcaucgcccgggggaugucccgccggcgcgaccgguacaagcgccggcgccggacggugcugaacacccucaccgaguucggccugaugcccgccaccaaggcggcccgcaaggcccugguggccgagacgaacgaccggcgcuucggggaggucgcgagcaacguguacgcccuccgggcccgcgcccuggacgagaagcugccccucuaccagcugggccgggcccuguuccaccucaaccagcgccggggguucaaguccaaccgcaagaccgacaagcgcgacaacgaccagggcaagaucgcgagcgccaucucccggcugggccgcaagcuggacgaggccggggcccggacccucggcgaguuccugcacaagcagcacgccgcggggaagugggugcgcguccggcccagccgcgugccgggcgaggacgacaaggaggaggacggcuacggguucuaccccgagcgguccuuccuggagcgcgaguucgccgccaucugggaggcccaggccgcguucuaccccgagcuccugaccgaggagcggcgcgaccaccuccacugggugauguucuuccagcggccccugaagcgcccgacggucggcaagugcagcuuccaccccgacgaggaccggcugcccaaggcccacccccuguuccaggaguuccgccucaucaaggagcugaacgagcuggagguggugcaccgcggggaccggcgggagaagcucaccccggaccagcgcgaccggcuguucaaccagcugcgcacccagcgcuccagcgccuucaccgcccuccggaagacgaucaaggcccccaccggcacccgcuucaacaaggaguccgacgcgcgggacaagcugaagggggacgaggucgccgccgagaugagccacaaggaccgcuucggccaggccuggaucggcaugccccuggcggagcggugggccgugguggccaugcuccuggacaccgaggacccccuggaggucaaggccuggcucgaggagcgcuacggguucgccgcggaccggaucgacgccaucgccgccgccaagcugccgacgggcuacgggcgccugggcgagaccgcgcuccgggacaugcuggacgagcugcgcaacgggaccgugaaggacgacgccggccgggacgugguccucaccgagcgccaggccauggacaacaucuggggcgacaaccccgcccugcagcgggccgugacggacgcgcgcgagcugccgcccuaccaggaggugcucgggcggcgcaucccgcccggcaccgggaagcccgccgaccccuacgacguccagaagggccggcugaccaaccccaccgugcacaucgggcugaaccagcucaagcgcaucgugaacguccugaugcggcgccacggccggcccgagcagaucgcccuggagcuggcccgcgaccucaagcugaacgaggagcagaaggcggagaagaaccgcgagaucgcccggaacacgaaggccgccgaggcccgcggcaagaagcuggaggagcucgggcacgcgaacaacggcuacaaccgggugcugcugaagcucugggaggaccugaaccugaagcagcccgagaaccgcgagugcaucuacugcgggaaggccaucggcaucggcacccuccuguccaaccaggucgacaucgaccacauccugcccuggagcaagacccucgacgacucccaggccaaccggaucgugugccacguggagugcaaccgccagaaggggaaccacgccccggccgaggucccccaguggcacgaccgguacgacgacauccuggcgcgcgccgagcggcugccccgcaacaaggccuggcgguucggccgcgaggccaugaagaaguucaaggacgacgagagcuuccucgcccggcagcugaccgacacgcaguaccugucccgccucgcgcacgaguaccugggggcccuguacccggacgaggagcccgacgaguggggcgggcccgcccggcgcaaccacgugcgggugauccccggccgcaugaccgagaugcuccggcgccaguggggccugaacgccaucaucagcgaccacaaccagaagaaccgcaacgaccaccggcaccacgcgaucgacgccaucgucgugggggugaccacccgccggcugcuccagcgcaucgccacggucgccggcgggcgggaggcccuggcgcuggaggagaccaucggcaagaucgagccgcccuggcccggguucuacgacgacgugaaggccgccaucgaccgcaucguggucagccacaagcccgaccacggcucccucccgaagcccggcaagcccgggcggaccgccggccagcugcacaacgacaccgccuacggguucacgggcgaggcgcgcaacggggugcccaucauggugcaccgggucccguucgccagccugaccgagaaggacauccccuccauccgcgaccggcagcucgccgacgcccuguacgccgcgaucagcggcaucuccggcaaggccgagcuggccgccgcccucgcgcgcuucagcgaguccgggcccuacaagggcauccggcacgugcgcguggucgagcccgugagcgugaucgccaucaaggaccaggccgggaaggccuacaagggcuacaagggggacgcgaacuaccgguacgacgucugggagcugccgaacggcaaguggacccacgaggugguguccauguucaacgcccaccgccccgacuggcagagcgagauccgguccaagaaccccgccgcccgcaagguccugagccuccaccagaacgacaugguggccuacgagcacccccaggacggcuacaccaucgggcggguggucaaguucuccgcgggcgggcagauggcccuggccggcaaccgcgagggcggggcccucaagagccgggacgccgacccggaggaccgcuuccgcuacuucuacaaguccggcggggcgaugcgggacgugcagcugcgccaggugcgggucgacgagaccggccgcguguucgaccccgggccccaggaccgggagagccgcaacgcccggaagcagaacgacgccggcuga

SEQ ID NO: 1565 - RNA, 3264 nt, Artificial Sequence
  Cas9 variant
augcgcuacaagaucggccuggacaucgggaucaccagcgugggcugggccgucaugaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccuggugauccgggaggggauccugacgaaggaggagcucgacaagcuguucgaggagaagcacgagaucgacgucuggcagcugcgcguggaggcccucgaccggaagcugaacaacgacgagcuggcccgcgugcuccugcaccuggcgaagcggcgcggcuucaaguccaaccgcaagagcgagcgguccaacaaggagaacagcaccaugcucaagcacaucgaggagaaccgcgccauccuguccagcuaccggaccgucggcgagaugaucgugaaggaccccaaguucgcccugcacaagcgcaacaagggggagaacuacaccaacacgaucgcccgggacgaccucgagcgcgagauccggcugaucuucuccaagcagcgcgaguucggcaacaugagcugcaccgaggaguucgagaacgaguacaucaccaucugggcgucccagcggcccguggccagcaaggacgacaucgagaagaaggucggguucugcaccuucgagccgaaggagaagcgcgcccccaaggccacguacaccuuccaguccuucaucgccugggagcacaucaacaagcugcggcucaucagccccuccggcgcgcgcgggcugaccgacgaggagcggcgccugcucuacgagcaggccuuccagaagaacaagaucaccuaccacgacauccggacgcugcugcaccuccccgacgacaccuacuucaagggcaucguguacgaccgcggcgagagccggaagcagaacgagaacauccgcuuccuggagcuggacgccuaccaccagauccggaaggccguggacaaggucuacgggaagggcaaguccagcuccuuccucccgaucgacuucgacaccuucggguacgcccugacccuguucaaggacgacgcggacauccacagcuaccuccgcaacgaguacgagcagaacggcaagcgcaugcccaaccuggccaacaagguguacgacaacgagcugaucgaggagcuccugaaccugagcuucacgaaguucggccaccucucccugaaggcccugcggagcauccuccccuacauggagcagggggagguguacuccagcgccugcgagcgcgccggcuacaccuucaccgggcccaagaagaagcagaagaccaugcugcugccgaacaucccgcccaucgcgaaccccgucgugaugcgggcccucacgcaggcccgcaagguggucaacgccaucaucaagaaguacggcucccccgugagcauccacaucgagcuggcccgggaccugucccagaccuucgacgagcgccggaagaccaagaaggagcaggacgagaaccgcaagaagaacgagaccgcgauccggcagcugauggaguacgggcucacgcugaaccccaccggccacgacaucgugaaguucaagcuguggagcgagcagaacggccgcugcgccuacucccuccagcccaucgagaucgagcggcugcuggagcccggguacgucgagguggaccacgugaucccguacagccgcucccucgacgacagcuacaccaacaagguccuggugcugacccgggagaaccgcgagaagggcaaccggauccccgccgaguaccucggggucggcacggagcgcuggcagcaguucgagaccuucgugcugaccaacaagcaguucuccaagaagaagcgggaccgccugcuccggcugcacuacgacgagaacgaggagaccgaguucaagaaccgcaaccugaacgacacgcgguacaucagccgcuucuucgccaacuucauccgcgagcaccucaaguucgcggaguccgacgacaagcagaagguguacaccgucaacgggcgggugaccgcccaccuccgcagccggugggaguucaacaagaaccgcgaggaguccgaccugcaccacgccguggacgccgucaucguggccugcaccacgcccagcgacaucgcgaaggugaccgccuucuaccagcggcgcgagcagaacaaggagcuggccaagaagaaggagccccacuucccgcagcccuggccccacuucgccgacgagcugcgggcccgccuguccaagcaccccaaggagagcaucaaggcgcucaaccugggcaacuacgacgaccagaagcuggagagccuccagccggucuucgugucccggaugcccaagcgcagcgugaccggcgccgcccaccaggagacccugcggcgcuacgucgggaucgacgagcgguccggcaagauccagaccguggugaagacgaagcugagcgagaucaagcucgacgccuccgggcacuuccccauguacggcaaggagagcgacccgcgcaccuacgaggccauccggcagcgccugcuggagcacaacaacgaccccaagaaggcguuccaggagccccucuacaagcccaagaagaacggggagccgggccccgucauccggaccgugaagaucaucgacaccaagaaccaggugaucccccugaacgacggcaagacggucgccuacaacuccaacaucgugcgcguggacgucuucgagaaggacgggaaguacuacugcgugcccguguacaccauggacaucaugaagggcauccugccgaacaaggccaucgagcccaacaagcccuacagcgaguggaaggagaugaccgaggacuacaccuuccgguucucccucuaccccaacgaccugauccgcaucgagcugccgcgcgagaagacggucaagaccgccgcgggggaggagaucaacgugaaggacguguucgucuacuacaagaccaucgacagcgccaacggcggccucgagcugaucucccacgaccaccgguucagccugcgcggggugggcucccggacccucaagcgcuucgagaaguaccagguggacguccuggggaacaucuacaaggugcggggcgagaagcgcguggggcuggccagcuccgcccacagcaagcccggcaagacgauccggccccuccaguccacccgcgacuga

SEQ ID NO: 1566 - RNA, 3264 nt, Artificial Sequence
  Cas9 variant
augcugcgcaugaaguacgccaucggccucgacaucgggaucgccagcgugggcuacgcgguccuggcccuggaccacgaggagaaccccugggggaucauccggcucggcucccgcaucuucgacguggccgagaacccgaaggacggggccagccuggcccugccccggcgcgaggcgcgguccgugcgccggcgccuccggcgccaccaccaccggcuggagcgcaucaagaaccugcucaucaacaccgaguucaucaccaaggacgagcugcugcaccucuacgacggcaaccugagcgacgucuacgagcugcgggugaaggcccucgacuacuccgugacgaacgccgagcugacccgcauccugcuccaccuggcccagcggcgcggcuucaagagcaaccggaaguccgacgcgaacgacaaggaggccgggcagcugcucgaggccgucagcgccaacgccaagcgcaugcaggagaaccacuaccggaccgugggcgagauguucuacaaggacgaccuguucuccaaguacaagcgcaacaagggcgggaccuaccugacgaccgugcaccgggacaugaucgcggccgaggcccgcaccauccucgagaagcaguucgcccuggggaacaacaucugcacccaggacuucaucgacaaguaccugagcauccuccugucccagcgccaguucgacgagggccccggcgagcccagcccguacgccgggaaccagaucgcgaacaugaucggcaagugcacguucgagcccaacgaguaccgggccgccaaggccuccuacagcuucgagcgcuucaaccugcuccagaaggucaaccaccuccggcugcugcuggaggggaaguccaucgcccuggacaacgagcagcgcaagaagaucaucgcgcucgcccacgacaaggccgaccugcgguacagccacauccgcaaggcccugggccucgacgagaaggugcuguucaacaccaucaccuacaacgacgacguguccgucaucgagaagaagaccaaguucaacuuccugcaggccuaccaccagaucaagaaggugcucgcggaggacaugcagaagcugacgaccgagcagcuggacaacaucggccagauccucagcaccuacaaguccgacaacaagcggaccgaggagcugagcgcccuggggcucgagaagaagaucaucgacgcccugcugggcaucaacgggcugagcaaguucgcccaccucucccugaaggcgcugcgcaagaucaaccccuaccucgaggagggcaagaucuacaacgaggccugcacggccgccggguacgacuucaaggcccacgcgaacacccagaagaccgagcugcugcccgccuacaaggaggagauggacgacaucaccagcccgguggcccggcgcgccaucgcccaguccaucaaggucaucaacgcgaucauccgggagcagaagggcagcccccucuacaucaacaucgagcuggcccgcgagauggccaagggcuucgacgagcggacgcagaucgacaaggccaacaaggagaaccaggccaagaacgagcgcaucauggagcggauccgcaccgaguuccacaaggcgaaccccaccgggauggaccugaucaagcucaagcugugggaggagcaggacggccggucccccuacagccagaaggccaucuccaucaaccgccuguucgagccgggguacguggacaucgaccacaucgugcccuacagcaucuccuucgacgacagcuucaagaacaagguccucguguucuccgacgagaaccgggacaagggcaaccgccugcccaucgccuaccugcagagcaaguucggggccaaggcggccgagaacuucaugaucugggugcaguccaacaucaaggacuacaagaagcgccagaagcuccugaagcgggagaucaccgaggaggacaucaacaaguucaaggagcgcaaccugcaggacacgaagaccaucagccgguuccucuacaacuacaucaacgacuaccugcuguucgcccccuccgacaccggcaagaagaagcgcgucaccgccgugaacggcacgaucaccgccuaccuccggaagcgcugggggaucaacaagauccgggcgaacggcgacaagcaccacgccguggacgccgucgugaucgccugcaccaccgacaagaugaucaaggaccugagcuccuucagccgcuaccacgagcuggaguacacgcacaccgacaccgaguccuuccucgucaacagccugaccggggagauccugaagcgguucccguaccccugggaggacuuccgccccgagcucauggcccggcugagcgacaaccccgcggacgcccugcgcaagcucaaccugaucuucuaccacggcaucgaccuguccacgaucaagccgaucuucgugagccggaugccccgccacaaggugaccggggccgcccacaaggccaccaucaaguccgcgcggugccucgacaacggcaucgucaucugcaagaccagccugcagaaccugaagcucgacaaggagggcgagaucgccaacuacuacgcccccgaguccgacaccauccuguacaacgcccugaaggagcgccuccggagcuacgacaacaagcccgcgaaggccuucgccgagccguucuacaagcccaaggccgacgggacgcccggcccccuggugaagaaggugaaggucuacgagaaguccacccugaacguggccgugcagcagaacaccgcggucgccgacaacgacagcauggugcgcguggacgucuuccacgugaaggggaacggcuacuaccucgugccgaucuacaucgccgacacccugaagaaggagcugcccaacaaggccaucgucgccuacaagcccuacgcggacuggccggugauggacgacuccaacuucaucuucagccucuaccccaacgaccugaucaaguucgagcacaagaacuccgugaaguucgccaaggucaacaaggagagcacgcugaacgacuucuacuccaccaagagcgagaucguguacuucaagggcugcaacaucaacaccggggccaucaccaucaucaaccacgagaacacguacguggucuccagccucggcgugaagacccugcccucccuggagaaguaccaggccgacgugcucgggaacuacaccaaggucaagaaggaggugcggaagcccuuccgcuga

SEQ ID NO: 1567 - RNA, 3264 nt, Artificial Sequence
  Cas9 variant
augcgcuacaagaucggccuggacaucgggaucaccagcgugggcugggccgucaucaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccugaucauccgggaggggauccugacgaaggaggagcucgacaagcuguucgaggagaagcacgagaucgacguguggcagcugcgcgucgaggcccucgaccggaagcugaacaacgacgagcuggcccgcgugcuccugcaccuggcgaagcggcgcggcuucaaguccaaccgcaagagcgagcgguccaacaaggagaacagcaccaugcucaagcacaucgaggagaaccgcgccauccuguccagcuaccggaccgugggcgagaugaucgucaaggaccccaaguucgcccugcacaagcgcaacaagggggagaacuacaccaacacgaucgcccgggacgaccucgagcgcgagauccggcugaucuucuccaagcagcgcgaguucggcaacaugagcugcaccgaggaguucgagaacgaguacaucgcgaucugggccucccagcggcccguggccagcaaggacgacaucgagaagaaggugggguucugcaccuucgagccgaaggagaagcgcgcccccaaggccaccuacacguuccaguccuucaucgcgugggagcacaucaacaagcugcggcucaucagccccuccggcacccgcgggcugaccgacgaggagcggcgccugcucuacgagcaggccuuccagaagaacaagaucaccuaccacgacauccggacgcugcugcaccuccccgacgacaccuacuucaagggcaucgucuacgaccgcggcgagagccggaagcagaacgagaacauccgcuuccuggagcuggacgccuaccaccagauccggaaggccguggacaagguguacgggaagggcaaguccagcuccuuccucccgaucgacuucgacaccuucggguacgcccugacccuguucaaggacgacgcggacauccgcagcuaccuccgcaacgaguacgagcagaacggcaagcggaugcccaaccuggccaacaaggucuacgacaacgagcugaucgaggagcuccugaaccugagcuucacgaaguucggccaccucucccugaaggcccugcgcagcauccuccccuacauggagcagggggagguguacuccagcgccugcgagcgggccggcuacaccuucaccgggcccaagaagaagcagaagaccaugcugcugccgaacaucccgcccaucgcgaaccccguggucaugcgcgcccucacgcaggcccggaagguggugaacgccaucaucaagaaguacggcucccccgucagcauccacaucgagcuggcccgcgaccugucccagaccuucgacgagcggcgcaagaccaagaaggagcaggacgagaaccggaagaagaacgagaccgcgauccgccagcugauggaguacgggcucacgcugaaccccaccggccacgacaucgugaaguucaagcuguggagcgagcagaacggccggugcgccuacucccuccagcccaucgagaucgagcgccugcuggagcccggguacaccgagguggaccacgucaucccguacagccggucccucgacgacagcuacaccaacaaggugcuggugcugacgaaggagaaccgcgagaagggcaaccggauccccgccgaguaccucggggucggcaccgagcgcuggcagcaguucgagaccuucgugcugaccaacaagcaguucuccaagaagaagcgggaccgccugcuccggcugcacuacgacgagaacgaggagacggaguucaagaaccgcaaccugaacgacacccgguacaucagccgcuucuucgccaacuucauccgcgagcaccucaaguucgcggaguccgacgacaagcagaaggucuacaccgugaacgggcgggugaccgcccaccuccgcagccggugggaguucaacaagaaccgcgaggaguccgaccugcaccacgccgucgacgccgugaucguggccugcacgacccccagcgacaucgcgaaggucaccgccuucuaccagcggcgcgagcagaacaaggagcuggccaagaagaccgagccccacuucccgcagcccuggccccacuucgccgacgagcugcgggcccgccuguccaagcaccccaaggagagcaucaaggcgcucaaccugggcaacuacgacgaccagaagcuggagagccuccagccgguguucgugucccggaugcccaagcgcagcgucaccggcgccgcccaccaggagacgcugcggcgcuacguggggaucgacgagcgguccggcaagauccagaccguggucaagaccaagcugagcgagaucaagcucgacgccuccgggcacuuccccauguacggcaaggagagcgacccgcgcaccuacgaggccauccggcagcgccugcuggagcacaacaacgaccccaagaaggcguuccaggagccccucuacaagcccaagaagaacggggagccgggccccgugauccggacggugaagaucaucgacaccaagaaccaggucaucccccugaacgacggcaagaccguggccuacaacuccaacaucgugcgcgucgacguguucgagaaggacgggaaguacuacugcgugcccgucuacaccauggacaucaugaagggcauccugccgaacaaggccaucgagcccaacaagcccuacagcgaguggaaggagaugacggaggacuacaccuuccgguucucccucuaccccaacgaccugauccgcaucgagcugccgcgcgagaagaucaucaagaccgccgggggcgaggagaucaagaucaaggaccucuucgcguacuacaagaccauccacagcggcacggccgggcuggagcuggugucccacgacugcagcuucucccucagcggcguggggucccggacccugaagcgcuucgagaaguaccaggucgacgugcugggcaacaucuacaaggugcgcggggagaagcgggucggccucgccagcuccgcccacagcaagaccggcgagaccauccggccccugcagagcacgcgcgacuga

SEQ ID NO: 1568 - RNA, 3264 nt, Artificial Sequence
  Cas9 variant
augcgcuacaagaucggccuggacaucgggaucaccagcgugggcugggccgucaucaaccucgaccugccccggaucgaggaccugggggugcgcaucuucgaccgggccgagaacccgcagaccggcgagucccucgcgcugccccgccggcuggcccgcagcgcccggcgccggcuccgccggcgccggcaccgccuggagcggauccgccggcugcucacgcgcgagaacgugcugacccaggaggagcuggacaagcuguucgagaagaagcacgagaucgacgucuggcagcugcggguggaggcccuggaccgcaagcucaacaacgacgagcuggcccgggugcugcuccaccuggcgaagcgccgcggguucaaguccaaccgcaagagcgagcgguccaacaaggagaacagcaccaugcugaagcacaucgaggagaaccgguccauccucaccggcuaccgcacggucggcgagaugaucgugcgggaccccaaguucgugcugcacaagcgcaacaagggggagaacuacaccaacaccaucgcccgggacgaccuggagcgcgagauccagcucaucuucgcccggcagcgcgaguucggcaacaugaucugcaccgaggccuucgagaacgaguacaucgcgaucuggagcucccagcggcccgucgccagcaaggacgacaucgagaagaaggugggguucugcacguucgagccgaaggagaagcgcgcccccaaggccaccuacaccuuccaguccuucaucgccugggagcacaucaacaagcugcggcuggugagccccuccggcacccgcgagcucacggacgaggagcggcgccugcuguacgagcaggcguuccagaagaacaagcucaccuaccacgacauccggacccugcugcaccuccccgacgacaccuacuucaaggggaucgucuacgacuggggcgagccgcugaagcagaacgagaacauccgcuuccuggagcucgacgccuaccaccagauccggaagacgguggacaagguguacggccgcggcaagagcuccagcuuccugcccaucgacuucgacaccuucggguacgcccugacccucuucaaggacgacgcccacauccgcuccuaccugcggaacgaguacgagcagaacgggaagcgcaucgccaaccuggcgaacaaggucuacgacaacgagcucaucgaggagcugcugaaccucagcuucaccaaguucggccaccugucccugaaggcccuccggaacauccugcccuacauggagcagggcgagguguacagcagcgccugcgagcgcgccggguacacguucaccggccccaccaagaagcagaagaccgugcugcugccgacgaucccgcccaucgccaaccccgucgugaugcgggcgcucacccaggcccgcaagguggucaacgccaucaucaagaaguacgggucccccgugagcauccacaucgagcuggcccgggaccugucccagaccuucgacgagcgcaagaagaccaagaaggagcaggacgagaaccggaagcgcaacgagacggccauccggcagcucaucgaguacggccugacccgcaaccccaccgggcacgacaucgugaaguucaagcuguggagcgagcagaacggccggugcgcguacucccuccagcccaucgagaucaagcgccugcuggagcccggcuacgucgagguggaccacgucaucccguacagccggucccucgacgacagcuacaccaacaaggugcuggugcugacgaaggagaaccgcgagaaggggaaccggauccccgccgaguaccucggcgucgggaccgagcgcuggcagcaguucgagaccuucgugcugaccaacaagcaguucuccaagaagaagcgggaccgccugcuccggcugcacuacgacgagaacgaggaggccgaguggaagaaccgcagccugaacgacacgcgcuacaucucccgguucuucgccaacuucauccgcgagcaccucaaguucgcggacagcgacgacaagcagaagguguacaccgucaacggcggggugaccgcccaccuccggucccgcugggacuucaacaagaaccgggaggagagcgaccugcaccacgccguggacgccgccaucgucgcgugcaccacccucuccgacaucgcccgcgugacggccuucuaccagcggcgcgagcaggccaaggagcuggccaagaagaccgagccccacuucccccagccguggccccacuucgcggacgagcugcgggcccgccucagcaagaaccccaaggaguccaucaaggcccugaaccugggcaacuacgacaacgagaagcucgagagccugcagcccguguucgucucccggaugccgaagcgcagcgugaccggcgccgcccaccaggagacccugcggcgcuacaucgggaucgacgagcggagcggcaagauccagacgguggucaagaccaagcucuccgagaucaagcuggacgcgagcgggcacuuccccauguacggcaaggaguccgacccccgcaccuacgaggccauccggcugcgccuccuggagcacaacaacgacccgcggaaggccuuccaggagccccuguacaagcccaagaagaacggggagcucggccccaucauccgcaccgugaagaucaucgacacgaagaaccaggugaucccgcugaacgacggcaagaccgucgccuacaacagcaacaucgugcgcguggacgucuucgagaaggacgggaaguacuacugcgugcccguguacaccauggacaucaugaagaagguccugcccaacaaggcgaucgagcccaacaagccguacuccgaguggaaggagaugaccgaggacuacacguuccgguucagccucuaccccaacgaccugauccgcaucgagcugccccgggagaagaccgugaagaccaccgccggccacgagaucaacaucaaggacguguucgucuacuacaagacgaucgacuccgccaccgggggccucgagcugaucagccacgacaacuccuucagccugcgcggcaucgggucccggacccucaagcgcuucgagaaguaccagguggacgugcugggcaacaucuacaagguccgcggggagaagcgggugggccuggccagcuccgcccaccccgagacccgggagacgauccgcccgcuccagagcacccgggacuga

SEQ ID NO: 1569 - RNA, 3264 nt, Artificial Sequence
  Cas9 variant
augaagaagcuggugcucggccuggacaucggggucgccagcgugggcugggggaucaucgacgccgagaacggcgacguggucgacaccggggugcgccuguucuccagccgggacgcguccgagaacgagagccgccggaccucccgccagagccggcgccucucccggcgcaagaagcaccggcgcgagcggaucaagcagcugcugcucgcccacgacauggacaucugcgacaucgugaacgagaaccccuacgagcugcgcgucaagggccugaacgagaagcucgaggugagcgagaucuacguggcccugacgcaccuggccaagcggcgcggcgucuccuaccucgacgacgugguggaggagggcgggaccaucaagagcgagcaccugaacaagaacauggaggagaucaaguccgggaagaugccgugcgagauccagcuggagcgguucgagaaguacggccagguccgcgggaugaucgagaucaaccaggacaccgaggagagcuccuuccucgugaacaucuuccggaccagcgacuacaucaaggaggccaagacgauccuggcgacccagcagaaguuccacaagcagaucaccaacgaguucaucgacgaguacauccacaucauggccuccaagcgcgacuacuucaucggccccggcaacgagaagucccggaccgacuacgggguguaccgcacgaacggcgacaccugggacaaccuguucgagauccucaucgggaagugcagcgucuuccccgaggagacccgggccgcccgcagcuccuacguggcgcaggaguucaaccugcugaacgaccucaacaaccugaagaucagcaaccuggagagcggcaagcucuccgccagccagaagcacgacaucguggagaaggucaagaacuccaagaaguucggcaccaaggaccugcugaaguacaucgccagcgugugcgagugcaagaucgaggacaucgggggcugccgcguggacaagaaccggaagcccaucaugcacacguucgagaacuaccgcaagguccacaacgcccucaacgaggccgggguggaccugcggcuguccgagaccgacuacgacgagcucaugaagaucaugacccugaacagcgagacccuggagaucaagaagcagugcaaggagaagcucccgcagcugacggaggacuaccugaacgugugccucguccugaacaagaagggcgcguucuccggguggcacgcccugagccucaaggccaugaagcugaugaugcccgagcuguacggcaccuccaagaaccagaugcagaucauccacaccaugcagcucggcaaggccuaccugaagccccugaaccagcagaaguaccucaacagcgaggccauccuggaggagaucuacaaccccaucgcggcccgcuccauccggcagaccaucaaggugacgaacgccauccugaagaaguacgggcaccucgacagcgucaucaucgagaugccgcgcgacuaccagaccuccgaggacgagcggaagaugaucgagaagaugcagaaggagaacgagaaggagaagaaggccgcccugaagcgcgcgcgggaggaguaccccuuccccgacgaggccuuccgcaaccacaaggagcuggccaccaagcugcggcucugguaccagcaggaccaguucugcguguacagcggccgcaagaucuccguggucgaccuggugcggaaccccaaccaguucgagaucgaccacaucaucccgcagagcgugucccuggacgacagccucaacaacaagguccugugcuucuccgaggagaaccagaagaaggggcagcagacccccuucuacuaccacaagggcaagagcgggaacuggacguacgagcaguacaagcuguucguggagaagcuguucgacaagaagaagaucagcaacaagaagcgcgagcugcuccucuucgaggaggacaucaacaagugggacgugcggcgcggcuucaucgcccggaaccuggucgacacccgcuacgccucccgggugauccugaacagcuaccagcaguacuucggcaaccacgagauggggaccaaggugaaggucgugcgcggcaaguucaccucccagcuccgcaagaaguggcggaucuucaaggaccgcaacgagagccacucccaccacgcgaucgacgcccugaucguggccgccacggcgaaccugcggcucuggaagaagaacacccugggggucagcgacgagggcaagguguacgacaaggagaccggggagauccugcccuucgagaagcucaccgaguccgaguacaacgagaugaugaacaaggagcccuaccugaacuucaagacgaagcugcagaacaucgagaccaaggugaaguacagcuaccgcgucuccaagaaggugaaccggaagaucagcgacgccaccaucuacuccacccgcgagcgggacggcaucgacuacaucgugggcaagaucaagaacaucuacgacgucaagacguacaaggaccaguuccucaagcgcuacaagaagaacaaggagcaguuccugauguaccagcacgacccgcagaccuucgccauccuggagaacaucauggccaccuaccaggacgccgagaaccccuuccucgcguacaagaaggaguacggggugauccggaaguacagcaagaagggcgggggcucccccgugaccagccugaaguucaucgacaagguccugggccagaagaucgaccucaccgccaagaaccaggccgcccugcccaagaacaagaagguggugcugcaguccaucacgccguaccgcgccgacgucuacuacgacgagaucgacaagcgguaccaccucaucggggugaaguacagccuguucuccuucagcaagcagggcuacgugaucaaccccaucgcguaccagaagcugcucgagaaggagcagauccacagcgagaugaaguucugcuucucccuguaccgcgaggacaucaucgaguucggggaggaccccgacagccugacccgguaccgcuucugguccaagaacgagagcggcaagaacaagaucgaggucaagcccaucgagaagccgaacuucgagaagcagaccgugcucaccaucacgaagaagaucaagauccugaacaaguaccagaccgacgugcuggggaacuccuucaaggcccaggaggagaaggacccccggaacaucgaguga

SEQ ID NO: 1570 - RNA, 3264 nt, Artificial Sequence
  Cas9 variant
augcgcuacaagaucggccuggacaucgggaucaccagcgugggcugggccgucaugaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccuggugauccgggaggggauccugacgaaggaggagcucgacaagcuguucgaggagaagcacgagaucgacgucuggcagcugcgcguggaggcccucgaccggaagcugaacaacgacgagcuggcccgcgugcuccugcaccuggcgaagcggcgcggcuucaaguccaaccgcaagagcgagcgguccaacaaggagaacagcaccaugcucaagcacaucgaggagaaccgcgccauccuguccagcuaccggaccgucggcgagaugaucgugaaggaccccaaguucgcccugcacaagcgcaacaagggggagaacuacaccaacacgaucgcccgggacgaccucgagcgcgagauccggcugaucuucuccaagcagcgcgaguucggcaacaugagcugcaccgaggaguucgagaacgaguacaucaccaucugggcgucccagcggcccguggccagcaaggacgacaucgagaagaaggucggguucugcaccuucgagccgaaggagaagcgcgcccccaaggccacguacaccuuccaguccuucaucgccugggagcacaucaacaagcugcggcucaucagccccuccggcgcgcgcgggcugaccgacgaggagcggcgccugcucuacgagcaggccuuccagaagaacaagaucaccuaccacgacauccggacgcugcugcaccuccccgacgacaccuacuucaagggcaucguguacgaccgcggcgagagccggaagcagaacgagaacauccgcuuccuggagcuggacgccuaccaccagauccggaaggccguggacaaggucuacgggaagggcaaguccagcuccuuccucccgaucgacuucgacaccuucggguacgcccugacccuguucaaggacgacgcggacauccacagcuaccuccgcaacgaguacgagcagaacggcaagcgcaugcccaaccuggccaacaagguguacgacaacgagcugaucgaggagcuccugaaccugagcuucacgaaguucggccaccucucccugaaggcccugcggagcauccuccccuacauggagcagggggagguguacuccagcgccugcgagcgcgccggcuacaccuucaccgggcccaagaagaagcagaagaccaugcugcugccgaacaucccgcccaucgcgaaccccgucgugaugcgggcccucacgcaggcccgcaagguggucaacgccaucaucaagaaguacggcucccccgugagcauccacaucgagcuggcccgggaccugucccagaccuucgacgagcgccggaagaccaagaaggagcaggacgagaaccgcaagaagaacgagaccgcgauccggcagcugauggaguacgggcucacgcugaaccccaccggccacgacaucgugaaguucaagcuguggagcgagcagaacggccgcugcgccuacucccuccagcccaucgagaucgagcggcugcuggagcccggguacgucgagguggaccacgugaucccguacagccgcucccucgacgacagcuacaccaacaagguccuggugcugacccgggagaaccgcgagaagggcaaccggauccccgccgaguaccucggggucggcacggagcgcuggcagcaguucgagaccuucgugcugaccaacaagcaguucuccaagaagaagcgggaccgccugcuccggcugcacuacgacgagaacgaggagaccgaguucaagaaccgcaaccugaacgacacgcgguacaucagccgcuucuucgccaacuucauccgcgagcaccucaaguucgcggaguccgacgacaagcagaagguguacaccgucaacgggcgggugaccgcccaccuccgcagccggugggaguucaacaagaaccgcgaggaguccgaccugcaccacgccguggacgccgccaucgucgcgugcaccacgcccagcgacaucgccaaggugaccgccuucuaccagcggcgcgagcagaacaaggagcuggccaagaagaccgagccccacuucccgcagcccuggccccacuucgccgacgagcugcgggcgcgccuguccaagcaccccaaggagagcaucaaggcccucaaccugggcaacuacgacgaccagaagcuggagagccuccagccgguguucgucucccggaugcccaagcgcagcgugaccggcgccgcccaccaggagacccugcggcgcuacguggggaucgacgagcgguccggcaagauccagacggucgugaagaccaagcugagcgagaucaagcucgacgccuccgggcacuuccccauguacggcaaggagagcgacccgcgcaccuacgaggcgauccggcagcgccugcuggagcacaacaacgaccccaagaaggccuuccaggagccccucuacaagcccaagaagaacggggagccgggccccgugauccggaccgucaagaucaucgacacgaagaaccaggugaucccccugaacgacggcaagaccguggccuacaacuccaacaucguccgcguggacguguucgagaaggacgggaaguacuacugcguccccguguacaccauggacaucaugaagggcauccugccgaacaaggccaucgagcccaacaagcccuacagcgaguggaaggagaugaccgaggacuacacguuccgguucucccucuaccccaacgaccugauccgcaucgagcugccgcgcgagaagaccgugaagaccgcggccggggaggagaucaacgucaaggacguguucguguacuacaagaccaucgacagcgccaacggcggccucgagcugaucucccacgaccaccgguucagccugcgcggggucggcucccggacgcucaagcgcuucgagaaguaccagguggacgugcuggggaacaucuacaagguccggggcgagaagcgcguggggcuggccagcuccgcccacagcaagaccggcgagaccgugcggccccuccaguccacccgcgacuga

SEQ ID NO: 1571 - RNA, 3264 nt, Artificial Sequence
  Cas9 variant
augcgcuacaagaucggccuggacaucgggaucaccagcgugggcugggccgucaugaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccuggugauccgggaggggauccugacgaaggaggagcucgacaagcuguucgaggagaagcacgagaucgacgucuggcagcugcgcguggaggcccucgaccggaagcugaacaacgacgagcuggcccgcgugcuccugcaccuggcgaagcggcgcggcuucaaguccaaccgcaagagcgagcgguccaacaaggagaacagcaccaugcucaagcacaucgaggagaaccgcgccauccuguccagcuaccggaccgucggcgagaugaucgugaaggaccccaaguucgcccugcacaagcgcaacaagggggagaacuacaccaacacgaucgcccgggacgaccucgagcgcgagauccggcugaucuucuccaagcagcgcgaguucggcaacaugagcugcaccgaggaguucgagaacgaguacaucaccaucugggcgucccagcggcccguggccagcaaggacgacaucgagaagaaggucggguucugcaccuucgagccgaaggagaagcgcgcccccaaggccacguacaccuuccaguccuucaucgccugggagcacaucaacaagcugcggcucaucagccccuccggcgcgcgcgggcugaccgacgaggagcggcgccugcucuacgagcaggccuuccagaagaacaagaucaccuaccacgacauccggacgcugcugcaccuccccgacgacaccuacuucaagggcaucguguacgaccgcggcgagagccggaagcagaacgagaacauccgcuuccuggagcuggacgccuaccaccagauccggaaggccguggacaaggucuacgggaagggcaaguccagcuccuuccucccgaucgacuucgacaccuucggguacgcccugacccuguucaaggacgacgcggacauccacagcuaccuccgcaacgaguacgagcagaacggcaagcgcaugcccaaccuggccaacaagguguacgacaacgagcugaucgaggagcuccugaaccugagcuucacgaaguucggccaccucucccugaaggcccugcggagcauccuccccuacauggagcagggggagguguacuccagcgccugcgagcgcgccggcuacaccuucaccgggcccaagaagaagcagaagaccaugcugcugccgaacaucccgcccaucgcgaaccccgucgugaugcgggcccucacgcaggcccgcaagguggucaacgccaucaucaagaaguacggcucccccgugagcauccacaucgagcuggcccgggaccugucccagaccuucgacgagcgccggaagaccaagaaggagcaggacgagaaccgcaagaagaacgagaccgcgauccggcagcugauggaguacgggcucacgcugaaccccaccggccacgacaucgugaaguucaagcuguggagcgagcagaacggccgcugcgccuacucccuccagcccaucgagaucgagcggcugcuggagcccggguacgucgagguggaccacgugaucccguacagccgcucccucgacgacagcuacaccaacaagguccuggugcugacccgggagaaccgcgagaagggcaaccggauccccgccgaguaccucggggucggcacggagcgcuggcagcaguucgagaccuucgugcugaccaacaagcaguucuccaagaagaagcgggaccgccugcuccggcugcacuacgacgagaacgaggagaccgaguucaagaaccgcaaccugaacgacacgcgguacaucagccgcuucuucgccaacuucauccgcgagcaccucaaguucgcggaguccgacgacaagcagaagguguacaccgucaacgggcgggugaccgcccaccuccgcagccggugggaguucaacaagaaccgcgaggaguccgaccugcaccacgccguggacgccgucaucguggccugcaccacgcccagcgacaucgcgaaggugaccgccuucuaccagcggcgcgagcagaacaaggagcuggccaagaagaccgagccccacuucccgcagcccuggccccacuucgccgacgagcugcgggcccgccuguccaagcaccccaaggagagcaucaaggcgcucaaccugggcaacuacgacgaccagaagcuggagagccuccagccggucuucgugucccggaugcccaagcgcagcgugaccggcgccgcccaccaggagacccugcggcgcuacgucgggaucgacgagcgguccggcaagauccagacgguggugaagaccaagcugagcgagaucaagcucgacgccuccgggcacuuccccauguacggcaaggagagcgacccgcgcaccuacgaggccauccggcagcgccugcuggagcacaacaacgaccccaagaaggcguuccaggagccccucuacaagcccaagaagaacggggagccgggccccgucauccggaccgugaagaucaucgacacgaagaaccaggugaucccccugaacgacggcaagaccgucgccuacaacuccaacaucgugcgcguggacgucuucgagaaggacgggaaguacuacugcgugcccguguacaccauggacaucaugaagggcauccugccgaacaaggccaucgagcccaacaagcccuacagcgaguggaaggagaugaccgaggacuacacguuccgguucucccucuaccccaacgaccugauccgcaucgagcugccgcgcgagaagaccgucaagaccgccgcgggggaggagaucaacgugaaggacguguucgucuacuacaagaccaucgacagcgccaacggcggccucgagcugaucucccacgaccaccgguucagccugcgcggggugggcucccggacgcucaagcgcuucgagaaguaccagguggacguccuggggaacaucuacaaggugcggggcgagaagcgcguggggcuggccagcuccgcccacagcaagcccggcaagaccauccggccccuccaguccacccgcgacuga

SEQ ID NO: 1572 - RNA, 3264 nt, Artificial Sequence
  Cas9 variant
augcgcuacaagaucggccuggacaucgggaucaccagcgugggcugggccgucaucaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccugaucauccgggaggggauccugacgaaggaggagcucgacaagcuguucgaggagaagcacgagaucgacguguggcagcugcgcgucgaggcccucgaccggaagcugaacaacgacgagcuggcccgcgugcuccugcaccuggcgaagcggcgcggcuucaaguccaaccgcaagagcgagcgguccaacaaggagaacagcaccaugcucaagcacaucgaggagaaccgcgccauccuguccggcuaccggaccgugggggagaugaucgucaaggaccccaaguucgcccugcacaagcgcaacaagggcgagaacuacaccaacacgaucgcccgggacgaccucgagcacgagauccgccugaucuucagcaagcagcgggaguucgggaacauguccugcaccgagaaguucgagaacgaguacaucaccaucugggcgagccagcgccccguggccuccaaggacgacaucgagaagaaggugggcuucugcaccuucgagccgaaggagaagcgggcccccaaggccacguacaccuuccagagcuucaucgccugggagcacaucaacaagcugcgccucaucuuccccuccggggcgcggggccugaccgacgaggagcgccggcugcucuacgagcaggccuuccagaagaacaagaucaccuaccacgacauccgcacgcugcugcaccuccccgacgacaccuacuucaagggcaucgucuacgaccgcggggagagccggaagcagaacgagaacauccgguuccuggagcuggacgccuaccaccagauccgcaaggccguggacaagguguacggcaaggggaaguccagcuccuuccucccgaucgacuucgacaccuucggcuacgcccugacccuguucaaggacgacgcggacauccacagcuaccuccggaacgaguacgagcagaacggcaagcgcaugcccaaccuggccaacaaggucuacgacaacgagcugaucgaggagcuccugaaccuguccuucacgaaguucgggcaccucagccugaaggcccugcgcagcauccuccccuacauggagcagggcgagguguacuccagcgccugcgagcgggccggguacaccuucaccggccccaagaagaagcagaagaccaugcugcugccgaacaucccgcccaucgcgaaccccguggucaugcgcgcccucacgcaggcccggaagguggugaacgccaucaucaagaaguacgggucccccgucagcauccacaucgagcuggcccgcgaccugucccagaccuucgacgagcggcgcaagaccaagaaggagcaggacgagaaccggaagaagaacgagaccgcgauccgccagcugauggaguacggccucacgcugaaccccaccggccacgacaucgugaaguucaagcuguggagcgagcagaacgggcggugcgccuacucccuccagcccaucgagaucgagcgccugcuggagcccggcuacguggaggucgaccacgugaucccguacagccggucccucgacgacagcuacaccaacaaggugcugguccugacccgcgagaaccgggagaaggggaaccgcauccccgccgaguaccucggcguggggacggagcgguggcagcaguucgagaccuucguccugaccaacaagcaguucuccaagaagaagcgcgaccggcugcuccgccugcacuacgacgagaacgaggagaccgaguucaagaaccggaaccugaacgacacgcgcuacaucagccgguucuucgccaacuucauccgcgagcaccucaaguucgcggaguccgacgacaagcagaagguguacaccgugaacggccgcgucaccagccaccuccggucccgcugggacuucaacaagaaccgggaggagagcgaccugcaccacgccguggacgccgccaucguggccugcaccacgcccuccgacaucgcgaaggucaccgccuucuaccagcgccgggagcagaacaaggagcuggccaagaagaccgagccccacuucccgcagcccuggccccacuucgccgacgagcugcgcgcccggcugagcaagcaccccaaggaguccaucaaggcgcucaaccugggcaacuacgacgaccagaagcuggagagccuccagccgguguucgugagccgcaugcccaagcgguccgucaccggggccgcccaccaggagacccugcgccgguacaucggcaucgacgagcgcagcgggaagauccagacgguggugaagaccaagcuguccgagaucaagcucgacgccagcggccacuuccccauguacgggaaggaguccgacccgcggaccuacgaggccauccgccagcggcugcuggagcacaacaacgaccccaagaaggcguuccaggagccccucuacaagcccaagaagaacggcgagccgggccccaucauccgcaccgucaagaucaucgacacgaagaaccaggugaucccccugaacgacgggaagaccguggccuacaacagcaacaucguccggguggacguguucgagaaggacggcaaguacuacugcguccccguguacaccauggacaucaugaaggggauccugccgaacaaggccaucgagcccaacaagcccuacuccgaguggaaggagaugaccgaggacuacacguuccgcuucagccucuaccccaacgaccugauccggaucgagcugccgcgcgagaagaccgugaagaccaccacgggcgaggagaucaacgucaaggacguguucguguacuacaagaccaucgacuccgccaccggcgggcucgagcugaucagccacgacaaccgcuucucccugcggggcgucgggagccgcacccucaagcgguucgagaaguaccagguggacgugcugggcaacaucuacaagguccgcggggagaagcgggugggccuggcguccagcgcccacuccaagacgggcgagaccauccgcccccuccagagcacccgggacuga

SEQ ID NO: 1573 - RNA, 3264 nt, Artificial Sequence
  Cas9 variant
augcgcuacaagaucggccuggacaucgggaucaccagcgugggcugggccgucaucaaccucgacaucccccggaucgaggaccugggggugcgcaucuucgaccgggccgagaacccgcagaccggcgagucccuggcgcucccccgccggcuggcccgcagcgcccggcgccggcugcgccggcgcaagcaccggcucgagcgcauccggcgccugcugauccgggagggggugcucacgaaggaggagcuggacaagcuguucgaggagaagcacgagaucgacgucuggcagcuccgcguggaggcccuggaccggaagcugaacaacgacgagcucgugcgcguccugcugcaccucgccaagcggcgcggcuucaaguccaaccgccagagcgagcgguccaacaaggagaacagcaccaugcugaagcacaucgaggagaaccgcgcgauccuguccggcuaccggaccgugggggagaugaucgugaaggaccccaaguucgcccuccacaagcgcaacaagggcgagaacuacaccaacacgaucgcccgggacgaccuggagcgcgagauccggcugaucuucagcaagcagcgcgaguucgggaacauguccugcaccgaggaguucgagaacgaguacaucgccaucugggcgagccagcggcccgucgccuccaaggacgacaucgagaagaaggugggcuucugcaccuucgagccgaaggagaagcgcgcccccaaggccaccuacacguuccagagcuucaucgccugggagcacaucaacaagcuccggcugaucucccccagcgggacccgcggccugaccgacgaggagcggcgccuccuguacgagcaggcguuccagaagaacaagaucaccuaccacgacauccggacgcugcuccaccuccccgacgacaccuacuucaagggcaucguguacgacuggggcgagucccugaagcagaacgagaacauccgcuuccuggagcuggacgccuaccaccagauccggaaggccaucgacaaggucuacgggaagggcaagagcuccagcuuccugccgaucgacuucgacaccuucggguacgcccucacccuguucaaggacgacgccgacauccgcuccuaccugcggaacgaguacgagcagaacggcaagcgcaucgcgaaccucgccaacaagguguacgacaacgagcugaucgaggagcugcucaaccugagcuucacgaaguucgggcaccugagccucaaggcccugcgcaacauccugcccuacauggagcagggcgagguguacuccagcgccugcgagaaggccggguacaccuucaccggccccaagaagaagcagaagaccguccuccugcccacgaucccgcccaucgugaaccccguggucaugcgggcgcugacccaggcccgcaagguggugaacgccaucaucaagaaguacgggucccccgucagcauccacaucgagcuggcccgggaccucucccagaccuucgacgagcgccggaagaccaagcgcgagcaggacgagaaccggaagcgcaacgagacggccauccggcagcugauggaguacggccugacccucaacccgaccggccuggacaucgugaaguucaagcuguggagcgagcagaacgggcgcugcgcguacucccuccagcccaucgagaucgagcggcugcuggagcccggcuacguggaggucgaccacgugauccccuacagccgcucccucgacgacagcuacaccaacaagguccuggugcugacgaaggagaaccgggagaaggggaaccgcaucccggccgaguaccucggcguggggaccgagcgguggcagcaguucgagaccuucguccugaccaacaagcaguucuccaagaagaagcgcgaccggcugcuccgccugcacuacgacgagaacgaggagauggaguucaagagccggaaccugaacgacacgcgcuacaucucccgguucuucgccaacuucauccgcgagcaccucaaguucgccgagagcgacgacaagcagaagguguacaccgugaacggccgcgucaccucccaccuccggagccgcugggacuucaacaagaaccgggaggaguccgaccugcaccacgcgguggacgccgccaucguggccugcaccacgcccagcgacaucgccaaggucaccgcguucuaccagcgccgggagcagaacaaggagcuggccaagaagaccgagccccaguucccccagccguggccccacuucgccgacgagcugcgcgcccggcuguccaagcaccccaaggagagcaucaaggcccucaaccugggcaacuacgacgaccagaagcuggagagccuccagcccguguucgugucccgcaugccgaagcggagcgucaccggggcggcccaccaggagacccugcgccgguacaucggcaucgacgagcgcuccgggaagauccagacgguggugaagaccaagcugagcgagaucaagcucgacgccuccggccacuuccccauguacgggaaggagagcgacccccggaccuacgaggccauccgccagcggcugcuggagcacaacaacgacccgaagaaggccuuccaggagccccucuacaagcccaagaagaacggcgagcccggcccgaucauccgcaccgucaagaucaucgacacgaagaaccaggugaucccccugaacgacgggaagaccguggcguacaacuccaacaucguccggaucgacguguucgagaaggacggcaaguacuacugcgugcccgucuacaccauggacaucaugaagggggugcugcccaacaaggccaucgagccgaacaagcccuacagcgaguggaaggagaugaccgaggacuacacguuccgcuucucccucuaccccaacgaccugauccggaucgagcugccccgcgagaagaccgugaagaccgccgccggcgaggagaucaacaucaaggacauguucgucuacuacaagaccaucgacagcgcgaacggcgggcucgagcugaucucccacgacaacagcuucucccugcgcggcguggggagccggacgcucaagcgcuucgagaaguaccagguggacguccugggcaacaucuacaaggugcgcggggagaagcgggugggccuggccuccagcgcccacuccaagaccggcgagaccauccggccgcuccagagcacccgcgacuga

SEQ ID NO: 1574 - RNA, 3267 nt, Artificial Sequence
  Cas9 variant
augcccaaggaguucgacccgcugaagcccgccaaguaccgccucgcccuggacaucggcagcaaguccaucggguucgcgaucaucuuccugaaggaggacgugaacaagcuccugaagcccuacgccaucguccggagcggcgugcgcaucuucggggacggccggacccccgccgccccggggcagcugggcuccagccucgccgcggagcgccgggugaagcgcuccauccggcgccaguacgcccggaagcgcaagcggcugcagcgccugcuccggaaccugaaggagcugggcuucuuccccgacgacagcaagcucugcaaguccuucgaggaccugaaccccuacgagcugcgccacaaggggcucaccaaggagcugaagccccacgaguucggccggcugcucaugcacauggccaagaaccgcggguuccagagcaaccggaaggucgaccugcuggccgacaacaucgacucccaggcgaaggccgagacgagcgccaugaaguccgccaucgccacccuccagagccgccugaacggcgaguucgagacccugggggcguaccucuacgagcgguucaagaagggcgagaccaucaaguccagcaagacgcagaagggccagaaggccgaguacgaguucuccaucagccgccggauggugaagcaggaguucgaccgccugugggccgcccaggagcaguucaacccggagcuguucaacgagcaggccaagaacacccucaaggacaccaucuucuuccagcgcaaccugcugccccagaagguggggaagugcaccuuccuccccgagcacgagcgggcguccaaggcccugcccagcucccaguacuuccgcaucaucagcgagcugaacaagaucagcuucacggacgccgagggccucauccugccgaucucccuggagcagcggaacaagcuccucaagagccugcgcaucaagcagaagcuguccuucgaccggauccgcaccgagcugaaccuggacagcaccguccucaucaaccuggagcacgccuccaaggacagcaucgagggggacaagaccggcuaccugcucuccaagaaggaguacuucggccccgccuggcgggaccugagccuggagacgcaggacgcgaucgugaccgcccuccugacccacgagaacgaggccgagcuggugcagaagcuggucgacgacuucaacaucgcccacgacguggccaaggcgcucgccaacgcccgccuggagucccaguacaugcggcugagcaaggaggccaucgagcgccucauccccgagcuggagaaggggguggacucccaggacggcuacaagguccccgugaaguaccacgaggcgaccgaggccgccggguucggccaccacagcgcccugcaggagaacugggccgacuucccgacgcucgaccugaagcagcugcacuccgacgacaacgacaaguacaccguggcggagcucccccugcccuacuacgggaaggucaucacccgccagguggccuucggcaccggcgacgugaacgaccccgucgagaagcgguucgggaagaucgccaacccgacggugcacaucugccugaaccaggugcggguccuccuggacgagaucaucgccaaguacggcuaccccuacgaggugaacaucgagcuggcccgcgagcucaagcagaaccacgagcagcggcagcgcagcaucaagcagcaggcggccaacaagaaggagaacgaggagauccggcgcgagaucaagcaggccuacaagguggagaaggcccggaucaucaccgacuccgagaucagccgcgccgacaucgagaaguggcgccuguggcggcgcuccaagagcaagcugugcgucuacuccgggaagaagaucugcgagaccaugauccucaacaacgagguggaggucgaccacauccugccccggagccgcaccggcgacaacagcuaccagaacaaggugcuggugcucaacaaggcgaaccggaucaaguccaaccgcacgcccugggaggccaaggagcuguucgaggcccagggguggagcuacgaggacauccugaaccggaugcgcgcccucgacaagcaccagcuguuccgguucgcggagaacuccauggacaucugggacaagaacuaccgcagcuucgaggcccgggcccugaacgacacccgcuacaucucccgggucgugaaggacuaccucaagguggucugccacaaggaccgcaucguggugagcaacggcgcccacaccgcccugauccggcgcgaguucggccugaacgaccuccuggggaagaagggcgagaagaaccgggacgaccaccgccaccacgcgaucgacgccugcgucaucggggcccuggaccgguccaugcuccgcaagcugcagaucgccauggagguggccgagaagcagaacagcgcgcggaacuucgugggccugcaggagccgugguucaacuucuccacccagguccgccgcagcaucgggcagaucuacgugucccacaagcccaaccacaacuacgagggcgagaucuucgaggccagcaucuacggccuccggcugaucuccgacaagcgcacggagaaguacguggggaucaagcggaaccccgagaccggcaagaccgacaagcccaagaaguccgucguggugaucagcgacccgaagacccagaaccgcuacgggcugcggcacaaguuccacagcgagggccuccccaagaaguacuacggccuguccagcagcuccgucuucugccuggagaucuaccgcgacgagaaggggaacuggcaggccuacacgaucccccgguacgaggccuaccgcaucgugaagcggcgcggcgugaacgcccucuacgacaacaagcggagcaacuucgaggggcgcccgcuggucaugcggcugaugcgcgacgacugcaucgcguucgagaagaacggcgugaaggagguguaccggauccagaagaucaacgggcucaagaagaacaucacccugacccgccacuucgacgccaacgucgacgaccgguaccgccggaugcugaaggcccagaaggccgagaaggcgggcgaggacuucgacuccgaggaccucugcgacgaccugguguucagcuccuucggcgccagcucccuguacagcaacaaggcccgcaaggugaccaucucccccauggggguccuccgcgaccccggcuucaagggguga

SEQ ID NO: 1575 - RNA, 3267 nt, Artificial Sequence
  Cas9 variant
augaagaagcuggugcucggccuggacaucggggucgccagcgugggcugggggaucaucgacgccgagaacggcgacgugcuggacgcggggguccgccucuucuccagccgggacgccuccgagaacgagagccgccggaccucccgccggcagagccgccggcugucccgccggaagaagcaccgccgggagcgcaucaagcagcugcuccuggcccacgacauggacgugugcgacaucgugaacgagaaccccuaccagcugcgggucaagggccucaacgagaagcuggagaucagcgagaucuacguggcccugacccaccucgccaagcgccggggcguguccuaccuggacgacgucguggaggagggcggggcgaucaagagcgagcaccugaacaagaacauggaggagaucaaguccgggaagaugccgugcgagauccagcucgagcgcuucgagaaguacggccaggugcgggggaugaucgagaucaaccaggacacggaggagagcuccuuccuggucaacaucuuccgcaccagcgacuacaucaaggaggccaagaccauccuggccacccagcagaaguuccacaagcagaucacgaacgaguucaucgacgaguacaucaacaucauggccuccaagcgggacuacuucaucggccccggcaacgagaagucccgcaccgacuacgggguguaccggaccaacggcgacaccugggacaaccucuucgagauccugaucgggaagugcagcguguuccccgaggagacgcgcgcggcccgcagcuccuacgucgcccaggaguucaaccugcucaacgaccugaacaaccugaagaucagcagccucgaguccggcaagcugagcaccucccagaagcacgacaucguggagaaggugaagaacagcaagaaguucggcaccaaggaccugcucaaguacaucgccuccgucugcgagugcaagaucgagaacaucgacgggugccggaaggacaagaaccgcaagcccaucaugcacaccuucgagaacuaccggaaggugcacaacgcccugaacgaggcgggcguggaccugcgccucagcgaggccgacuacgacgagcugaugaagaucaugacgcugaacuccgagacccucgagaucaagaagcagugcaaggagaagcugccgcaccugaccgaggacuaccucaacgucugccuggugcugaacaagaagggggccuucagcggcuggcacgcccucucccugaaggccaugaagcugaugaugcccgagcucuacgggaccagcaagaaccagaugcagaucauccacacgaugcagcugggcaaggcguacaucaagccccugaaccagcagaaguaccucaacuccgaggccauccuggaggagaucuacaaccccaucgccgcccggagcauccgccagaccaucaaggugaccaacgccauccugaagaaguacggcccgcucgacuccgucaucaucgagaugccccgggacuaccagaccagcgaggacgagcgcaagaugaucgagaagaugcagaaggagaacgagaaggagaagaaggcggcccugaagcgggcccgcgaggaguaccccuuccccgacgaggccuuccggaaccacaaggagcuggccacgaagcugcgccucugguaccagcaggaccaguucugcguguacuccgggcggaagaucagcgucguggaccuggugcgcaacccgaaccaguucgagaucgaccacaucaucccccaguccgucagccuggacgacucccucaacaacaaggugcugugcuucagcgaggagaaccagaagaagggccagcagacccccuucuacuaccacaagggcaagagcgggaacuggaccuacgagcaguacaagcuguucguggagaagcuguucgacaagaagaagaucuccaacaagaagcgggagcugcuccucuucgaggaggacaucaacaagugggacguccgccggggguucaucgcgcgcaaccugguggacacccgguacgccagccgcgugauccugaacuccuaccagcaguacuucggcaaccacgagaugggcacgaaggucaagguggugcgcgggaaguucaccagccagcuccggaagaaguggaagaucuucaaggaccgcaacgagucccacagccaccacgccaucgacgcccugaucgucgcggccaccgccaaccugcggcucuggaagaagaacaagcugggcaucuccgacgaggggaagguguacgacaaggagaccggcgagauccugcccuucgagaagcucacggccagcgaguacaacgagaugaugaacaaggagccguaccugaacuucaagaccaagcugcagaacaucgagaccaaggugaaguacuccuacaaggucagcaagaaggugaaccgcaagaucuccaacgacaccaucuacagcacgcgggagcgcgacgggaucgacuacaucgugggcaagaucaagaacaucuacgacgucaagaccuacaaggaccaguuccucaagcgguacaagaagaacaaggagcaguuccugauguaccagcacgacccccagaccuucgccauccuggaguccaucauggcgaccuaccccgacgccgagaaccccuuccucgccuacaagaaggagcacggcgugauccgcaaguacgccaagaacaaggccggggcgccggugacgagccugaaguucaucgacggcgcccuggggcagaagaucgacgucaccuacaagaacaaggccgcccuccccaagaacaagaagguggugcugcaguccaucaagcccuaccgggccgacgucuacuacgacgagggcaacaagcgcuaccaccugaucggcgugaaguacagccucuucuccuucagcaagcagggguacgugaucaaccccaucgcguaccagaagcugcuggagaaggagcagauccacagcgagaugaaguucugcuucucccucuaccgggaggacaucaucgagagcggcgaggacccggacucccugacccgcuaccgguucuggagcaagaacgaguccgggaagaacaagaucgaggucaagcccaucgagaagcccaacuucgaggaccgcaaggugaucaccaucaccaagaagaucaagauccugaacaaguaccagacggacgugcucggcaacagcuucaaggcccaggaggagaaggacccccgguccaucgaguga

SEQ ID NO: 1576 - RNA, 3267 nt, Artificial Sequence
  Cas9 variant
augaacuacaagaugggccuggacaucgggaucgccagcgugggcugggccgucaucaaccucgaccugaagcgcaucgaggaccugggggugcggaucuucgacaaggcggagcacccccagaacggcgagucccucgcccugccgcgccggaucgcccgcagcgcccggcgccggcugcgccggcgcaagcaccggcucgagcgcauccggcgccugcugguguccgagaacguccucaccaaggaggagaugaaccugcuguucaagcagaagaagcagaucgacguguggcagcuccggguggacgcccuggagcgcaagcugaacaacgacgagcucgcgcggguccugcugcaccucgccaagcgccggggguucaagagcaaccgcaaguccgagcggaacagcaaggaguccagcgaguuccugaagaacaucgaggagaaccaguccauccuggcccaguaccgcagcgugggcgagaugaucgugaaggacuccaaguucgccuaccacaagcgcaacaagcucgacagcuacuccaacaugaucgcgcgggacgaccuggagcgcgagaucaagcugaucuucgagaagcagcgggaguucaacaaccccgucugcaccgagcgccucgaggagaaguaccugaacaucuggagcucccagcggcccuucgccagcaaggaggacaucgagaagaaggugggcuucugcacguucgagcccaaggagaagcgcgccccgaaggccaccuacaccuuccaguccuucaucgugugggagcacaucaacaagcugcggcucgucagccccgacgagacccgcgcccugacggagaucgagcggaaccugcucuacaagcaggcguucuccaagaacaagaugaccuacuacgacauccgcaagcugcugaaccucagcgacgacauccacuucaaggggcugcuguacgaccccaagagcucccucaagcagaucgagaacauccgguuccuggagcuggacagcuaccacaagauccgcaagugcaucgagaacguguacggcaaggacgggauccggauguucaacgagaccgacaucgacaccuucggcuacgcccucacgaucuucaaggacgacgaggacaucguggccuaccugcagaacgaguacaucaccaagaacgggaagcgcgucuccaaccuggccaacaagguguacgacaagagccucaucgacgagcugcugaaccucuccuucagcaaguucgcccaccuguccaugaaggcgauccggaacauccugcccuacauggagcagggcgagaucuacagcaaggccugcgagcucgccggcuacaacuucaccgggccgaagaagaaggagaaggcccugcugcugcccgugauccccaacaucgccaaccccgucgugaugcgcgcgcucacccagucccggaagguggucaacgccaucaucaagaaguacggcagcccgguguccauccacaucgagcuggcccgcgaccugagccacuccuucgacgagcggaagaagauccagaaggaccagacggagaaccgcaagaagaacgagaccgccaucaagcagcucaucgaguacgagcugaccaagaaccccaccgggcuggacaucgugaaguucaagcucuggagcgagcagcagggccgcugcauguacucccugaagcccaucgagcuggagcggcuccuggagcccggcuacgucgagguggaccacauccugccguacagccgcucccucgacgacagcuacgccaacaagguccuggugcugacgaaggagaaccgggagaaggggaaccacacccccguggaguaccucggccugggguccgagcgcuggaagaaguucgagaaguucguccuggcgaacaagcaguucagcaagaagaagaagcagaaccuccugcggcugcgcuacgaggagaccgaggagaaggaguucaaggagcggaaccucaacgacacccgcuacaucagcaaguucuucgccaacuucaucaaggagcaccugaaguucgccgacggcgacgggggccagaagguguacacgaucaacggcaagaucaccgcccaccuccggucccgcugggacuucaacaagaaccgggaggagagcgaccugcaccacgcgguggacgccgucaucguggccugcgccacccaggggaugaucaagaagaucaccgaguucuacaaggcccgcgagcagaacaaggaguccgcgaagaagaaggagcccaucuucccccagccguggccccacuucgccgacgagcugaaggcccggcugagcaaguucccccaggaguccaucgaggccuucgcccucggcaacuacgaccgcaagaagcuggagagccugcggcccguguucgucucccgcaugccgaagcggagcgugacgggggcggcccaccaggagacccuccgccggugcgugggcaucgacgagcaguccgggaagauccagaccgccgucaagaccaagcugagcgacaucaagcuggacaaggacggccacuuccccauguaccagaaggaguccgacccccgcacguacgaggccauccggcagcgccuccuggagcacaacaacgaccccaagaaggccuuccaggagccgcuguacaagcccaagaagaacggcgagcccgggccggugauccgcaccgugaagaucaucgacaccaagaacaaggucgugcaccucgacggcagcaagaccguggcguacaacuccaacaucguccggacggacguguucgagaaggacgggaaguacuacugcgugcccgucuacaccauggacaucaugaagggcacccugcccaacaaggccaucgaggccaacaagcccuacagcgaguggaaggagaugaccgaggaguacacguuccaguucucccuguucccgaacgaccucgugcgcaucgugcugccccgggagaagaccaucaagaccagcaccaacgaggagaucaucaucaaggacaucuucgccuacuacaagaccaucgacuccgcgaccgggggccuggagcucaucagccacgaccgcaacuucagccugcggggcgucggguccaagacgcugaagcgcuucgagaaguaccagguggacgugcucggcaacauccacaaggucaagggggagaagcgggugggccuggccgcccccaccaaccagaagaagggcaagaccguggacagccugcaguccgucagcgacuga

SEQ ID NO: 1577 - RNA, 3270 nt, Artificial Sequence
  Cas9 variant
augaccgccuucaagcccaacccccugaacuacauccucggccuggacaucgggaucgccagcgugggcugggcgauggucgagaucgacgacaaggagaaccccgugcgccugaucgaccucggggugcgggucuucgagcgcgccgagaugcccaagaccggcgacucccuggccgccgcccggcgccuggcgcggagcgugcgccggcucacgcgccggcgcgcccaccggcugcugcgcgcccggcgccuccugaagcacgagggggugcugaagcccgaggacuucgacgagaacggccucgucaagccgcugcccuacauccccaagcagccccggaacaccccguggcagcugcgcgccgcggcccucgaccggaagcugacgccccuggagugggccgccgugcuccugcaccuggugaagcaccgcggcuaccucucccagcggaagaacgagggggagaccgacgacaaggagcugggcgcccugcucaagggggucgcggacaacacccacgcccugcaggccggcaacuuccgcacccccgccgagcuggcccucaacaaguucgagaaggagagcgggcacauccggaaccagcgcggcgacuacucccacaccuucagccgcaaggaccugcaggcggagcuggugcuccuguucgagaagcagaaggaguucggcaaccccuacguguccgacgaccugaagaacgggaucgagaaccuccugaugacccagcggccggcccugagcggcgacgccauccagaagaugcucgggcacugcacguucgagcccgccgagcccaaggccgcgaagaacaccuacaccgccgagcgcuucaucuggcugaccaagcugaacaaccuccggauccugaaccagggcaacgagcgcccccugacggacgccgagcggaccacccucauggacgagccguacaagaaguccaagcugaccuacgcccaggcccgcaagcugcucgaccuggacgacacggcguucuucaagggccugcgguacgggaaggacaacgccgagagcgccacccucauggagaugaaggccuaccacgcgaucucccgcgcccuggagaaggagggccugaaggacaagaaguccccgcugagccucagccccgagcugcaggacgagaucgggaccgccuucucccuguucaagaccgacgaggagaucacgggccggcucaaggggugccugcagcccgagauccuggacgcccuccugaagcacaucagcuucgacaaguucguccagaucucccugaaggcccuccgccggaucgugccccugauggagcagggcaagcgcuacgacgaggcgugcgccgagaucuacggcgaccaccacgggcggcgcaacagcgaggagacccuguaccucccgcccauccccgccgacgagauccggaaccccgugguccugcgcgcccugucccaggcccggaaggugaucaacggcguggggcgccgguacggcagccccgcgcgcauccacaucgagaccgcccgcgaggucggcaagagcuucaaggaccggaaggagaucgagaagcgccaggaggagaaccggaaggaccgcgagaaggccgccgccgaguuccaggaguacuuccccaacuucgugggggagcccaaguccaaggacauccucaagcugcggcuguaccgccagcagaacugcaagugccucuacagcggcaaggagaucaaccuggggcggcugaacgagaagggcuacguggagaucgaccacgcgcucccguucucccgcaccugggacgacagcuucaacaacaagguccuggugcugggguccgagaaccagaacaagggcaaccggacgcccuacgaguaccucaacgggaaggacaacagccgcgaguggcaggaguucaaggcccggguggagaccucccgcuucccccacagcaagaagcagcggauccugcugcagaaguucgacgaggagggcuucaaggagcgcaaccucaacgacacccgguacgucaaccgcuuccugugcaaguucguggccgaccacaugcagcugaccggcaaggggaagcggcgcgucuucgccuccaacggccagaucacgaaccuccugcggggguucuggggccugcgcaaggugcgggcggagaacgaccgccaccacgcccucgacgccguggucguggccugcagcaccguggccaugcagcagcgcaucacccgguucguccgcuacaaggagaugaacgcguucgacggcaagaccguggacaaggagacgggggaggugcugcaccagaagacccacuucccgcagcccugggaguucuucgcccaggaggucaugauccggguguucggcaagcccgacgggaagcccgagcuggaggaggccgacaccccggagaagcuccgcgcccugcuggccgagaagcucuccagccggcccgaggcggugcacgaguacgucgcgccccuguucgugucccgcgcccccaaccggaagaugagcggccaggggcacauggagaccaucaaguccccgaagcgccuggacgagggcaucagcgugguccgggugccccucacgcagcugaagcugaaggaccucgagaagauggugaaccgcgagcgggagcccaagcuguacgaggcccugaaggcccgccucgaggcccacaaggacgaccccgccaaggccuucgccgagccguucuacaagcaggacaaggcgggcaaccggacccagcaggucaaggccgugcgcaucgagcagguccagaagaccggggugugggugcggaaccagaacggcaucgccgacaacgccaccauggugcgcgucgacguguucgagaagggcgggaaguacuaccuggugcccaucuacuccuggcaggucgccaaggggauccugcccgacaaggcgaucaucgccuucaaggacgaggaggaguggcagcucaucgacgacagcuucaacuucaaguucccccugcacccgaacgaccugguggaggugaucaccaagaaggcccggaucuucggcuacuucgccuccugccaccgcggcacggggaacaucaacauccggauccacgaccucgacaacaaggucggcaagaacgggauccuggagggcaucggggugaagaccgcccugagcuuccagaaguaccagaucgacgagcucggcaaggagauccgccccugccgccugaagaagcggccgcccgugcgcuga

SEQ ID NO: 1578 - RNA, 3270 nt, Artificial Sequence
  Cas9 variant
augaacgugcgcuacaagaucggccuggacaucgggaucaccagcgucggcugggccguggugaaccucgacaucccccggaucgaggaccuggggguccgcaucuucgaccgggccgagaacccgcagaccggcgagucccuggcgcucccccgccggcuggcccgcagcgcccggcgccggcugcgccggcgcaagcaccggcucgagcgcauccggcgccugcugauccgggaggggauccucaugaaggaggagcuggacaagcuguucgaggagcgccacgagaucgacguguggcagcuccggguggaggcccuggaccgcaagcugaacuccgacgagcucgcccggguccugcugcaccucgcgaagcgccgcggcuucaagagcaaccggaaguccgagcacaacagccgcgagaacuccacgaugcugaagcacaucgaggagaaccgggccauccugagcuccuaccgcaccguggccgagaugaucgugaaggaccccaaguucgcccuccacaagcggaacaagggcgagcacuacaccaacaccaucgcgcgcgacgaccuggagcgggagauccagcugaucuucacgaagcagcgcgaguucgggaacaugaacugcaccaaggaguucgagaacgaguacaucgccaucugggccagccagcggcccuucgccuccaaggacgacaucgagaagaaggucggcuucugcaccuucgagccgaaggagaagcgcgcccccaaggcgaccuacacguuccagagcuucaucgccugggagcacaucaacaagcuccggcuggugucccccgccgggacccgcggccugaccgacgaggagcggcgccuccuguacgagcaggccuuccagaagaacaagaucaccuaccacgacauccggacgcugcuccgccugcccgacgacaccuacuucaaggggguggucuacgaccggaacaugccgcugaagcagaacgagaccauccgcuuccucgagcuggacgccuaccaccagauccggaaggugaucgacaaggcguacggcaagggcaagagcuccagcuuccugcccaucgacuucgacaccuucggguacgcccucacgcuguucaaggacgacgccgacgugcgcuccuaccugcagaacgaguacgagcagaacggcaagcccaugcccaaccucgccaacaagaccuacgacaacgagcugaucgaggagcugcucaaccugagcuucaccaaguucgggcaccugucccucaaggcccugcacaacauccugccguacauggagcagggcgaggucuacagcagcgcgugcgagcgcgccggcuacaaguucaccgggccccggaagaagcagaagacgaugcuccugcccaacauccccuccaucgccaacccgguggugaugcgcgcccugacccaggcccggaaggucgugaacgcgaucaucaagaaguacggcagccccguguccauccacaucgagcuggcccgcgaccucagccagaccuucgacgagcggcgcaagaccaagcgggagcaggacgagaaccgcaagaagaacgagacggccauccggcagcugauggaguacgggcugacccucaaccccaccggccacgacaucgucaaguucaagcugugguccgagcagaacgggcgcugcgccuacagccugcagcccaucgagaucgagcggcuccuggagccgggcuacaccgagguggaccacgugauccccuacucccgcagccuggacgacuccuacacgaacaagguccucgugcugaccaaggagaaccgggagaagggcaaccgcacccccgcggaguaccugggggucggcaccgagcgguggcaccaguucgagacguucgugcucaccaacaagcaguucagcaagaagaagcgcgaccggcugcugcgccuccacuacgacgagaacgaggagaccgaguucaagaaccggaaccugaacgacacccgcuacaucucccgguucuucgccaacuucauccgcgagcaccugaaguucgccgagagcgacgacaagcagaagguguacacggucaacgggcgcaucaccgcccaccuccggucccgcugggaguucaacaagaaccgggaggagagcgaccugcaccacgccguggacgcggccaucguggccugcaccacccccuccgacaucgccaagaucaccgccuucuaccagcgccgggagcagaacaaggagcuggcgaagaagacggagccgcacuucccccagcccuggccccacuucgccgacgagcuccgcgcccggcugagcaagcacccgaaggaguccaucaaggcccugaaccucggcaacuacgacaacgagaagcuggagagccugcaccccgucuucgugucccgcaugcccaagcggagcgugaccggggccgcgcaccaggagacccuccgccgguacgucggcaucgacgagcgcagcggcaagauccagaccguggugaagacgaagcuguccgagaucaagcuggacgccagcgggcacuucccgauguacggcaaggaguccgacccccggaccuacgaggccauccgccagcggcuccuggagcacaacaacgaccccaagaaggccuuccaggagccccuguacaagccgaagaagaacggggagcccggccccaucauccgcaccgucaagaucaucgacaccaagaaccagguggugccccucaacgacgggaagacggucgcguacaacagcaacaucgugcggguggacgucuucgagaaggacggcaaguacuacugcgugccgguguacaccauggacaucaugaagggcguccugcccaacaaggccaucgagcccaacaagcccuacuccgaguggaaggagaugaccgaggacuacaccuuccaguucagccuguacccgaacgaccucauccgcaucgagcugccccgggagaaggccauccgcacguccaccggggaggagaucaagaucaaggacuucuucgccuacuacaagaccauccacagcggcaccgggggcauggagcugaucucccacgaccgcagcuucucccucagcggcguggggucccggacgcugaagcgcuucgagaaguaccagguggacguccugggcaacaucuacaaggugcgcggggagaagcgggugggccucgccagcuccgcgcacagcaagaccgggaagaccguccggccccugcaguccacccgcgacuga

SEQ ID NO: 1579 - RNA, 3273 nt, Artificial Sequence
  Cas9 variant
augcgcuggcggcugggccucgacaugggggccggcagccugggguggugcgccgugggccuggacgaccagggguaccccgacuccauccucgcggccggcagccacaucuucggcgacgggcgcgccccgucccggggcgaccagcaggggacgccccugggcgucgagcgccgggccgccaaggcgaugcgccggcgccgggaccgcuuccuggggcggcaggccaagcuccuggcccgccugacccucgccggccuguuccccgcggaccccgugcgggccaaggcccuggagcuccuggacccguacgugcugcgcgcccgggcccucgacgaggcgcugccgccccaccagcugggccgcgccuucuuccaccucaaccagcggcgcggguucaagagcaaccggaagaccgaccgcggcgucgacgacgaggccgggaagaucgccaucggcaucgaccggcugcgcgccgcgaucgccgccgccgaggcccgcaccaugggcgaguuccugcacaagcggcgccaguccgcgcccgacgugaaccagauccccagcgugcggacccgccuccggcccgagaccggggaggaggccaagggcgacggguacgacuucuaccccggccgcgagcuggucgaggaggaguucgacgccaucugggacgcccaggcgccccaccacccgucccugcucacgcccgacaaccgggcccugcugcacgaggccaucuucuaccagcgcccccucaaggcccccaagaucgggaagugcacccugcugaacaacgagccgcggcuccccaaggcccacccccuguuccagcgccggcgccugcucgaggaggugaacgcgcugcggaucgugcgccccggcgaggucgccaccaagcugaccugcgagcagcgggaccuccugaugcugaagcucaaggacaaggccaaggugagcuucgagacgcugcgcuccaaggugcugaagcucgagccggaggcccgguucaacaaggagggcgagaaccgcaccgagcuggucggggacgaggugugcgcccagaugagcgcgaagacccgguucggcaaggccugggcccacuucaccgacgagaagcgcugggccauccugucccgccucaucgaggaggaggacgaggagcggcuggacacguggcugcgcaccgagcacgggcucgacgccgagcaggcgcgggccguggccggcgcccgccugcccgccggguucggccgguucggcgagaccgcgacccgccggcugaucgccgcccugcaggccgaggucaucguguacagcgaggcgguggucgccgccgggcucggccaccacuccgacaugcgcacgggggaggugcuggccgagcugcccuacuacggcaugacccucgagcggcaccuccugcccgggaccggcgacaaggccgacccggaggagcuccgcaucggccggcugaccaaccccacggugcacaucgcgcugaaccgccuccggcgcaucgucaaccggcugaucaagaccuacgggcgccccgagcagaucgccaucgagcugggccgggagcucaagcugaccgacgaggacaagcagcgccugagccggcagaacaaccgcaaccgggccgacgccgaggcccgcuccaagaagcucgcggagcuggggcaggccgacaacggcgccaaccgcgcccggcugaagcucugggaggagcugaaccgcgagaacgcccuggaccggcgcugcaucuacagcggccagcagaucuccaucgcgaugcuguucagcgacgccguggagguggaccacauccugcccuucgacgccacccuggacgacuccaacaacaaccggauccucugccugcgcgaguggaaccggcgcaagcggaagcagagcccguacgaggccugggggcacacggacuacuggcccgacaucgcggcccgcgccgcccggcugcccaaggagaagcgcuggcgguucgagccggacgccaugcagcgcuucagcgcggaggaccgguucaucgcccgccaccucgucgacacccaguacaugucccggcuggcccgcgaguaccuggaggcccucuaccccgagaagggcgaggggagcggccacgugugggucucccccgggcggcugaccgagcugauccgccgcaagcucggccugaacgagcugcuccccgaccacaacuucgccggcgugaagaaccggcuggaccaccgccaccacaccaucgacgcguucguggucgccgugacggaccggagccugcuccaggggaucucccgcgccagcgcccuggagggcgaggaggggcgggagcgcgugaucgucccggagcccugggacggcuuccgggaggcccugcgcaccacccucaacaccaucacgguguggcaccggcaggaccacgggaccgcguccaaggccggccuggcccagggccgcgaccagaccgccgggaagcugcacaacgacaccgccuacggccucacggggcggcaggacaccaagggcaacgaccugguggucagccgcaagccccugaugucccucaagcccgcggacaucgagccggugcccgacguggcccccaucaccaaggggguccgggaccgcgaccugcggaaggcccuggcccacuucacccaggcgaccgagggcaagggcuuccuccaggcccuggagcgcuucacgcggcuggggccccuccacuuccgcggcauccggcgcgugcggcugauccagccgcuggccgugauccccaucaaggggcccggcgggguccccuacaagggcuaccucggcggggagaacuuccgcugcgacgugugggagaugccggacggcgccuggaagcccgaggugaccagcauguuccaggcccaccagcccggguggaccuccgcgauccgcgccgccugccccaccgcccggaagguccugagccugcacaagcgcgacaugaucgccaucgagcgggaggagggcgugcgcacgcucaugguggucgcgcagaucugguccaacggccaggugacccugguggagccgcacgaggccggggaccugaacaagcggaacaagagcgaggacgaccccuucggcuacuucaugcccaccgccgggggccucaagcgccugaaggcccggcagguccgcguggacgagcuggggcgggugcaggaccccggcuucccggcccgcaaggcgcggcgccggacccgccccaagcaggucgacuga

SEQ ID NO: 1580 - RNA, 3273 nt, Artificial Sequence
  Cas9 variant
auggacuggcgccugggccucgaccugggggccaacagccugggcugggccgcgcuccggcuggaccgcgccggggaccccaucggcauccuggccauggggucccggaucuucagcgacggccgcgacccgaaguccggcgccagccucgccguggaccggcgcgcggcccgggccaugcgccggcgccgggaccgcuucaagcagcggcaggccgcgcugcugaaguaccucauccgcgacgggcuguuccccgccgaccaggccgaccggcagcgccuggccgacgaggaccccuacgcccuccgggcgcgcgcccuggacgaggagcugucccucuucgagaucggccgggcccuguuccaccugaaccagcgccggggguuccagagcaaccgcaaggccgaccgcggccaggacgacgaggccgggaagaucgcggucggcguggaccggcucaaccagcagauggaggagcagggcgcccgcacccugggggaguuccugcaccagcggcgccgggccgccaccgacgccaaccacauccccuccgugcgcacgcggcuccgcccggagaccggcgagggggcgaagggcgacggcuacgacuucuaccccagccgggcccugaucgccgaggaguucgaggagaucugggccgcccaggcgccccacuaccccgacacccugacccagcagguccacgaccgccucuacgagaucaucuuccaccagcggccgcugcgcgcgccccagguggggcagugcacgcugguggccggcgagacccggcuccccaaggcccacccccuguuccagaagcgccggcugcucgaggagaucaacgcccugaugaucguccgcccgggggagaucgcccagcggcugacccccgaggagcgcgacacccucuaccugaagcugaaggacaagcggacgguguccuucgccacccuccgcaagacccugaagcuggacagcgccgcccgcuucaacaaggaguccgagaaccggaccgagcucaagggcgacgagguggcggccgagcugggggccaagacgcgccugggcacccgguggcagcaccucagcggcgaccagcagugggaggucgugcaccgccugauggcccuggagucccaggccgacgaggcggccuuccgggacuggaucagccagaccuacgaccuccugcccgagcaggccgccgccgugcugggggcgcgccucccccagggccacgggcgguucggcccgaccgccacgaccacccugaucgacucccugcugcacgaccgcaccgaggacgggcgggucgugguguacagcgaggccguccagcgcuccggccucggccaccacagcgaccugcggcacgaccgcgacgacgaggacgugacggagcugcccuacuacgggguggcccucgagcggcacaucaugcccggcaccgcggagcccaccgacccggaggagaugcgcaucgggcggcugaccaaccccacgguccacaucggccugaaccagcuccgccacguggugaaccggcugauccgcgccuacgggccgcccaaggagaucgccaucgagcuggcccgggagcucaagcuguccgaggacgagaagaagaagcgcaacagcgagaaccgggacaaccgccuggccgcggagggccgcagcaagaagcucgaggagauccggcagcgcgacaccggcgccaaccgggcccugcugaagcucugggaggagcugaaccccgggaacguccuggaccgccggugcaucuacaccggcgagcagaucuccaucgacaugcuguucagcgaccgcguggagguggaccacauccuccccuucgcccagacccuggacgacuccaacgggaacaagcuccugugccugcgggaggccaaccgcgagaagcggcgccggagccccuacgaggcguggggccacacggaccgcuggcccgacaucgccgagcgggccucccgccucccgaagcccaagcgguggcgcuucgagcccgacgccaugcagcgguucgccaccgaggacggcuuccuggcgcgccaccuggucgacacccaguaccucgggcggcuggcccgcgaguaccugagcuggcucuacccgggccgcggggagggcuccgggcacgugugggucagccccggccggcugaccgagauggugcgccggaagcugggccucaacgaccugcugcccgaccacaacuucgggggcggggccgaccagcccaagaaccgccucgaccaccggcaccacgccaucgacgcgcugguggucgccaucguggaccgcggcaugcugcaggccaucgcccgggccuccgggcaggacggcagcgagggccgcgagcggauccacaucccggcgcccugggacggguuccgcgacgaccuccggguggccgucaacggcaucaucgugucccaccgccccgaccacgggacgguggccaaggccggccuggcccgggggcgcgaccagaccgcgggccggcugcacaacgacaccgccuacggccucaccggggagacggacgccaagggcaacagcaucgucgugcgccggaucccccuguccgccaucaagaagccggccgacaucgcgcgcgugcgggacccccugcuccgcaacgcccuggccgaguucaccaaggggcuggacggcaaggccuucgaggcccggaucgggcgcuuccacgagcucggcccccugcuguaccgcggcauccggcgcguccgggugguggagacccucaccgucauccccauccgcgacgcggaggggcgggccuacaagggcuacaagggggacagcaacuaccgcuacgacgugugggagaugccggacggcaaguggcggugccagguggucuccauguucgacgcccaccagagcaccgagcaggcccgcccccaccccgcggcccggaagauccugucccugcagcgcaacgacauccucgccaucgagcggacggagggcgaccgcgagcuggugcggguggucaaguucagcgagaagcaguucgccguggcgcccccgcacgagggcgggucccugaagacccgcgacgggaacgccgacgaccccuuccgguaccucuaccccagccccaacacccugaagggcuggcgcgcccgccaggugcggaucgacgagcuggggcggguccucgacccgggcuuccccgcccgcaagagcgugcgccggacccgcccccgggccgcccccguggacuga

SEQ ID NO: 1581 - RNA, 3276 nt, Artificial Sequence
  Cas9 variant
auguacagcaaccugcuguucuccuucgacaucggcaccaacagcaucggguggugcguguucgcccuggacgaggccggcgagcccuaccgcaucgucgaccugggggcgcggaucuacgccgacggccgcgacccgcaguccaagaccagccucgccguggcccggcgcgaggcccgggcgaugucccgccggcgcgaccgguaccugcgccggcgcaaggccacgcugcggaccaugaucgaguacgggcucaugcccggcgacaaggccggccaggaggccgugcugcgcgagaccggggaccgggagggcggggacgagagcuucaaccccuacgcgcugcgcgcccgggcccucuccgagaagcugcccccggccuacaucggccgcguccuguuccaccucgggcagcggcgcggcuucaagagcaaccggaagaccgaccgcaaggacaacgacaagggcaagaucgcccuggggaucgacgagcugacggcggccaugcaccgcuccggcagccccacccucggggccuggcuggccaugcggcgcgccgagggccacuccgugcggcugcgcgcgggcagcgagguguucgacgccgagggguacgccuucuaccccgagcggucccuccuggaggacgaguuccgccagaucugggacgcccaggccguccaccaccccgacauccugaccccggagcggcgcgcgcaccucuuccgggugauguucuaccagcgcccccugaagaagccccuggugggccggugcagcuucaaccccgccgaguuccgccucucccgggcccacccgcuguuccaggaguuccgccuguacaaggagaucaacgaccucgaggucgugcugcccgaccagagccaccggaagcugacccucgacgagcgcaacgcccugguggccaagcugaagacgucccggaaggcgagcuucuccgcccuccgcaagacccugaagcugacccccgaccucgucuucaacaaggagagcgaggcccggaaggagcugcugggggacgagaucuacagcgugcucgccgacgcgaagauguucggcgcccgcuggggcggguucucccgcgcccggcagugggagaucaucacccgccugaaggaggaggaggaccccgccagccuguccagcuggcucaaguccgaguucggccuggacgacgagcgggugacggccaucgcgaacgccagccugccggacggguacggccgccucggggagaccgcccuggccuccaugcuggaggagcucaagaccgccgucauccccgagagcgaggcggcccggcugugcggcuacgaccacuccaaccuggccaaggagcaggacgaggggcuggacacccuccccgaguaccaggagauccuggagcgccacaucccgcccggcacgggcgaccccgacgacaucuacgaccugcggaaggggcgcaucaccaaccccaccgugcacaucggccucaaccagcugcggcgcguggucaacgcccugauccaccgguucgggcgcccccagcggaucgugguggagcucgcccgcgaccugcagcugagcgagaagcagaaggacgacgucaaccggcgcaucgcgaagaacacccgggaggccgagggccgcucccagaagcucaucgagauggggcagcuggacacgggcuacaaccggcugcuccugaagcugugggaggagcucaaccuggacaagccggaggaccgcgugugcaucuacagcggcaagcccaucgggaucgccaugcuguucuccggcgagguggacgucgaccacauccuccccuggagcaagacccuggacgacucccaggccaacaagcugcucugccucaagagcgcgaaccggcagaagcgcaaccgcacccccuccgacgugccggaguggcgggaccgcuacgacgagguccuggcccgggccgcccgccucccccggaacaagcgcuggcgguucgccgcggacgccaugcagcaguucgaggccgagggcggguuccuggcccgccagcugaccgacacgcaguaccucagccggauggcccuggaguaccuguccgcgcucuaccccagcgaggaggccgacaagagcggcgagcugcgccagcggaagcgcgugcacguggucccggggcggcugaccgagcuccugcgccggaacuggggccugaacacccuccugcccgaccacaaccugggggagauggcccaggagaagaaccgccgggaccaccgccaccacgccaucgacgccgcggugaucggcaccacgucccggagccuccugcagcgcauguccggggccgccgcccgccuggacgacguggcguucgacgaccucguccggaccguggugaaggacaacccgcccuggcccggcuuccgcgaggagcugcuggccgccaucggccgggucaccgugagccacaagcccgaccacgggaccgugucccgcgccgccuacgcgcagggcaaggggcagacggccggcaagcuccacaacgacaccgccuacgggcugaccggccuggucgacgccaagggcagcccccucguggugcggcgcaagcccuucauggcccuggaggucaaggacaucgcguccauccgggacaccgagcugcagagcgcccucuacggggccaucggcucccugacggagaagaaggcccugcaggaggcccucauccgcuuccgggacacccacccgcaguucaaggggauccgccgggugcgcgugcuggagacccugagcgucauccccaucguggaccgggacggcaaggcguacaagggguacaagggcgacgccaacuaccgcuacgaggugugggagacccucgacggcaaguggcacaccgaggucguguccauguucgacgcccaccagcccggguggcagagccccuuccacaagcagaacccggccgcccggcgcgugcugaagcugcagcagaacgacauggucgcguacgagcaccccgccgacggcuacacgaucgcccggguggugaaguucuccaacgacaagcgcaucuacuucgccagccaccgggaguccgggagccucaaggcgcgcgacgccgacaagggcgaccccuucuccuacuucgccaaggccaacaacgggcugcgggacaucaagugccgccagguccgcaucgacgccgcgggccggaucuucgaccccggcccgcaggaccgcgagacccggcaggccaacaaggggguguga

SEQ ID NO: 1582 - RNA, 3279 nt, Artificial Sequence
  Cas9 variant
auggccuacaccaugggcaucgacguggggaucgccagcugcggcugggcgaucgucgaccuggagcgccagcggaucaucgacaucggggugcgcaccuucgagaaggccgagaaccccaagaacggcgaggcccucgccgugccgcggcgcgaggcccgguccagccgccggcgccugcggcgcaagaagcaccggaucgagcgccugaaguacauguucguccggaacgggcucgcgguggacauccagcaccuggagcagacgcugcgcucccagaacgagaucgacguguggcagcuccgggucgacggccuggaccgcaugcugacccagaaggaguggcuccgggugcugauccaccuggcccagcgccggggcuuccagagcaaccgcaagaccgacggguccagcgaggacggccaggugcucgucaacgugaccgagaacgaccggcugauggaggagaaggacuaccgcacgguggccgagaugauggucaaggacgagaaguucuccgaccacaagcgcaacaagaacgggaacuaccacggcguggugagccgggccucccugcucgucgagauccacacccuguucgagagccagcgccagcaccacaacuuccuggcguccaaggacuucgagcucgaguacaucaacaucuggagcucccagcggcccguggccaccaaggaccagaucgagaagaugaucgggaccugcacguuccugcccaaggagaagcgcgcccccaaggccagcuggcacuuccaguacuucaugcugcuccagaccaucaaccacauccggaucaccaacgcccagggcacccgcccgcugaacaaggaggagaucgagcaggucgugaacauggcgcugacgaaguccaaggugagcuaccacgacauccggaaggugcucgaccuguccgaggaguaccaguucgucggccuggacuacgggaaggaggacgagaagaagaagguggagagcaaggagaccaucaucaagcucgacgacuaccacaagcugaacaagaucuucaacgagguggagcuggccaagggcgagaccugggaggccgucgacuacgacaccguggccuacgcccucacguucuucaaggacgacgaggacauccgcgacuaccugcagaacaaguacaaggacuccaagaaccggcuggucaagaacguggcgaacaaggaguacaccaacgagcucaucgagaaggugagcacccugagcuuccgcaaggucgggcaccugucccucaaggcccugcggaagaucauccccuuccuggagcagggcaugaccuacgacaaggccugccaggccgccggcuucaacuuccaggggaucagcaagaagaagcgcuccguggugcuccccgucaucgaccagaucagcaaccccguggugaaccgggcgcugacgcagacccgcaaggucaucaacgcccugaucaagaaguacggcuccccggagaccauccacaucgagaccgcccgggagcucagcaagcgcuucgacgagcggaagaacaucacgaaggacuacaaggagaaccgcgacaagaacgagcgggccaagaagcaccuguccgagcuggggaucaucaaccccaccggccucgacaucgugaaguacaagcuguggugcgagcagcaggggcgcugcauguacagcaaccagcccaucuccuucgagcgccugcgggagagcggcuacaccgagguggaccacaucauccccuacucccgcagcaugaacgacuccuacaacaaccggguccucgugaugacccgcgagaaccgggagaaguccaaccagacgccguacgaguacaugggcaacgacacccagcgcugggacgaguucgagcagcgggugaccaccaacccccagaucaagaaggagaagcgccagaaccugcugcugaagggguucacgaaccggcgcgagcucgagaugcuggagcggaaccugaacgacacccgccacaucaccaaguaccucagccacuucaucagcaccaaccuggaguucucccccagcgacaagaagaagaaggucgugaacacguccggccggaucaccagccaccuccgcagccggugggggcuggagaagaaccgcgagcagaacgaccugcaccacgccauggacgcgguggucaucgccgugaccuccgacagcuucauccagcaggucaccaacuacuacaagcggaaggagcgccgggagcugaacggcgacgacaaguucccccucccguggaaguucuuccgcgaggaggugaucgcccggcugucccccaaccccaaggagcagaucgaggcccugcccaaccacuucuacagcgaggacgagcucgcggaccugcagccgaucuucgugucccgcaugcccaagcgcagcaucaccggggaggcccaccaggcccaguuccggcgcguggucggcaagacgaaggagggcaagaacaucaccgccaagaagaccgcccugguggacaucuccuacgacaagaacggggacuucaacauguacggccgggagaccgaccccgcgacguacgaggccaucaaggagcgcuaccucgaguucgggggcaacgccaagaaggccuucagcaccgaccugcacaagcccaagaaggacgggaccaagggcccgcugaucaaguccgugcggaucauggagaacaagacccucguccaccccgugaacaagggcaaggggguggucuacaacagcuccaucgugcgcacggacguguuccagcggaaggagaaguacuaccugcugcccgucuacgugaccgacgugaccaagggcaagcuccccaacaaggucaucgccgcgaagaagggguacgacgacuggaucgagguggacgacagcuucaccuuccuguacucccuguacccgaacgaccucaucuucauccgccagaaccccaagaagaagaucagccugaagaagcggaucgagucccacagcaucuccgacagcaaggaggugcaggagauccugacguacuacaagggcgucgacagcuccaccgccgccaucgaguucaucacccacgacggcagcuacuacgccaagggggugggcgugcagaaccucgacugcuucgagaaguaccaggucgacauccuggggaacuacuccaaggugaagggcgagaagcgccuggagcucgagaccagcgacaacaaccacaaggggaaggacgugaacuccaucaagagcacgucccgguga

SEQ ID NO: 1583 - RNA, 3279 nt, Artificial Sequence
  Cas9 variant
augaaguacagcaucggccuggacaucgggaucgccuccgugggcuggagcgucaucaacaaggacaaggagcgcaucgaggacaugggggugcggaucuuccagaaggccgagaaccccaaggacggcuccagccucgcguccagccgccgggagaagcgcgggucccggcgccggaaccgccggaagaagcaccgccuggaccggaucaagaacauccugugcgagagcggccucgugaagaagaacgagaucgagaagaucuacaagaacgccuaccugaaguccccgugggagcugcgcgccaagagccucgaggccaagaucuccaacaaggagaucgcccagauccugcugcacaucgcgaagcggcgcggcuucaagagcuuccggaagaccgaccgcaacgccgacgacaccgggaagcuccuguccggcauccaggagaacaagaagaucauggaggagaagggguaccugacgaucggcgacauggucgccaaggaccccaaguucaacacccacgugcggaacaaggccgggagcuaccucuucuccuucagccgcaagcugcuggaggacgaggugcggaagauccaggcgaagcagaaggagcucggcaacacccacuucaccgacgacguccuggagaaguacaucgagguguucaacucccagcgcaacuucgacgagggccccagcaagcccuccccguacuacagcgagaucgggcagaucgccaagaugaucggcaacugcacguucgagagcuccgagaagcggaccgccaagaacaccuggagcggggagcgcuucguguuccugcagaagcucaacaacuuccgcaucgucggccuguccggcaagcggccccugaccgaggaggagcgcgacaucguggagaaggagguguaccucaagaaggagguccgguacgagaagcugcgcaagauccuguaccucaaggaggaggagcgguucggggaccugaacuacagcaaggacgagaagcaggacaagaagacggagaagaccaaguucaucucccugaucggcaacuacaccaucaagaagcucaaccugagcgagaagcugaaguccgagaucgaggaggacaagagcaagcucgacaagaucaucgagauccugaccuucaacaaguccgacaagacgaucgagagcaaccugaagaagcucgagcugucccgcgaggacaucgagauccugcucagcgaggaguucuccgggacccugaaccugagccucaaggccaucaagaagauccugcccuaccuggagaagggccucuccuacaacgaggccugcgagaaggcggacuacgacuacaagaacaacgggaucaaguucaagcggggcgagcugcugcccgugguggacaaggaccucaucgccaacccggucgugcugcgcgccaucagccagacccggaagguggucaacgccaucauccgcaaguacggcacgccccacaccauccacguggagguggcccgggaccuggcgaaguccuacgacgaccgccagaccaucaucaaggagaacaagaagcgggagcucgagaacgagaagaccaagaaguucaucagcgaggaguucgggaucaagaacgucaagggcaagcugcugcugaaguaccgccucuaccaggagcaggaggggcggugcgccuacucccgcaaggagcugagccugagcgaggugauccucgacgaguccaugaccgacaucgaccacaucauccccuacagccgguccauggacgacagcuacuccaacaaggugcugguccugagcggcgagaaccgcaagaaguccaaccuccugcccaaggaguacuucgaccggcaggggcgcgacugggacacguucgugcugaacgucaaggccaugaagauccacccgcgcaagaaguccaaccuccugaaggagaaguucacccgggaggacaacaaggacuggaagucccgcgcccugaacgacacccgguacaucagccgcuucguggccaacuaccucgagaacgcgcuggaguaccgggacgacagccccaagaagcgcguguucaugauccccggccagcugaccgcccagcuccgggcccgcuggcggcugaacaagguccgcgagaacggcgaccugcaccacgcccucgacgccgcggugguggccgucacggaccagaaggccaucaacaacaucagcaacaucucccgguacaaggagcugaagaacugcaaggacgugauccccagcaucgaguaccacgccgacgaggagaccggggagguguacuucgaggaggucaaggacacccgcuucccgaugcccugguccggcuucgaccuggagcuccagaagcggcuggagagcgagaacccccgcgaggaguucuacaaccugcucuccgacaagcgguaccuggggugguucaacuacgaggagggcuucaucgagaagcugcgccccguguucgugagccggaugccgaaccgcggggucaagggccaggcgcaccaggagaccauccggagcuccaagaagaucagcaaccagaucgccguguccaagaagccccucaacagcaucaagcugaaggaccuggagaagaugcagggccgcgacacggaccggaagcucuacgaggcccugaagaaccgccuggaggaguacgacgacaagcccgagaaggccuucgccgagcccuucuacaagccgaccaacuccgggaagcgcggcccccucgugcgggggaucaaggucgaggagaagcagaacgugggcguguacgucaacggcgggcaggcgagcaacggcuccauggugcgcaucgacguguuccggaagaacgggaaguucuacaccguccccaucuacgugcaccagacccugcugaaggagcuccccaaccgcgccaucaacggcaagccguacaaggacugggaccugaucgacgggagcuucgaguuccuguacuccuucuaccccaacgaccucaucgagaucgaguucggcaagagcaaguccaucaagaacgacaacaagcugacgaagaccgagauccccgaggugaaccugagcgagguccucggcuacuaccgggggauggacaccuccaccggcgccgccacgaucgacacccaggacgggaagauccagaugcgcaucggcaucaagaccgugaagaacaucaagaaguaccagguggacguccuggggaacguguacaaggugaagcgggagaagcgccagaccuucuga

SEQ ID NO: 1584 - RNA, 3285 nt, Artificial Sequence
  Cas9 variant
augaaguccacccuggccaucgccuccaucagcucccucggcugggugaucgagcugggggagaaccgcaucaugcggcugggccucgacaucgggagcaccuccaucggcugguggaucuacgagacgaccgacgggcagaucaccagcgucaucgacggcggcgugcgcaucuucuccgacgggcgggaccccaagagcaagggcucccuggcgguggaccgccgggucgcccgcgcccagcggcgccggcgcgaccgguaccugcgccggaaggccgcccucaugaagcgcauggcggagguggggcugaugcccagcgaccccaagcaggccaagcagcuggaggcccucgaccccuacgagcugcgggcccgcggccuggacgagacccucgagcugacggagcuggggcgggcccucuuccaccugaaccagcgccggggcuucaaguccaaccgcaagaccgacgccggcgacaacgagagcgggaagaucaucgacgccaccgcccggcuggacugggccaugcgcgaccaccgcgcgcggaccuacggcgaguuccuccacaugcgccggcagaaggccgacacgccccgcaccaccccggccgugcggacccgccugacgaucgccgcccgggacggggcggagaaggaggaguccggcuacgacuucuaccccgaccgccagcaccuccgcgacgaguucgacgcccugugggaggcccaggccgaguaccacggcguccugaccgaggaccugcgcgacgagaucgggaccaucaucuuccaccagcggccccucaagacccccaaggugggcaagugccuguucacgaacgaggagcgcguggccagcgcgcacccgcugaaccagcggcgcauccucgucgagaccgugaacgcccugcggguggcccagcugggggaggucgcccgcgcccucacccuggaggagcgggacaccauccugcacgcgcucgacaacaaggcccacacgaagucccugagcggcauguccaucaagcugaaggcccucgggaaggugaucaagcugcgcagcggccaguacuucacccuggagaccgccaaccgggacgcgaucgcgugcgaccccgugcgggccagccucagcaagcccgaccgcaucggcagcuacugguccacccuggaccacaacgcccagugggaggucgugaaccggauccgcgccgugcagagcgacgcggaccaccgggagcuggucgccuggcucgugucccagcaccgccuggccgccgagcacgccgagggggcggccuacgcgccccugccggacggcuacagccggcucgggaucacggccaccaagcgcauccuggccgcccuggaggccaacgugauccccuacuccaaggccgucgagagcugcggcuggcaccacuccgacgagcggaccggggaggugcucgaccgccugcccuacuacggcgagauccuggaccggcacgugauccccggcaccuacgacgacagcgacgacgacaucacgcgcuucgggcggaucaccaacccgaccguccacaucggccugaaccagcuccgccggcuggugaaccgcaucaucgagguccacgggaagcccgacgagaucgugguggagcuggcccgggaccucaagcugucccaggaccagaaggcggacgucgagcgcaccaucaagaagaacacgcaggccgccauccggcgcggcgagaagcuggaggagaugggggugcccaacaccggcggcaaccggauggugcuccgccugugggaggaccugaacgacgacgacgucaugaagcgguucugccccuacaccgggcagcgcaucagcgccggcaugcuguucgacggguccugcgacguggaccacauccugccguucagccgcacccuggacgacggcuucacgaacaagacccucugccugaaggaggccaaccggaagaagcgcaacuacgcgccccacgaggccgccgagaagggccugcucgaccgggacgccauggacuccguggccaaguaccugcccgacaacaaggcguggcgcuucgcccccgacgccaucgagcgguucgagggggagcgcgacuucaccgcccgggcccugaaggacacccaguaccucagccgccuggcgcggaccuaccuggacgcccucuacgacggcggggacgacaagucccacgucuggguggugccgggccgccugacggagaugcugcggcgccacugggggcucaacggccuggaggcccuggccgacagcgacgagaagaccgucaagcggaagaaccgcaccgaccaccggcaccacgcgaucgacgccgccgugguggccgccaccgaccgcucccucauccagaagaucagcaagaucgcggccuccgacgagcaggccggcgccgaggacacgcucaagagcaccccgccgcccugggacagcuuccgggacgacaucgccgcgcagcugcagaacaucaccgucucccaccgcgccgaccacgggcggaccgacagccucgccaagggccgcggggaggacacgaccuccggcgcccugcacgaggccaccgcgcuggggaucaucgacgagacccacgugacggugcgcauccccaucgagagccucaaguccggccaccugaucgagggcagccggaacggguacauccgcgaccccuaccugcgggaccagcucacccuggccaccaagaacggcuccgacaaggacuucaccacgguccugcagaaguucuucgaccgcagcaagcgguacgggggcacccgccgggugcgcaucaucaagacccuccaggacaccgcccggaucuccgugccccacaacgcccccaucaaggccuacaagggcggcagcaaccacgcguucgagaucuggcgccugcccaacggcaagaucgagucccaggucaucacgaccugggagcaccacaaccugaccgagcccaagcggccccacccggccgccaagcgcaucauccggcuccacaagaccgacaugguggccaucgagcgcgacgggaagacggugaucugcuucguccagaagaccgaccccagcaacggcgcguuccuggugccccacuucgaggccaacgccgacgggcggaagcgcaagaacgagcccguggagugguaccagauguccgccaacagccugaucaaggccgaccuccggcgcgucggcguggacgagauggggcgggugcgcgacccggggcccccgcccauccgguga

SEQ ID NO: 1585 - RNA, 3285 nt, Artificial Sequence
  Cas9 variant
augaaguaccgcgugggcuucgaccuggggaccaacagccucggcugggccgucgugcggcugaacgccuccggggagcccgaccgcaucgagguggcgggcagccggaucuucuccgacgggcgcgagcccaagagcggcgccucccuggccggcgcccggcgcgacgcccgggcgaugcgccggcgccgggaccgcuucaagcagcggcaggccgcccucaucaaguaccugacccaggccggguucuuccccgcggacgagagcgagcgcaaggcccuguccgcccucgaccccuacgagcugcgggcccgcgcccuggacgaggcgcucccccuggcccaccugggccgggcccucuuccaccugaaccagcgccggggguucaagagcaaccgcaagacggaccggggcaagaacgacgacaccgggaagauccgcaucggcgucgcccgccuguacgagcagaugcgggacgccgacgcgcgcacccucggcgaguuccugcacaagcggcgcgccgccgccuccgacccgaacgccaucccccacgugcggacccgcaucgugacgcuggcggccgaggacgggaaggccagcgacgucuacgacuucuaccccgaccggcagacccucgaggaggaguucgaggccaucugggaggcccagaccucccaccaccccgaggcgcugaccgaggagcgccgggcccaguucuacgagaucaucuuccaccagcgcccgcugaagcagcccaagaucggcuucugcacgcuccugccgcccgagaagcggcugccgaaggcccacccccucuuccagcgccggcgccugcuggaggaggugaacgcccuccggaucgugcugcccgggaaggagacccgcgcgcuggagaaggccgagcgggacgcccuccugagcaagcugaaccagcgcaagaaggccgccuacgagucccuccggaaggcgcugaagcuggaccccgacgcccgcuucaacaaggagagcgacaaccgcgaggacaugaucggcgacgagaucgccgccgagauggcccacaagucccgguucggcaaggucuggcucgggaugagcgcggaggcccaggcccaggugaucgagcgccugcggggccuggaguccgacgccgacgccgacgacuucgaggcguggcuccgcgacgaccacgggcuggcccaggagcaggccaaggccgugaccgcggccaaccugccggagggcuacgggcgguucggcgagaccgccacgcgcaagcucaucgccgcccuggagcaggaggucaucguguacagcgaggcggugcagcgggccggccuggggcaccacuccgaccuccgcgacggccaggucuggaccgacaagaaggggaaccccgcccugcccuacuacggcgccgugcuggagcggcacaucgugcccgggaccgccgacccgaacgagaccgacgacgcgcuccgcaucggccggcugacgaaccccaccguccacaucggccugaaccagcugcgccggguggugaacgcccucaugcgccgguacgggcagccccaggagaucgccaucgagcuggcccgcgagcugaagcucagcgacgaccggaagaaggagaucaacacccgcaaccgggagaaccgcaaggccgcggagaagcggagccagaagcugcgcaacaucggccaggccgacaagggcgggaaccgcgcccugcucaagcugugggaggagcugaaccccgagaacguccucgaccggcgcugcguguacaccgggcgggugaucuccaucgacaugcuguucagcggcgccgcggaggucgaccacauccugccguucuccgugagccucgacgacuccaacggcaaccgcauccugugccugcgggaggucaaccgcaucaagcggcagcgcacgcccugggaggcccgggacgaccuccgcgcccacuucgggcccgacgccggcugggaggccaucgcggcccgggccgcccgccugccccgggagaagcgcuggcgguucgagccggacgccgcgaaccgcuucgacgcccagggcggguuccuggcccggcaccucaccgacacccagcaccugagccgccuggcccgguccuaccucagcgcccuguaccccgagaccggcgagggguccggccacgugugggugagccccgggcgccugacggagaugcuccgccgggcguggucccugaaccaccaccucccggaccacaacaucgccggcgccgccaaccagcccaagaaccgcaaggaccaccggcaccacgccaucgacgcgaucgucguggcccuggccgaccgcgccaugcugaaccggaucgcgcgcgagagcgggaaggagggccacgaggccgccggccggcugguggccuccauccccgagcccugggagggguucagcgacgaggucggccgcgccgugcgggcgaucaccgugucccaccgcccggaccacgggaccgccagcaaggccggccgggccaaggacaaggacgccaccgcggggcgccuccacaacgagacggccuacggccugaccggcgagaaggacgcccgggggcuggacaucgucgugacccgcaagccccucuccgccuucaagaaguccgccgaccuggacgcgauccgggacgacgaccugaagcagaagcucaaggccugggccgccggcaaggagggcggggcguucgagcaggccaugcgcagcuucggggaccccgagcggggcccccgcagccacccgggccugcggcgcauccgggugaccgagccccugagcgucauccccauccgcgaccgcgacgggcggcccuacaaggccuacaagggcgacuccaacuaccgcuucgacaucugggagcucaagacggggaaguggaaggacgagguggugagcauguucgaggcccaccggccgaacuggaccucccccauccgcgccggcaaccccaccgcgcggaagguccugagcgugcgccagaacgacgugaucgccaucgagcgggagaacgggcccgagcugaugcgcgucgugaaguucuccgccggcagccucgcccuggccccgccccaggaggcgggcucccugaaggcccgggacgccgacaagaacgaccccuucaaguacguguacgggagccccuccagccuccagcgcuggaaggcccggcagguccgcaucgacgagcugggccggguguucgacccgggguucgccgugcgcucccggcgcagcuccgaguga

SEQ ID NO: 1586 - RNA, 3291 nt, Artificial Sequence
  Cas9 variant
augaagaacaucuucagcuucgacaucggcaccaacuccaucgggugggccgugcuggcccucgacggcaacggggaccccguccgcaucgcggacgccggcgugcggaucuucagcgacgggcgcgacccgaaguccaaggccagccuggccgaggcccggcgcauggcgcgggccaugucccgccggcgcgaccggacccugcgccggaagcgcgccacgcuccggacccuggccgagaucggccugaugcccgacaccagcuccgcgcgccaggcccagcuccgggagaccagcgaccccaaguccggcagcgggcagcugacgcgcaaccccuacgcccugcgggcccucgcccuggaggagaagcugccccucuuccacaucggccgcgcgcuguaccaccuggggcagcggcgcggcuuccaguccaaccggaagaccgaccgcaaggacaacgacaaggggaagaucgcccucggcaucgaggagcugcacgccgccaugcgccaggacggcgcccagaccuacgggcaguggcuggcgcggcgccacgcccucggccaggccgugcggcugcgcagcggggcccuggaccucgagggcgagggcuacgccuucuaccccgagcggaagcugcuggaggacgaguuccaccgcaucugggaggcgcaggcccggcacuaccccgacauccucacccccgagcgccgggaccaccuguucacggucauguucuuccagcgcccgcugaagaagcccaagguggggaagugcuccuucaacaaccaggaggagcggcucagcaaggcccacccccuguuccaggaguuccgccuguacaaggaggugaacgagcucgagaucgucgagcccgaccugacccacaagaagcugacccucgaccagcggaacgcccuggugaagaagcuccaggugucccgcgaggccagcuucgcggcccuccggaagguccugaagcugcgcccggaccagcggcucaacaaggaguccgagagccgcaccaagcugaagggcaacgagguguacgccgugcuguccgacaagacgcgguucgggccccgcuggggcaccuucagccaggccgagcagugggcgaucaucgagcgccucaaggaggaggaggaccccgggcggcuguucgccuggcugcgcagcgccuucggcaucgagggcgagcaggccgccgacaucgcgaacguccaccuccccgaggggcacggccggcuggggaagaccgcccuggaggccaugcucgaggagcugaaggccgaggugaucaccgaggccgaggcggccaagcgcugcggcuacgaccacgcccggcucgggggcggcuccgacgagggggagccggagcugccgcccuaccaggagauccugcagcaccgcaucccgcccggcacgaacaaccccgacgaccccuacgacaucgagaaggggcgguucaccaaccccaccgugcacaucgcccugaaccagcugcgccacgucaugaacacccucauccggcgcuacggcaagccggcccagaucgcgguggagcuggcccgggaccugaagcucagcgagcgccagaaggaggaggugaaccggacgaucgcccgcaacacccgggacgccgagcgccgggggaagacccuggaggagaaccgcauccccaacaccggcuacaaccggacgcugcuccgccugugggaggagcugaaccccggcaaggucgaggaccggugcugcaucuacaccgggaagcccaucuccaucagcaugcuguucuccggcgagguggacaucgaccacauccugccguggagccgcacccuggacgacucccacgggaacaagcuccugugccugcgcgaggcgaaccgggugaagcgcaaccgggcccccgccgacgucaccgaguggcgcgacaacuacgacgagauccucagccgggccgcccgccugccccagaacaagcgggaccgcuucgcgccggacgccauggagcgguucgagaaggccggcggcuuccuggcccgccagcucacggacacccaguaccugucccggauggcccuggaguaccucgcgugccuguuccccgccgaggagauggacggguucggcgagcugcgccggcaccgcuacaucaacgugugccccgggcggcucaccgagaugcugcgccggaacuggggccugaacagcauccucuccgacagccagcugggggagaccgcccaggagaagaaccgcaaggaccaccggcaccacgccaucgacgccaucgugaucggcgucacgggccgcucccugcucaaccgcaucagcuacgcggccgggcggcuggaggcccagcagcuggagacccucgugaaggaggccgcggccaccaacaagcccugggacggcuuccgcgaggacgucgccaagguggucgggggcaucaucgugucccacaagccggaccacgggaccgccggccggaaggccaaggaccccgcgcgccagcagacggccggccggcugcacaacgacaccgccuacgggcugaccggcgagaccgacgcccgcgggaacaccaucguggugcggcgcaagcccuuccucagccugacguccaaggacauccccagcauccgggacgaggcccugcgcgcgguccucgagcagcaccuccggggcaucccggacgggaaggccuuccaggccgcccuggacgccuuccgcaagcagaagggcuuccaccacuaccacggcauccggcacgugcgccugaccgagccccuguccgugaucgggaucaaggaccgggacggcaaggucuacaagggguacaagggcgacgcgaaccagcgcuacgacgugugggagacccuggacgggaaguggcacgccgagguggucagcauguucgacgcccaccagcccggcuggcagagccgguuccacgccgagaaccccaccgcccgccgggugcuccgccugcagcaggacgacaugguggcgcugaacgccccggacggcgggcggcuccugguccgcguggugaaguuccgccagaacggccagaucacguucgccgggcacaacgaguccggcaaccugaaggcccgggacgcggccagcaacgagcaggaccccuucaaguacaucucccgcauggccagcucccucaaggacugcggcugccggcagguccgcaucgacgccaccggccagguguucgaccccgggccccaggaccgggccagccgccugcagaagcaguccaagcgguga

SEQ ID NO: 1587 - RNA, 3294 nt, Artificial Sequence
  Cas9 variant
augaagaagcagccccagcgcuacauccugggccucgaccuggggaucgccagcgugggcugggcccugauccucgucgacggggcggagaacccggugggccugcuggacugcggggugcggaccuucgagcgcgccgagguccccaagaccggcgacucccucgcccuggcccggcgccaggcccggagcgugcgccggcugauccgccggcgcgcgcaccggcuccugcgccugcggcgccuccugaagcgggagggcauccuguccgccgccgacuucaacagcgacgggcuccccaaccugcccaucgacgccuggcagcugcgcguggcgggccucgagcggaagcugacgaaccaggagugggccgccguccugcuccaccuggugaagcaccgcggguaccugucccagcgcaagagcgagacccagaccgagaacaaggagcucggccggcugcuggccgggguggccgagaacuccaagcuccugagcgaguccagcgagcaguaccggaccccggcggagcuggccgucaagcuguucgccgagcaguccggccaccuccgcaacaagggcggggaguacacgcacaccuucaaccgccuggaccuccagaaggagcugcaccuccucuucgagcggcaguacgcccugggcaaccccuucgccagcgcggagcugcaguccaagguggacgagcuccugaugacccagcgcagcgcccugcagggggaggccgugcucaagaugcugggcaagugcaccuucgagcccuccgaguacaaggccgccaagaacacguacagcgcggagcgguucaucuggcugaccaagcucaacaaccugcgcauccuguacaacggcgaggagcgggcccucgacgagggggaccgcaagaagcugcuggacgagcccuacaagaaggccaagcugaccuacaagcagguccgguccauccucaaccugccggagagcgccguguucaagggccugcgcuacgggaaggacuccgacggccucaaggccgagaacgggacccugauggagaugaaggcguaccacaagauccggacgauccuggacaaggccggccucaagggcgagugggagaaccgcauccggaaccccgagauccuggacaagaucgggaccgccuucagccuguacaagaccgacgaggacauccaggccgcgcucgccgaccugcgccugcccgagaacgugcucgacgcccugcuggccggccucaacuucgacaaguucauccagcugagccugaaggcccuccggaacauccugccccugauggagcgcgggauccgguacgacgaggcgugcaaggaggucuacggcgaccaccgcgcccucgccgaguccaagaaccaggugcugcugccgcccauccccgccgacgagauccggaaccccgugguccuccgcacccugacgcaggcccggaaggugaucaacgcgaucauccgccgcuacgggagcccgcagcgggugcacaucgagaccgcccgcgagcugggcaaguccaagcaggagcgggacaagaucgaccgcaagaacaaggagaaccagaacgaccggaaccgccucgccagcgacauccggaagcacuucaacuucgagcccacccccaaggacauccugaagcugcgccucuacgagcagcagcacggcaagugccuguacuccgaccugcgggaggagaagggggagugccucuacaccggcaacgucaucgagcugcaccgccuguucgaggacggguacguggagaucgaccacgcccucccccugagccggacgugggacaacucccugaacaacaaggugcucguccucaagagcuccaaccagaacaagggcaacaagaccccguacgaguggcuggacggggccaacaacagccgccgguggcgcgaguuccaggcgcgggugcagggcugccacuuccccuacgucaagaagcagcgcauccagaccgccaagcuggacuccaaggccgagcagggcuuccuggagcggaaccugaacgacacccgcuacaucagcaaguucaugugccaguucaucacggccaaccuccggcuggcggagaccuccaacgcccugauggaggagguggccggggagaaccccuacuggaaggagcgcaagcggcagcgcguguucgcccccagcggcuccaucaucgcccuccugcgcgggcuguggggccucaagaagguccgggaggacaacgaccgccaccacgcgcuggacgccaucgugguggccugcagcaccgucuccaugcagcagaagaucaccaaggccaugcagcggcgcgagacgcuggagaccguggacagcgagaccggcgaggugaagacccggaucccgcagcccugggacuucuuccgccaggaggucaugauccggguguucuccgacagcccccgcgaggagcucgccgagaagcugaacagccggcccgaggcgcugcacgacuucguguccccgcuguucgucagccgcgcccccaaccggaagaugacggggcagggccaccuggagaccgugaaguccgccaagcgccugagcgagaacaucuccgugguccggaagccccucaccgcccugaagcugaaggacaucgagaacaucgugggguacccggaccgcgagcccgcccucuaccaggcgcugcgggagcgccugcucgcccacaaggacgaccccgugaaggccuucgccgacaagcccuucuacaagccggcgaaggacggcgggcagggcagccuggucaaggccgugcggaucaucgagaacaccaagcacggccugaagauccgcaacgggaucacggacaccaacggcgacauggugcggaccgacgucuaccagaagaccgacaagaaggggaagcgccaguacuucaucgugcccguguacgccuggcaggucgagaagaacgagcuccccaccguggacugcaagggcuacgagaucgacgacaacuacgaguucugcuucucccuguacaaguacgaccugaucgagauccagaaccccaacgacaucaaccaggagcuccgcgccuacuacaucaacugcgacagcuccgacgggcgguucuggcuggccuaccacgacaagagcgcgaaggagcagcaguuccgcaucuccacgcagaaccagccgaucaucaagaaguaccagguggacacccugggcaaggagauccggcucugcaaggccgagaagcgcaccgcccugaacggcaagaagaagaaguga

SEQ ID NO: 1588 - RNA, 3294 nt, Artificial Sequence
  Cas9 variant
augggcaagggggacauccuguucagcuucgacaucggcaccaacuccaucggguggugcguguucgcccucagcgacaacggcgaccccugccgcauccuggacgccaacgcgcggaucuucgccgacgggcgcgagccgaaguccggcaacagccuggccgagggccggcgcgccgcccgggcgauggcccgccggcgcgaccgguacaagcgccggcgcaaggccguccuccggacccugacggaguacgggcugaugcccgccgaccccaaggcgcgccaggcccucguggccaagaccggcgaccgggggcccaaguccgaggaggcccuggccgacguguacagccugcgcgcgcgggcccucauggagaagcugccgcugcaccacaucggccgcgcccucuuccaccugaaccagcggcgcggguucaaguccaaccggaagaccgaccgcaagagcaacgagaagggcgccaucgagaccggcgucaaccgccugcucgaggagaugcgggacacgggggcccccacccugggcgcguaccuggccaagcgccgguccgacgggcgccccgugcgggugcgcgccggcgccagcgagcaggaggccgaggacggcaagcccgcgaagaccgccuacgacuucuacccgguccggcgccuccuggaggaggaguucgacgccaucugggagaagcaguacuccuaccaccccgaggugcugaccgaggagcggcgcgggcaccucuuccgggugauguuccaccagcgcccccugaagcccgccaucgucggccggugcagcuucaacuccgccgagacgcgccuggcgaaggcccacccccucuuccaggaguuccggcuguacaaggaggugaacgagcuggagguggucaugcccgaccagagccaccgcaagcucacccugcccgagcgggaccgccuggugcucaagcugcgggggcagcgcaaggccaccuacgccgcgcugcgcaaggagcuccggcugcgcgaccugcgguucaacaaggagaccgagaaccgcacggacaugaugggcgacgaggugaccgccgcccucgccgacaaggccgucuucgggaaccggugguccggcuucagcaccgacgagaaguggcgcaucguggagcggcugcgcgaggaggaggaccccuucgcgcugcacgaguggcucguguccgagcacggccugagcgacgccgaggccgagcaggccgccaagguccaccucccggacggguacggccggcucgggcccaccgcgguguccacgaugcuggaggagcugaaggccgacgugaucaccgaggccgacgccgcccgccucgcgggcuacgaccacagccuggcccgggccgacgaggacgggcuggaccgccuccccaaguaccaggagguccuggagcggcgcaucccgccgggcaccaacgaccccgacgaccccuacgacaucgccaagggccggaucaccaaccccacggugcacaucgcgcugaaccaguuccgccacguggucaacgcccuggcccggcgcuucgggaagccggaccagaucgccaucgagcucgcccgggagcugaagcugaacgaccgccagaaggacgaggugaaccgggucaucggccgcaacacccgcgcggccgcccuccggagccagaagcugcgcgacaucgggcagaaggacaacggcuacaaccgggcccugcucaagcugugggaggagcugaaccccgacaagcccgaggaccgcgugugcguguacaccgggcggcccaucugcaucuccaugcuguucagcggcgaggucgacguggaccacauccugccguggucccgcaccauggacgacagccaggccaaccggauccugugcguggucgaggcgaaccgcgugaaggccaaccgggcccccgccgagguggccgaguggggcgggcgcuacgacgagauccucgagcgggcggcccgccugccccggaacaagcgcuggcgguucgcccgcgacgccauggagaaguacaaggagaacgagggcuuccuggcgcggcagcucacggacacccaguaccugucccgccuggcccgggaguacgccgaggcccucuacccgaccgaggagcccgaccgccugggggagcugcgccggcgcaaccacguccgggugauccccggccgccucaccgagaugcugcggcgcggcugggggcugaacgcccuccugcccgaccacaacuucggcgcggggcaggccaagaaccggaaggaccaccgccaccacgccaucgacgccgccguggucggcgugacgacccgggggcugcuccagcgcaucagcaccgaggcgggccugcgggagaagcuggcccucgaggagaccaucgccgacaucccgaugcccuggcccggcuuccgcgaggagcugaaggccgccaucgaccgggcgguggucucccacaagcccgaccacgggacgcugccgaagcccggcgagcacgggcgcaccgccggccagcuccacaacgacaccgccuacgggaucaccggcgagacggacgcccggggcaaccccaucguggugcgccggaagcccuuccugagccugaccgacaaggacaucccguccauccgcgacaccgagcuccgggggcgcgucuacagcgccaccuccggccugagcgggcgggagcuguccgcggcccucgacuacuuccgcaagaccgacaagcaguuccgcggcauccggcacgugcgcgugacggagagccuguccgucauccccauccgggaccgcgacgggaacaucuacaagggcuacaagggcgacgccaacuuccgguacgacgugugggagcugcccgacgggaaguggaaggccgacguggucaccauguucgacgcgcaccgccccgaccgggccgccgaggagcgccggccgcaccccgccgcccgcaaggugcucagccugaagcagaacgacaugguggcgugcgagcaccccaaggacggcuacaccaucgggcgggucgugaaguucaacaccgccggccagaucuacuucgccgcccacaacgagggcgggucccugaaggcccgcgacgcggaccgggccgaccccuucaaguacuucagcaaguccgccagcggccucaaggagaucgccgcccgccaggugcggaucgacgcgacggggcagguccuggacccgggcccccaggaccgcgagagccggcuggcccgcaacaagcggcucgagcgcgagcgcgccuga

SEQ ID NO: 1589 - RNA, 3303 nt, Artificial Sequence
  Cas9 variant
augaaguacaccaucggccuggacaucgggaccagcuccgugggcuggggcgucaucgacacggagcgcaaccggauccaggaccucggggugcgccuguucgagagcgccgagaaccagaaggacggggagucccuggccaagccccggcgcgacgcgcggagcaugcgccggcgccucgcccggcgcggcucccggcuggagcgcgucaagagcaucuucgagaaggccaaguuccugacccggggccagauggggaucacccacgcccgcccgaacgaccccuaccggcuccgcgccgagggccuggaccggcugcucuccaacgaggaccuguucaucgcgguguaccaccuggccaagcgccggggguacaagagcaaccgcaagaacgugcucgagggcgacggggaggacgugcgggagggcaaggccguccuggacggcguggcccagaacaagaagcugauggcguuccgcggguaccgcaccgugggcgagauguucuucaaggacuccgucuucacggaggccaagcggaacaaggccgggagcuacaagcacugcgugcuccgcgagaugcuggaggacgagcugggcaagauccuccacgcccagcggucccugggcaacacccuggugaccgacagcuucaucuccaagcuccuggagaagaagaccggggucuucguguaccagcgccccuucgccagcggcaaccagauccugaagcucguggggcccugcacguucgagccggaggagauccgggcggccaaggccaccuacuccuuccaguacuucaacguccugcagcgccugaacaaccucaccaucaagaacaccgacacgggcaccgagcggaagcugaccagcgaggagcgcgccaagaugaucgccuucaucuucucccacaaggacgugcaguacgcgcagauccggcuggagcucaagcugagcgacguggaccgcuucaacauggucaacuacuucgugcagcggaaggagcuggagaccaagacggccgaggagcuccgccgggagaucgagaagaagaccaaguuccccucccugagcgacuacuacaccauccgcaagaccgugagcgagaucgacuccgccuucuggauccagaucgagaagcagcacgacgucaucgacgccaucggggagaucuucacgcuguacaagaccgacgaggacaucaucgcccagcucaacacccggauccccagcaucccccgcccggugguguccgcgcugcugggccucagcuucaccaaguucggccaccugucccugaaggcccuccggaagaucaucccccaccuggagaacggggacacguacgacgucgccugcgccaaggccgaccccaaguacaccgaccgcgcgaagacccgggcccgcaagcugcgcccccucgacaaggaggaccacagcaucaccaacccgguggcccggcgcgccaucgcgcagacgaucaaggucgugaacgccaucaucgacaaguacgacucccccagcgaggugcacaucgagcugggccgggaccuggccaagaacuucaaggagcgcaugaagauccagaaggagcagaagcagaaccaggaggggaacgagcgggccaucgccaagauccacgagcucuacaagcuggagaacccccgcggccaggacaucaucaaguuccggcuguggaacgagcagaacgggcagugcauguacuccggcgagcgcaucgacgagauccggcuguucgacaacggcuacaccgagaucgaccacaucauccccuucagccgcuccuucaacgacagcuacuccaacaagguccucgugcugaagaugcggaaccaggagaagaugaacaagaccccguacgaguacaugggcggggacgcggacaccuggcagcgcuucgagaaccuggugaacagcaugcacaacaucgggccccggaagaagcagaaccuccugcugaagaaguacgucgccgacgaccucacgcugcgcacccugaacgacacccgguucaucgcccgcuacaugaagaacuacaucgagaacacccuccuguucacggagggcccccagaagcagcggguguacaccgugaacgggcaggccaccgccuaccugcgcaagcgguggguccuccacaaggaccgcaccgagaacaaccggcaccacgcgcaggacgccgugguggucgccguggccacccccucccuggugcagggcaucaugcgccacgccaagaugggcgagaucgucgacuaccugcacagccagaaguucgcgccgaacgugacggacaucgagaccgggaagcccuucgaguccgccgacauccagagcgccaaggagcgcaucaucgccaagcacgagcaccggcuccgcauccccgagcccugggagggcuucuccgacgagcuggacgcgcggaugggggacgacguggucgagaagcugagccuccgcaagagcaacauccacggcuacaagaccaccuccgacuucagccagauccacccgaucuucgugucccggaugcccaagcgcaagacgaccggccgggcccaccaggagacccugcgcagcccccggcgcuucaaggaguuccaggaguccgugguccggacgccccugagcuccaucaaccucaagaagcuggaggagaugagcgggaagaacuccgacaagcugcucuacgacauccugcgcaagcggcugcucgcccacggcgacgacccgaagaaggccuucaccgagcccgugcacaagccccgcaaggacgggacccagggcccgcuggugcggagcaucaagauggucuccgaggggcagcgcagcggcauccuggugaacaacgagcaggcccucguggaccaggacuccaugauccggaucgacaucuucagcaagcccaacaagaagggcaaggacgaguacuacaucauccccgucuacgcguaccacuucgcccagaaggagcugcccaacaaggugaucaccgccaaggccgaggccgacuggcgcaccaucgacgacacguucgcguucgaguucucccuguacccgaacgaccucgugaagcugaccaagggggacgacauccgguucggcuacuacagcgggugcaaccgcgcccuggccgccauccacauccucccccacgaccagaacaugccccuggucaacaacggcaucaagacccuggacaagaucgacaaguacgugguggacauccucggggaguaccacaaggucggcaaggagacccgccagcagauccaguga

SEQ ID NO: 1590 - RNA, 3303 nt, Artificial Sequence
  Cas9 variant
augggcgccaccaucgugaccgacaucagccgcuccgccuucgcguucgacaucgggaccaagagcaucggcuccgccguccugcggcucgacgaccgcggggagcccaucggcaucaucaacgccgccgugcggaucuacgccgacgggcgcgagcccaagagcggcacgucccuggcggagggccggcgccuggcccgggggaugagccgccggcgcgaccgguacaagcgccggcgccggacccuccugaacacccugacggaguucggccucaugccgcccaccgacgaggcccgcaaggcccugcuggcggagaccaacgaccggcgcuucggggccguggccggcaacgucuacgcccuccgggcccgcgcgcuggacgagaagcugccccuccaccaccuggggcgggcccuguuccaccucaaccagcgccgcggcuucaaguccaaccggaagaccgacaagcgcgacaacgaccagggcaagaucgccagcgggaucucccggcugggccagaagcuggacgaggccggggcccgcacgcucggcgaguuccugcaccggcagcacagcgcgggcaagugggugcgcgugcggccgucccgcguccccagcaaggacgacaaggaggaggacggguacggcuucuaccccgagcgguccuuccuggagcgcgaguucgccgccaucuggaaggcccaggccgcguucuaccccgagcuccugaccgaggagcgcggggaccaccuccaccgggugauguucuuccagcggccgcugaagcgccccaaggugggcaagugcagcuucuaccccgacgaggaccggcugcccaaggcccacccgcuguuccaggaguuccgccucgucaaggagcugaacgagcuggagguggugcaccgcggggaccggcgggagaagcucacccuggagcagcgcgacacccuguucaaccagcuccgcacgcagcgguccagcgccuucaccgcccugcgcaagacccugaaggcccccaccggcacgcgguucaacaaggaguccgacgcgcgcgacaagcucaagggcgacgaggucgccgccgagaugagccacaaggaccgguucgggcaggccuggaucggcaugccccuggcggagcgcugggccgugaucgagaugcugcucgacaccgaggacccccuggaggugaaggccuggcuggaggagcacuacggguucgccgccgaccggaucgacgcgaucgccgccgccaagcucccgcccggcuacgggcgccugggcgagaccgcccugcgggacaugcucgacgagcugaagaacggcaccgucaaggacgacuccgggcgcgacguggugcugacggagcggcaggcgauggacaacaucuggaaggacaaccccgcccuccagcgcgucguggccgacgcccgggagcugcccccguaccaggaggugcugggccgccggaucccgcccgggaccggcaagcccgaggaccccuacgacguccagaaggggcgccugaccaaccccaccgugcacaucggccucaaccagcugaagcggguggucaacgcccuggugcgccggcacggccgccccgaccagaucgcgcucgagcuggcccgggagcugaagcucaacgaggagcagaaggccgagaaggaccgcgagaucgcccgcaacacgaaggcggcccaggcccggagcgagaagcugcgccagcuggacaucgacgacaacggguacaaccggguccuccugaagcugugggaggaccucaaccugcgccagcccgagaaccgggagugcaucuacugcggcaaggccaucgggaucggcacccuguucagcaaccagguggacaucgaccacauccucccgugguccaagacccuggacgacagccaggccaaccgcaucgugugccacgucgagugcaaccggcagaagggcaaccacgcgcccgccgaggugccccaguggcacgaccgcuacgacgacauccuggcccgggccgagcgccucccgcggaacaaggccuggcgcuucgggcgggaggcgaugaagaaguucaaggacgacgaguccuuccuggcccgccagcugaccgacacgcaguaccucagccggauggcccacgaguacguggccgcccuguaccccgacgaggagcccgacgaguggggcgucuucacccgccggaaccacgugcgcgugauccccgggcggaugaccgagaugcugcgccgccaguggggccucaacgcgaucaucuccgaccacgaccagaagaaccggaacgaccaccgccaccacgccaucgacgccaucgucgugggggugaccacgcggcgccugcugcagcggaucgccaccgcggccggcggccgcgaggcccucgcccuggaggagaccaucgggaagaucgagccgcccuggcccggcuucuacgacgacgucaaggaggccaucgaccggaucguggugagccacaagcccgaccacgggucccugccgaagcccggcgagcccgcgcgcaccgccgggcagcuccacaacgacacggccuacggcuucaccggcgaggagcggaaggggguccccaucauggugcaccgcgugccguucgccacccugaccgagaaggacauccccagcauccgggaccgccagcuggccgaggcgcucuacggcgccaucgccgggaucuccggcaaggccgagcuggccgcggcccuggcccgguucagcgccuccgggcccuacaagggcauccgccacguccgggugguggagcccgucagcgugaucgccaucaaggaccgcgacggcaccccguacaagggguacaagggcgacgcgaacuaccgguacgacgugugggagcuccccaacgggaaguggacgcacgaggucguguccauguucgacgcccaccgccccgacuggcagagcgagauccggaacaagaaccccgccgcccgcaaggugcugucccugcaccagaacgacauggucgcguacgagcacccgcaggacggcuacaccaucgggcggguggugaaguucggcagcggcgggcagauggcccucgccggcaaccgcgagggcggggcccugaagucccgcgacgccgaccccgaggaccgguuccgcuacuucuacaagagcggcggggcgaugcgggacgcccgccugcggcagguccgcguggacgagaccggccggguguucgaccccgggccccaggaccgcgagucccggaacgcccgcaagcagagcgccgccggcuga

SEQ ID NO: 1591 - RNA, 3306 nt, Artificial Sequence
  Cas9 variant
augaagacccugggccucgaccuggggaccaacagccugggcugggccaucguggagacgcgcgacgagcccaccaaguacuccgaggggagcaucgucgccuccggcgugcggaucuucagccaguccgagauggcggggcgcgacccgcagagcaaggccucccucgccguggcccggcgccaggcccggggcagccgccggcgccgggaccgcuaccugaagcggcgccagcggcuggucgaccuccugguggaccugggccucaugcccgcggacaaggccgcccgcgccgagcuggugaagaaccacggggacggcaagaccggggaccuguccagcuccgucuacgcgcuccgggcccgcgcccuggacgaggcccugagccccuacgagaucggccgggccaucuuccaccucaaccagcgccggggguucaaguccaaccgcaaggcggacagcaacgaccccgagcagggcgugaucuccgagggcaugcgggcccuggacgagaagauggccgaggccggggcccgcaccaucggcgaguggcugcacaugcgccggcuccaggggcugccggugcgcgcgcggaucgcccccgacggcgagggcuacgccuucuaccccagccgcggggcccuggagcgggaguucgaccgcaucauggcccggcagacccucuuccacacggaccugcugaccgacaccgcgauccgcgagcuccgggaggucguguuccaccagcgcccccugcggccggugaagcccggcaagugcuccuacaacccccuggaggagcgccucgccaaggcccacccccuguuccagaaguuccggcugcucaaggagcugaacgagcuggagaucgucggggaggaccagaagcacaucaagcucacgccggagcagcgcaacgcccuggcccugcagcuccggaccagccugaccaagcagggcaaggugcccuucuccaagcugcgcagcacccucaagcuggggcgggaggugcgcuucaacaaggagacggacaaccggagcgaccuggagggcgacgucaucuacuuccgcaugucccgccccgagugcuucggcaaccggugggcggaccuccccguggagaugcaggccgccaucaccgagcgccugcggaccgagccggacuacaagacccugaugaacuggcucaaggccgagacggggcuggacgaggugcacgcgcgcgccgucgccgacacccccgugcccgacggcuucgggcggcugggccagagcgcccucaccgcccugaucgacgcgcuggagaacgaggugggggagggcggcuucgucaucaccgaggccgaggccgccaagcgcguguacgggcggacgaacuccgaggccgaccccgaccgcaagggcguggacgagcugccgaaguaccaggagguccucgcgcggcacaucccgcccgggaccggcgagcccgacgaccccuacgacgacuucauggggcgcaucaccaaccccaccgugcacaucgcccugaaccagcugcggcgcgucgugaacgcccucauccggacguacggcaagcccgaccgcaucgccaucgaggugggccgggaccugaagaugaacgaccgcgagcgggacgaggucaaccgccggaucgggcgcaacaccaaggccgcgaucgagcggggcgugaagcugaccgagaccuuccgccagcucgacacgggguacaaccgccugcggcuggagcucugggaggaccugaaccagaagcccgagaaccgcgugugcaucuacugcggcaaggccaucgccggccacaugcuguucaacggggagaccgacaucgaccacauccucccguacagcaagacccuggacgacuccaaggccaaccggauccugugcugcaccagcugcaaccgcgagaagaagaaccggccgcccucccgcgucccccaguggcggagccgcuacggcgagauccucgcgcgggccacgacccugcccaagaacaagcaguggcgcuucgccgaggacgccaugacccgguucggggaggaggagggcuuccuggcccgccagcucaccgacaugcaguacaucucccggcuggcgcugacguaccucgcccaccuguacgacuacgaggagguggaccuggacgggaucuacaagcgccacgcccgggugcgcgcccuccccggccggaugaccgagaugcugcgccggcaguggggccugaacgagcuccugcacgaccacaaccugaucgggggcgacgucgccaagcccaagaaccgccucgaccaccgccaccacgcgaucgacgccaucgugaucgccugcaccagccgggcccugauccagcgccuggccaccgcguccgccgccgccgaggagcgcggggcggagcggguggucgagcggaucgacccgcccuggagcggcuuccgcgaggacgugcgggccgccgugggggccaucgucgugucccacaagcccgaccacggcaccgugggccgcgagggguacgccaagggccgggggcagacggcgggcaagcuccacaacgacaccgccuacgggcacaccggcgagaaggacgccagcggcaacgacaucgucgugcgccggaucgccgugaccgacauccgcucccccgccgacauccggaagauccgcacgaacgcgcacgggcacagcgagcugcgggaccgccuguacgaggccacccggggccucgaggggaaggccuucgagcaggccguccuggacuucgugaagggcgacgccaaguuccgcgggauccggcacgugcgcaucaccgaggucgcgaacccgguguggaucacccacggcgacggccggcacaagaagggguaccugcccggcgggaacgaccgcuucgacgugugggagcucgccgacggccgcugggacgccgaggucgugacgaccuucgacgcccaccggcccggcuucgugccccgcaugcggcuggagaaccacaacgcccgcaagaucaugucccugaagaagggggacaugaucgcguacaacgacccggucagcggccagcggaucaucgccaucgugcgcaaguucgaccagcggaacaagcagcucuaccuggacccccacaacgaggccgggaaccuggaccgccgggagaaggagaagaccuacaagccccuccgccccaugccgaacccccugaagaaguaccggccccgccaggugcggaucgacgagaucggccaggucuucgaccccgggccguggugggagcgccaggacggcuga

SEQ ID NO: 1592 - RNA, 3306 nt, Artificial Sequence
  Cas9 variant
auggagcagaccagccuggaccucucccaggccaugaagaagguggcccagccccagaagccguaccgccugggcgucgacguggggguggcgagcaucggcgccgccgccgucaccgacacggagauccuggggauccacgugcggaccuucgagaagggcgagaucaacgggaaguccggccgcaagccccucaacgccgacuaccggcgccagaagggccagcggaagcgccugcggcgcaagaagaaccggcugcucagccugcgccggcuguuccgccggguggggaugaucgaguccgcggccaucgaggccuuccccaucagcuccaccagccccuggcagcuccgcaccgagggccuggaccggcgccugacgaacgaggagugggcccagguccucuaccacaucgcgaagcaccggggguuccaguccaaccgccggguggacauggacgaggccaccaagcugagcgacgccgccggcgacuccccggagaccaccacgaacaccgagagcgacuccgacaccaagaagaugcuggccgggguggcggacaacaagcgccuccuggccgagaagggcuaccggaccaucggcgaggccgucgcccgcgaccccaaguucagccaccgcauccggaacaaggaggaguccuacagccacacgaucgggcgcgacgagaucaacgccgagcugaacugccucuuccaggcgcagaaccacuacggcaacccccacgccaccgaggagcuguccgagcagaucaucgaccugaucaacuggcggcgcaagaccgugaccggggacgacaucaagcggauggugggccgcugcacgcucgagcccaaggaguaccgggccgccauccacagcgucuccgccgaggaguuccgcuggcugagcacccugagccggcuccgcaucgugacccagggcgagucccggccgcugaccaagugcgagugggacaagguggucgaccugcccuggcgccaggaggcgaucacguacaccagcauccggaacgccaucgggcuccgccacgacauccggucccgcuucaacauccgguacgagaccggcgggaagaagaccaagacggacaccaagaacgagaccaccaagggccagagcgccgacgccgugacguccgaggugaagaccgccgagaaggagaccgcguucaaggccaagggguaccacauccugcgcaaggccuacaaggccuucggcuacgacgagcagugggaccgggaccgcuucaacaccgagcugcucgacacgcuggcgaccgccgucaccuucuacaaggacgacagcgagauccaggcccaccuggagaccaacgacacgcccgaguacgccauccagaucgcccuccgccugcccacccugaccaaguucuccaagcucagcaacaaggcgauccugaagauccugccgcacaugcgggagcgccaguccuacagcaacgccugccuccuggccggcuacaagaaccaccacaagcaguacgacgacacgccccagaacgggaagaucccccgguccgccaucgagcacaucaagaacaccgugguguaccgcagccugaaccaggcccggcgcgucaucaacgcgauggugaaggaguacggcgcgccccaggaggugcacaucgagcucgcccgggacauggagaaguccgccaagaagaaggacgagaucgaccuguggaugaagaagcgcaagaagaagaacgacgagcugcgggagcgcuucgggaagaaccucagccgggacgagcugcugaaguacaagcucuacgaggagcagaacggccagugcgccuacucccugcagccgauccagcuggggcgccugcucgagcccaacuacgucgagguggaccacgcccugccccggagccgcuccauggacaacagcuacaacaacaagguccuggugcucaccaagcagaaccgggacaagggcgaccgcacccccuucgaguacuucggcgaggaccaggaguccguggacuggaagcgguucaccaacugggucgagagcaacccgcagaugccccaggccaagcgccggaagcugcugaccaagagccuccagaaggggauccuggacaacuucuccgcccgcaaccugagcgacacgcgguacaucgcccgcgagcucaagacccugaucgagcacuacauccugaacacccccgagcgcgagaagaccaaguacgagcggugcguggugaucuccggcaagcucacggcgcagaugcgccagcugugggggaucagcaaggcccgggacgucuccgaccgccaccacggcagcgacgccgccgugaucgccugcaucacccccuccauggugcggcgcaucacccgguaccugcagcuccaggagcgccgggcgaugccgagcgcccccgggaagggcgacgagcaccccgccgucguggcccgcgccaucccccacgcgccggugcccuggcccaccuucgagcacgaccuggaggccgcccuggagaagguccucgugucccggccgcagagccgcaagugguccggccccauccacgccgacacgaucuacggggagcacaaggaccaggagaccaacaccguggcccccacccagcggaucaagcugacgcagcugaccaagagcaacuacaagaacaucgucggcuacgacgaggagcgcaacaaggacuucaucgaccagaucgaggagcggcucgagugccacaacuucaacgggaagcaggcguucggcaccucccagagccccaucuaccgcaucaagaagaacggcgagcuggggccggaggugaagaaggugaccaucaagcugcccaucaagaacuccgucuuccggauccgccggggcuacgugaagaacgccaagaacagcacgaucuacaucaacaucuaccagaacaccaagaccgggaaguucgagaugcaccccguguacgccaaggaccucaccuccagcgccaacgcgagcaaguccuucgaguacagccccgaccugcagcuggucgacacgauccgccgcggcgacuacaucgagaucacccggcgcaacggggaggugaucuccggcuacuacgccacccacaacaucagcaccuccgugcucgagcugcagccgcacgacacgaccgacagccggaacaaccgcacccccgccaucaagaccucccugaacaucgagcgguuccacaucgacauccucggccgcaagcggcgcgucgugcggcgcgccaagaacgggcuggccgacgaccgggacaaguga

SEQ ID NO: 1593 - RNA, 3309 nt, Artificial Sequence
  Cas9 variant
augggcuaccgcaucgggcuggacaucggcaucaccagcgugggguacgccauccucaagaccgacgagaagggcucccccuacaagaucgagcaccugacgagcgucaucuucccgaucgccgagaaccccaaggacgggaagucccuggcgaugccccggcgcgagcagcggggcgcccgccggcgcaaccggcgcaccaaguuccggaagcaccgcaccaagaugcuguucgugcggagcgagcuccugaccaucaagcagaucgaggccaucuacuccgagaagcagaagcucagcuccaucuacgagcugcgcacgaaggcccugaacgagcggcucaccaacgaggagcuguuccgcauccuguacuucuucagcggccaccggggguucaaguccaaccgcaagagcgagcucaccgagaaggacaugggccccgugcugaccgccaucaaggacaucgaggagaagcuggcggacgggacguaccggacccucggcgaguacauggagcuggacgagaaguaccaggagcacaagcgcaacaaggacgggaucgaccgguaccugggcaccgccaagcgcucccucaucgaggacgagaucaagcagaucaucaucgcccagcagcaguucggcaacaccaagcugacgagcggguuccaggucgccuucaucggcgacgaggagcagaccgggaucuucaacgaccagcgggaguucgaggacggcccgggcaagcagucccccuacgcggggaaccagaucgagaagaugaucggcgccugcaccuucgaggagaacgagaagcgcgcccccaaggccagcuacaccuuccaguacuucgacuuccugugcaagcucaacaaccugaaguaccgcgagacgaucgggggcgaguaccgguuccugucccucgagcagaagaacgugcugaaggagaaggugcugaccacccagaagaucaccuucagcggggucaagaagcuccuggaccugcccgagcacgcccaguucaaccucgugaacuacggcacgaaguccaccgugaaggagaccgagaccaagagcgucuucuacgcgaugaucuccuaccacaagcugaagaaggccaucccggcccccaucuucagcaaccugagcacggccgagcucgacgagaucggccgcauccugacccuguacuccagcgacaaggggcggaagaacgaguucuacucccgccucgccauccccgaggaggugguggaggcgcugcugcccaucaacuucagcaaguucggcaaccucucccugaaggccaugcggaagaucaucccguaccuggagauggggcucgucuacagcgaggccgccacccaggccggcuacgacuuccgccacaagaagaucgaccaggcguacauccacgagaacgugaccaaccccguggucaagcgggccgccucccagacgaucaagaucgugaacaacaucauccgcaaguacggggagcccgacggcaucaacaucgagcuggcccgggagcugagcaagaacuucuccgagcgcaagaagaccgugaaguaccaggaggagaaccgggcccgcaacgagcggaucgcggacaagcuccgcgagugcgagcugcccgucaacggcgccaacaucacccggcugaagcuguucgaggagcagggggaguucgacccguacaccggccucaagauccccuucgaccgcgccuucagcgaggaguacgagguggaccacaucauccccuacuccaagacgcuggacgacagcuacgggaacaagauccugguguccgccaaggcgaaccaggagaagggcaaccggauccccauggaguaccuccaggggaagccggagcgcaucaagaagcuggagagcaucaccgccaccaucaagaaccccaagaagcgggagaagcugcucaagcagcagcugaccaaggaggacgucgacggcuggaagacgcgcaaccugaacgacacccgcuacaucuccagccuccugcacgacuacuucaaccagaacaucuccuucgccaagcuggagagcgagaagaagaagcgggugaucgccgugaacggcgccaucaccuccaagcuccgcgcgcgguggggguucaacaagauccgcgagaacggcgacgagcaccacgcccuggacgcccugaucgucgccugcgugaccgacaaguacaucaaggagaucaccagcuucagcaagcggaaggagguccgcuucaacgagaaccucuggaagcgggagaagacgccccaggagaucgagcaggagguggugcacuucaagaaggacuacgaccgcaucuucaaccaggccuucccccugccguggaccaacuuccgggaggaggucuccugccgcaugagcgagaaccccgcggagcugaugaagaaccacaccugggagaccuacacggacgacgagaucgccgcccuccggcccaucuucaucgugcgcaugcccaacaugaagaccuccgggccggcccaccaggagaccauccggagcggcaagcuggaggagaagggccugaacaucucccgcgugagcaucgagaagcucaagcuggacaaggaggggaccaucaaguccggcaacgcccaguucuacaaggacagcgggaacggcuggcagcugcuccacgacaagcugaaggucgcgcuggagaagcacgacggggacggcuccaaggccuuccccgacggcguguucaaguaccaguaccucgacaaggagcacacggugcggaagguccgccugguggccaagagcacccugcagaccucccucaacgagaagaaguccguggccgacaacgggagcaugauccggaucgacgucuuccgcaacgagcagggcaaguaccaguucgugcccaucuacgcgaaggaccggguggccaagaagcugccgaaccaggccgucgccguggggaagaucgccaaggaguggccccugaucgaggagagcgacuucaaguucucccucuacagcaacgaccugauccgcgugaagcacaagaagggcgucaagcacguguccaaggacgggaacaaggaggagaaguccaagaccgacuucuucggcuacuacacgggcgcggacaucgccaccgccagcaucagcgggaucagccccaacaacuucuucgaguuccgguccaugggccuggccacccucaucagcaucgagaaguacaagguggacuacuucgggaacuaccaccaggucaacgagaaggugcgccagaaguuccccaagaaccgcauguga

SEQ ID NO: 1594 - RNA, 3312 nt, Artificial Sequence
  Cas9 variant
augaaguacgacaucggcaucgacaucgggguggccagcgucggcgaggccgugaucgaccaggaggggaacauccuggaggcgugcuccaaccucuucgacgaggccgacgccgccagcaacguggaccgccggaacuuccgcgagggccggcgcaacaagcggcgcgagcggacccgcgucaacgacuucaagaagcuguggaccaaguucggguucgagauccccaagaacgugaugaacgacacgauccugcuccggaacaagggcaucaagugcgagcuggaccugaccgagcucuacuccgugcugcuguacaugcucaagcaccgcggcaucagcuaccuggaggacgccaucgacgaggcgaagggguccaacuacgccaagggcaucgcccugaaccagaaggagcucaaggagaagcugccgugcgagauccagcuggagcggcucaagaucuacgggagcuaccgcggcgacugcaucgucaagaaggaggacgaggacgaguaccacuccaacguguucaccaucagcgccuacaagaaggagcuggagauccuguuccggaaccagaagcuccccgaggaguucauccagggguacaugaagaucuucgagcgcaagcgggaguacuacaucggccccggcaacgagaagucccgcaccgacuacgggguguacacgaccaacaaggacgaggagggccacuacaucaccgacaagaacaucuucgagaagcugaucgggaagugcagcgucuacaaggacgaguuccgggcggccggcgccuccuacaccgcccaggaguucaacgugcugaacgaccucaacaaccugacggugaacaaccgcaagcugaccgagaacgagaagaagaagaucgucgagaagaucaagagcuccaacgccgugaacaugcggagcaucaucaagaaggugcucggcgaggacaucgagcaguucgggggcgcgcgcaaggacaaggccgacaaggagaucuaccacaccuucgaggucuaccggaagaugaagaaggaguucgagaagaacgggaucgacaucgccgacuucucccgcgagaagcuggacgagaucggcaacauccugacccucaacacggagaccgaggggaucaagggcgcccugcacgaggccaagaacagcuucaccuacuccgagaucgagacccugaucgacauccgcaagaagaacagcucccucuucagcaaguggcagagccugucccugaagaucaugaacgagcucaucccccagauguacgcgcagccgaaggagcagaugcagcugcugacggagaugggcguguucaaguucaagagcgugaaguucaagaacuccaaguacauccccgucgaggagaucaucaaggacaucuacaaccccguggugguccggagcgugcgcaccaccaucaagaugaucaacgagaccauccggaaguacggguaccccgacaacaucaucaucgagaugccgcgcgacaagaacuccacggaggagaaggagcggaucaagaaggagcagagcaagaacgagaaggaguacgagggcauccucaagcgcaucaaggacgaguacgacaucgagaucaaccgggacgacuaccgcaagcaggagaagcuggcccugaagcucaagcuguggaacgagcaggaggggcggugccccuacuccggcaagaugaucagcaucuacgggcugcucgaggacccccagcuguucgagaucgaccacaucauccccaaguccaucagcuucgacgacucccgcaacaacaaggugcuggucuaccggagcgagaaccagaagaagggcaacaacaccccguacauguaccucuccaagggcgacaagaacuggaacuacgaccaguacaagagcuacgugcuggggcugaagaacaagggcaacaucuccgacaagaaggucaacaacaugcuguucauggaggacaucaacaagaucgacgugcucaagggguucaucacccgcaaccugaacgacacccgguacgccagccgcgugguccugaacaugcuccaguccuucuucaacgagaaggacggcugccccacgaaggugaaggugauccgggggagcuucacccaccagaugcgcgucaaccugcggaucaacaaggaccgcgacgaguccuacagccaccacgccguggacgccaugcugaucguguacagccagcggggcuacgaggcguaccgcaagauccaggaggccugcgucgacuucgagaccggcgagaucaucgacgaggagcgcuggcagcagugcaucugggggaaggacuacgaccaggugauguacgaggccaagugguccaagauccgggagaagaucaucgaggccgagaagaacgugaaguaccaccaccgcgucgacaagaaggugaaccggggccucugcaaccagaccaucuacgggacgcgcaucaaggacggcaagaucuacaagaucagcuccuacaacaucuacgacaacaaggagugcgccagccugcugaagaugaucaagggcgggaaggaguccaagauccucauguacaacuacgacagcaagaccuaccgggacaugaucaagaucaucgacgaguacuccgacgagaagaaccccuucguggcguacaugaaggagaccggcgacuacuuccgcaaguacgccaagaagcacaacgggcccaagaucgagaaggucaaguacuacaaggaggaggccggcagcugcaucgacaucucccacaaguacggguacgagaagggcagcaagaaggugauccugggcucccugaacccguaccggaccgacguguucuucaacgagcgccucaagaaguacuaccugaucgggaucaaguacaaccacaucaagugcgagggcaacaacuacgucaucgacgaggacgccuacaacgggcugcuccgggacgcgggcgugaucagccacgagaacacgaucaacgaccuggagaaggugggggucaaguaccuguucucccucuacaagaacgacaucaucaaguacgagaagaacggcgagauguucguggagcgcuuccugagccggaccauggaguacgccaacaacuacaucgagaccaagcccauccacaagcccuucuuccagaagaaggacaagaagggcaacaucaagaacucccagaaccugguggggcucagcaagaccaaguacaucggcaagcuggucacggacgcccuggggaacaccuacaugguggagaaggagaaguucucccucaucguggacaucuga

SEQ ID NO: 1595 - RNA, 3315 nt, Artificial Sequence
  Cas9 variant
augaagcugauccucgcccuggacaucggcaucgccagcguggggugggcgguccuggacaagaaguccgagaccgugcucgaggccggcagcaacaucuuccccgaggccuccgccgccgggaaccaggugcgccgggagaugcgccaggcgcggcgcaucaagcggcgccagcggacccgccuggacgacuucaacaagcuguggcggaagaacaaccucagcaucccgcaguacaaguccacggagaucgucaaccugaaggugaaggcccugcgcgaggagaucagccucgacgagcuguaccugauccucuacuccuaccugaagcaccggggcaucagcuaccuggaggacgcccaggacgacucccucagcuccagcaacgccuacaccaacgggcugcgcgagaacgcgaaggcccuggagaagcacuaccccugcgagauccagcgggaccgccuccagaccaucggcaaguaccggggccagacccagaucacggacgacaacaacgagaagaucgaccuguccaacguguucaccaucggggccuaccgcaaggagaucaagaagguccuggagacccagaagcucuaccacaacgagcugaccgacgagcugugcgacgacuacauccucaucuucaaccggaagcgcaaguacuacgagggccccgggaacgagaagucccggacggacuacggccgcuucaccacccggcuggaccagaacgggaacuacaucgacgaggagaacaucuucgagaagcugaucggcaagugcagcguguaccccgacgagcuccgcggcgccgccgcgagcuacaccgcccaggaguucaaccugcugaacgaccucaacaaccugacgaucaacgggcgcaagcuggaggaguccgagaagcacgccaucgugcagcggaucaagaccagcaacaccgucaacaugcgcaagaucaucgccgacugcaugggcgagaccaucgagaacuucuccggggcccggaucgacaagagcggcaaggagcaguuccacaaguucgagacguacaacaagaugcgcaagagccucuccgagaucggcaccgacaucgacgaguucagccgggacgagcuggacaagaucggguacaucaugaccaucaacaccgacaaggaggcgcugauggaggccuucaacgaguccggccucaaccuggacgacagcgugaaggagugccugaucuccuuccgcaaggccaacagcuccagcuucuccaaguggcagagcuucucccucaagaucaugaacgagcugaucccggagauguacauccagcccaaggagcagaugacgcugcucaccgagauggggguggccaagggcagcuccggggacuucgccggccugaacuacauccccgucgacgugaucagcgacgagaucuacaaccccgugguccggcgcuccgugcggaucagcuucaagauccugaacgcggugcucaagaaguacaagguccuggacaccaucgugaucgagaugccgcgcgaccggaacuccgacgaggagcgcaagcggaucaccgacagccagaagcugaacgagaaggagauggaguucaucgagggcaagcucgcccagaucuacaacaucaagcuguccagcagcgacuucuccagccagaagcagcugucccugaagcucaagcuguggaacgagcaggacgggaucugccuguacagcggccgcacgaucgaccccgaggacaucaucaagaaccccgaccucuucgagaucgaccacaucaucccccgguccaucagcuucgacgacucccgcagcaacaaggugcuggucuaccgguccgagaaccagaagaaggggaaccagaccccguacuucuacaucacccacagcgacggcgccuggaccuacgagcaguucaaggccaacgugaugaaccuguccaagaagaaggaguacgccaucagccgcaagaaggugcagaaccuccuguacuccgaggacaucacgaagcgggacguccugaagggguucaucaaccgcaacaucaacgacaccggcuacgcgagccgcgugguccucaacaccgugcagaacuucuucaaggccaaggaggccgacaccaaggugaaggucaucaagggcuccuacacgcaccagaugcggagcaacaugaagcuggacaagaaccgcgacgaguccuacagccaccacgccguggacgcgaugcugaugggguucagcgagaugggcuacgaggccuaccggcgccuccagggggaguucaucgacuucgagaccggcgagauccugaagaacgacauguggaacgagaagauguccgacgacguguacgucgacuaccuguacgggcggaaguggagcgccauccgcaacgagaucgugaaggccgagaaggacgugaaguucuggcacuucaucguccggaaguccaaccagggccucugcaaccagaccauccgcggcacccgggaguacgacgggaagaaguacaagaucaacaaguucgacauccgcacgaaggagggcgugaagcuguucaagaagcuggccuucagcgagaaggaguccgaccgggagaagcuccugguguaccugaacgaccgccagaccuucaacaaccucgucaagaucuucgaggacuacaaggacgcgcccaaccccuucgugcaguacgagaaggagaccggggacgugguccggaaguacagcaagcgccacaacggcccccggaucgacaagcugaaguacaaggacggcgaggugggggccugcaucgacaucucccacaaguacggccuggagaaggacagccgcaaggugauccucgagucccuggucccguaccggauggacguguacuacaaggagagcgacaagauguacuaccuggugggggucaagcaguccgacaucaagagccagaacggcgccaacgugaucgacgaggaccucuacacccgcauccugaucaacgagaagaugaucgagcccgggcagucccgggacgaccuggagcagcucggcuacgaguuccgcuucagcuucuacaagaacgacaucaucgaguacgagaaggagggcaagguguucgucgagcgguucgugucccgcaccaugcccaaggugcgcaacuacaucgagacgaagcccaucaacaaggccaacuucgagaagcagaacccggucgggcugggcaagaccaagagcaucaagaaguaccggaccgacauccuggggaaccgcuaccucugcgagaaggagaaguucaccaaguucugcuga

SEQ ID NO: 1596 - RNA, 3315 nt, Artificial Sequence
  Cas9 variant
augaaccacuacgugcugggccucgacaucgggaucaccagcgucggcuacggggugaucgaccuggacaacuaccaguucguggacuacggcguccgccuguucaaggaggggaccgccgaggacaacgugaaccggcgcacgaagcggggcucccgccggcucaagcgccggcgccagacccggcuggacgacaugaaggagcugcuccagaaggagaagaucaugagcgagaccuaccacuccagcuacgaccccuacgacaugcgcaucaagggccugucccagaagcugagcaacgacgagcugaccugcgccauccuccacaucacgaagugccgggggaccacccuggaggcgcucgacuccgccgacgaggacagcgagggcaccaaguccauccugagcaagaacgaccaggaccugaagaaguaccacuacgugugccucguccagaaggagcgccugaagcaguccgggaagauccggggcacggagaacaacuucaagaccgacgacuacaucaaggagcuggacgagauccucagccaccaggaccuguccgaggaccugugcgagaagauccgcaccaucgugagccggcgccggcaguacuacgaggggccgggcuccgagaagucccccacccccuacggccgcuggaucgcccaggggguggcccccaucgaccucaucgagaagaugcggggcaagugcagcgucuucccggaccagcugcgcgccgcgaagaacagcuacacggccgagcuguucaaccuccugaacgaccugaacaaccucgagugcgagggggagaagcugaccaccucccagaagcaggacgugaucgacuucgugaacgagaagggcggcaucacccccaagcagcuggccaagcuccugaacgucgaccugaaccagaucaagggguuccggaucgacaagaacgacaagccccuccugacggaguucaagggcuacaaggccuucaagaagaucuucgacaccaacaacugcgaccuguacaagaaggaccucagcauccuggacgggcuggcggagaucgugaccggcaagaaggggaucgaggagcgcaagcaggccauccagcaggccuaccccgagaucgacgaggccaucguggagcagugcgccgucaugaagggcaugacccaguaccacagccucucccugaaggcgaugcaccugaucaaccaggagaugcuccagagcccgcgcaaccagaugcagguccugcacgagucccacguguucgacaagaaccgggugagccacaagggccagaaguacaucgaggccgacgacgaggccauccugucccccguggugaagcgcgcccagcgggagacguucaaggucgugaacgcccuccgcgagaaguacggggaguucgagagcaucguggucgagaccacccgggaccgcaacucccaggagcagaagaagcggcugaacgacagccagaaguacuacgagcaggagaaccgcaagguggacgagcugcucucccacgagggcuacgaccccagcaagaucaacgggaagaccaagcugaagguccggcuguaccugcagcaggagggcaagacggcguacaccaacgcccccaucgaccucaaccugcugaucaaggacgccaccgccuacgagguggaccacaucaucccgcucuccaucagccuggacgacuccaucaacaacaaggcccugaucaaccgcaccgagaaccagaacaagagcaacaugacgcccaucuacgcgauccuccgggggaagcugaacaucucccuggacaccuacaagaccguggucaagaacaaccgcaacuacaccggcaagaagcggagcuaccuccuguacgacaaggacaucacgaaguucuccaacaugcaggaguucaucgcccgcaaccugguggacaccagcuacgccugccggguggucauguccacccucagcgacuacuucaaggacaacgagaucagcacccacgugcacacggugcgcggccgggucaccaacauguuccgcaaccggaucaacaugcagaaggagcgcgagaaggacuaccugcaccacgccguggacgcccugaucguggcguccaucaagaagcucaaccugcugaacaccuaccuccugaaguacaacuucaacgaccuguacaacgaggagaccggggaggucuucgccgugggcgacgaccagcagguccucgaccccaaguacauccgcuucaucacccagcugaagacgaucuacgacgagagcaacauguacuacaacgggcugaucgagcggaacgugaugcaguucccgcccaucaagaucucccacaagaucgacaccaagcccaaccgccagaucagcgacgagaccaucuacuccacccggacggugggcaacgaggaguacguggucaagaaguacagcgacaucuacgaccccaaguucacccagcucaccgacgacaucaucaacgaccgcccccuggaccgguggcugauguaccgcaacgacaaccagaccuucaagaucauccaguccaucauccucgaccacuuccacaucuucaaggacgacgagaagcacuacagcugcacgaagaagaaggggcagauccaguacgcccugaagggcaagaacccgcuguaccucuacaagcaggagcacggcaaggugcggaaguacgccaagaaggggaacggccccgagaucaccaugaugaaguacuucgacgggaagcugggcaacaacaucgacaucuccaaccacuaccacgugcacaacaagaaggucgugcugcuccagaucagccccuaccgcaccgacuucuacgugucccccgagggcaaguacaagaugcugaccguccgguacgcgaacguguucuacaaggagagcaagaagaaguacgugaucgacgagaagugguacgccuccgagaagaagcgcaagaacaucacggacgacgacaucuucgucugcagccugcaccacgacgagcucaucgggauccagaagaaggacggcgccaaguacguguacgaccuguccaccgaggacgggggcaagccgcggcuguaccacggggagauggagauccucaaguucaccgccaccaacaacgacagcaagaacaucaucgaggugaagcccaucuacacguacugcaagaagcagcugaugaucuccaucggccccaucaccaagcuggccaaguacgcgaccgacguccucggcaacguguacgaggugaagaagaacaucaucgaccaccugagccaccuguga

SEQ ID NO: 1597 - RNA, 3318 nt, Artificial Sequence
  Cas9 variant
augggcauccgcaucgggcuggacaucggcaucgccagcguggggugggccgucguggacgacgacuacaacaucaucgaguccggcgcgaacaucuucaacgaggccaaggccgccagcaacguggaccggcgcacguuccggcagaccaagcgccuccugcggcgccagaagacgcggcugcgcgacuucgacauccucuggaucaacgccgggcuggacauccccaaggagaaggucaacaagcagcugcaguuccgggugcagggcaugaccauggagcucuccgagaacgagcuguacgcggcccugaagaacaugcucaagcaccgcggcaucagcuaccuggaggacgcccuggacgaggagcaguccggcaagagcaccuacgagaaggggcuccaggugaaccagaaggcccugaagugcgacaagaugccgugcgagauccaguacgagcggcugaugaaguacggguccuaccgcggccacaucgaggucaaggacgagagcggggaggagaugauccucuccaacaucuucacccuggacgcguacugcaaggaggccaagaagauccuggagugccagaagcaguaccacagcuucaucacggaggccuucgaggacgacuaccucgcccugcugcggcgcaagcggaaguacuacgagggccccggcaacgagcagucccgcaccgacuacgggaaguacaccaccaagcucaaccccgagacgggcgaguacgugaccgaggagaacaucuucgagaagcugaucgggaagugcagcguguaccccaaggagaugcgggccuccgcggccagcuacaccgcccagaucuacaacaugcugaacgaccucaacaaccugaccaucaacggccgcaagcuggaguacgaggagaagaaguccaucgucgaggaggugcagaaggccagcuccgugaacaugcucaagaucaucaagaaggucaucaacgaggacaucacgaccaucgagggcgcccggaaggacaagaacgacaaggagaucuuccacaagauggagaccuacaacaagaugcgccacuacuucgagaagaacgggcuggaguucaagaagaucagcaccgacgaccuggacgagaucggcaacauccucacgcugaacaccgagaaggaggcgauccuggaggccuucaacaagucccagcucgagcugagccaggaggagaaggaggccuucaucgagauccggaagaagaacgggagccuguucaacaaguggcacuccuucagccucaagaucaugaaggagcugaucccggagcuguaccuccaguccaagaaccagaugcagcugcugaccgacaugggcguguucaagaagaagaccgagaucuuccagaacuacgacaagauccccacggacgugaucaucgaggacaucuacaaccccgucgugaagcgcagcauccgcaucaccgugaagaucgucaacgcccucaucaagaaguacggguacccccgggagguggugaucgagaugccgcgcgaccggaacuccgacgaggagaagaagcgcauccaggacgagcagaagaagaacgacaccgagcugaagaagaucaucgagaaggucgagagcgaguacggcaucaagaucaccgacacgcacuuccggaaccacaagaaccugcgcaugaagcuccggcuguggcacgagcaggacggccgcugccuguacuccgggaaggugaucgacaucagcgagcuccugaacgacugcuccaaguucgagaucgaccacgugauccccaagagcaucuccuucgacgacagccgguccaacaagguccugguguacagcaccgagaaccagaagaagaccaaccagacccccuaccaguaccuggagggcaacgggaaggagugguccuucgacgaguacaugaaccaggucaucgagcucaaggaccgcaagcugaucagcaaggccaagaugaacaagcuccuguuccgggaggacaucacgaagaucgaggugcugaagggcuucaucgcgcgcaacaucaacgacacccgguacgccucccgcgugguccugaacagcuuccagaaguacuucgaguccaagcagagcgacaccaaggugaaggugauccgggggagcuucacccaccagaugcgcaagaagcuccagcuguccaagaaccgggacgagagcuacgcccaccacgccgucgacgccaugcugaucugcuacucccagaugggcuacgaggcguaccgccagcuccaggaggaccugaucgaccccgacagcgagaagauccgggaccugggccucuggaaggagacgaucaccgaggccaaguacgacgaggugcuguacaccgccaaguggcuggagaaccgcgggaagauccaggaggccgagaagaaggugaaguucuggcacaaggucgacuccaaggcgaaccgcgcccucugcaaccagaccauccggggcacgcgcgugaucgacgggagcauccagaagaucaacaagaucaacaucuacuccguggacggcuacaagaccuucaagaacaugauccagaaggggaaggagaaggacuuccugauguaccggaacgaccgccggagcugggacgaccugaugaaggucuaccgcgaguacuccgacgccaagaacgccuucgccgcguaccaggaggagaccggcgacuacgugcggaaguacgccaagaagcacaacggcagcaagaucaccaaccucaaguacugcgccaaggagcugggguccugcaucgacaucagccacaaguacggccuggagaaggacucccgcaaggugauccucgagagccuguccccguaccggagcgacgucuacuacaacgccgggcugaagcaguacuacaucgugggcaucaagaacuccgaccucugcuuccugaagggcgaguacuucaucgacagcaagcgcuaccugcagauccuccgggaggagggggugcugaccgagcagcacacgcugaacgaccucgccgcgaucggcaccgaguuccaguucagccuguacgagaacgacuaccuggaguacgagaagaacggggagaucaagaccgagcgcuuccucucccggaccaagcccaagcagaagaacuacaucgagaccaagagcaucgacgcccccaagaucaagaacaagaagcagaaccuggucggccuggccaaguccaagagcaucaagaagauccgcguggacauccucgggaaccgguacuacgccuccaaggagaaguucagccugaugguggacaaguucuga

SEQ ID NO: 1598 - RNA, 3318 nt, Artificial Sequence
  Cas9 variant
auggacauggccuggcgccugggccucgaccuggggaccaacagccugggcugggccgcgcucucccuggacgccgccggggcccccgacgccauccuggcggccggcagccggaucuucggggacggccgcgacccgcaguccggcaccagccucgccguggaccggcgcgccgcgcgggccgcccgccggcgccgggaccgcuucaagcagcggcagcgcgcccugcugaagcaccucgaggccgacgggcuguuccccgcggaccccgagguccagcaggcccuggccgcccucgaccccuacgcccugcgggcgcgcgcccuggacgaggcccucucccugcacgagaucggccgggcccuguuccaccucaaccagcgccggggguuccagagcaaccgcaaggccgaccggggcaaggacgaggacgcggggaagaucgccaucggcguggaccgccugaaggacgccaucgccgccgcgggcgcccggacguucggggaguuccugcgccagcgccgggccggcgccaccggggagaaccagaucccguccgugcgcacccggcuccgcgcggagaccggcgagggcgccaaggggagcggcuacgacuucuaccccucccgggcccugcugaaggacgaguucgacgccaucuggcacgcccaggcggagcaccaccccaagguccucacggacgaggccuaccaccgccugcacgagaucguguuccggcagcgcccccugcgggccccgaaggugggggccugcacccucguccccggcgaggcccgccugcccaaggcgcacccccuguuccagcggcgccggcuccuggaggagcugaacgcccucaugaucgugcgcgccggggccguggccgagcggcugaccccggagcagcgcgaccugcuccugcugaagcucaaggacaagggcaaggucaccuucaagagccugcgggagaaggugcugaagcucgacggcgacgcgcgcuucaacaaggaguccgagcaccggacggagcugaagggggacgagguggccgccgagaugggcgggaagacccgcuucggcagccuguggccccaccucuccaccgagcagcaguggaccgucaucgagcgccagcaggcccuggagagcgacgcggacgaggccgccuuccggacguggcugguggagacccacaagcucaccgccgagcaggcccgcgcgguggccggggcccggcugcccgccggccacggccgcuucgggcugaccgccacggcggcccugcucgccgcccugcgggacggccgcacccccgaggggcggggcccgaacgcccccgcgaccgaggccgggcgcgucgugguguacuccgaggccgccgcgaucgccggcuaccaccacagcgaccaccgguccggcgaggucuucaccgacgccaaggggcgccccgcccugcccuacuacggcgugccgcucgaccggcacaucgugcccgggacggccgaccccgacgagcccgacgaggcggcccgcaucggccggcugaccaacccgaccguccacaucgcccugaaccagcuccgccggguggugaaccgccugauccgggucuacggcccgcccgccgagguggcccuggagcucgcgcgcgagcugaagcugagcgaggacgagaagaaggagcggaaccgcgagaacucccggaaccgccucgacgccgagaagcgcagcagcaagcuggccgagcuggggcagcgggacaacggcgggaaccgcgcccuccugaagcugugggaggagcucaaccccgagaacauccuggaccggcgcugcaucuacuccggccggcagaucagcaucgggaugaucuucuccggcgccgcggaggucgaccacauccugcccuucgacgccacccucgacgacagcaacgccaacaagauccugugccugcgcgaggccaaccgggacaagcgcaagcggucccccuucgaggccuggggcgggacgccccagugggaggagaucgcggagcgcgccagccggcucccgcgcaacaagcgguggcgcuucgagcccgacgccauggagcgguucgccgaggagggcggguuccuggcgcgccaccugguggacacccaguaccucggccggaucgcccacgacuaccugcgcugccuguaccccgacaagggggacggcuccagccacgugugggucucccccggccggcucaccgagauggugcgccgcaagcuggggcugaacggccuccugggggaccacaaccugggcgccgagcagccgaagaaccggaaggaccaccgccaccacgccaucgacgccguggucaccgcgauccucgaccggagcaugcugcagcgcauccagcgggccuccggggagggcgccagcgacgccgagcugcuccgcaucaucgugcccgagcccuggacgggcuuccgggacgaccugcagcgcgccguggaccggaucgucguggcgcaccgcgccgaccacgggaccguggccaaggccgccacccggggccgcgaccagaccgcggcccggcugcacaacgacacggccuacggguucaccggcgaggccgacgcgaaggggacccccaucgucgugcaccgcgccccgcucggcgcccugaagaagcccgagcacaucgaccaggugcgggacccccugcuccgcgccgcccugcacgacuucaccgcgggccuguccgggaagcccuucgaggaccggaucgccgccuucccgcgccucggcccccuggacuaccgggggauccgccggguccgcgugguggagccccugcaggucauccccauccgcgacgccgccggccgggcguacaagggcuacaagggggacagcaacuaccgcuacgacgugugggagcucccggacggcaagugggagcagcgggugcugcagauguacuacgcccaccaguccggggagccgccccgcccccaccccgccgcccggaagguccugagccuccaccgcgacgacgugcuggccaucgagcggggcgagggcgggcgcgagcuggugcgggucgugaaguucuccacgaacgaguucacccucgcgccccugaacgagggcggggcccucaagagccgccacgccgacaagggcgaccccuuccgguaccuguaccccuccccgagcacccugaaggccuggcgcgcgcgggaggugcgcgucgacgagcuggggcgggugcucgaccccggcuuccccgcccgcaagcggcgccgggugacccgcccggggcgcgccgacgccgacuga

SEQ ID NO: 1599 - RNA, 3321 nt, Artificial Sequence
  Cas9 variant
augcaguacaucguggccaucgacaucggcgucgccagcgugggguacgcggugaucgacaagaccuccgagaccgucaucgaggccggcagcaacaucuuccccgaggccuccgccacggacaaccaggagcgccgggggaugcgccaggcccggcgccugaagcggcgcgagcggacccgccucgacgacuucaccaagcugugggaguaccacggccuggcgaucccccaggugaagaagaacgacaucguggggcucaaggucaaggcccuguacgagagcaucucccuggacgagguguaccucauccuguacagcuaccugaagcaccggggcaucuccuaccucgaggacguggaggacagcuccgucagcggcuccaccgccuacgccaacgggcugaagcugaacgcgaaggagcucgagaagaacuucccgugcgagauccagaaguaccgccuggagaacaucggcaaguaccgggggcagauccagaucgaggacgaccagggcgagaagcuggaccucagcaacguguucacgaucggggccuacaccaaggagauccagcagauccuggacacccagaagaaguaccacgccgagaucgaggacgaguucugcgagaaguaccugaagaucuucacccgcaagcggaaguacuacgagggccccggcaacgagaagucccgcacggacuacgggaaguacaccacccggcucaaggagaacggcgaguacaucaccgagaagaacaucuucgagaagcugaucgggaagugcagcguguacaaggacgagcugcgcgccgccuccgcgagcuacacggcccaggaguucaaccuccugaacgaccugaacaaccucaccgucaacggccggaagcuggaggagaacgagaagcaccugaucguggacaaggugaagaccuccaacaccaucaacaugcgcaagaucaucgccgacgccaugggcgagaagaucgaggaguucuacggggcccggaucgacaagagcgagaaggagaucuuccacaaguucgaggucuacaacaagaugcgcaaggcgcucgccgccauccacgugaacaucgaggaguucucccgggacgaccuggacgagaucggcuacauccugacgaucaacaccgacaaggaggccaugauggaggccuucgacaacagccgccucgagcugcccggggagaucaagaacugccugaucagccuccgcaagaccaacggcacccuguacuccaaguggcacagcuucucccugaagaucaugaacgagcucaucccggagauguaccggcagcccaaggagcagaugacgcugcugaccgagaugggggugaugaagggccagaccgacgaguucgagaagaacaaguacauccccgucgacguggcgagcgaggacaucuucaaccccgugguccgccgguccgugcgcaucagcuucaagauccucaacgcccugaugaagaaguacggcacccuggacgagguggucaucgagaugccgcgggaccgcaacuccgacgagcagaagaagugggagaaggagacgcagaagaagaacgagaaggagcaggaguacaucgagaacaagcucgccaccguguacgacauccggcugagcuccgccgacuucagcucccagaagcagcugaaccucaagcugaagcuguggaacgagcaggacgggaagugccucuacagcggcaagaucaucgagcccgaggaccugaucaagcacuccgagcuguucgagaucgaccacaucaucccccgcagcaucuccuucgacgacagccgguccaacaagguccugguguaccgcaccgagaaccagaacaaggggaaccagacccccuacuacuaccucacgcacaccaacagcaagugguccuucgagcaguacaaggcccuggugauggaccugagcaagaagaaggaguacggccucagcaagaagaagguccggaaccugcuguacuccgaggacaucaccaaggcggacgugcuccgcggguucaucaaccggaacaucaacgacaccagcuacgccgcccgcgugguccugaacacggugcagggcuacuuccgggccaaggagaugggcaccaaggugaaggucauccgcggguccuacacccaccagaugcgggugaacaugaagcuggacaaggaccgcgagaaguccuacgcgcaccacgccguggacgccaugcucaucgccuucagccagcugggcuacgaggccuaccggaagcugcagggggaguucaucgacuucgagaccggcgagauccucaacagcgagaaguggaaggaccagauguccgacgaggucuacaagcaguaccuguaccgcaagaaguggagcaacauccgcaacgagaucacgcgggcggagaagaacgugaaguacugguacuacguggaccacaaguccaaccgcgggcugugcaaccagaagauccggggcacccgcgucuacgacggcaagaucuacaagaucaacaagcucgacauccggaagaaggagggggccgcccuguucaagaagcuggccuucagcgagaaggaguccgaccgcgagaagcuccugguguacaagaacgacaagaagaccuacgaggaccuggugcggaucaugcaggacuacagcgacuccaagaacccguucguccaguacgagaaggagaccggcgacuacgugcgcaaguacgccaagaagcacaacgggccccggaucgacaagcucaaguacaucgacggcgaggugggcagcugcaucgacaucucccacaaguacggguacgagaagggcagccgcaaggucgugcuggagucccuggugcccuaccggauggacgucuacuacaagaaggaggagcagaccuacuaccucguggggaucaagcagagcgacgugaagugccagaagggcgaguacgucaucgacgaggacgcguacgccaucaaccuggugaaggagaagaugauccagcaggggcagaagcgcagcgaccuggagucccucggcuucgaguuccagcugagcuucuacaagaacgacaucaucgaguacgagaaggacggcaagaucgugcgggagcgcuuccugucccggacgaugcccaaggucaagaacuacaucgagaccaagccgaucgaccgcgccaaguacgaguggcacgaccggaagcucguggggcugggcaagaccaagcgcauccggaaguaccgcauggacauccuggggaacuacuaccucugcaacaaggaggaguucagcaaguacugcuga

SEQ ID NO: 1600 - RNA, 3324 nt, Artificial Sequence
  Cas9 variant
augggcuacaccguggggcuggacaucggcgucgccagcguggggguggccguccucgacgagaacgacaacaucguggaggcgguguccaacaucuucgacgaggccgacaccagcaacaacaagguccgccggacgcugcgcgagggccggcgcaccaagcggcgccagaagacccggaucgaggacuucaagcagcugugggagaccuccggguacaucaucccccacaagcuccaccugaacaucaucgagcugcgcaacaagggccucacggagcugcugagccucgacgagcuguacugcgugcugcucuccaugcugaagcaccggggcaucagcuaccuggaggacgccgacgacggggagaagggcaacgccuacaagaaggggcucgccuucaacgagaagcagcugaaggagaagaugccgugcgagauccagcuggagcgcaugaagaaguacggcaaguaccacggggaguucaucaucgagaucaacgacgagaaggaguaccaguccaacguguucaccaccaaggcguacaagaaggagcucgagaagaucuucgagacccagcggugcaacggcaacaagaucaacacgaaguucaucaagaaguacauggagaucuacgagcgcaagcgggaguacuacaucggccccgggaacgagaagucccgcaccgacuacggcaucuacaccacccggacggacgaggaggggaacuucaucgacgagaagaacaucuucggcaagcugaucggcaagugcagcgucuaccccgaggaguaccgcgccagcuccgccagcuacaccgcccaggaguucaaccugcucaacgaccugaacaaccugaagaucaacaacgagaagcucaccgaguuccagaagaaggagaucguggagaucaucaaggacgcguccagcgugaacaugcggaagaucaucaagaaggucaucgacgaggacaucgagcaguacuccggggcccgcaucgacaagaagggcaaggagaucuaccacaccuucgagaucuaccggaagcugaagaaggagcugaagacgaucaacguggacaucgacagcuucacccgcgaggagcucgacaagaccauggacauccugacccugaacacggagcgggaguccaucgugaaggccuucgacgagcagaaguucgucuacgaggagaaccucaucaagaagcugaucgaguuccgcaagaacaaccagcgccuguucagcggguggcacuccuucagcuacaaggccaugcuccagcugauccccgugauguacaaggagccgaaggagcagaugcagcugcucaccgagaugaacguguucaagagcaagaaggagaaguacgucaacuacaaguacauccccgagaacgagguggugaaggagaucuacaaccccgucguggugaaguccauccggaccaccgucaagauccugaacgcccugaucaagaaguacggcuaccccgagagcguggucaucgagaugccgcgcgacaagaacuccgacgacgagaaggagaagaucgacaugaaccagaagaagaaccaggaggaguacgagaagauccucaacaagaucuacgacgagaaggggaucgagaucacgaacaaggacuacaagaagcagaagaagcuggugcugaagcucaagcuguggaacgagcaggagggccugugccucuacagcggcaagaagaucgcgaucgaggaccugcugaaccaccccgaguucuucgagaucgaccacaucauccccaaguccaucagccucgacgacucccggagcaacaaggugcuggucuacaagaccgagaacuccaucaaggagaacgacacccccuaccacuaccugacccgcaucaacgggaaguggggcuucgacgaguacaaggccaacgugcuggagcuccggcgccgggggaagaucgacgacaagaaggugaacaaccugcugugcauggaggacaucacgaagaucgacgucgugaagggcuucaucaaccgcaaccucaacgacacccgguacgccagccgcgugguccugaacgagaugcaguccuucuucgagagccggaaguacugcaacaccaaggugaaggugauccgcgggucccugaccuaccagaugcggcaggaccuccaccugaagaagaaccgcgaggagagcuacucccaccacgccgucgacgccaugcugaucgcguucagccagaagggcuacgaggccuaccggaagauccagaaggacugcuacgacuucgagacgggcgagauccucgacaaggagaaguggaacaaguacaucgacgacgacgaguucgacgacauccuguacaaggagcgcaugaacgagauccggaagaagaucaucgaggccgaggagaaggugaaguacaacuacaagaucgacaagaagugcaaccgcgggcugugcaaccagaccaucuacggcacccgggagaaggacgggaagauccacaagaucuccagcuacaacaucuacgacgacaaggagugcaacucccucaagaagaugaucaacagcggcaaggggagcgaccugcugauguacaacaacgacccgaagaccuaccgcgacaugcucaagauccuggagacguacuccagcgagaagaaccccuucguggccuacaacaaggagaccggcgacuacuuccgcaaguacuccaagaaccacaacggccccaaggucgagaaggugaaguacuacagcgggcagaucaacuccugcaucgacaucagccacaaguacggccacgccaagaacuccaagaaggugguccuggugagccucaaccccuaccggaccgacguguacuacgacaacgacaccgggaaguacuaccuggucggcgugaaguacaaccacaucaagugcgugggcaacaaguacgucaucgacuccgagaccuacaacgagcugcuccgcaaggagggggugcugaacagcgacgagaaccuggaggaccucaacuccaagaacaucacguacaaguucagccuguacaagaacgacaucauccaguacgagaagggcggggaguacuacaccgagcgguuccugucccgcaucaaggagcagaagaaccucaucgagaccaagccgaucaacaagcccaacuuccagcggaagaacaagaagggcgagugggagaacacccgcaaccagaucgcgcuggccaagacgaaguacguggggaagcuggucaccgacgugcucggcaacugcuacaucgugaacauggagaaguucagccuggucguggacaaguga

SEQ ID NO: 1601 - RNA, 3324 nt, Artificial Sequence
  Cas9 variant
augggcuacacccuggggcucgacaucggcaucgccagcgugggguucggccugaucgacaacgucgacgggaagauccuggaguccggcgugcgccucuucagcuccgccgaccccgacaacaaccagacccggcgcagcucccggcaggcgcgccggcugaaccgccggaaggugcaccgccuggagcgggucgcccaccuccuggaggaggccggcuucgagaagggggaggugcuggccccgacgcccuaccaccuccgcgugaagggccugaccgagaagcugagcaagcccgaggucuacgccgcgcucuacaaccugaugaagcaccgggggaucuccuaccuggaggacguggagcucgacgaggccgacagcuccagcgugucccagaacgucgagcugcugaaggaguacuaccccugcgagauccagcucgagcgcuacgaggaguacggccagauccgggggaucaucgagaccuacaacaaggacggcgagaaggagagccuggugaacaucuucccgaccggcgccuacaagaaggaggccgaggcgaucauccugaagcaggggcaguucuaccccgagcucgacaagguguuccuggagaaguucacggagauccugaccgucaagcgccccuacuacgugggccccgggaacaagaagucccggaccgacuacggcaucuaccgcgagaacggcgagacccucgagaaccuguucgacauccugaucgggaagugcacgaucuacccgcaggaggcccgggccgccaaguucagcuacaccgcccagcuguucgacuuccugaacgacaugaacaacaucuccaucgcgggcgagaagcugaccgaggugcagaagcgcgagaucuaccaccagaucaugagcuccaagaccgucaacaugaugaagaucaucacgaaggugaccgggugccucaaggaggaggugaccggcuaccgggucgacagcaaguacaaggccgaguuccacuccuucgccagcuaccgccaguuccggaacaagaugcuggacuacggguucgacgugcagacccugaacguggagauguucgacaagcucgccgccaagcugacgcugaacaccgaguaccaccagaucaucacccagcucgagagccugaaccugggccucuccaaggagcugaucgagaagaucgcggacuuccgcaagaagaaccgcagccuguucuccaaguggcacagccucucccugaaggccaugaacgaggucguggacgagcuguggagcaccuccaagaaccagaugcagaucuucagcgagcucggcggguucaaguccaacaucgagguguucaagggccugaaguacaucccccuggacgccauggucgacgagaucuacaaccccgugguccggugcagcauccgcgaguccaucaagaucaucaacgcccuccugaagaaguacggggcccuggacaagguggugaucgagaugccccgggacagcaacgagaaggaggagaaggaccgcaucacgaagcugaacaaggagaacgacaacaagaagaagcaggcgaucgagaaggcccggaacgaguacggcuucggggaggaggccuaccgccagcagaacgaccucaacaccaagcugcggcugugguacgagcagaagcagcgcugccucuacuccggcgagaucaucaagaucuucgaccugaucaagaacccgcaccuguucgacaucgaccacaucauccccaagagcaucuccuacgacgacagccucuccaacaagguccugugcuacgccaccgagaaccgggagaagggcaaccugacccccuaccgcuacuucaagcggaaggccagccucacguggaacuacgaggcguacaaguccuacgugaucgagcuguacaaggacgggaagggcgaccugagccgcaccaagcucgagcugcuccucuucgaggaggacaucaacaaguacgaggugcggcagcgcuucaucaaccggaaccuggucgacacccgcuacgccagcaagguggugcugaacacccuccaggacuucaugaaggagaacuaccccacgaccaccgucgagguggugcgggggaaguucaccgcccagcugcgccggcacuggggcauccgcaagaaccgcgacgagaaccacgcccaccacgcgaucgacgcccugaucaucgccugcgucccgcaccucucccuguggaaggagcagaagaagguguucagcacggacgaguuccggguggacgagaccaccggggagaucaucgagcaguccuacaaccagcugaccuaccaggagcccuucagccaguucuucuaccagcucgagaaggucuccaucgacugccgcuacagcuacaagguggaccggaaguucaaccgccagguggccgacgccacgaucuacuccacccggcagggcaucgucaagcagaccagcggcgacaaguccuucacccuggacagcaacuccaaggagcacuacgugaucgcgaagaucaagaacaucuacgaggacguggacgccaagcgcuucauggaccgguacaagaaggacaagacccaguuccugauguaccaccacgacccccagacguucagcauccucgaggacgucaugaagaccuaccccgacaagaagaacccguuccaggccuaccgccuggaguacgggcccauccggaaguacuccaagaagggcaacgggccccagauccagagcaucaaguacuacgacuccaagcugggccagcacaucgagcucaagcaggccaaccagagcaccaagaagguggugcugcagucccugaaccccuggcgcugcgacaucuacuacaacaagaaggacaagcgguacaucgccgcgggccucaaguacgccgaccugagcuaccagaaggggaccggccuguacgggaucagccuccagcgcuaccagcagauccugaacuccgagaagaucgagcugagcaucgagcagaucgagcuccugcuggagggccggcucaacgaguccaacuucgaguucugcuucagccuguacaagaacgacuucauccaguggaacgacgagaacaaccagacguuccaguaccgcuuccuggcccggaaccucuccagcccgaaccgcaucgaggucaagcccaucaacaaguccaaguacgacaagcaggccgaggggcugaagacccugaagaagggccucaaccgguucuacaagaucagcguggacgugcugggcuaccagcacuucaucaagaaggagaagcugaagcucaccuucaaguga

SEQ ID NO: 1602 - RNA, 3330 nt, Artificial Sequence
  Cas9 variant
augagccacuacgugcugggccucgacaucgggaucaccuccgucggcuacgggaucaucgaccuggacaccaacgacuucaucgacuacggcgugcgccuguucaaggaggggacggccgccaacaacgaggaccggcgcaacagccggucccgccggcgccuccugagccggaagcacacccgccugauggacaugcagaaggugcucaaggaggcgggcaucaugaccgaguccuacagcccccuguccaacgucuacgagauccggaagaagggccugaccaaggagcucacgaacgacgagcugaccgccgccauccugcacaucaccaagcaccgcgggagcgugaucgagaccguggaggacgacgaggccgccgcgaaggagacgggcgagcucaaguccacccugcacgagaacgcccugcuccuggccaacaacaaguucgucugcgagauccagcuggagcggcucaacaccgagaacaagauccgcaaccacaagaacaacuucaagaccaaggacuacguggccgagcugaaggagauccugaaccaccagaaccucagcgaggaggugaagaacaagaucauccagaucgucgagcggcgccgggcguacuacgaggggccgggcuccuucaacagccccacgcccuacgggcgcuucaucgaggugaacggccaggugcaggagaucgaccugaucgagaagaugcggggcaagugcuccgucuaccccgacgaguuccgcgccccgaagaugagcaucuccgccgaccuguucaacauccucaacgacuucaacaaccugcuggugcagggggagaagcuccaggaggaggacaagaagaaccugcugaagaucaucaacgacaagggcagcaucacccuccggcagaucuccaagaagcuggaggugaacgaggacgagaucaagggguaccgcaucgacaagaagggcaaggcccuguucaccgaguucaagggcuacaagauccucaagaagcuguuccugaacugcgggcagagcaucucccucgaggacuacgagaugcuggacgagaucaucgagaucgucaccaagaagaagggcaucgacgagcggaaggacgcccugaaggagcucaagugggaccugagcgacgacaucaucaacagccuguccgaggugacggggaucgugggcuaccacagccucucccugaaggcgauccgcgagcuggacagcgagcucuacaagaccucccugaaccagaugcagcugcuccacgagcugaagauguucgacaagaaccgccccagcuacaaggggaagaagaacaucgucgccgaccccgaggccauccugucccccguggccaagcgggcccagaacgagaccuucaaggugaucaacgcgcugcgcaagaaguacggcgaguucgacagcaucgucguggagaugacccgggacaagaacucccaggagcagaagaagcgcaucaacgacagccagaaggcccucgagucccugaacaaggagguggaccagcugcuccagcagaagggcuacgacccgcagaaggucaaggggaagacgaagcagaaggugcggcuguacaugaugcaggagggcaagagcgccuacacccugcaggagcucgaccugcaccgcgucaucaaggacgacaaguacaccgagaucgaccacaucauccccaucuccaucagccuggacgacucccagagcaacaaggugcucgcccugcacuccgagaaccagcagaaggggaaccugacccccuucauggccuuccacacgggccgguucgcggacauggggugcaccuggaacaaguucaaggagaacgugcucagcaacaagaacuacaagcacaagaagaagaacaaccugcuggacgagcgcgacaucaacaaguucuccgucauccaggaguucaucaaccggaaccucguggacaccagcuacgccaaccgcgugguccugaacacccugacggacuacuucaaggacaacgagaucgacaccaaggugcacaccgugaacggcaagcucaccgaccuguuccggaagcgcaucaaccugaagaaggaccggaacgaggacuaccuccaccacgccaucgacgcccugaucgucgccagcaucaagaagcugcgccuccuggacggcuaccuggcgaaguacggguucgagacgcucuacgacgagaugaccggcgagaucaaggagauccccgaggacaaggccuucuucgacgacaaguacauccgguacauccugaaccugaagaccaucuacgaguccagcaacauguacuaccgcgggauccucgagcgggaggagcugaucuaccagccgaucaagaucucccacaagaucgacaccaagcccaaccgcaaggugagcgacgagacgaucuacuccacccggaucaucgacaacgaggaccaccugaucgagaaguacagcgacaucuacgaccccaaguucaagaaccucaccgaggacauccugaacggcgagaagaacaaguaccugauggagaagaacgacccccagaccuucaacauccucaagcagaucaucuucaaccacuacaacaccuacaaggacuccaaggaguacuacaagaucgagaagaagaaggagaaggagaucaucaagcugguggggaucaacccgcugagccucuacaaggaggagaacggccccaucaagaaguacuccaagaagggcaacgggcccgucaucaugagcaugaaguacgacuccgagaagcugggcaaccacaucgacaucacgcccgacagcgccaagaacaagaaggugauccugaagcagaucuccccguaccgcaccgacuucuacaagugcagcgacgagaaguuccgcuucgugaccguccgguacaaggacgugcacuaccagaaguccaucgacaaguacugcaucgacaaggagugguaccagaacgagaagaagaacaagaagaucgacgagaaggccgaguuccucuucagcaugcaccacgacgagcugaucgggaucacccgcaaggaguccgagcaguucaucuacgacgagagcaaggagaaccacggcgacccccgguaccacgacggcgugaagcccgagauccugaaguucacggcgaccaacaacgacaccaaggggaucaucgaggucaagccccucuacaccuacagcgccuaccgccugaagccgacggugcugaacgugaagaacaucaagaaguacgccaccgacguccucggcaaccuguacgaggugaagcagaacgagcugaagcucgaguucuga

SEQ ID NO: 1603 - RNA, 3333 nt, Artificial Sequence
  Cas9 variant
auggccgagggcaagaagcgcaucuggcggcugggggccgaccucggcgcgaacagccuggggugggccgccaucgagcuguccgcccccgugaacggcaagccgaucgccauccucgcggccgggagccgcaucuucuccgacggccgggaccccaagagcggcgccucccuggccgucgaccgccgggacgcgcgcgccaugcggcgccggcgcgaccgguucaagcagcgccagaaggcccugaucaaguaccucaucgccgacgggcuguuccccgccgacgaggcggcccggaacgccauggccgccaucgaccccuacgcggugcgcgcccgggcccuggacgaggcccucagccugccggagcugggccgcgcccucuuccaccugaaccagcggcgcggguucaaguccaaccggaaggcggaccgcaaggccgacgacgacgccggcaagaucgccaucgggaucgaccggacccgcgacgccaucgcggaggacgaggccgacgccggcgccgagcccggcagcuggaccuucgggaaguggcugcacgagcgccggcucaagggccaguccgugcgcacgcggcugcgccccgagagcggggaggacgcgaagggcgacggcuacgacuucuaccccgaccgggcccugauggaggaggaguucgacgccaucugggccgcccaggcgccgcaccaccccgacguccucaccaacgacgugcacgaccgccugcacgagaucaucuucuaccagcggccccugaaggcgccccagguggggaugugcucccucaucccgggcgaccgccggcugcccaaggcccacccccuguuccagcgccggcgccuccuggaggagcugaacgcccucaugaucguccggcccggggagguggcccagcgccugacccgggaggagcgcgacauccugcuccugaagcugaaggacaagaacaaggugagcuucgccacccuccggaaggcccugaagcuggacccggacgcccgcuucaacaaggaguccgaggaccggacggaccucaagggcgacgaggucgccgccgugauggggagcaagacccgcuucggcaaccugugggugcaccuguccaucgaggcgcagugggacguccucgcccgccuggacgccguggagagcgacgccgaggacgcggccuucugcgccuggcugguggagaccuacgcccucacccccgagcaggcccgggcggucgccaacgcgccccugcccccgggcuacgggcgcuucggcgagacggccacccggaagcugaucgaggcccuccgcgacgggaagaaggacgaccgggugcugguguacuccgaggccgucaccgaggccggccuggggcaccacagcgaccgccggaccggcgagguguucgaggacgccaagggccgcccccagcuccccuacuacgggguggcccuggagcggcacaucaugcccggcacgggggacccguccgaccccgaggagaugcgcgucggccggcugaccaaccccaccgugcacaucgggcugaaccagcuccgccggauccugaacgugcugauccgcgccuacgggcccccggcggagaucgccaucgagcucgcccgggagcugaagcugaccgacgaggacaagaagcgcaucaaccgggagaacaacgacaaccgcaucgccgcggagcggcgcagcgagaagcuccuggccaucggccaggccgacagcggcgccaaccgggcccugcucaagcugugggaggagcugaaccccgcgaacguccucgaccgccgcugcaucuacuccggccggcagaucagcaucgacaugcuguucuccgccgccguggaggucgaccacauccugcccuucgccgccacgcucgacgacagcaacgggaacaagaucgugugccugcgcgaggcgaaccgggagaagcgcaagcgguccccgcacgacgccuggggccacagcgcccgcugggacgagaucgccgcccgggcggcccagcugccccgcaacaagcgguggcgcuucgagcccgacgccauggacaaguuccgggacgagggcggguuccaggcccgccaccucguggacacccaguaccuggcccggcugucccgcgaguaccucgcgacccuguaccccgagaagggcgaggggagcggccacaucugggucuccccggggcggcugaccgagauggugcgccggaagcucggccugaacgaccugcuccccgaccacaacuucggcgggggcgccgaccaggccaagaaccgccuggaccaccggcaccacgccaucgacgcgguggucguggccaucguggaccgcgggaugcugaacgccaucgcccgcgccagcggccaggagggggcggagggccgggagcgcaucaucauccccgagcccugggacggcuuccgggacgcccuccgcgagacggucaaccggaucaccgugucccaccgcaccgaccacgggaccgccagcaaggccggccugccgaaggggaaggacgccacggcgggccggcugcacaacgacaccgccuacggguucaccggcgacaccgacgccaagggcaacuccaucgugguccgccgggugccccucagcuccuucaagaagcuggccgaccuggaccgcauccgggacgccgaccucaaggcggcccuguaccagcaccugaacgggcucgagggcaaggccuucgagaaggcccuggcggaguuccacaagcuggaguggcacaacuucgggggcgugcgccggguccgcgugacggagccccucaccgugauccccaucaaggaccggaacgggcgcaucuacaagggcuacaagggcgacagcaacuaccgguacgacgucugggagcugccggacgggaagugggugaccaacuggaagaacgaggccggcgaggccauguccagcgugaucuccauguucgacgcccaccagagcagcgagccgccccgcccccaccccgccgcgcggaagauccugucccuccaccagaacgaccugcuggccaucgagcgcgagggggaggaccggaagcucaugcgcgucgugaaguucggccagagcggccagaucacccuggccgagcaccagcaggccggggaccugaagaagcgcgacgccguguccaacgacgacgaccccuucaaguacuucgcgcccacgagcggcgggcucaagaaggucaaggcccgccaggugcggaucgacgagaucggccgggugcuggaccccggguucccggcccgcaccgcccggcgcaagacccggggcuga

SEQ ID NO: 1604 - RNA, 3333 nt, Artificial Sequence
  Cas9 variant
augaccgcccgcacccacaagaucuggcggcugggcgccgaccucggggcgaacagccugggcugggccgccaucgagcuguccgcccccguggacgggaagccgaucgccauccuccacgcgggcagccgcaucuucuccgacgggcgggaccccaagagcggcgccucccuggccgucgaccgccgggacgcccgcgcgaugcggcgccggcgcgaccggcugcagcagcgccagcgggcccucaucaaguaccugaucgccgacggccuguuccccgccgacgagaacgagcgcaaggccauggcgacgaucgaccccuacgccgugcgggcccgcgcccucgacgaggcccugacccugccggagguggggcgggcccucuuccaccugaaccagcgccggggcuucaagagcaaccgcaaggccgaccggaaggccgacgaggacgccgggaagaucgccaucggcaucgaccgcacccgcgacgcgauccggcaggccgaggaggaggccggggccgagcccggcuccuggaccuacggcaaguggcuguacgagcgccgggccagcgcgacggacgccaacgccauccccuccguccgcacccggcuccgccccgagaccgacgagcacgccaagggggacggcuacgacuucuacccggggcgggcgcugauggaggccgaguucgccgccaucugggaggcccaggcggcccaccaccccgacgcccugaccaacgaggugcacgaccgccuccacgagaucaucuucuaccagcggccccugaaggcgccccagaucggcgugugcacgcugauccgcggcgaccagcggcucccgaaggcccacccccuguuccagaagcgccggcugcucgaggagcugaacgcgcugaccaucguccgccccggggagauggcccagcggcucacccgcgaggagcgggacacccuguuccugaagcucaaggacaaggccaaggugagcuucgugucccugcgcaagacgcugaagcucgaccccgacgcccgguucaacaaggagagcgagaaccgcuccgaccugaagggcgacgaggucgccgcggccaugggggccaagacccgcuucggcaaccggugggugcaccugagcaucgaggagcagugggacgugaucgcccgccucgaggaggucgaguccgacgcggaggacgccgccugccgggccuggcuggccgcgaccuucgaccugaccccggagcagauccgcgccgugacgaacgcgccccucccgcccggguacagccgguucggcaagguggccacccagcgccugaucgacgcccugcgggacggcgagaaggacgggcgcguccucguguacuccgaggccguggccgccgccggccuggggcaccacagcgaccugcggaccggcgagaucuucgaggacgcccaggggcgcccccagcuccccuacuacggcgucgcgcuggagcggcacaucaugcccggcaccgggaaccccgaccacuccgacgagaugcgcaucggccggcugacgaacccgaccgugcacaucgggcucaaccagcugcgccggaucgugaacacccugauccgcgccuacggcccgcccgccgagaucgccaucgagcuggcgcgggagcucaagcugaccgacgacgacaagaagcgcaucaacaaggagaacaacgagaaccggcuggccgccgagaagcgcagcgagaagcuccugacgaucgggcggcccgacaccggcgccaaccgcgcccugcucaagcugugggaggagcugaaccccgcgaacguccucgaccgccggugcaucuacaccggcacccagaucagcguggacaugcuguucuccgccgccguggaggucgaccacauccugcccuucacggccacccucgacgacagcaacgggaacaagaucgugugcaugcgcgaggccaaccggaccaagcgcaagcagucccccuacgaggcguggggccacaccgaccggugggaggagaucgccgcccgcgccgcccagcugccgcggaacaagcgcuggcgguucgagcccgacgcgauggagaaguucaaggacgagagcggguuccaggcccgccaccuggucgacacgcaguaccucgcccggcugucccgcgaguaccuggagacccucuaccccggcagcggcgagggguccagccacaucugggugucccccggccggcugaccgagauggugcgccggaagcuggggcucaacgaccugcugccggaccacaacuucggcgggggcgccgaccaggccaagaaccgccucgaccaccggcaccacgcgaucgacgccgucgugguggccaucgucgaccgcagcaugcugaccgagaucucccgggugagcggccuggagggggccgagggccgcgagcgcaucaucaucccgccgcccugggacgaguuccggaacgaccuccgcacggcggugaacgccaucaccgucucccaccggaccgaccacgggaccaucagcaaggccggccugcccaaggggaaggacgccaccgccggccgccugcacaacgacacggcguacggcuucaccggggagaccgacgccaagggcaacuccaucguggugcggcgcgucccccucgccagcuucaagaagcuggccgaccuggaccggauccgcgacaccgaccucaaggccgcgcuguaccagcaccuggaggggcucgagggcaaggccuucgagaaggccgugauggacuuccccaaccuggaguggcaccccuucgggaacgugcggcgcguccgggugacggaggugcuguccgucauccccaucagcgaccagaacggccgcaucuacaagggcuacaagggggacuccaacuaccgguacgacgugugggagcuccccggcgggaagugggaggccgagguggucagcaccuucgacgcccaccagcccgacugggugagcaagauccgcucccggagccccaccgcgcgcaaggugcugucccugcagcagaacgaccucaucgccgucgagcgggcccacgagacccgcgagcugaugcggguggugaaguuccgccagaacggcgagaucacguucgccccgccccaggaggcggggagccugaagcggcgcgacgccacccccaacgaggacgaccccuucaaguacuucgccgucgccgccuccagccuccagaaggcgaaggcccgccaggugcggaucgacgagcugggccgcgugcuggacccgggcuuccccgcccggaccgcccgccggaagacccgcaaguccacguga

SEQ ID NO: 1605 - RNA, 3333 nt, Artificial Sequence
  Cas9 variant
augcgcauccugggcuucgacaucgggaucaccagcaucggcugggccuacguggagggggaggagcucaaggacugcggcguccggaucuucaccaaggccgagaacccccagaacggggacucccuggcggccccgcgccgggaggcccgcggcgugcggcgccggcuggcccgccggaaggugcgccucaacgucaucaagcggcugcugugcaaggaguucggccucaaccugagcgacuacuucgccaacgacggggagcugcccaaggcguacgagacgaccaaggacaccaagucccccuacgagcuccgcagccuggcccuggagcagaagcucgagcccaaggagcuggcccgggugauccugcacaucgccaagcaccgcggcuacgggaacaagcacgcgaagcgggaccucgaggccgaggagaaggccaagaaggccgccgagaaggcgccgcaggagaaggaguccaccacgaccaacggcgacagcaagaaggagcaggagaaggugcugaaggcccuguaccagaacgagacccuccugaagaaguaccagaccaacuaccagacgaacaacaagaccaacgacgagaccaacaacaagaccaucuuccuggucgggaaguaccucuacaaggaguuccaggacaagggccagcgcauccggaacacgaccaacaacuaccagcacaccaugcgccaggaguggcugaaggacgagcuggaguucaucuucaagaagcagaaggacuucggcgccaccuucuccgagaacuucgagagccagauccucgagacggccuucuaccagcgggaccugaaguccuucgaggacaagguggggaagugcguguucuacgagaacgagaaccgcgcccccaaggacagccuguccgcgauggaguucgucgcccucacccggaucaucaacacccugaagaaccuggagaagaaguccaagaaccucggcaucggggagaccuacggcaaggacaagauccaggagauccugaagaucgugcuggacaagggcgagaugagcuacaaggagcuccgcaagauccugaagcugaacgagagcauccucuucgccaaggacuccaagcuggacuacacgaaggggaugcaggaggccgagaaggccaaguucaucgagcugaagaaccucaaggcguucaagaaggccaugggcggggacuucagcaaguucccccgcgaggagcuggacaagaucgccaccgacaucgugcugaucaaguccaaggagaaccucgccaagaagcugcagaacuacagcgcccuguccaaggagcaggucgaggcgcucagcaaccugaacuucgccaagcacaucgaccugagccucaaggcccuggacaagauccugcccuucaugcgggagggccuguccuacgacgagguggugaagaaggucgggcuccaggagcaccgcaaguacaagcagaagggcgaguuccugaucccgcugaaggaguacgagcccuaccucgccaaccccgugguggcgcgggcccugagcgaguaccgcaagguccugaacgcccuccugcggaaguacggcaacgugcacaagauccaccuggaguucacccgcgaggccgggaagaacuacgacgagcggaagaagaucgagaaggagcagcgcgagcacuucgaggccaaccagaaggcgaucaagcagcgggagauccucggccugcccaucaacggggccaacauccugaagaugaagcucuggaucgagcagggcgagugcugcguguacuccggggagaagaucaccagcaagcacuucuucgacuccaacgcccugcaggucgaccacaucuacccguacagccgcuccuucgacgacagcuacaugaacaaggugcugguguucgccaaggagaaccagaacaagcucaacaagacgcccuucgaggccuucggcuccgacaaggagaagugggaccggauccugagccuguccgcgaagcuccccaagcagaagcagcgccggaucagcaacaaggacuucaaggacaaggagcugggcuucaucgcccgcaacaucaacgacaccggguacaucgcccggcuggccucccaguggaccaacaacugccucaaguucgaggaccugcgcgagaacgaggucaccaucgccggcgagaaggggagcaagaaccaccuggaggugaucuccggccagcucacgagcaugcugcggcacuacugggggcugggcgacaaggaccgcaacaaccaccuccaccacgcggucgacgccgugaucaucgccuacaccaacgccaagaccaucaaggcguucgccgacuucaagaagaaccaggagcagaaccgggccaaguucuacgccaagcagaucuccgagcaggaguacaagcgccagcgcaaccccuucgagccgugcgccaacuuccggcagcgcguggaggagaagaucaacaagaucuucgucagcaagccgccccggaagcgcgcgcggggcgcccugcacaaggagaccuucggguccaucugccuggacggcaacaacaacuggguggcccgcuucaagaucaagagcaagaaggagcaggaggacaucacgaaggagaaggccaccaaggccaaguacaaggacgaguucaagggggaggagaacauccggaaggcgcucaagcugggcaagauccgccggaucaacaacacccagaaggacaucgccaucggcgacaagaucgugaagaacgagaccaugguccgcguggacaucuucaaggacaagaaggggaaguucuacgccgugcccaucuacacgauggacuucgcccugggcauccuccccaacaaggccgucgcgaccggggaggacgaggacggcgugaucaaggacuggaucgagauggacaagaccaaguacgaguucugcuucagccuguucaaggacgaccugaucaaggugcggaagaagaagaugaaggaggccgagcucugcuacuucgucggguucgacaccgacggcucccgcaucaucguggccaagcacaacaacgacuaccagaccaugacggagaacgagugcaagcuguucacccugaaggagaagaagaagaagcagaagacccucaacgacgaggaggacaaccaggagcggaucgagaccgaguacaagaucaucggcgggcgcacgggcauccagaaccuggagaccuucgagaagcaccaggugagcccccugggggagguccagaaggccgaguucgaggaccggcaggagaucaagcucaaguccagccccaagggcaaggacuga

SEQ ID NO: 1606 - RNA, 3333 nt, Artificial Sequence
  Cas9 variant
augagcgagaaguaccgccugggccucgacguggggaccaacucccugggcugggccgucaucgggcugaaggaggacgugcccagcuccgugcucgccaccggcguccggaucuucagcgaggggcgcgacgcgaagacgaaguccacccugaaggccagccggaccgagaagcgcuccgcccggcgccggcgcgaccgguuccugcagcgccagaccuuccucaucagcgagauggugaaguccggccuguucccgaaggacaucguggagcagaagaaccuggagcuccuggaccccuacgagauccgguucaaggcccugacggagcaggucccccuccaccaccugggccgcgcccuguuccacaucaaccagcggcgcggguucaagagcucccggaaggacaagagcgaggagaccaccuccggcguggugagcaaguccguccgcgcgcucuacgaggagaugcagcugaucaaccccgccccggugaucgacgaccccaaggcccugagcaaggaggagcggcgcgagauccgggugcaggaggccuccagccgcgaggaggcgcucgucacccuggccgagcagaagggggugacguucggcgccuuccuguaccggcgccuccaguccggcaagagcgugcgcgcccggaaggacgccgacagccagcuguacgacgucuaccccacccgcgagcugcucaaggacgaguacuccaagcugaugcagcaccaggcgcaguacuaccccaacgugaucaacgaggcccugaucagccggcuccacgacgugaucuucuuccagcgcaagcugaaggagcaggagcggggguucugcaccuacuacccguccgagcgccggaccuuccgcugcaugcccagcuuccagcaguaccggaugguccaggagcugaacgcccucgaguggguggacgccgccggcaagcacugccugcgcgacuaccccgagucccgggaccugauccucagcgagcuggagaacaucuccacgaaggcgggggaguucaccuucggcaacaugaagaagauccugaagaagaugggggugaucgacggcgaggucagcuucaacuucgagggccccaagcgcaagggguuccagggcaacgugaccucccgggagaugcgccacgaggacugcuucgggacccggugggacgagcucagccuggacgagaaggacgacaucaucgacaagaucaacgacgaccaccuggacgacgaggacauggagcgcuaccucaucgacacguacggccuguccagcuucuccguggggaacgccaucaacgcccggcugcucgagggcaccgccaacgucagccgcaaggccgcgcggacccuguacgagaccaugcuguccgccaacugccuccagagcgacgccgugaucgccgucuccgagcaggacgacacguucgugaacccguacagccgcaccggccgcggggagcugcuguccgagcuccccuacuacggcgaggccuuccaggacgggcggcacaucauccccggcaagcgcgagcccaaggugagccacgaccagcugaaguucuacgggggcgucagcaacccgaccgugcacaucgcgcugaaccagauccggcugguggucaacgagaucaucaagcgcuacggccuccccuccagcaucuccaucgagcuggcccggaaccugcccgaggggcaggacggccgccggaagaucgagaagaugcagagcgagaaccagaagaacaacgagcgcuacgaccagauccucaccgagaacgggcagucccccaaccgggacaaccgccugcggcuggcccucugggaggagcugggcgaggggccgacggaccgccugugcguguucaccggcaagcucaucgagcuggccgaccuguucaacggcagcguggagaucgagcaccucauccccuucuccgucagccuggacgacuccaaggcgaacaagaccgugugcuggaaggaggccaaccgguucaaggggaacaagacccccuacgaggccuucgccaacaacagcggcgacuacuccugggaggagaucauggagcgcgugcgggcccugcccaacagcaagcaguggcgcuuccaggaggacgcgcucaagaucuggaacuccgaccacagcgacuucuccgggcggcaccugaacgacacgcgcuacaucagccggcuggcccgcgaguaccucgagaacaucugcccguucaacaagaucgacgucgugaccggccggcugaccgcccugcuccgcggccacugggggcugaacaacauccugcgcggccacaacgagcccgagaccgccacgcccaagaagaugcgggacgaccaccgccaccacgccaucgacgcgguggucaucgccaugaccucccucaccauccugcagaaggugagcagcgccgccgggaaggccgaggagcuggacgugggcaagcuguucgcgaaggacgaguccgggcggagcgucaucgaccccugggacggcuuccgcgacgagguggccgagaaggugcggaacaucaucgucucccacaagaccaagcgcaagacgaucggcaacagcgggaaguccaccgaccgggcccuccacaacgagaccgccuacggccugaucgacgggccggacgagaagggccucuacagcguggugaccaccaagcccaucuccuacuucgacaaccgcgacaagaucgagaagauccgggacgagaagcugcgcgacgacuuccugacggcgugggacggggagggcgacaacaaggccagccagcucgccguccuggacaaggccuccggccugaacgugaagaagugccgguacguggagcgcaagaaggucauccccaucaacgggccggacggccagcccuacaaggccuacgacgggaacagcaacuggggcauggagaucuacgaguuccccaacgggcaccccaaggagaagaaguggaacggcguggugaucuccaccuacgacgcgaacaagagcgaguucaagccgggcgagaccuuccggccccaccccgccgccaagcucgucaugcgccugcacaucaacgacaucguggaggugcagaacgacggggagcccauccuguaccggguccagcucaucuccgccggcacccugacggugagcccgcugcacgaggccaacguggacucccgcaaccgggacaagcacgacgaguucaaguacaagagccucuccgucacccccaugcagaagaugggggcgaagaaggugaacaucagccccaccggccugaagaacuacucccgcuga

SEQ ID NO: 1607 - RNA, 3345 nt, Artificial Sequence
  Cas9 variant
augggcaucaucaucgggcuggacaucggcaucgccagcguggggaucgccgucguggacaaggacacccucgacaucaagugcguggucuccgaccuguucgacagcgcggacgccuccaagaacaucgagcgccggaacaaccgccaggcccggcgccugaaccggcgccggaagacccgcaucggcgacuucaacacgcucugggugagcauguucggggagcugcccgaggagguggacuccaacguccugcuccugcggaacgccggccuggacgagcagcucacccuggacgagaucuacugcgugcugaaguacaugcucaagcaccgcggcaucagcuaccuggaggacgcccugaacgaggagaacgugaccggguccuaccagaagggcaucgcgaucaaccagcgggagagcgaguacaugcucccgugcgagauccagcuggagcgcuuccggaaguacgggcaguaccgcggcgagugcgaggccgagaacgagaacggggagaagaucacccuguccaacgucuucaugacgaacagcuaccggaaggagaucgacaaguuccucaacacccagggcaaguacggcauccugaaccagaaguucaucgacgaguaccugaagaucuucaaccgcaagcggaaguacuacgaggggcccggcaacgagaagucccgcaccgacuacgggaaguacaccacgggcaaggaccucgacggcaaguacaucaccgagaagaacaucuucgagaagcugaucgggaagugcagcguguacaaggaggagcugcgggccgccggcgcguccuacaccgcccaggaguucaacauccucaacgaccugaacaacaucaccgugaacaacaagaagcugacgacccagcagaagaaggacgucaucgagaucgugcagaacagcgaccgcaucaacauggagaagaucaucuccagcugcaucggggagaagaucgagaagaucgagggcgcccggaucgacaagaacgagaagaacaucuaccacaccuucgagcaguacaacaagaugcgcaagaucuucgccgagaagaacuacgacaucaaggagcucaccaucgagcagcuggacgagaucgggcgcauccugacgaucaacaccgagcgggagggcaucaaggacgccaucauggaguccgagcuccugcaccugaacaacgagcagaucaaccuccugaucgagcugcgcuacaagaacagcucccucuucaccaaguggcagagccugagcaucaaggcgaugcgggagaucauccccgaccuguacgaccgcaacgugaaccagaugaacauccucgccgagcggggcgucuucaaggacaagaucaaccuguucgagaacuccguguaccugcccaaggagccggugcucgaggagaucuacaaccccgucgugcgccggagcaucuccaugaccaucgacgcccugaacgcccugaucaagaaguacggguaccccgaggacaucgugaucgagaugccccgcgaccggaacgacgccgagcagaaggaccgcaucaagaaguuccagaagacgcgggagaacgagcucaagaacaucaagaagaagaucaaggaggaguacggcaucgagaucaccgacgaguacuuccgcaagcacaaggggcuggagcuggagcucaagcugugggucgagcagaacgagaagugcccguacagcggcaaguacaucaacgugcaggacauccuguaccaccacgagcuguucgagaucgaccacaucaucccccucuccaucagcuacgacgacucccggaacaacaaggugcuggucuacaaggaggagaaccaggacaaggggaaccgcacgccccugauguaccucagcaccgugaaccggcaguacgaccagcacgaguucaugaacuacguccuguccaccaagacccugccccgcaagaagcgggagcuccugcugaacuacgaggacaucaccaagaucgacgugcucaagggcuucaucaaccgcaaccugaacgacacccgguacgcgagccgcuccgugcugaacgccauccagcuguucuucggcgggaaggagugcgacacgaagguccgcgugauccggggcgccgugaccaaccagcuccgcaucaagcugaaccucccgaaggaccgggagaaguccuacagccaccacgccaucgacgccgcgaucaugugcuacagccagauggggcugaugaacuuccgcaacauccagaacaaguucaucgacuucgagaacgagaccuaccuguccgacgagcgggacagcugcuucgacaacaaguacuacgacgaggcccucuucggccagguccugaagaugcgcaagaaccugcucaaggccgaggggaagccccagcgguccgugcagagcaagggcguguucgacgaggaggagaagaacaacggcaucguccgcuaccaccacaagguggacaagaagcccaaccgggggcuguccaacgccagcaucuacggcacccgcaagaucgacgacaagaucuacaagaucgugggguacgacauccggaacaacaaggacgccgaggcgaucaucaacaucaucaagaagggcaagagcgacaacuuccugauggccaagcacgaccccgagacguucaagaaccucauggagaucuacgagcaguacaaggaggagaagaacccguuccuggccuacgagcaggagaccggcgacuacauccgcaaguacgccaagaaccacaacgggcccaucaucaagaagaucaaguacgucgacuccgaggugggcagcugcaucgacaucuccgcgaacuacggguacaagaacggcgacaagcgggugaucauggacacccugacccccuaccgcgccgacgucuacuacaacuacaaggacgggacguaccggaucaucggcgugaaguacgccgacuucaaguacagcaacgccaaguacgugcucgacgaggaggccuacgcgcugauccugaucaaggagggccuccugaagaucggggacucccuggagaacaucagcuccagcggcuacgaguaccgccucuccuucuacaagaacgacaucaucgaguacaccaagaacgacaucgucuacaaggagcgguuccugagccgcaccaugcccaaggugaagaacuacaucgagaccaagccgaucuccgccgcccuguacgagaagcggaaccccaucgggcucaccaacgccacgaacaucugcaagaucuacaccgacgugcugggcaacgagaccaagaucuacaaggagaaguucaagcugagcgucgacuga

SEQ ID NO: 1608 - RNA, 3345 nt, Artificial Sequence
  Cas9 variant
augaacuacaccgagaaggagaagcuguucaugaaguacauccucgcccuggacaucggcaucgccagcguggggugggcgauccuggacaaggaguccgagaccgucaucgaggccggcagcaacaucuuccccgaggccuccgccgccgacaaccagcuccgccgggacaugcgcggggcgaagcggaacaaccgccggcugaagacgcgcaucaacgacuucaucaagcugugggagaacaacaaccucagcaucccgcaguucaaguccaccgagaucgugggccugaaggugcgggccaucaccgaggagaucacccuggacgagcucuaccugauccuguacagcuaccucaagcaccgcgggaucuccuaccuggaggacgcccuggacgacacggucagcggcuccagcgccuacgcgaacggccucaagcugaacgccaaggagcuggagacccacuaccccugcgagauccagcaggagcggcucaacaccaucgggaaguaccgcggccagucccagaucaucaacgagaacggggaggugcuggaccugagcaacguguucaccaucggcgccuaccggaaggagauccagcgcgucuucgagauccagaagaaguaccaccccgagcucacggacgaguucugcgacggguacaugcugaucuucaaccggaagcgcaaguacuacgagggccccggcaacgagaagucccggaccgacuacgggcgcuucaccaccaagcuggacgccaacggcaacuacaucacggaggacaacaucuucgagaagcucaucgggaagugcagcguguacccggacgagcugcgggccgcggccgccuccuacaccgcccaggaguacaacgugcugaacgaccucaacaaccugaccaucaacggccgcaagcuggaggagaacgagaagcacgagaucgucgagcggaucaagagcuccaacaccaucaacaugcgcaagaucaucagcgacugcaugggcgagaacaucgacgacuucgccggggcgcggaucgacaaguccggcaaggagaucuuccacaaguucgagguguacaacaagaugcgcaaggcccuccuggagaucgggaucgacaucagcaacuacagccgcgaggagcuggacgagaucggcuacaucaugacgaucaacaccgacaaggaggccaugauggaggccuuccagaaguccuggaucgaccucagcgacgacgugaagcagugccugaucaacaugcggaagaccaacggggcccuguucaacaaguggcaguccuucagccucaagaucaugaacgagcugauccccgagauguacgcgcagcccaaggagcagaugacccugcucacggagaugggcgucaccaagggcacccaggaggaguucgccgggcugaaguacauccccguggacguggucuccgaggacaucuucaacccgguggugcgccggagcguccgcaucuccuucaagauccugaacgccgugcucaagaaguacaaggcccuggacaccaucgugaucgagaugccccgggaccgcaacagcgaggagcagaagaagcggaucaacgacucccagaagcugaacgagaaggagauggaguacaucgagaagaagcucgccgucacguacggcaucaagcugagccccuccgacuucagcucccagaagcagcugagccucaagcugaagcuguggaacgagcaggacgggaucugccuguacuccggcaagaccaucgaccccaacgacaucaucaacaacccgcagcuguucgagaucgaccacaucaucccccgcagcaucuccuucgacgacgcgcggagcaacaaggugcucguguaccgcuccgagaaccagaagaaggggaaccagacccccuacuacuaccugacccacagccacagcgagugguccuucgagcaguacaaggccacggucaugaaccucagcaagaagaaggaguacgccaucucccggaagaagauccagaaccugcuguacagcgaggacaucaccaagauggacgugcucaagggcuucaucaaccgcaacaucaacgacaccuccuacgccagccggcugguccugaacaccauccagaacuucuucauggcgaacgaggccgacacgaaggugaaggugaucaagggcuccuacacccaccagaugcgcugcaaccucaagcuggacaagaaccgggacgagagcuacucccaccacgccgucgacgccaugcugaucggguacagcgagcucggcuacgaggccuaccacaagcugcagggggaguucaucgacuucgagaccggcgagauccugcgcaaggacaugugggacgagaacauguccgacgagguguacgcggacuaccucuacgggaagaagugggccaacauccggaacgagguggucaaggccgagaagaacgugaaguacuggcacuacgugaugcgcaagagcaaccggggccugugcaaccagaccauccgcggcacgcgcgaguacgacgggaagcaguacaagaucaacaagcuggacauccggaccaaggagggcaucaaggucuucgccaagcucgccuucuccaagaaggacagcgaccgcgagcggcugcugguguaccucaacgaccgccggaccuucgacgaccugugcaagaucuacgaggacuacuccgacgcggccaaccccuucgugcaguacgagaaggagaccggggacaucauccgcaaguacagcaagaagcacaacggcccgcggaucgacaagcugaaguacaaggacggcgaggucggggccugcaucgacaucucccacaaguacggcuucgagaaggggagcaagaaggugauccucgagagccuggugcccuaccgcauggacgucuacuacaaggaggagaaccacuccuacuaccuggugggcgugaagcagagcgacaucaaguucgagaaggggcggaacgucaucgacgaggaggccuacgcccgcauccucgugaacgagaagaugauccagcccggccagucccgggcggaccuggagaaccugggcuucaaguucaagcucagcuucuacaagaacgacaucaucgaguacgagaaggacgggaagaucuacaccgagcgccuggugucccggacgaugcccaagcagcgcaacuacaucgagaccaagccgaucgacaaggccaaguucgagaagcagaaccuggucggccucgggaagaccaaguucaucaagaaguaccgguacgacauccugggcaacaaguacagcugcuccgaggagaaguucaccagcuucugcuga

SEQ ID NO: 1609 - RNA, 3348 nt, Artificial Sequence
  Cas9 variant
augagcgccaccuacaccaucggccuggacaucgggaucgccuccgugggcuggugcgcguucggggagacgcacauccucgaccugggcguccgcgccuucgacaaggccgagaccgccaaggagggggagagccugaaccucgcccggcgcaacgcgcggcugaugcgccggcgccuguuccggcgcaccuggcggcucaagaagcuggcccgccagcugaaguccgagggccucaucgccgacaccaagcuguucaagcccgagcugcccuucagcaagucccucuggcagcugcggguggacggccuggaccgccggcucaacgacgaggagugggcccgcgugaucuaccaccugugcaagcaccggggguuccacuggaucagccgcgcggaggccaagcaggccgagggcgacuccaagagcgagggcgggaaggucaagcaggggcuggccggcacggccaagcucauggacgagaagggcuaccgguccgcggccgagauggugcuggccgaguucccccaggcccagcgcaacaagcagggggaguaccagaaggcccugagccgggagcuccuggcgaaggagcuggcccuccuguucgcccagcagcgcgaguacggcaaccugcacacccccggggcccucgagaccgccauccugggcaacggcgacaagaaguccgggcuguucuggcagcagaagcccgcgcucgccggcaccgaccugcugaagaugcucgggacgugcaccuucgagaagggcgaguaccgggccccgaaggccagcuucaccgccgagcgccacguguggcugacccgccugaacaaccuccggaucgucacggacggggugacccgccagcugaccgagcaggagcggcagcugugccucccccugcccuaccgccaggcgggcgaccugaccuacaagcagcucggcuccgcccuggccaaggccgggcugcucgaggcgggcggguucaaguucacgggccuggccuaccccaccgaggcccagaaggccgaggggaaggccaaggacccggagagcgcgacccuggugaagauccccgccuggcacgagcuccggcagacccugacgaagggcggccugaacgacgagugggagaagcuggccggggacgcccucugcggccagcccgagaucuucgacaagaucgccuggguccuguccguguacaaggacgacgacgaggugcgcgcggagcuggccaagcucgcccugcccaacccgcaggcccugaccgaggcccuccugaacauccgguucgacaaguuccacagccugucccucaaggcgcugcgcgccaucgucccccacauggagcaggggcugcgguacgacgaggccugcgugcaggccggcuaccaccacagccagcuccugaaggugggggagggcgagcacaaguaccugccgccccucuacgacggccgcgacggggacggccggaugaucuucgcggaggacgccgacaucccccgcaaccccgucgugcugcggucccugaaccaggcccgcaagguggucaacgccaucauccggcgcuacgggagccccagcgccgugcacaucgagauggcgcgggaccucucccgccccuucgacgagcggaacaagaucaagaaggaccaggacgaguaccaggcccgcaaccagcgcgaccgggagcaguucagcgagcuguucggccacccgcccaagggccuggaguucgagaaguggcgccucuaccgggagcagaacgggcagugcgccuacucccagcgcccccugaccgccagcggcaacguggccgagaucuuccuggacggguccaccgagaucgaccacgcgcuccccuacagccgguccuucgacgacagcaagaacaacaagguccuggugcugacgcgcgagaaccgggacaagggcaaccgcaccccguacgaguaccucgggggcgccgagaacuccgagagcuggcagcgguucguguccuucgucgagagcaacaaggccuaccgccuggccaagcggacccgccugcuccggaaggacuucggcgccaaggaguccgaggaguuccgcgagcggaaccugaacgacacccgcuacgugugccgguucuucaagaacuacgucgagcagcaccugaagcucgcggaggggagcgagacgaagcgcugcgugguggucuccggccagcugaccaacuuccugcgggcccgcugggggcuccugaaggugcggagcgacuccgaccgccaccacgcccuggacgccgcgguggucgccgccugcagccacuccauggugcagcgccucagcaacuacagccggacccgcgagcuggagcagguccgggacggcuucguggacaucgagaccggggagaucgugaaccccgccaugcaccagcagcugcgcgagcacuuccccgaccccuggccguacuuccggcacgagcucgaggcccgccugaagaucgacucccccgagcugcuccgggaggagauggcgcgccugggcagcuacuccgaggaggagcugaaggugcucaagccccuguucgucagccgggccccgcagcgccggaacggcggggccgcccacaaggacacgaucuacggccagcccgagaagcugaagaagaacggguccgugacccagaagguggcccucaccagccugacccugaaggacaucgaccuccuggcggacccccaccgcaacgccaagcuguacggcgccauccgggagcgccucgaggcccacgggggcaagggcgacaaggccuuccccgcgacgaacccgcugcggaagcccgacaaggaggggaaccccaccggccccaucguccgcaccgugaccaaggugaucgacaagcuguccgggaucccgguccggggcgggaucgccaagaacgacaccaugcuccgcguggacguguucacgaagggcggcaaguuccaccugguccccguguacgugcaccaccgggucaccgggcugcccaaccgcgccaucaucgccuucaaggacgaggacgaguggacccucaucgacgacagcuucgacuggugcuucucccuguaccccaacgaccugcuccgcaucaagcugaagaaggagagccacuccggcuacuacagcuccugcaaccggagcaccggggccgugaaccugugggcgcacgaccgcaacgugaacgucggcaaggacggcuucaucgaguccaucggggugaagauggccgugagcaucgagaagcuccacgucgacacgcugggcaacaucuacccggccccgcccgagaagcggcgcgggcuggccuga

SEQ ID NO: 1610 - RNA, 3351 nt, Artificial Sequence
  Cas9 variant
augagccagaaccagaaccccaacacccagucccaccugaacccgaccacgcagagcuccacccagagcaacccccagcccaccacccaggagucccucaagauccugggcuucgacaucgggguggccagcaucggcugggccuucguggagggcggggagcugaaggacugcggggugcgcaucuucacgaaggcggagaaccccaaggacggcuccagccucgcccugccgcggcgcgaggcccggggcgugcgccggcgccuggcccggcgcaaggggcggcucaacgcccugaagguccugaucugcaaggaguucggccucaaccgcuccgacuaccuggcgaccgccggggagcugcccaaggccuacgccaccagcaaggagaccaagucccccuaccagcuccgggcggagagccuggagcgcaagcuguccgccgacgaguucgcccgggugauccuccacaucgccaagcaccgcggcuacgggaacaagcacgccaaggagagcuccgacgacgacagcggcaaggugaagaaggcgaucuccgagaaccagaaggucaugagcgagaagggcuacacgaccgccgggcaguaccuguacggcgaguucuaccagaaggcccggaacuucuccgaggccgagcccaagagcccgaagaacgcccgcgggacccaggaguucaagaacgugcggaacaagagcgagaacuacgcgcgcugccuggcccaguccgagcuccagaaggagcuggagaucaucuucgccaagcagcgggaguucggcuuccaguucagcgacaagaagcacaagaccaucaacgccaacggcaagcugaaggagcucgacuucgccgacgcggugcuggagaucgccuuccugcagcgcccccucaaguccuucgccgacaaggucgggaagugcacguucuacgaggacaagccccgggcccccaaggacagccuguccgccaucgaguucguggcgcugacccgcaucaucaacacccucgccaacaucaccaagcgcagcggcgagguguacuccgccgacaagguccgggagauccugagcaucgugcuggacaagggggagaucacguacaagaaccuccgcaaggugaucgcccuggacgagcggcugcaguucccgaaggacuccaagcucgacuacgcgaaggaggacgccgagaaggccaaggccaucgaguucagcaagcugaaggccuuccgcaaggcgcugggcggguccuucgagggcuucauccgggccgagcucgacagcaucgccaccgacaucgcccugaucaaguccaaggacgagcugaaggccaagcucgcgaacuaccagagccugaacgacgagcagcgcgagaagcuguccgagcucagcuucgacaaguucaucgaccuguccuucaaggcccuggaggccauccucccccugaugcggggcgacaaggacgacaagaucuaccgcuacgacgaggccuggcgggaggccgggcuggucgagguggcgaagaagacccagaagggcgacagccucccgccccugaucgaguacgagaaggaccuggccaaccccguggucgcccgcgcccuggcggaguaccggaaggugcucaacgcccugcugaagaagcacgggaaggugcacaagauccaccucgaguucacccgccaggccggcgucuccagcaaggagcgcggggagaucaucgccgagcagaacaagcggcugaaggccaacgaggaggcgcggaagcgcugcgaggaguacggccugauccccagcggcaagaacauccucaagcugaagcuguggcaggagcagggggaguucugcguguacuccggcaagaagaucacgcagagcgaccuccgggacgaguccacccugcagaucgaccacaucuaccccuacagccgcuccuacgacgacagccagaacaacaaggugcuggucuucaccgacgccaaccagaacaagcucaaccagacccccuacgaggccuucgggaaggacaucuccaaguggaaccagauccugggccggaucgagaagcugccgaaggccaagaagaaccgcaucacgaacaagaacuucgccaacaaggaggcgggguucaucgcccgcaacaucguggacaccagcuacaucgcccggcucuccgccagcuacaccgacgccuucaucgaguucugcccccuggcggagaacgaggacaccacgcugggccgcggcgagaagggguccaagaagcacaucagcgucgugaacggcucccucaccgccaccaugcggcacuacugggggcugaacacccugcucgacggcgagaacagcgaguccaaggaccgcagcaaccaccuccaccacgcccuggacgccaucaucaucgcguacgugaacgacuccgucaucaaggccuucagcgacuucaagaagacgcaggagcagaacaaggcccggcugaucgccaaggagaucgagagcgccgaguacaagaucucccgccgguucuucagccccuccggcuucgagaacaacgaggcguuccgccaggccaucaagcggaagauccuggggcagagccuggagucccgcgagaacgacaugaccaucaacagcgaggcccucggcgagaaggucgggggcaucuucguguccaagcccccgcggaagcgcgcccgcggggcccugcacaaggagaccuucagcuccaucgacgacaaggaccugcucaagaccuacggcggcaaggagggggugaaccgggcgaucaagcugggcaaggugcggcagaucgggagcaagaucgccgacaacggcacgauggugcgcgucgacaucuuccggcacaagguguccgggaaguucuacggcgugcccaucuacaccauggacuucgcccugggcauccuccccaacaaggccgucgucgggggcaaggacaagagcggggugaucaaggacuggcugcccauggacuccaacuacgaguucugcuucagccuguucaaggacgaccucauccuggugcagaagaaggagauguccaaggccgagcugugcuacuucgcgggcuucgacaccagcgggggccagaucaagguggagaagcacgacaaccacuucgccacccucaccgacaaccagcgccugcuguucaacaucgccacgccgaaggagguggccggcaaguccaucgggauccagaaccucaaggucuucgagaaguggcaggucagcccccugggcgagguguccaaggccgaguucaaggagcgggagcccaucgcgcucaagagcaccccgaagcgcuuccugcagggguga

SEQ ID NO: 1611 - RNA, 3354 nt, Artificial Sequence
  Cas9 variant
augaagcacauccugggccucgaccuggggagcaacuccaucggcugggccuucgugcagcaggacuucgagaacaagcaggggaagaucaucgccaccggcagccgcaucauccccauggaccaggggauccugggcgacuucgagcggggcaacaccgucucccagacggcggagcgcaccaccuaccggagcaugcgccggcuccgcgagcggcaccuccugcgccgggagcgccuccaccgggugcugcaccuccucggguuccugccgccccacuacgacgcccagaucgacuucaccaagcgcuacggcaaguucaucgacaacgccgagcccaagaucgccuacaacaacgggaacuucaucuucaugaacuccuucaacgagaugguggaggacuucaagaagcaccagccccagcuguucuacaagaaguccaacggcgaggagagccggaucccguacgacuggacgaucuacuaccuccgcaagaaggcccugagccagaagaucacccagcaggagcuggcguggcucauccugcacuucaaccagaagcggggguacuaccagcugcgcggcgaggaggagaccgagaaccccaacaaggaggucgccuuccacucccucaaggugguggacgucgaggccgaggcccccaacaagaagggcgagaucugguacaccauccggcuggagaacggguggaucuaccgccggacgagcaagaacccccuggacgacuggaagggcaagacccgcgacuucaucgugaccaccgaccucaacgacgacgggacgaucaagcuggacaaggagggcaaggagaagcgguccuuccgcgcgccggacgagaacgacuggaaccugcucaagaagaagaccgagcacgacaucgacuucagcggcaagcccguggggaccuacaucuacgaccaccuccugcagaaccccaaccagaagaucaagggcaagcugguccgcaccaucgagcggaaguacuacaaggacgagcugaaggccauccuggccaagcagaucgcccuccagcccgagcuguucacggagacccugcucgccgacugcauccgcgagcuguaccggaagaacgagacccagcagcagaaccugcucuccaaggacuuccugcaccuguucguggaggacaucaucuucuaccagcgcccgcucugcagcaagaaguccaccaucgcgaacugcacgcuggagaagcggagcuacaucgacaaggagaccaacgagcgcaaggacgcccccaucaaggugugcgccaaguccaaccccuacuaccaggaguuccggguccugcaguggcuccagaaccugcgcaucuacgagaucgagaccgaccgggaggugaccgccgaguucaucgagacgccccaggacuacgaggcccuguucaacuuccucaugagccagaaggagaucgacaacgaggggcugcugaaguacuuccucuucgcgaagaacccgcagaucaaggacaaggccgccaaguccgagcugaagaaguggcugaccaccuaccgcuggaacuacguguacgacgccgccgacaacagcagcaagaaguaccccaugaacgagaccggcuacgagcugcagcgguaccuccagaaggucgaggggcugcccgcgaacuuccugacguucgacaucaccuaccagcucuggcaccuccuguacuccgugaaggacaagguggaguucgagaaggcccugaagaaguucgccaagaagaagcagcuggacaagaccagcuucgucgacuccuucaagaacuucaagcccuacccgaacgaguacggcagcuucuccgagaaggccaucaagaagcugcucccccugaugcgcuucggcaaccacugggacuucaaccggaucgacgugagcacccagaagcgcaucgacgaccugaucaacgggguggccaacgaggacauccggacgaucauccgcgagaaggcggagaaguaccagcucaacuccgagaccugcuuccaggaccugccccuguggcucgcccaguacgucguguacaaccggcacgccgaggccaccgacaucgagaaguggaccagcguguccgaccuggaggcguaccuggaggacuucaagcagcacagccuccgcaaccccaucgucgagcaggucgugacggagacccugcggguggugcgcgacaucuggcagcaguacuccggcgggcaggccaacuucuucgacgagauccacaucgagcugggccgcgagcucaagaagaccgccgaggagcggaagcagcugagcgacaagaaccaggagaacgagaacaccaaccugcgcaucaagaagcuccuggccgagcugaaggaggacgccuccauccagaacguccggccguacagccucgugcagcaggagcugcugaagaucuacgaggaggggguguucuccagcaccgacgagaucgaggaggacauccagaagauccgcaagaaggucgagcccacgccgcccgagauccagcgguacaagcucuggcuggagcagaaguacaagucccccuacaccggcgaggugaucagccugaccaagcuguucaccgaggaguacgagaucgagcacaucaucccccagucccgcuacuacgacgacagccugagcaacaaggugaucugcgaguccgcggucaacaagcugaagacgaaccagcucggccuggaguucauccagaaccaccacggggagaaggugcggaucaccgccaacaaggaggugaccaucuucaccgaggagcaguacaaggaguucgucaagaagcacuacgccaacaacagcgccaagcagcagaagcugcuccugaacgagauccccgagaagaugguggcccgccagcugaacgacacgcgguacaucuccaagugcaucagcgagauccucuccaagaucgugcgcagcgacgagaaggacgagggcgucaacuccaagaacaucaucccgugcaccgggaagaucaccaccgcgcugaagcaggacuggggccugaacgacguguggaacgagcucauccugccccgguucgagcgcaugaaccagcugacgcagacccagcuguucaccagcuacaacgaccggcugcagaagaaccugcccaccgugcccaucgaguacucccagggguuccagaagaagcgcaucgaccaccggcaccacgccauggacgcccucgucaucgccugcgccacgcgcgagcacaucaacuacaugaacaaccagcacgcgcuggacaagagcaaggacaagaaggagaagcagcagucccggaucgaccugcacccgcucuga

SEQ ID NO: 1612 - RNA, 3354 nt, Artificial Sequence
  Cas9 variant
augcagaccaagaaccugcucuacacccugggccuggacaucgggaucgccagcgugggcuggugcguccucggggagaaccgcaucaucgaccugggcgugcggugcuucgacaaggccgagacgcccgaccgcggggagucccugaacaaggugcggcgcgacgcgcggcucaugcgccggcgccugcggcgccgggccuggcgccugaccaagcucgcccggcugcugaagcacgccggccucaucgacagcacccgcaucguccgggaccgccacgacggcgccgugucccccuggcagcugcggguggaggggcuggaccgcaagcucgcgcccgaggagugggcccgggucaucuaccacaucgugaagcaccgcggcuuccacuggaucagccgggccgaggagcgcaaggccgaguccgacaagggggagggcgggaaggugaagcagggccugagcgcgaccaagcagcugauggucgagaagaacuaccgcuccgccgccgagauggugcucacggaguuccccggcgcccagcggaacaagcgcggggaguacaccaaggcccugagccggauccugcucgcggccgagcugaccacccuguucgagcgccagcaggagcucggcaacccccacgccgggccggaccugcagacgaagauccugggcaacggcgaccggaaguccgggcuccuguggaugcagaagccgccccugagcggcuccgcccuccugaagaugcuggggaagugcaccuucgagcgcgaggaguaccgggcccccaaggcgagcuucaccgccgagcgccacguguggcucaccaagcugaacaaccugcggguccucguggacggcgugacgcgcccccuguccgaccccgagcggcgccuggcccucagccugcccuaccagcaggccuccgacuucaccuacaagcagcugcgggccgcgcucugcaagaacgggcugcugcccgacagcuuccaguucuccggccucgccuacccgaccggcgcccagcagcccgacgggaaggccaagaaccccgagaacgaccgccuggucaagcugcccgccuggcaggaguuccggaagacccuccgcgacgcgggccuggagacggagugggagagcaucgccgggauggccgccggcgggcagccggaccugcuggaccagaucggcugggugcucuccguguucaaggacggcgacgagguccugcgggagcugcgcaagaucccccuccccgggggcgagaagauggugcaggcgcugagcggggugagcuucgacaccuuccacaaccugucccucaaggcccugcggaagaucgucccccacauggaggccggccugcgcuacgacgaggccugccucgccgcgggguaccaccacagcgaccugcgcaaggacaccgacgagcggucccuguaccucccgccccuguacagcggccgcaccacggacggccggaugguguuccgcgacgacaucgacgugccccggaaccccgucgugcugcgcgccaucaaccaggcccggaccgucgugaacuccgugguccgccgguacgggagcccguccagcaugcacaucgagauggcccgcgaccucucccggcccugggacgagcgcaacaaggugaagcgggcccaggaggaguaccgcgaccggaacgagaagcugaagaucgacuucgcggccgaguacggcaucgagcccaagagccgcgaguucgagaaguuccugcucuaccgggagcagggcgggaagugcgccuacucccugaagccccuggaccucgaccgcgugcugcgggaccugggcuacgccgaggucgaccacgcccucccguacagccgcuccuucgacgacagcaagaacaacaaggugcuggugcuggcggaggagaaccggaacaaggggaaccgcacccccuacgaguaccucgacggcaccuccgagagcccccgcuggcgggaguucaaggccuucgucgagacgaacaaggccuaccgccuggccaagcgggcgcgccugcuccggaaggacuucuccgggaagggcagcgaggaguuccgcgaccggaaccugaacgacacccgcuacaucucccgguucuucaagaacuacguggagcgcuuccugaagcucgccgaggagagcgaggagcggaccugcgugguccugagcgggcagcugaccgccuuccuccgcgcccgguggggccuggccaaggugcgcggcgacuccgaccggcaccacgcgcuggacgccgccgugaucgccgccugcagccgcuccauggucaagcggcucagcgacuacgcgcgccggcacgagcuggagaaggugcgcacgggguucguggacuucgagaccggcgagaucgucgacgccgggaaguaccgccagaucgagcgggacuucccgucccccuggcccuacuuccgcgacgagcugcucacccggcugaacaccgacgaccccgccgagcugcgcgagcggaugcagagccucggcuccuacccgcccgaggcccuggagacgcugcgccccauguucgugagccgggcgccccagcgccggaacgggggcgccgcccacaaggacaccaucuaccgccagaccgagcggcucaagaaggugggcuccgucacccagaaggugccgcuggccgcccugaaccuccgcgaccuggagaaccugguggacccccaccggaacgagaagcucuacgcggccauccgcgcccggcuggaggcccacgggggcaagggggagaaggccuucccgcccaacaacccccugcgcaagcccgaccgggacggcaaccccacggggcccaucguccgcaccgugacccucgugaucgacaagaugagcggcaucccgguccggggcgggguggcgaagaacgacaccaugcugcgcguggacaucuuccgguccaagaaggacggcaaguuccaccuggucccccucuacgugcaccacgccguggccaagcagcugcccacccgcgccgucaucgccuacaaggacgagggggaguggacgcccaucaacaaccacgacuucgacuuccuguucgcgcucuacccgaacgaccuggugcgcaucacccugaagaaggagcggcacuucggcuacuacgccgggugcaaccgcgccaccggcgccgugagcaucugggcccacgaccggaaccagcgcaucggcaaggacggguucaucgacggcaucggggucaagaccgcgcucuccguggagaaguuccacguggacacgcugggcaacgucuaccccgccccgcccgagacccggcgcggccuggccuga

SEQ ID NO: 1613 - RNA, 3357 nt, Artificial Sequence
  Cas9 variant
augggcacccgcuacagcuucgacaucgggaccaacagcaucggcugggccguguggcggacggggcgcgaccccaagggcaucuucggggagaaggacgccccgcuggagcuccugggcgcgggcguccggcuguucaaggacgggcgcaaccccaaggacggccagagccucgccaccaugcggcgcaucccccggcaggcccgcaagcggcgcgaccgguucgugcugcgccgggaggcccugguggccgcgcucaucgaggccgggcugaugcccgccuccgagaaggagcgcaaggcccuggcggaccucgacccguaccagcugcgggccgccggccuggacaaggcccucgcgccccacgagcuggggcgcgccaucuuccaccuccaccagcggcgcggcuucaagagcaaccggaagaccgaccgcaaguccgacgaccgggacaagggcaagaucgccaccgccagcgccgcccucgcgaagaaguucgaggacgagaacgcccgcacguucggggaguuccuguggcgccggcaccgcgaccccgacaugaagcggcaggccguccugaaggcccacgaccccgccaagggcaagccggaccuccgcgcggccaagcugcggcagcccacccgcauccggcuggaggggcagggcgccaccgcccucuacgaguucuaccccacccgcgagaugcugugccacgaguucgacgcccugugggaggcgcaggcccggcaccaccccaugcuccugacgcgcgaggccggcgacaagauccgguccauccuguuccgccagcgggagcucaagccgccccugaucgggcugugcaccuucgaguacgccgcgggcgagaaggagagccgccuccccaaggcccugcccuccgugcaggcccgggagaucuacgagcgccuggggcacauccggcucagcaccggcuccgggaccgaccgcccgcucaagagcuccgagcgggacgaccuggccacggcccugcugcacugcggccugaccaagaucaaggugagcaagaccaagggccucgcguucaagaccgaguuccgcaaggcccugcgccucgggggcgagguccggaucaacuucgaggagaugggggaggagggccugguggaccugcgcacgaaccggcugcucgugcaggacgaccacuacgggccccgcuggcgggcccuguccuggagcggcaaggacgccuucgucaagaagcugcucgaggccaccgacgacgacaagcugguggcgcgccugaugaccgaggacggccuguccgccgugcaggcccggaacgccgccagcaucccccuccccgacggguacucccgccugggcccgaccgcgaacgccgccauccugcaggcccucaucgacagccgggacgagaacggguucgucgugacguacgacaaggcggugcgccgggccggcgagcgccuggggaaggacuggcaccacagcgacgagcgggacggcgagauccuggacgcccuccccuacuacggcaagguccugcagcgccacauccugcccgggaugauggaccccgccgaccggaaggacgaggccaaguucuacggccgcaucaugaacccguccgugcacaucgggcucaaccagcugcggcgccuggugaacgcgcucaucgagcgguucggcccgcccgaccagaucgucguggagcuggcccgcgaccugaagaugagcgcccgggagaaggagcaggagcagcgccgcaaccgggacaaccgcgaggccaacgagaagcggaccaagaagcucguggagcugggccaggacaacaacggggagaaccgcgcccggcugaagcucuacgacgagcagcagcgcgcgggcaacggggucgcccacugccccuucacccuggaccccaucggcaucacccagcuguucucccccgagaucgagaucgagcacgugcucccccggagccgcacgcuggacgacuccgccgccaacaaggugcugugcuuccggaccaucaaccgcaucaagcgggggaagaccccgugggaggccuuccacgcggaccccaaguggcccgacaucgccgccaacgccgagaagcugcccccgaacaagcgcuggcgguuccgcgaggacgcgauggacgucuucgaggcccggaccagcggcaagauggacaagacgacccuggagcagaugggccugaccaccggguuccaggcccgccaccucaacgagacgaagcacaugucccggcuggccaaggccuaccugggcaagaucugcgaccccgacgcgguguacgucacccccggggcccucaccagccugcugcgcggcaagugggggcucaacuccauccugagcgacgacaaccugaaggaccggaccgaccaccgccaccacgccaucgacgccaucacgaucggcgccaugacccgcucccuccugcuggagcucaacacccuggcgggcaaggccgagcagagcgacuacgacgacgugguggggaagguccccuggccguucgacaacuuccgggacgccgugcgcuccguggucgaccgggugguggucagcaacaagcccgagcacggcaagcagggggcccugcacgaggacaccgccuacggcaucgugggggacgaggcggaggccgaggagaucggcaaccucgugcgccggaagcugcuggucgaccucacccccggcgagguggaccgcauccgggacgccgggcugcgcaaggccaugcaggccgcgguggcccccucccgggacgcccgcggcaaggucagcgacgccaagggguucgcggccgcccuggacacguucgccaaggcccagggcaugcggcgcauccggguggggaaggaggacauguccgcggugaccauccacgaccgccagaccgacaaggccuacaaggccgucgccccgggcgagaaccaccacguggacgugguccagaugcgggacggcgccuggaagggguucgcggugaccguguucgaggccaaccagaaggacuuccgcccccagugggagcgggagaagcucggcgggaagcuggucaugcgccugcacaagggcgacgccguggagcucgagagcuccggcgugcggcuggucaaguucgugcagcagaucuggaugaaguccaaccuggugcuccugacggagcacaacgagggcggggaccugcagaagcgccaccaggacgccgacgaccccuuccggugggacuucgccaacaucgggaagcucaaggagcgcggcugcgucgcggugaagguggacgagcuggggcgcgucaccaagcggaucagcaacaccuga

SEQ ID NO: 1614 - RNA, 3360 nt, Artificial Sequence
  Cas9 variant
augggcuaccgcaucgggcuggacgugggcaucaccagcaccggguacgccguccucaagacggacaagaacggccugcccuacaagauccugacccucgacuccgugaucuacccgcgggccgagaacccccagaccggggcgagccuggccgagccccgccggaucaagcgcggccugcggcgccggacccgccggacgaaguuccgcaagcagcggacccagcagcuguucauccacuccggccuccugagcaagcccgagaucgagcagauccucgccaccccgcaggccaaguacuccguguacgagcugcgcgucgccgggcuggaccggcgccucaccaacagcgagcuguuccgggugcuguacuucuucaucggccaccgcggguucaaguccaaccggaaggcggagcucaaccccgagaacgaggccgacaagaagcagaugggccagcugcugaacagcaucgaggagauccgcaaggccaucgccgagaagggguaccggacggugggcgagcucuaccugaaggaccccaaguacaacgaccacaagcgcaacaagggcuacaucgacggguaccuguccacccccaaccggcagaugcucgucgacgagaucaagcagauccuggacaagcagcgcgagcugggcaacgagaagcucaccgacgaguucuacgcgaccuaccugcugggggacgagaaccgcgccggcaucuuccaggcccagcgggacuucgacgagggcccgggggccggccccuacgccggggaccagaucaagaagauggugggcaaggacaucuucgagcccacggaggaccgcgcggccaaggccaccuacaccuuccaguacuucaaccuccugcagaagaugaccagccugaacuaccagaacacgaccggggacaccuggcacacccucaacggccuggaccggcaggccaucaucgacgccguguucgcgaaggccgagaagcccacgaagaccuacaagccgaccgacuucggcgagcugcgcaagcuccugaagcugcccgacgacgcccgguucaaccucgucaacuacgggucccugcagacccagaaggagaucgagacgguggagaagaagacccgcuucguggacuucaaggccuaccacgaccuggucaaggugcuccccgaggagauguggcagagccggcagcugcuggaccacaucggcaccgcccucacccuguacuccagcgacaagcgccggcgccgguacuucgcggaggagcugaaccuccccgccgagcugaucgagaagcugcucccgcugaacuucuccaaguucgggcaccugagcaucaaguccaugcagaacaucauccccuaccuggagaugggccagguguacagcgaggccacgaccaacaccggguacgacuuccgcaagaagcagaucuccaaggacaccauccgggaggagaucacgaaccccgucgugcgccgggccgugaccaagaccaucaagaucgucgagcagaucauccgccgguacggcaagcccgacggcaucaacaucgagcucgcccgcgagcuggggcggaacuucaaggagcgcggcgacauccagaagcgccaggacaagaaccggcagaccaacgacaagaucgcggccgagcugacggagcucgggaucccggugaacggccagaacaucauccgcuacaagcugcacaaggagcagaacgggguggaccccuacaccggcgaccagauccccuucgagcgggccuucagcgagggcuacgaggucgaccacaucauccccuacagcaucuccugggacgacagcuacaccaacaaggugcugaccuccgccaagugcaaccgcgagaaggggaaccggaucccgaugguguaccucgcgaacaacgagcagcgccugaacgcccugaccaacaucgccgacaacaucauccggaacagccgcaagcggcagaagcuccugaagcagaagcuguccgacgaggagcucaaggacuggaagcagcgcaacaucaacgacacgcgguucaucacccgcguccuguacaacuacuuccggcaggccaucgaguucaaccccgagcuggagaagaagcagcgcgugcucccccugaacggcgaggucaccagcaagauccggucccgcuggggguuccugaaggugcgggaggacggcgaccuccaccacgccaucgacgcgaccgugaucgccgccaucacgcccaaguucauccagcaggucaccaaguacagccagcaccaggaggugaagaacaaccaggcccuguggcacgacgccgagaucaaggacgcggaguacgccgccgaggcccagcgcauggacgccgaccuguucaacaagaucuucaacggcuucccgcuccccuggcccgaguuccuggacgagcugcucgcgcggaucuccgacaacccgguggagaugaugaagucccgcagcuggaacaccuacacccccaucgagaucgccaagcugaagcccgucuucguggugcggcuggccaaccacaagaucagcgggcccgcccaccucgacacgauccgcuccgcgaagcuguucgacgagaagggcaucguccugagccgcguguccaucaccaagcucaagaucaacaagaagggccagguggccaccggggacgggaucuacgacccggagaacagcaacaacggcgacaaggucguguacuccgccauccggcaggcccuggaggcccacaacggcagcggggagcuggcguuccccgacggcuaccucgaguacguggaccacgggaccaagaagcugguccgcaaggugcggguggccaagaaggucucccugcccgugcgccucaagaacaaggccgccgccgacaacggcagcauggugcggaucgacgucuucaacacggggaagaaguucguguucgugcccaucuacaucaaggacaccgucgagcagguccugccgaacaaggcgaucgcccgcggcaagagccugugguaccagaucaccgaguccgaccaguucugcuucagccucuaccccggcgacauggugcacaucgaguccaagaccgggaucaagcccaaguacagcaacaaggagaacaacacguccguggugcccaucaagaacuucuacggcuacuucgacggggccgacaucgccaccgccagcauccuggugcgggcgcacgacuccagcuacaccgcccgcuccaucggcaucgccgggcugcucaaguucgagaaguaccaggucgacuacuucggccgguaccacaaggugcacgagaagaagcgccagcuguucgugaagcgggacgaguga

SEQ ID NO: 1615 - RNA, 3360 nt, Artificial Sequence
  Cas9 variant
augaacgacaagaagaaccugggcccccucaccuucggguucgacaucggcaucgccagcguggggugggccguccuguccccgacccgcaucguggaccugggcgugcggugcuucgacaaggcggagacggccaaggagggggagagccucaaccuggcccgccgguccgcccgccugaugcggcgccggcuccgccggcgcgccuggcggcugaucaagcuggcgcgccuccugaagcacgagggccugaucgccgacaccaagaccuucauccagcccagcgccucccacgccagccccuggcagcuccggaaggacggccuggaccgcgcgcugucccccgaggagugggcccggguccucuaccaccugugcaagcaccgcggguuccacugggugagccgggccgaggcccgcaaggccgacggcgacaccaagggggagggcgggaaggugaagcagggccuggcguccacgaccaagcucaugaacgacaagagcuaccggaccgccgccgagaugguccuggccgaguucccguccgcccagcgcaacaagcggggcgaguacaccaaggcgcugagccgcgagcuccuggacaacgagcugaagcagcuguucgagcgccagcgggaguacgggaacccccacgccgacacgaaccucgaggccaagauccgcggcuccggggaccacaagagcggccuguucugggagcagaagcccgcccucuccggcaacgaccugcugaagaugcucgggaagugcaccuucgagaagcaggaguaccgggcccccaaggcgagcuucaccgccgagcgccacguguggcugacccggcugaacaaccuccgcaucaucguggacggccggacgcgcccgcuggccgacgccgagcggaccauggcccugucccuccccuacgagcaggucggggacuucaccuacaagcagcugcgcgcggcccuggugaaggccggccucaugcccgacagcuucaaguucgccucccuggcguaccccagcgaguuccagaaggccgaggggaaggccaaggacccggagagcgccgcccugaccaagcucgcggccuggcaggagcugcgggccacgcugaagaaggccgaccucgaguccgaguggcagcagaucagcugcgccgcgcuggagggccagcccgagacccuggacgagaucgccggcgugcucuccgucuucaaggacgacgacgaggugcugaacgagcugcagaagcuggggcuccccggcggggccaagaccgagaacgcccugcuggacauccgcuucgacaaguuccacgcccucagccugaaggcgcugcggaagaucgugcccuacauggagcgcggccuccgguacgacgaggccugcgagcgcgccgaguaccaccacucccagcugcacaaggucggggagggcaaccggaaguaccugccgccccucuacaagagccgcgacaaggacggccggaugguguucaacgacgagcugggggacaucccccgcaaccccgugguccugcgcucccucaaccaggcccggaaggugcugaacgcgcugaucgcccgcuacggcagcccguccagcgugcacaucgagauggcccgggagcucuccaagcccuucgacgagcgcaugaaggucgggaaggagcaggaggccuaccgggagcgcaacgagaaggacaagcagaccuucguggccgaguucggcaucgugggggcggccaagggcggcgaguucgagaaguggaagcuguaccgggagcagcaggggaagugcgccuacagcauccagggcaucgaccugaaccgccuccuggagcccggguacgucgagaucgaccacgcccugcccuacucccggagcuucgacgacuccaagagcaacaaggugcucguccuggccgcggagaaccgcaacaagggcaaccggacgccguacgaguaccuggacggcgagcacaacuccgagcgcuggcggcaguucgugggguucguggagagcaacaagcucuaccgccaggccaagcggucccgccugcugcggaaggacuucggcaaggagcaggccgacgaguuccgcgagcggaaccucaacgacacccgcuacgucugccgguucuucaagaaccagguggagcaguuccugaagcuggccgaggggagcgagagcaagcgcugcgugguccucuccggccagcugaccgccuuccugcgcgcgcggugggggcucaucaaggugcgcgacgagagcgaccggcaccacgcccuggacgccguggucguggccgcgugcacccacggcauggugaagcgcauguccgacuacgcccggcgcaaggagcuggaccaggucgccgagggcuucguggacguggagacgggggagaucaucaacgccgccauguuccagcagcuccacgagcacuuccccgaccccuggccccacuuccgggacgagguccagaugcgccugaagaucgacgacccggcgcagcugcggagcgaccuccugcgccugggcaacuacgccgaggaggacgugcacgccgugcggccccucuucgucucccgcgcgccccagcggcgcaacagcggggccgcccacaaggagaccaucuacggccagccggagcggcugaaggcccagggcggggugaccgagaagguggcccugaccgcccucacgaugaaggaccuggaccgccugaucgacccccaccggaacgagaagcucuacgccgcgauccgcaagcggcuggaggaguucggcgggaaggccgacaaggccuucgccgccuccaacccccugcacaagcccgacaaggagggcaacccgaccgggcccaucguccgcaccgugacccucgagaucgacaagcugagcggcgugcccguccgcgggggcaucgcgaagaacgacacgaugcugcggguggacguguucaccaaggccggcaaguuccaccucguccccguguacgugcaccacaaggucaccgggcugccgaaccgcgccaucguggccuccaaggacgaggacgaguggaccgcgaucgacgacagcuucgaguuccuguucucccucuaccccaacgaccuggugacgaucacccagaagggcaaggcccccguccggggguacuacgccagcugccaccgcggcaccggggccuucucccugugggcccacgaccgggcgagcuccgugggcaagggcgggcagaucgagggcaucgggaucaagaccgcccucgccgugcagaaguacaacgucgacgugcugggcaccacguacgccgcgccccuggagcagcgccggggccucgccuga

SEQ ID NO: 1616 - RNA, 3363 nt, Artificial Sequence
  Cas9 variant
augcgcaaggugaccaucggcuucgacaucggggucagcuccgugggcuggagcguggucgacaugaacaacggggccaucguggagaccggcgugcggcuguucuccgccagcuccgcggagaacaacgucgagcgccggaacaaccgccagacgcggcgccucaaccggcgccggaagaaccgccugaaggacgugaaguaccugcucgagaccaaccacuucaccuucgaccaggagcaggggaccaaccccuacgagcugcggguggccggccugcaccgcaagcucacgcggagcgagcuggcccgcgcccuguaccaccucgucaagcggcgcggcaucuccuacgaccugaccgacaucgaggaggaggagaucgugaccaccagcgccuacaagacggcgcuggggaagaaccagucccagcucgccgagaagaccccgggcgagauccaguucgcccggcuggagaacuacgggaaggugcgcggcagcaucgagaucaacgagcaggacauccugcucaacaucuuccccaccuccgccuaccugaacgaggcgaagcggauccuggccacccagcgcaaguucuaccccgagaucacggaggccuucaucgagaaguacugcaccauccucacccggaagcgcgaguacuacgucgggcccggcaccgagaagaaccgcacggacuacggcaucuaccggaccaacggggagacccuggacaaccuguucgagauccucaucggcaaggacaaguucuacccgaacgaggagcgcgccgccgggaacagcuacaccgcgcagcuguucaacuucgugaacgaccugaacaaccucaagauccagacgaucgaggaccagaagcugacccccaagcagaaggaggagaucaucgagcaggucaagaccgccgagaagaaggugucccugauccagcucaucagcaagaucaccaagacgcccaaggaccagaucaccggcuaccggaccgacaagaacggcaagcccgaccugcacuccauggccguguuccgcaaggugcggaagcaguuccugaccauggagaucgacauccuccacuggccggacgagcugcugaacgaccucgggcgccugcugacgcucaacaccgagaagggcgagauccggaagcagcugaccaaggacuucaugaagcgcuaccccauccugaacgagcagcucgucgaccagaucaucgagaaccggcacaucuucgccgugagcgggaaccacaaguggcaccgcuucucccugcggaccaugaacgagcugcuccccgagaugcuggccacgagcaaggagcagaugacccugcucuccgagcgcggcaugaucaagcagcacaagcgggacuaccugaagaugaacgagcuggacgcgcgccucaucagcgaggagaucuacaaccccguggucggcaagagcgugcgggaggccaucaagcuguucaacgagcugaugaagaaguaccaggaggugcgcuacgucgugcuggagaugccgcgggacgacaacgaggagaaggccaagaaggagcuccagaaguaccagaaggagaacgagaacgagaaggagaucgcccuguccgaguuccagcgcaagggguucuucagcgacgcccagcuggagcgggcgcucaucaaggaccgcaagcugaagaccaagauccgcuucuggcaccagcaggagggcaagugccuguacuccgggcagaucaucacccccgucgagcuccugacgaacagcuucuccuucgacaucgaccacaucaucccccagagcguguccuucgacgacagccugaacaacaaggugcucugcaccaaggagaugaacgaccagaagggcaagcagacccccuacggguuccugcugaacggcaacgggcagggcuucgaccgguucaaggccauggucaacgccaaccgccucauguccaagggcaagaagaagaaccugcuguucauggaggaccucaacaacaucgagacccggaagcgcuucaucgcccggaaccugguggacacccgcuacgccagccgggugguccugaacgagauccagcaguaccuccgcgcgaagaacaaggacacccagguggccgugguccgggggaaguucacggccacccugcgcaagcacuggaacaucaacaagucccgggagacccaccaccaccacgcccuggacgcgagcaucaucgccaucacgccgcuccuguccguguggaagaagaagcagacccugauccccaagacccucagcgaggagaagcuggaguucgaguacgacgacaucguggaggacaccaucuucgagaaggcccuguaccagcuccccaaggagaacuucaaggagcagcugaacaacucccagcccaacaucaaguucagcuaccaggucgacaagaagaugaaccgcaagguguccgacgccacgaucuacagcgugaagcaggccaagcuguccagcgacaagcagagcgaggaguacguccucgcgaagaucaaggacaucuacuccguggagggcuacaagaccuucgccaagaucuacgagaaggacaagagcaaguuccugauggcccagaacgacccgaagaccuucgagaagcuggaggagaucauccaguccuaccccagcacccgggagaucaucgugggggagaaggucaaggugguggacgucucccccuucgagcucuaccgcaaggaguacggcuacaucacgaaguacgccaagaagaacaacgggcccaucauccggcagcugaaguacuacgaccacaagaucggcaugcaccuggacaucaccaaccagaagaacaacggcaaggggaagaaggugauccuccagcagcucaagagcuggcgcaccgacguguacuacaaccacgagaagcaggaguacgagaucaugggccugaaguacuccgaccugcgguucaagaaggaccaguacgggaucccgaaggagcgcuaccaggaggucaagcagauggagaagaucgcgccccagagcgaguucugcuucucccuguaccggaacgaccgcaucaaggugcugaacaaggagaccgacgaggagguggagcuccuguucggcgcccggaacuacacgagcgccggcuacgucgaccugaagcccaucgaccgcguggaguucgggaagaaggaguggauccccguguaccaguacgccaccuccgacggcaagugcaagaagaaguucgccaagaagggguacgagaucuacaaggucaacaccaccauccucggcgagagcuacuacaucaagaaggagcgcaugcugccgaagaacauccuggacuga

SEQ ID NO: 1617 - RNA, 3363 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgccgggugcgccugaaccgccucuucgaggagaucggccugaucaccgacuucaccaagaucuccaucaaccugaacccguaccagcuccgggugaaggggcugaccgacgagcugagcaacgaggagcuguucaucgcccugaagaacauggucaagcaccggggcaucuccuaccuggacgacgccagcgacgacgggaacuccagcgugggcgacuacgcccagaucgugaaggagaacuccaagcagcucgagacgaagacccccgggcagauccagcuggagcgcuaccagaccuacggccagcugcggggcgacuucaccgucgagaaggacgggaagaagcaccgccucaucaacguguuccccacgagcgccuaccgguccgaggcgcugcgcauccugcagacccagcaggaguucaacccccagaucaccgacgaguucaucaaccgguaccucgagauccugaccggcaagcgcaaguacuaccacgggccgggcaacgagaagucccggacggacuacggccgcuaccgcaccagcggggagacccuggacaacaucuucggcauccucaucgggaagugcaccuucuaccccgacgaguuccgggccgccaaggccagcuacacggcgcaggaguucaaccugcugaacgaccucaacaaccugaccgugcccaccgagaccaagaagcuguccaaggagcagaagaaccagaucaucaacuacgucaagaacgagaaggccaugggccccgccaagcuguucaaguacaucgccaagcuccugagcugcgacguggccgacaucaagggguaccgcaucgacaaguccggcaaggcggagauccacacguucgaggccuaccggaagaugaagacccucgagacccuggacaucgagcagauggaccgcgagacccuggacaagcucgccuacgugcugacgcugaacaccgagcgggagggcauccaggaggcccucgagcacgaguucgccgacgggagcuucucccagaagcaggucgacgagcuggugcaguuccgcaaggcgaacagcagcaucuucggcaagggguggcacaacuucuccgugaagcugaugauggagcucaucccggagcuguacgagaccagcgaggagcagaugaccauccugacgcggcucggcaagcagaagaccaccuccagcuccaacaagaccaaguacaucgacgagaagcugcugacggaggagaucuacaaccccgucguggccaagagcgugcgccaggccaucaagaucgucaacgccgccaucaaggaguacggggacuucgacaacaucgugaucgagauggcgcgggagaccaacgaggacgacgagaagaaggccauccagaagauccagaaggccaacaaggacgagaaggacgccgccaugcucaaggcggccaaccaguacaacggcaaggccgagcugccccacuccguguuccacggccacaagcagcuggccaccaagauccgccuguggcaccagcagggggagcggugccucuacaccggcaagacgaucagcauccacgaccugaucaacaaccccaaccaguucgaggucgaccacauccugccgcucuccaucaccuucgacgacagccuggcgaacaaggugcuggucuacgccaccgccaaccaggagaaggggcagcgcacccccuaccaggcccucgacuccauggacgacgccuggagcuuccgggagcugaaggcguucgugcgcgaguccaagacccugagcaacaagaagaaggaguaccuccugacggaggaggacaucuccaaguucgacgugcggaagaaguucaucgagcgcaaccuggucgacacccgguacgccagccgcguggugcucaacgcccugcaggagcacuuccgggcccacaagaucgacaccaaggucuccguggugcgcggccaguucaccagccagcugcgccggcacugggggaucgagaagacgcgcgacaccuaccaccaccacgccgucgacgcgcucaucaucgccgccuccagccagcugaaccuguggaagaagcagaagaacacccucgugagcuacuccgaggaccagcugcuggacaucgagaccggcgagcucaucagcgacgacgaguacaaggaguccguguucaaggcccccuaccagcacuucgucgacacgcucaagagcaaggaguucgaggacuccauccuguucagcuaccagguggacuccaaguucaaccggaagaucagcgacgccaccaucuacgcgacccgccaggccaaggugggcaaggacaaggccgacgagaccuacguccucgggaagaucaaggacaucuacacgcaggacggcuacgacgccuucaugaagaucuacaagaaggacaaguccaaguuccugauguaccggcacgacccccagaccuucgagaaggugaucgagccgauccuggagaacuaccccaacaagcagaugaacgagaaggggaaggaggugcccugcaaccccuuccucaaguacaaggaggagcacggcuacauccgcaaguacagcaagaagggcaacgggccggagaucaagucccugaaguacuacgacagcaagcugggcaaccacaucgacaucacccccaaggacuccaacaacaaggucgugcuccagagccugaagcccuggcggaccgacguguacuucaacaagaacacggggaaguacgagauccugggccucaaguacuccgacaugcaguucgagaaggggaccggcaaguacagcaucuccaaggagcaguacgagaacaucaagguccgcgagggcguggacgagaacagcgaguucaaguucacccuguacaagaacgaccugcuccugcugaaggacagcgagaacggggagcagauccuccugcgguucaccucccgcaacgacacgagcaagcacuacguggagcugaagcccuacaaccggcagaaguucgagggcuccgaguaccucaucaagagccuggggaccgucgugaagggcgggcgcugcaucaagggccugggcaaguccaacaucagcaucuacaaggugcggaccgacguccucgggaaccagcacaucaucaagaacgagggcgacaagccgaagcuggacuucuga

SEQ ID NO: 1618 - RNA, 3363 nt, Artificial Sequence
  Cas9 variant
augggccuggacaucgggguggccagcgucggcuucuccgugcucgacaucgacaaggggaaggugaucgagcugggcgcccgccuguucagcgcgaccgucgccgccgggaaccaggaccggcgcgacaugcggggcgcccgccggcuccugaaccgcaacaagcagcggcgccaggacaccggcaagcuguucaagaaguucgggcucaucgacgacuucgacaagggcuccuucuacgacaacuucaaccagaaccugaaccccuacgagcugcgggugaaggggcucacggagcagcugaccaaggaggagcuggccgagagccucuaccagaucgugaagcaccgcggcaucuccuacgcgcugaaggacgccgacgucgacgagggcgggaccgacuacagcgugucccugaagaucaacagccaggagcucgccgagaagaccccggcccagauccagcugcagcggcugaacgacuacggcaaggugcgcgggcaggucgugaucggcgacgaccccgacaaccagaaggugcuccugaacgucuuccccacguccgcguacgagaaggaggccaagcagaucaucgccacccagcagcaguucuaccccgagagccugaccgacaaguucaccgaggaguacugccagauccucacgcggaagcgcgacuacuucguggggccgggcaacgagaagucccggaccgacuacggcaucuacaagaccgacgggcgcacccuggacaaccuguucgaggagcucaucggccacgacaagaucuaccccgaggagcugcgggccagcgccgcguccuacacggcccagcuguucaacgugcucaacgaccugaacaaccugcgcauccucaacuacgaggacgggaagcugaccaaggaggacaaggagaagaucaucgccgagaucaagaacaacaccaccacgaucaacaugcugaacgucaucaagaagguggccggcugcagcaaggacgacaucaagggguuccgggugaacgagaaggacaagcccgagaucuccagcaugcccgucuaccgcaagauccacaaggaccuccugaaggccggcguggacaucuccgacuggccgguggaguucaucgacgagcugagcuucauccucacccugaacaccgagaacggcgagauccggaagcagcugaacaaccgccucgcgcccaaguucgacuuccugaacgccgaccugauccagcucaucaucgacaacaaggacuccuucgagaucaagaccaacaacaaguggcaccgcuucagcgucaagacgaugaacaagcugauccccgagaugauggagcggcccguggagcagaugacccugcucaacgagauggggcuggugaagaaggacaagaagcgcuucgagaacaacaaguaccugccguacaaggagaucgccaaggacaucuucaaccccgucgccagcaaguccgugcgggaggcccucaagaucgucaacgcggugcugaagaaguacggccacaucgacuaccugguggucgagaugccccgcgacaagaaccugaaggaggagcaggacaacaucaaggaguuccagaacaagaacaagaaggccaaggacgccgccuucgaggccuucgucaagagcgugggguccgagcagcgggugaaggaggcgcucagcaagaaccgcaagcugcagaugaagaugcggcugugguaccagcagcaggagaucgaccccuacaacggcaagaccaucgacgccaccgaccucaucaacaacccggacaaguucgagaucgaccacaucaucccccaguccaucagcuucuacgacuccaucaacaacaagacgcugugcuucgccagcaugaaccaggugaaggggcagaagacccccuacgaguucaugcuggagggccacggccaguccuacgacaaguucaaggccaccgugauggcgaacaagaacuucgggaaggccaagcgcgccaacuaccucuucgaggagaacgucagcgacaucgagacccggaagcgcuuccugucccggaaccugguggacacgcgcuacagcucccgggugguccucaacagccugcaggacuucuuccgcgagaaguccgccgacaccaaggugaccgugauccggggcaaguucaccagcaacaugcgcaagcacuggcacaucgacaagacgcgggagaccuuccaccaccacgccaucgacgcguccaucaucgccgccacccccuuccugcgcauguggaagaagggcgggaccaucuucccggucaaggugggggaggagagcaucgacaucgagacgggcgagauccucgacgacaagaacuucgacaaggccauguacgaggagcccuacuccggcuucgugagcgagaucaugaacgccgacgaccggaucaaguucagccaccaggucgacaagaagaugaaccgcaagguguccgacgcgaccaucuacagcacccgcaccgggaagcuggccaaggacaagaaggacgccgaguacaucguggccaaggucaaggacaucuacuccguggacggcuucaagaaguucaagaagguguacgacaaggacaagaccaaguuccugcucuacaaguacgacccccggacguucagcaagcuggagcgcaucaucuccgacugccccgacaaggucgagaaggugcagaccaacgggaaggugaaggccgucgacaucagcccguucgagauguaccggcgcgaccacggcaugaucaagaaguacuccaagaagggcaacgggcccgcgaucaagcagcugaaguaccucgacaagaagcugggcagccacaucgacaucacccccgccaacgccaacgggaagcacgugauccugcagucccucaagcccuggcggaccgacguguaccugaaccacgagacgggcgaguacgagaucauggggaucaaguacagcgaccugaaguucaacaagaacgagggcuacggcaucaagaaggacaaguaccucgagaucaagaaggucgaggagguguccgagaaguccgaguucauguucagccuguaccgcaaggaccgggugaagguccaggacaugaagaccggggagagcguggagcuccuguucuggucccgcaacuucagcaacaagaaguacgccgagcugaagccgaucucccaggcggagaacgacaagaagcugcccguguacggcaaggggcggcucaucaagcgccugauccccaagaacugcaagaucuggaaggucaacaccaccauccugggcgacccguacuaccucgagaaggagagcgacagccccaaggacauccuggacuga

SEQ ID NO: 1619 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgccgggugcgccugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccggggcaucagcuaccuggacgacgccuccgacgacgggaacagcuccaucggcgacuacgcccagaucgugaaggagaacagcaagcagcucgagacgaagacccccgggcagauccagcuggagcgcuaccagaccuacggccagcugcggggcgacuucaccguggagaaggacgggaagaagcaccgccucaucaacgucuuccccacguccgccuaccggagcgaggcgcugcgcauccugcagacccagcaggaguucaacccccagaucaccgacgaguucgugaaccgguaccucgagauccugaccggcaagcgcaaguacuaccacgggccgggcaacgagaagucccggacggacuacggccgcuaccgcaccaacggggagacccuggacaacaucuucggcauccucaucgggaagugcaccuucuaccccgacgaguuccgggccgccaaggccagcuacacggcgcaggaguucaaccugcugaacgaccucaacaaccugaccgugcccaccgagaccaagaagcuguccaaggagcagaagaaccagaucaucaacuacgucaagaacgagaaggccaugggccccgccaagcuguucaaguacaucgccaagcuccugagcugcgacguggccgacaucaagggguaccgcaucgacaaguccggcaaggcggagauccacacguucgaggccuaccggaagaugaagacccucgagacccuggacaucgagcagauggaccgcgagacccuggacaagcucgccuacgugcugacgcugaacaccgagcgggagggcauccaggaggcccucgagcacgaguucgccgacgggagcuucucccagaagcaggucgacgagcuggugcaguuccgcaaggcgaacagcagcaucuucggcaagggguggcacaacuucuccgugaagcugaugauggagcucaucccggagcuguacgagaccagcgaggagcagaugaccauccugacgcggcucggcaagcagaagaccaccuccagcuccaacaagaccaaguacaucgacgagaagcugcugacggaggagaucuacaaccccgucguggccaagagcgugcgccaggccaucaagaucgucaacgccgccaucaaggaguacggggacuucgacaacaucgugaucgagauggcgcgggagaccaacgaggacgacgagaagaaggccauccagaagauccagaaggccaacaaggacgagaaggacgccgccaugcucaaggcggccaaccaguacaacggcaaggccgagcugccccacuccguguuccacggccacaagcagcuggccaccaagauccgccuguggcaccagcagggggagcggugccucuacaccggcaagacgaucagcauccacgaccugaucaacaacuccaaccaguucgaggucgaccacauccugccccucagcaucaccuucgacgacucccuggcgaacaaggugcuggucuacgccaccgccaaccaggagaaggggcagcgcaccccguaccaggcccucgacagcauggacgacgccugguccuuccgggagcugaaggcguucgugcgcgagagcaagacccuguccaacaagaagaaggaguaccuccugacggaggaggacaucagcaaguucgacgugcggaagaaguucaucgagcgcaaccuggucgacacccgguacgccucccgcguggugcucaacgcccugcaggagcacuuccgggcccacaagaucgacaccaaggucagcguggugcgcggccaguucaccucccagcugcgccggcacugggggaucgagaagacgcgcgacaccuaccaccaccacgccgucgacgcgcucaucaucgccgccagcagccagcugaaccuguggaagaagcagaagaacacccucguguccuacagcgaggaccagcugcuggacaucgagaccggcgagcucaucuccgacgacgaguacaaggaguucguguucaaggcccccuaccagcacuucgucgacacgcucaagagcaaggaguucgaggacuccauccuguucagcuaccagguggacuccaaguucaaccggaagaucagcgacgccaccaucuacgcgacccgccaggccaaggugggcaaggacaaggccgacgagaccuacguccucgggaagaucaaggacaucuacacgcaggacggcuacgacgccuucaugaagaucuacaagaaggacaaguccaaguuccugauguaccggcacgacccccagaccuucgagaaggugaucgagcccauccuggagaacuacccgaacaagcagaugaacgagaaggggaaggaggugcccugcaaccccuuccucaaguacaaggaggagcacggcuacauccgcaaguacagcaagaagggcaacgggcccgagaucaagucccugaaguacuacgacagcaagcugggcaaccacaucgacaucaccccgaaggacuccaacaacaaggucgugcuccagagcgugucccccuggcgggcggacgucuacuucaacaacaccacggggaaguacgagauccugggccugaaguacgccgaccuccaguucgagaaggggaccggcaccuacaagaucagccaggagaaguacaacgacaucaagaagaaggagggcguggacuccgacagcgaguucaaguucacccuguacaagaacgaccugcuccuggugaaggagacggagaccaaggagcagcagcuguuccgcuuccucagccggaccaugcccaagcagaagcacuacgucgagcugaagcccuacgacaagcagaaguucgagggcggggaggcccugaucaaggugcucgggaacguggccaacggcgggcagugcaucaagggccugggcaaguccaacaucagcaucuacaagguccgcaccgacgugcuggggaaccagcacaucaucaagaacgagggcgacaagccgaagcucgacuucuga

SEQ ID NO: 1620 - RNA, 3366 nt, Artificial Sequence
  Cas9 variant
augaacggccuggugcucgggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugaaccgccggaagaagcaccgcggcguccgguuccaggaccuguucgaggacuacggccuccugaccgacuucuccaaggugagcaucaaccugaacccguaccgccuccggguggacgggcugaacaagcagcugacgaacgaggagcuguucaucgcccucaagaacaucgucaagcgccggggcaucuccuaccuggacgacgcgagcgaggacgggggcaccguguccagcgacuacgggaaggccguggaggagaaccgcaagcuccuggccgagcagacccccggccagauccagcuggagcgguucgagaaguacggccagcuccgcggggacuucaccgucguggagaacggcgagaagugccggcugaucaacguguucuccacgagcgccuacaagaaggaggcggagcgcauccugcggaagcagcaggaguucaacuccaagaucaccgacgaguucaucgaggacuaccucaagauccugaccgggaagcgcaaguacuaccacggccccggcaacgagaagucccggaccgacuacgggcgcuuccgcaaggacggcacgacccuggacaacaucuucgggauccucaucggcaagugcaccuucuaccccaacgaguaccgggccagcaaggccagcuacaccgcccaggaguucaaccugcugaacgaccucaacaaccuguccgucccgacggagaccaagaagcugagcgaggagcagaagaagaccaucaucgaguacgccaaguccgcgaagacccucggggccagcacgcugcugaaguacaucgccaagaugaucgacaccuccguggaccagauccgcggcuaccggguggacgucaacaacaagcccgagaugcacaccuucgagguguaccgcaagaugcagagccucgagaccaucagcgugggcgagcugucccggaacguccuggacgagcucgcccacauccugacgcugaacaccgagcgcgaggggaucgaggaggccaucaacaccaagcucaaggacagcuucucccaggaccaggugcuggagcuggugcaguuccggaagaacaacagcucccucuucagcaagggcuggcacaacuucucccugaagcugaugauggagcucauccccgagcuguacgagaccagcgaggagcagaugacgauccugacccgccucgggaagcagaaguccaaggagaccagcaagcgguccaaguacaucgacgagaaggagcugaccgaggagaucuacaaccccgucguggccaagagcgugcgccaggcgaucaagaucaucaacgaggccacgaagaaguacggcaucuucgacaacaucgucaucgagauggcccgggagaacgacgaggaggacgccaagaaggacuacaucaagcgccagaaggcgaaccaggacgagaagaacgccgccauggagaaggccgccuuccaguacaacgggaagaaggagcugccggacaacaucuuccacggccacaaggagcuggcgaccaagauccggcucuggcaccagcagggcgagaagugccuguacaccgggaagaccauccccaucuccgaccugauccacaaccaguacaaguacgagaucgaccacgugcucccccugagccuguccuucgacgacagccucuccaacaagguccuggugcuggccacggccaaccaggagaagggccagcgcacccccuuccaggcccucgacagcauggacgacgggugguccuaccgggaguucaagagcuacgugaaggagagcaagcugcugggcaacaagaagaaggaguaccuccugaccgaggaggacaucuccaagaucgaggucaagcagaaguucaucgagcgcaaccugguggacaaccgguacagcucccgcgugguccucaacgcgcugcaggacuucuacaaggcccacaaguucgacaccacgaucagcguggugcgggggcaguucaccucccagcugcgccgcaaguggggccucgagaagucccgggagaccuaccaccaccacgccgucgacgcccugaucaucgccgcgagcagccagcugcgccucuggaagaagcacaacaacccgcugaucuccuacaaggagggccgguucaucgacagcgagaccggggagaucaucucccugagcgacgacgaguacaaggagcucguguucaaggcccccuacgaccacuucguggacacccugcgcuccaagacguucgaggacagcauccuguucuccuaccaggucgacagcaaguacaaccggaagaucuccgacgccaccaucuacgccacccgcaaggccaagcucgacaaggacaagagcgaggagaccuacgugcugggcaagaucaaggacaucuacagccaggcgggguacgacgccuucaucaagaucuacaacaaggacaaguccaaguuccugauguaccacaaggacccccagacguucgagaaggugaucgaggagauccuccggaccuaccccagcaaggagcugaacgacaagaacaaggagaucccgugcaaccccuucgagaaguaccgccaggagaacggccccauccggaaguacuccaagaagggcaacgggcccgagaucaagagcaugaaguacuacgacaagaacaucccggaguccuucaucaacaucacccccagcaacuccaacaacaagguccugcuccgccagcuguaccccuggcggaccgacguguacuucaacccccagacggacaaguacgagcugcucggccugaaguacgccgaccugcaguucgagaaggccaccgggaaguacagcaucaccaucgacaaguacaacgagaucaaggagaaggagggcguguccaaggagagcgaguucaaguucacccucuacaagaacgaccugcugcucaucaaggacacgaagaacaacgaggagcagaucuuccgcuuccugucccggaccaugccgaaccagaaccacuacgucgagcugaagcccuacgacaaggggaacuucgagggcaaggagaagaucaagguguucaagaugaccagcaacggccgcugcaucaaggggcucggcaagaaguaccuguccaucuacaaggugaagaccgacauccuggggaacaagcacuucaucaagaaggagggcgacgagcccaagcucaaguucuga

SEQ ID NO: 1621 - RNA, 3366 nt, Artificial Sequence
  Cas9 variant
augaacggccuggugcucgggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugaaccgccggaagaagcaccgcggcguccgguuccaggaccuguucgaggacuacggccuccugaccgacuucuccaaggugagcaucaaccugaacccguaccgccuccggguggacgggcugaaccagcagcugacgaacgaggagcuguucaucgcccucaagaacaucgucaagcgccggggcaucuccuaccuggacgacgcgagcgaggacgggggcgccguguccagcgacuacgggaaggccguggaggagaaccgcaagcuccuggccgagcagacccccggccagauccagcuggagcgguucgagaaguacggccagguccgcggggacuucaccgugguggagaacggcgagaagcggcgccucaucaacgucuucuccaccagcgcguaccggaaggaggccgagaagauccugcgcaagcagcaggaguucaacaaccagaucacggacgaguucaucgaggacuaccugaagauccucaccgggaagcggaaguacuaccacggccccggcaacgagaagucccgcaccgacuacgggcgcuuccggaccgacggcacgacccuggacaacaucuucggggugcugaucggcaagugcaccuucuaccccaacgaguaccgcgccagcaaguccagcuacaccgcccaggaguucaaccuccugaacgaccugaacaaccucacggugccgaccgagaccaagaagcuguccgaggagcagaagaaggucaucguggaguacgccaaggaggcgaagacccugggggccagcacgcuccugaaguacaucgugaagaugaucgacgccuccgucgaccagaucagcggcuaccggguggacgugaacaacaagcccgagaugcacaccuucgaggucuaccgcaagaugcagucccuggagaccaucagcgugggcgagcucagccggaacgugcuggacgagcuggcccacauccucacccugaacacggagcgcgaggggaucgaggaggccaucaacuccaagcugaugggcgucuucagccaggaccaggugcucgagcugguccaguuccggaagaacaacuccagccuguucuccaagggguggcacaacuucagccucaagcugaugauggagcugauccccgagcucuacgagaccuccgaggagcagaugaccauccugacccgccugggcaagcagaaguccaaggagacgagcaagcggaccaaguacaucgacgagaaggagcucaccgaggagaucuacaaccccgugguggccaagagcguccgccaggcgaucaagaucaucaacgaggccaccaagaagcacgggaucuucgacaacaucgugaucgagauggcccgggagaacaacgaggaggacgccaagaaggacuacaucaagcgccagaaggcgaaccaggacgagaagaacgccgccauggagaaggccgccuuccaguacaacggcaagaaggagcugccgggcaacaucuucaacgggcacaaggagcuggcgacgaagauccggcuguggcaccagcagggcgagaagugccucuacaccgggaagaccauccccaucuccgaccugauccacaaccaguacaaguacgagaucgaccacauccugccccucagccuguccuucgacgacagccuguccaacaaggugcucguccacgccaccgccaaccaggagaagggccagcgcacgcccuuccaggcccuggacagcauggacgacgcgugguccuaccgggaguucaagagcuacgugaaggaccugaagucccucagcaacaagaagaaggacuaccugcugaccgaggaggacaucagcaagaucgaggugaagcagaaguucaucgagcgcaaccucgucgacacccgguacuccagccgcguggugcugaacgcccugcaggacuucuacaagucccaccaguucgacaccacgaucagcgucgugcgggggcaguucaccucccagcuccgccgcaaguggggccuggagaagucccgggagaccuaccaccaccacgccguggacgcccugaucaucgccgcgagcagccagcuccgccuguggaagaagcagaacaacccgcugaucaccuacaaggagggccaguucaucgacucccagaccggggagaucaucagccucacggacgacgaguacaaggagcuggucuucaaggcccccuacgaccacuucguggacacccugcacuccaagaccuucgaggacggcauccucuucagcuaccagguggacuccaaguacaaccggaagaucagcgacgccaccaucuacgccacgcgcaaggccaagcuggacaaggacaaguccgaggagaccuacguccuggggaagaucaaggacaucuacagccaggcgggcuacgacgccuucaucaagaucuacaacaaggacaagcggaaguuccucauguaccacaaggacccccagaccuucgagaaggugaucgaggagauccugcgcaccuaccccuccaaggagcggaacgacaagaacaaggaggugccgugcaaccccuucgagaaguaccgccaggagaacggccccauccggaaguacagcaagaaggggaacggccccgagaucaagugccugaaguacuacgacaacaagcucgggaacuacaucgacaucagcccggacggcuccgacaaccaggucgugcugcagagccugaagcccuggcgcacggacguguacuucaaccaccagaccaagaaguacgagcucauggggcugaaguacuccgaccugagcuucgagaagggcuccggcaaguacagcaucuccaacgagaaguacaacagcaucaagcggaucgagggggucaacgagcaguccgaguucaaguucacccucuacaagaacgaccugauccugaucaaggacagcgagaacaacgagcagaagcuguuccgcuucaacucccggaacgacaccgccaagcacuacguggagcucaagcccuacgacaaggcccgcuucgacggccagcaggagcugaucacgauccucgggaacguggccaagggcgggcagugccugaagggccugaacaagagcaacaucuccaucuucaaggucaagaccgacgugcucggcaagaagcacaucaucaagaaggagggggacgagcccaagcugaaguucuga

SEQ ID NO: 1622 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgcaucgugcggcugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccgcggcaucagcuaccuggacgacgccuccgacgacgggaacagcuccgugggcgacuacgcccagaucgugaaggagaacagcaagcagcucgagacgaagacccccgggcagauccagcuggagcgguaccagaccuacggccagcugcgcggcgacuucaccgucgagaaggacgggaagaagcaccggcucaucaacguguuccccacguccgccuaccgcagcgaggcgcugcggauccugaagacccagcaggaguucaacccccagaucaccgacgaguucaucaaccgcuaccucgagauccugaccggcaagcggaaguacuaccacgggccgggcaacgagaagucccgcacggacuacggccgguaccgcaccaacggggagacccuggacaacaucuucggcauccucaucgggaagugcaccuucuaccccgaggaguuccgcgccgccaaggccagcuacacggcgcaggaguucaaccugcugaacgaccucaacaaccugaccgugcccaccgagaccaagaagcuguccaaggagcagaagaaccagaucaucaacuacgucaagaacgagaaggccaugggccccgccaagcuguucaaguacaucgccaagcuccugagcugcgacguggccgacaucaagggguaccggaucgacaaguccggcaaggcggagauccacacguucgaggccuaccgcaagaugaagacccucgagacccuggacaucgagcagauggaccgggagacccuggacaagcucgccuacgugcugacgcugaacaccgagcgcgagggcauccaggaggcccucgagcacgaguucgccgacgggagcuucucccagaagcaggucgacgagcuggugcaguuccggaaggcgaacagcagcaucuucggcaagggguggcacaacuucuccgugaagcugaugauggagcucaucccggagcuguacgagaccagcgaggagcagaugaccauccugacgcgccucggcaagcagaagaccaccuccagcuccaacaagaccaaguacaucgacgagaagcugcugacggaggagaucuacaaccccgucguggccaagagcgugcggcaggccaucaagaucgucaacgccgccaucaaggaguacggggacuucgacaacaucgugaucgagauggcgcgcgagaccaacgaggacgacgagaagaaggccauccagaagauccagaaggccaacaaggacgagaaggacgccgccaugcucaaggcggccaaccaguacaacggcaaggccgagcugccccacuccguguuccacggccacaagcagcuggccaccaagauccggcuguggcaccagcagggggagcgcugccucuacaccggcaagacgaucagcauccacgaccugaucaacaaccccaaccaguucgaggucgaccacauccugccgcucuccaucaccuucgacgacagccuggcgaacaaggugcuggucuacgccaccgccaaccaggagaaggggcagcggacccccuaccaggcccucgacuccauggacgacgccuggagcuuccgcgagcugaaggcguucgugcgggaguccaagacccugagcaacaagaagaaggaguaccuccugacggaggaggacaucuccaaguucgacgugcagaagaaguucaucgagcgcaaccuggucgacacccgguacgccagccgcguggugcucaacgcccugcaggagcacuuccgggcccacaagaucgacaccaaggucuccguggugcgcggccaguucaccagccagcugcggcgccacugggggaucgagaagacgcgcgacaccuaccaccaccacgccgucgacgcgcucaucaucgccgccuccagccagcugaaccuguggaagaagcagaagaacacccucgugagcuacuccgaggaccagcugcuggacaucgagaccggcgagcucaucagcgacgacgaguacaaggaguccguguucaaggcccccuaccagcacuucgucgacacgcucaagagcaaggaguucgaggacuccauccuguucagcuaccagguggacuccaaguucaaccggaagaucagcgacgccaccaucuacgcgacccgccaggccaaggugggcaaggacaagaaggacgagaccuacguccucgggaagaucaaggacaucuacacgcaggacggcuacgacgccuucaugaagaucuacaagaaggacaaguccaaguuccugauguaccggcacgacccccagaccuucgagaaggugaucgagccgauccuggagaacuaccccaacaaggagaugaacgagaaggggaaggaggugcccugcaaccccuuccucaaguacaaggaggagcacggcuacauccgcaaguacagcaagaagggcaacgggccggagaucaagucccugaaguacuacgacagcaagcugggcaaccacaucgacaucacccccaagaacuccaacaacaaggucgugcuccagagcgugucccccuggcgggccgacgucuacuucaacaagaccacggggaaguacgagauccugggccugaaguacgcggaccuccaguucgagaaggggaccggcaccuacaagaucagccaggagaaguacaacgacaucaagaagaaggagggcguggacuccgacagcgaguucaaguucacccuguacaagaacgaccugcuccuggugaaggacacggagaccaaggagcagcagcuguuccgcuuccucagccggaccaugcccaagaagaagcacuacgucgagcugaagccguacgacaagcagaaguucgagggcggggaggcccugaucaaggugcucgggaacguggccaacuccggccagugcaucaaggggcuggccaagagcaacaucuccaucuacaagguccgcaccgacgugcugggcaaccagcacaucaucaagaacgagggcgacaagcccaagcucgacuucuga

SEQ ID NO: 1623 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgccgggugcgccugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccggggcaucagcuaccuggacgacgccuccgacgacgggaacagcuccaucggcgacuacgcccagaucgugaaggagaacagcaagcagcucgagacgaagacccccgggcagauccagcuggagcgcuaccagaccuacggccagcugcggggcgacuucaccguggagaaggacgggaagaagcaccgccucaucaacgucuuccccacguccgccuaccggagcgaggcgcugcgcauccugcagacccagcaggaguucaacccccagaucaccgacgaguucaucaaccgguaccucgagauccugaccggcaagcgcaaguacuaccacgggccgggcaacgagaagucccggacggacuacggccgcuaccgcaccagcggggagacccuggacaacaucuucggcauccucaucgggaagugcaccuucuaccccgacgaguuccgggccgccaaggccuccuacacggcgcaggaguucaaccugcugaacgaccucaacaaccugaccgugcccaccgagaccaagaagcugagcaaggagcagaagaaccagaucaucaacuacgugaagaacgagaaggccaugggccccgccaagcuguucaaguacaucgccaagcuccuguccugcgacgucgccgacaucaagggguaccgcaucgacaagagcggcaaggcggagauccacacguucgaggccuaccggaagaugaagacccucgagacccuggacaucgagcagauggaccgcgagacccuggacaagcucgccuacgugcugacgcugaacaccgagcgggagggcauccaggaggcccucgagcacgaguucgccgacggguccuucagccagaagcaggucgacgagcuggugcaguuccgcaaggcgaacagcuccaucuucggcaagggguggcacaacuucagcgugaagcugaugauggagcucaucccggagcuguacgagaccuccgaggagcagaugaccauccugacgcggcucggcaagcagaagaccaccagcuccagcaacaagaccaaguacaucgacgagaagcugcugacggaggagaucuacaaccccguggucgccaaguccgugcgccaggccaucaagaucgugaacgccgccaucaaggaguacggggacuucgacaacaucgucaucgagauggcgcgggagaccaacgaggacgacgagaagaaggccauccagaagauccagaaggccaacaaggacgagaaggacgccgccaugcucaaggcggccaaccaguacaacggcaaggccgagcugccccacagcguguuccacggccacaagcagcuggccaccaagauccgccuguggcaccagcagggggagcggugccucuacaccggcaagacgaucuccauccacgaccugaucaacaacagcaaccaguucgagguggaccacauccugccccucuccaucaccuucgacgacagccuggcgaacaagguccugguguacgccaccgccaaccaggagaaggggcagcgcaccccguaccaggcccucgacuccauggacgacgccuggagcuuccgggagcugaaggcguucguccgcgaguccaagacccugagcaacaagaagaaggaguaccuccugacggaggaggacaucuccaaguucgacgugcggaagaaguucaucgagcgcaaccugguggacacccgguacgccagccgcgucgugcucaacgcccugcaggagcacuuccgggcccacaagaucgacaccaagguguccgucgugcgcggccaguucaccagccagcugcgccggcacugggggaucgagaagacgcgcgacaccuaccaccaccacgccguggacgcgcucaucaucgccgccagcucccagcugaaccuguggaagaagcagaagaacacccucgucagcuacuccgaggaccagcugcuggacaucgagaccggcgagcucaucagcgacgacgaguacaaggaguccguguucaaggcccccuaccagcacuucguggacacgcucaagagcaaggaguucgaggacuccauccuguucagcuaccaggucgacuccaaguucaaccggaagaucagcgacgccaccaucuacgcgacccgccaggccaaggugggcaaggacaaggccgacgagaccuacgugcucgggaagaucaaggacaucuacacgcaggacggcuacgacgccuucaugaagaucuacaagaaggacaaguccaaguuccugauguaccggcacgacccccagaccuucgagaaggucaucgagcccauccuggagaacuacccgaacaagcagaucaacgagaaggggaaggaggugcccugcaaccccuuccucaaguacaaggaggagcacggcuacauccgcaaguacagcaagaagggcaacgggcccgagaucaagucccugaaguacuacgacagcaagcugggcaaccacaucgacaucaccccgaaggacuccaacaacaaggugguccuccagagcgugucccccuggcgggcggacguguacuucaacaagaccacggggaaguacgagauccugggccugaaguacgccgaccuccaguucgagaaggggaccggcaccuacaagaucagccaggagaaguacaacgacaucaagaagaaggagggcgucgacagcgacuccgaguucaaguucacccuguacaagaacgaccugcuccuggugaaggacacggagaccaaggagcagcagcuguuccgcuuccucagccggaccaugcccaagcagaagcacuacguggagcugaagcccuacgacaagcagaaguucgagggcggggaggcccugaucaagguccucgggaacguggccaacuccggccagugcaagaaggggcugggcaagagcaacaucuccaucuacaaggugcgcaccgacguccugggcaaccagcacaucaucaagaacgagggggacaagccgaagcucgacuucuga

SEQ ID NO: 1624 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgccgggugcgccugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccggggcaucagcuaccuggacgacgccuccgacgacgggaacagcuccgugggcgacuacgcccagaucgugaaggagaacagcaagcagcucgagacgaagacccccgggcagauccagcuggagcgcuaccagaccuacggccagcugcggggcgacuucaccgucgagaaggacgggaagaagcaccgccucaucaacguguuccccacguccgccuaccggagcgaggcgcugcgcauccugcagacccagcaggaguucaacccccagaucaccgacgaguucgugaaccgguaccucgagauccugaccggcaagcgcaaguacuaccacgggccgggcaacgagaagucccggacggacuacggccgcuaccgcaccaacggggagacccuggacaacaucuucggcauccucaucgggaagugcaccuucuaccccgaggaguuccgggccgccaaggccagcuacacggcgcaggaguucaaccugcugaacgaccucaacaaccugaccguccccaccgagaccaagaagcuguccaaggagcagaagaaccagaucaucaacuacgugaagaacgagaaggccaugggccccgccaagcuguucaaguacaucgccaagcuccugagcugcgacguggccgacaucaagggguaccgcaucgacaaguccggcaaggcggagauccacacguucgaggccuaccggaagaugaagacccucgagacccuggacaucgagcagauggaccgcgagacccuggacaagcucgccuacguccugacgcugaacaccgagcgggagggcauccaggaggcccucgagcacgaguucgccgacgggagcuucucccagaagcaggucgacgagcuggugcaguuccgcaaggcgaacagcagcaucuucggcaagggguggcacaacuucuccgugaagcugaugauggagcucaucccggagcuguacgagaccagcgaggagcagaugaccauccugaagcggcucggcaagcagaagacgaccuccagcuccaacaagaccaaguacaucgacgagaagcugcugaccgaggagaucuacaaccccgugguggccaagagcauccgccaggccaucaagaucgucaacgccgccaucaaggaguacggggacuucgacaacaucgugaucgagauggcgcgggagacgaacgaggacgacgagaagaaggccauccagaagauccagaaggccaacaaggacgagaaggacgccgccaugcucaaggcggccaaccaguacaacggcaaggccgagcugccccacuccguguuccacggccacaagcagcuggccaccaagauccgccuguggcaccagcagggggagcggugccucuacaccggcaagaccaucagcauccacgaccugaucaacaaccccaaccaguucgaggucgaccacauccugccgcucuccaucacguucgacgacagccuggcgaacaaggugcuggucuacgccaccgccaaccaggagaaggggcagcgcacccccuaccaggcccucgacuccauggacgacgccuggagcuuccgggagcugaaggcguucgugcgcgaguccaagacccugagcaacaagaagaaggaguaccuccugaccgaggaggacaucuccaaguucgacgugcggaagaaguucaucgagcgcaaccuggucgacacgcgguacgccagccgcguggugcucaacgcccugcaggagcacuuccgggcccacaagaucgacaccaaggucuccguggugcgcggccaguucaccagccagcugcgccggcacugggggaucgagaagacccgcgacacguaccaccaccacgccgucgacgcgcucaucaucgccgccuccagccagcugaaccuguggaagaagcagaagaacacccucgugagcuacuccgaggaccagcugcuggacaucgagaccggcgagcucaucagcgacgacgaguacaaggaguccguguucaaggcccccuaccagcacuucgucgacacccucaagagcaaggaguucgaggacuccauccuguucagcuaccagguggacuccaaguucaaccggaagaucagcgacgccacgaucuacgcgacccgccaggccaaggugggcaaggacaagaaggacgagaccuacguccucgggaagaucaaggacaucuacacccaggacggcuacgacgccuucaugaagaucuacaagaaggacaaguccaaguuccugauguaccggcacgacccccagacguucgagaaggugaucgagccgauccuggagaacuaccccaacaaggagaugaacgagaaggggaaggaggugcccugcaaccccuuccucaaguacaaggaggagcacggcuacauccgcaaguacagcaagaagggcaacgacccggagaucaagucccugaaguacuacgacagcaagcuggggaaccacaucgacaucacccccaaggacuccaacaacaaggucgugcuccagagcgugucccccuggcgggccgacgucuacuucaacaagaccaccggcaaguacgagauccuggggcugaaguacgcggaccuccaguucgagaagggcacggggaccuacaagaucagccaggagaaguacaacgacaucaagaagaaggagggcguggacuccgacagcgaguucaaguucacccuguacaagaacgaccugcuccuggugaaggacaccgagacgaaggagcagcagcuguuccgcuuccucagccggaccaugcccaagcagaagcacuacgucgagcugaagccguacgacaagcagaaguucgagggcggggaggcccugaucaaggugcucggcaacguggccaacuccgggcagugcaagaagggccugggcaagagcaacaucuccaucuacaagguccgcaccgacgugcuggggaaccagcacaucaucaagaacgagggcgacaagcccaagcucgacuucuga

SEQ ID NO: 1625 - RNA, 3366 nt, Artificial Sequence
  Cas9 variant
augaacggccuggugcucgggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugcaccgccggaagaagcaccgcggcguccgguuccaggaccuguucgaggacuacggccuccugaccgacuucuccaaggugagcaucaaccugaacccguaccgccuccggguggacgggcugaaccagcagcugacgaacgaggagcuguucaucgcccucaagaacaucgucaagcgccggggcaucuccuaccuggacgacgcgagcgaggacgggggcaccguguccagcgacuacgggaaggccguggaggagaaccgcaagcuccuggccgagcagacccccggccagauccagcuggagcgguucgagaaguacggccagguccgcggggacuucaccgugguggagaacggcgagaagcggcgccucaucaacgucuucuccacgagcgccuaccggaaggaggcggagcgcauccugcggaagcagcaggaguucaacuccaagaucaccgacgaguucaucgaggacugccugaagauccucaccgggaagcgcaaguacuaccacggccccggcaacgagaagucccgcaccgacuacgggcgguuccgcacggacggcaccacccuggacaacaucuucgggauccugaucggcaagugcaccuucuaccccgacgaguaccgggccagcaaggccagcuacacggcccaggaguucaaccuccugaacgaccugaacaaccucaccgugccgaccgagaccaagaagcuguccgaggagcagaagaaggugaucgucgaguacgccaaggaggcgaagacgcugggggccagcacccuccugaaguacaucgccaagaugaucgacgccuccguggaccagauccgcggcuaccggguggacgucaacaacaagcccgagauccacaccuucgaggccuaccgcaagaugcagagccuggagaccaucuccgugggcgagcucagccggaacgugcuggacgagcuggcgcacauccucacgcugaacaccgagcgcgaggggaucgaggaggccaucaacaccaagcugaaggacagcuucucccaggaccagguccucgagcuggugcaguuccggaagaacaacagcucccuguucagcaagggcuggcacaacuucucccucaagcugaugauggagcugauccccgagcucuacgagaccagcgaggagcagaugacgauccugacccgccuggggaagcagaaguccaaggagaucagcaagcggaccaaguacaucgacgagaaggagcucaccgaggagaucuacaaccccguggucgccaaguccgugcgccaggccaucaagaucaucaacgaggccacgaagaagcacggcaucuucgacaacaucgucaucgagauggcgcgggagaacaacgaggaggacgccaagaaggacuacaucaagcgccagaaggccaaccaggacgagaagaacgccgccauggagaaggcggccuuccaguacaacgggaagaaggagcugccggacagcaucuuccacggccagaaggagcuggccaccaagauccggcuguggcaccagcagggcgagaagugccucuacaccgggaagaacauccccaucuccgaccugauccacaaccaguacaaguacgagaucgaccacauccugccccucagccuguccuucgacgacagccuguccaacaaggugcucgugcuggccaccgcgaaccaggagaagggccagcgcacgcccuuccaggcccuggacagcauggacgacgccugguccuaccgggaguucaagagcuacgucaaggaguccaagcuccuggggaacaagaagaaggaguaccugcucaccgaggaggacaucagcaagaucgaggugaagcagaaguucaucgagcgcaaccugaucgacacccgguacagcucccgcgugguccugaacgcccuccaggacuucuacaaggcccacaaguucgacaccacgaucagcguggugcgcggccaguucaccucccagcugcggcgcaagugggggcuggagaagucccgggagaccuaccaccaccacgcggucgacgcccucaucaucgccgccagcagccagcugcgccuguggaagaagcagaacaacccgcucaucgccuacaaggagggccaguucguggacuccgagaccggcgagaucaucagccuguccgacgacgaguacaaggagcugguguucaaggcgcccuacgaccacuucgucgacacccucagcuccaagacguucgaggacagcauccuguucuccuaccagguggacagcaaguucaaccggaagaucuccgacgccaccaucuacgccacccgcaaggccaagcuggacaaggagaaguccgaggagaccuacgugcucgggaagaucaaggacaucuacagccaggccggcuacgacgcguucaucaagaucuacaacaaggacaagagcaaguuccugauguaccacaaggacccccagacguucgagaaggucaucgaggagauccugcggaccuaccccagcaaggagcucaacgacaagaacaaggagaucccgugcaaccccuucgagaaguaccgccaggagaacgggcccauccggaaguacuccaagaaguccaacggccccgagaucaagagccugaaguacuacgacaacaagcugggcaaccacaucgacaucaccccggagagcuccgacaaccagguggugcuccagagccugaagcccuggcgcaccgacgucuacuucaaccaccagacgaagaaguacgagcugauggggcucaaguacuccgaccugagcuucgagaagggcuccgggaaguacagcaucuccaaccagaaguacaacagcaucaagcggaucgagggcaucgacgagcaguccgaguucaaguucacccuguacaagaacgaccucauccugaucaaggacagcgagaacaacgagcagaagcuguuccgcuucaacucccggaacgacaccgccaagcacuacaucgagcucaagcccuacgacaaggccaaguucgacggggagcaggagcugaucaccauccugggcaacguggccaagggcgggcgcugccucaagggccugaacaagagcaacaucuccaucuucaaggugaagacggacguccuggggaagaagcacaucaucaagaaggagggcgacgagcccaagcucaaguucuga

SEQ ID NO: 1626 - RNA, 3366 nt, Artificial Sequence
  Cas9 variant
augaacggccuggugcucgggcuggacaucggcaucgccagcgucggggugggcauccugaacaaggacaccggggagaucauccacaccaacucccgcaucuuccccgccgcgacggccgacaacaacguggagcggcgcaacagccggcaggaccgccggcucaaccgccggaagaagcaccgcggcguccggcugcacgaccuguucgaggacuacgaccuccugaccgacuucuccaaggugagcaucaaccugaacccguaccgccuccgggugcagggccuggacaacucccugaccaccgaggagcuguucaucgcccucaagaacaucgucaagcgccgggggaucagcuaccuggacgacgccuccgaggacggcgggguggugagcuccgacuacggcaaggccgucgaggagaaccgcaagcuccuggcggagcagacgcccgggcagauccagcuggagcgguucaagaaguacggccaggugcgcggcgacuucaccguggucgagaacggggagaagcggcgccucaucaacguguucagcaccuccgccuaccggaaggaggccgagcgcauccugcggaagcagcaggaguucaacaaccagaucaccgacaaguucaucgaggacuaccugaagauccucacggagaagcgcaaguacuaccacggccccgggaacgagaagucccgcaccgacuacggccgguuccgcaccgacggcaccacgcuggacaacaucuucgggauccugaucggcaagugcaccuucuaccccaacgaguaccgggccagcaaggcgagcuacaccgcccaggaguucaaccuccugaacgaccugaacaaccucaccgugccgacggagaccaagaagcuguccgaggagcagaagaagaccaucgucgaguacgccaagagcgccaagacccugggggccuccacgcuccugaaguacaucgcgaagaugaucgacgccagcguggaccagauccgcggcuaccggguggacgucaacaacaagcccgagaugcacaccuucgagguguaccgcaagaugcagucccuggagaccaucagcgugugggagcucagccggaacauccuggacgagcuggcccacauccucacccugaacacggagcgcgaggggaucgaggaggccaucaacaccaagcugauggacgucuucucccaggaccaggugcucgagcuggugcaguuccggaagaacaacagcucccuguucagcaagggcuggcacaacuucucccgcaagcucaugauggagcugauccccgagcuguacgagaccagcgaggagcagaugaccauccucacgcggcugggcaagcagaaguccaaggagaccagcaagcgcaccaaguacaucgacgagaaggaggucaccgaggagaucuacaaccccguggucgccaaguccgugcggcaggcgaucaagaucaucaacgaggccacgaagaaguacgggaucuucgacaacaucgugaucgagauggcccgcgagaacaacgaggaggacgccaagaaggacuacaucaagcggcagaaggccaaccaggacgagaagaacgucgcgaucgagaaggccgccuuccaguacaacggcaagaaggagcugccggacagcaucuuccacgggcacaaggagcucgccaccaagauccgccuguggcaccagcagggcgagaagugccuguacaccgggaagaacauccccaucuccgaccugauccacaaccaguacaaguacgagaucgaccacauccucccccugagccuguccuucgacgacagccucuccaacaaggugcuggugcuggccaccgcgaaccaggagaagggccagcggacgcccuuccaggcccucgacagcauggacgacgccugguccuaccgcgaguucaagagcuacgucaaggacuccaagcugcugggcaacaagaagaaggacuaccuccugaccgaggaggacaucagcaagaucgaggugaagcagaaguucaucgagcggaaccugguggacacccgcuacagcucccgcgucgugcucaacacccugcaggacuucuacaaggcccacaaguucgacaccacgaucagcgugguccgggggcaguucaccucccagcugcgccggaaguggggccucgagaagucccgcgagaccuaccaccaccacgcgguggacgcccugaucaucgccgccagcagccagcugcggcucuggaagaagcaggccaacccgcugaucuccuacaaggaggaccaguucguggacagcgagaccggggagaucaucucccugacggacgacaaguacaaggagcucgucuucaaggcgcccuacgcccacuucguggacacccugagcuccaagaaguucgaggacagcauccuguucuccuaccagguggacagcaaguacaaccgcaagaucuccgacgccaccaucuacgccacccggaaggucaagcucgacaaggacaagagcgaggagacguacgugcugggcaagaucaaggacaucuacucccaggccggguacgacgcguucaucaagaucuacaacaaggacaagagcaaguuccugauguaccacaaggacccccagaccuucgagaaggugaucgaggagauccuccgcaucuaccccagcaaggaguucaacgagaagaacaaggaggucccgugcaaccccuucgagaaguaccggcaggagaacggccccaucugcaaguacuccaagaagggcaacgggcccgagaucaagagccugaaguacuacgacaagaacaucccggaguccuucaucgacaucacccccagcaacuccaagaacaaggugauccugcgccagcucaaccccuggcggaccgacguguacuucaaccaccagacggagaaguacgagcugcugggccucaaguacgccgaccugcaguucgagaagaagaccgagaccuacagcaucaccaucgacaaguacaacgagaucaaggagaaggagggggucggcgagcacuccgaguucaaguucacgcuguacaagaacgaccuccugcugaucaaggacauggagaucaaggaggagcagaucuuccgcuuccucagccggaccaugcccaacaagaagcacuacguggagcugaagccguacuacaagggcaacuucgaggggaaggagcgcaucaagguguucaacaccaccuccaacggccggugccugaaggggcucggcaagaaggggcugagcaucuacaagaucaagacggacguccugggcaacaagcacuucaucaagaaggagggcgagaagcccaagcucaaguucuga

SEQ ID NO: 1627 - RNA, 3366 nt, Artificial Sequence
  Cas9 variant
auggaccgcaccgaggugaacaucggcuucgacaucgggaucagcuccgucggcuggagcgugguggccaccaaguccgggcggauccuggagagcggcgucucccucuucagcggggccuccgcggccaagaacgaggagcgccggaacuuccgccagagccggcgccugcugcggcgccggaagaaccgcaucuccgaccucaagaaguaccugaaggagcagagcuucacguacaacggcgagcugcucaacgagaaccccuacgagauccgggugaagggccugaccgagaagcuguccaaggaggagaucgcccucgcccugcugcacaucgugaagcgccgcggggucagcuacgaccucggcgacaucgaggaggaggggaccaccggcuccuacaaggagggggugaagaagaaccagaagcugcugaaggagaagacgccggccgagauccaguuccagcggcucaagaaguuccacaaggugcggggccagaucgcgaucgacgagaacgacguccugcugaacguguuccccaaccacgccuacguggacgaggcccagcagauccucuacacccagcaggaguucuaccccgagaucaacgagaccuucaucaaccaggucaccgacuucaucagccgcaagcgggacuacuucaucggccccggguccgagaagucccgcacggacuacggcaucuaccggaccgacgggaccacccugcagaaccuguucagcauccucaucggcaaggacaagaucuucccggacgaguuccgcgccgcgggcaacagcuacacggcccagguguacaaccugcugaacgaccucaacaaccuggccaucgacgacaccgagaccgggaagcugaccaagcagcagaaggagaagaucaucauggagcucaagacgaccgagaaguccgugaacaugaugaagcugaucgccaagaccgccggcgucaccguggagcagaucagccgguaccgcaucaaccgcgacggcaagagcgagauccacaacauggcgguguaccggaagauccgcaaggucuuccuggagcucggguacgagaucaacgaguggcccucccagcugcuggacgagcucggggacgcccugagccugaacacggagaacggcgagauccggcgcauccucaccgacaaccuggccaacaaguacaagauccuggaccagcagcucaucaaccugaucaucgagaacaagaacgccuucacccuguccaccaaccagaaguggcaccgguucagcuacaagacgaugaagauccucauccccgagcugcuggagaccaacaaggagcagaugaccauccucaccgagaugggccugaugaagaaggaccagcgcaacuacguggggaagaacaagaucgacuccgaggcccugcucgagaaccuguacaaccccgugguccgcaagagcacgcggcagaccaugaagcuguucaacacccugcucaagaaguacccgaacaucgcguacguggugaucgagaugccccgggaggacgacgaggacaaggcccgccgggacuacgucaaguuccagaaggacaacgagaaggagaaggacgccgcccugaagaacuucaucauggaguccggcaagagcgaggccgaggugaucgcgaaguaccgccaguccaagaaguuccggagcaagguccgccugugguaccagcagauggggcggugccucuacuccggcaaggccaugcccgccgagcgcguguuccgggacgaccacuucaccgacaucgaccacgugaucccccugagcgucuccuucgacgacgggaugaacaacaaggugcugugccucgccgagaugaaccgccagaaggacaagcagacgccguacgccuucuucaacgcgggccacggccagggguuccaggccaugaacgccaugcugaagaacaacaaccggaucagcuccgccaagaagcgcaaccuccuguucaccgagaaccugaacgaccuggaggugcgcaagcgguucaucgagcgcaaccucgucgacacccgguacgcgagccgcguggugcugaacgagcugcagcaguucgucaaggccaagcagcucgacaccaaggugacggugauccggggcaaguucaccuccaagcugcgcgagaaguggaacaucaacaagagccgggacacccaccaccaccacgccgucgacgccgccgugaucgcggugucccccaugcugaaccucugggagaagggggccagcaucauccccaacaaggucggcgagaacgugaucgacaucaagaccggggagaucaucaccgaccacgacuacgaggccgacguguacgagcugcccuacgccaaguuccuggagcagaucccgaaggucaagaaggacaucaaguuccgccaccagguggacaagaagaagaaccggaaggugagcgacgccacgaucuacaccacccgcaaggcgaaggucggcaaggacaaggaggagaccgacuacgugcucggcacgaucaaggacaucuacucccuggagggguacgugagcuucaagaagaucuacaacaaggacaaggccaaguuccugauggcccggaucgaccccaagaccuucgagaagcucgagaagaucgucgccgaguaccccgaguccaucgagguggugcaggacaacggcaaggucgacgugcagaagaucagccccuucgagcuguaccgcaaggacaacggguucgugaccaaguucgccaagaagaacaacggcccggcggucaagucccugaaguacuacgacagcaagcucggcuccagcaucgacgugacccccgacaacgccaagaacaagaaggugauccugcagucccugaagcccuggcggacggacgucuacuucaacgaggagaaccaggaguacgagaucauggggcucaaguacagcgaccugaaguucggcaagaacgggaaguacggcgugcccaaggugcgcuacgaggagaucaagcaggaggaggagaucuccgaggggagcaaguuccuguucucccucuaccggggcgaccgcaucaaggucaccaacgagcugggcgagaaccuggaccuccuguucagcucccggacccugccggcccagaagggguacguggagcucaagcccaucgacaagaccaaguucgacggcaaggagaaggugagcuucuacgggacggucacccccaacggccaguucgugaagaaguucgccaagaagggguacaagauccugaagcugaacaccgacgagcucggcaacaccuacaucgagaacggcgagaaggagcccuccgacauccuggacauguga

SEQ ID NO: 1628 - RNA, 3366 nt, Artificial Sequence
  Cas9 variant
augaacggccuggugcucgggcuggacaucggcaucgggagcgucggcguggggauccugaacaaggacaccggcgagaucauccacgccaacucccgcaucuuccccgccgcgaccgccgacaacaacgugguccggcgcagcucccggcagggccgccggcucaaccaccgcaagaagcaccggagcgugcgccugaaggaccuguucgaguacuacgaccuccugacggacuucuccaaggugagcaucaaccugaacccguaccggcuccgcgucaacgggcugaaccagcagcugaccaacgaggagcuguucaucgcccucaagaacaucgugaagcggcgcggcaucuccuaccuggacgacgccagcgaggacgggggcgccguguccagcgacuacgggaaggcggucgaggagaaccggaagcuccuggccgagcagacccccggccagauccagcuggagcgcuucgagaaguacggccaggugcgcggggacuucaccguggucgagaacggcgagaagcggcggcucaucaacguguucuccacgagcgccuacaagaaggaggccgagcgcauccugcggaagcagcaggaguacaacaaccagaucauggacgaguucaucgcggacuaccugaccauccucaccgggaagcgcaaguacuaccacggccccggcaacgagaagucccggaccgacuacgggcgcuuccgcacggacggcaccacccuggacaacaucuucgggauccugaucggcaagugcaccuucuaccccgagaaguaccgggccagcaaggccuccuacacggcccaggaguucaaccuccugaacgaccugaacaaccucaccgugccgaccgagaccaagaagcugagcgaggagcagaagaagacgaucgucgaguacgccaaguccgcgaagacccugggggccagcacccuccugaaguacaucgccaagaugaucgacgccuccguggaccagauccgcggcuaccggguggacgucaagaacaagcccgagaugcacaccuucgagguguaccgcaagaugcagagccuggagacgaucagcgugggcgaguucucccgggagguccucgacgagcuggcccacgugcugacccucaacaccgagcgcgaggggaucgaggaggcgaucaacaccaagcugcgggacagcuucucccaggaccagauccuggagcucgugcaguuccgcaagaacaacagcucccuguucagcaagggcuggcacaacuucucccugaagcucaugauggagcugauccccgagcuguacgagacgagcgaggagcagauggccauccucacccggcuggggaagcagaaguucaaggagaccuccaagcgcaccaaguacaucgacgagcaggaggucacggaggagaucuacaaccccguggucgccaagagcgugcggcaggccaucaagaucaucaacgaggccaccaagaaguacggcaucuucgacaacaucgugaucgagauggcgcgcgagaacaacgaggaggaggccaagaaggacuacaucaagcggcagaaggccaaccacgacgagaagaacgccgccauggagaaggcggccuuccaguacaacggggagaaggagcugccggacuccaucuuccacggccacaaggagcucgccaccaagguccgccuguggcaccagcagggcgagaagugccuguacaccgggaagaacauccccaucagcgaccugauccacaaccaguacaaguacgagaucgaccacauccucccccugucccugagcuucgacgacucccucagcaacaaggugcuggugcuggccacggcgaaccaggagaagggccagcggacccccuuccaggcccucgacuccauggacgacgccuggagcuaccgcgaguucaaguccuacgucaaggacagcaagagccuggggaacaagaagaaggacuaccugcucaccgaggaggacaucuccaagaucgaggugaagcagaaguucaucgagcggaaccugguggacacccgcuacagcucccgggucgugcugaacacgcuccaggacuucuacaaggcccacaaguucgacaccaccaucagcgugguccgcggccaguucaccucccagcugcgccggaagugggggcuggagaagucccgcgagaccuaccaccaccacgccguggacgcgcucaucaucgccgccagcagccagcugcggcuguggaagaagcagaacaacccgcucaucuccuacaaggagggccaguucguggacagcgagacgggcgagaucaucucccugaccgacgacgaguacaaggagcuggucuucaaggcccccuacgaccacuucguggacacccuccgcagcaagaaguucgaggacuccauccuguucagcuaccagguggacuccaaguucaaccggaagaucagcgacgccaccaucuacgcgacgcgcaagaccaagcuggacaaggacaaguccgaggagaccuacguccucgggaagaucaaggacaucuacagccagagcggcuacgacgccuucaucaagaucuacaacaaggacaaguccaaguuccugauguaccacaaggacccccagaccuucgagaaggugaucgaggagauccugcggacguaccccagcaaggaguucaacgagaagaacaaggagguguccugcaacccguucgagaaguacaagcaggagaacgggcccauccgcaaguacagcaagaagggcaacggccccgagaucaagucccucaaguacuacgacaagaacauccccgagagcuucaucaacaucaccccguccaacagcaagaacaaggucauccugcggcagcugaaccccuggcgcaccgacguguacuucaaccaccagaccgagaaguacgagcuccuggggcugaaguacgccgaccuccaguucgagaagaagacgggcaccuacuccaucaccaucgacaaguacaacgagaucaaggagaaggagggggugagcgagcacuccgaguucaaguucacccuguacaagaacgaccugcuccugaucaaggacacggagaucaaggaggagcagaucuuccgguuccugagccgcaccaugcccaaccagaagcacuacgucgagcucaagcccuacuacaagggcaacuucgaggggaaggagcggaucaagguguucaacaccaccuccaacggccgcugccugaagggccugcggaagaaggggcucagcaucuacaagaucaagacggacgugcugggcaacaagcacuucaucaagaaggagggggagaagccgaagcugaaguucuga

SEQ ID NO: 1629 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgcaucgugcggcugaaccgccucuucgaggaguccggccugaucaccgacuucaccaagaucagcaucaaccugaacccguaccagcuccgggugaaggggcugaccgacgagcuguccaacgaggagcuguucaucgcccucaagaacauggucaagcaccgcggcaucagcuaccuggacgacgccuccgacgacgggaacagcuccgugggcgacuacgcccagaucgugaaggagaacagcaagcagcucgagacgaagacccccgggcagauccagcuggagcgguaccagaccuacggccagcugcgcggcgacuucaccgucgagaaggacgggaagaagcaccggcucaucaacguguuccccacguccgccuaccgcagcgaggcgcugcggauccugcagacccagcaggaguucaacccccagaucaccgacgaguucaucaaccgcuaccucgagauccugaccggcaagcggaaguacuaccacgggccgggcaacgagaagucccgcacggacuacggccgguaccgcaccagcggggagacccuggacaacaucuucggcauccucaucgggaagugcaccuucuaccccgacgaguuccgcgccgccaaggccuccuacacggcgcaggaguucaaccugcugaacgaccucaacaaccugaccgugcccaccgagaccaagaagcugagcaaggagcagaagaaccagaucaucaacuacgucaagaacgagaaggccaugggccccgccaagcuguucaaguacaucgccaagcuccuguccugcgacguggccgacaucaaggaguaccggaucgacaagagcgggaaggcggagauccacacguucgaggccuaccgcaagaugaagacccucgagacccuggacaucgagcagauggaccgggagacccuggacaagcucgccuacgugcugacgcugaacaccgagcgcgagggcauccaggaggcccucgagcacgaguucgccgacggcuccuucagccagaagcaggucgacgagcuggugcaguuccggaaggcgaacagcuccaucuucgggaagggcuggcacaacuucagcgugaagcugaugauggagcucaucccggagcuguacgagaccuccgaggagcagaugaccauccugacgcgccucgggaagcagaagaccaccagcuccagcaacaagaccaaguacaucgacgagaagcugcugacggaggagaucuacaaccccgucguggccaaguccgugcggcaggccaucaagaucgucaacgccgccaucaaggaguacggcgacuucgacaacaucgugaucgagauggcgcgcgagaccaacgaggacgacgagaagaaggccauccagaagauccagaaggccaacaaggacgagaaggacgccgccaugcucaaggcggccaaccaguacaacgggaaggccgagcugccccacagcguguuccacggccacaagcagcuggccaccaagauccggcuguggcaccagcagggcgagcgcugccucuacaccgggaagacgaucuccauccacgaccugaucaacaacagcaaccaguucgaggucgaccacauccugccccucuccaucaccuucgacgacagccuggcgaacaaggugcuggucuacgccaccgccaaccaggagaagggccagcggaccccguaccaggcccucgacuccauggacgacgccuggagcuuccgcgagcugaaggcguucgugcgggaguccaagacccugagcaacaagaagaaggaguaccuccugacggaggaggacaucuccaaguucgacgugcgcaagaaguucaucgagcggaaccuggucgacacccgcuacgccagccggguggugcucaacgcccugcaggagcacuuccgcgcccacaagaucgacaccaaggucuccguggugcgggggcaguucaccagccagcugcgccgccacuggggcaucgagaagacgcgggacaccuaccaccaccacgccgucgacgcgcucaucaucgccgccagcauccagcugaaccuguggaagaagcagaagaacacccucguguccuacagcgaggaccagcugcuggacaucgagaccggggagcucaucuccgacgacgaguacaaggagagcguguucaaggcccccuaccagcacuucgucgacacgcugaaguccaaggaguucgaggacagcauccuguucuccuaccagguggacagcaaguucaaccgcaagaucuccgacgccaccaucuacgcgacccggcaggccaaggugggcaaggacaaggccgacgagaccuacguccucggcaagaucaaggacaucuacacgcaggacggguacgacgccuucaugaagaucuacaagaaggacaagagcaaguuccugauguaccgccacgacccccagaccuucgagaaggugaucgagcccauccuggagaacuacccgaacaagcagaucaacgagaagggcaaggaggugcccgucaaccccuuccucaaguacaaggaggagcacggguacauccggaaguacuccaagaagggcaacggccccgagaucaagagccugaaguacuacgacuccaagcuggggaaccacaucgacaucaccccgaaggacagcaacaacaagguggugcuccaguccgucagccccuggcgcgcggacguguacuucaacaagaccacgggcaaguacgagauccuggggcugaaguacgccgaccuccaguucgagaagggcaccgggaccuacaagaucucccaggagaaguacaacgacaucaagaagaaggagggcguggacagcgacagcgaguucaaguucacccuguacaagaacgaccugcuccuggucaaggacacggagaccaaggagcagcagcuguuccgguuccucucccgcaccaugcccaagcagaagcacuacguggagcugaagcccuacgacaagcagaaguucgagggcggggaggcccugaucaaggugcucggcaacgucgccaacagcgggcagugcaagaagggccuggggaaguccaacaucagcaucuacaaggugcggaccgacgugcugggcaaccagcacaucaucaagaacgagggcgacaagccgaagcucgacuucuga

SEQ ID NO: 1630 - RNA, 3366 nt, Artificial Sequence
  Cas9 variant
augaacggccuggugcucgggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugaaccgccggaagaagcaccgcggcguccgguuccaggaccuguucgaggacuacggccuccugaccgacuucuccaaggugagcaucaaccugaacccguaccgccuccggguggacgggcugaaccagcagcugacgaacgaggagcuguucaucgcccucaagaacaucgucaagcgccggggcaucuccuaccuggacgacgcgagcgaggacgggggcgccguguccagcgacuacgggaaggccguggaggagaaccgcaagcuccuggccgagcagacccccggccagauccagcuggagcgguucgagaaguacggccagguccgcggggacuucaccgugguggagaacggcgagaagugccggcucaucaacgucuucuccaccagcgcguaccgcaaggaggccgagaagauccugcggaagcagcaggaguucaacaaccagaucacggacgaguucaucgaggacuaccugaagauccucaccgggaagcgcaaguacuaccacggccccggcaacgagaagucccggaccgacuacgggcgcuuccgcaccgacggcacgacccuggacaacaucuucggggugcugaucggcaagugcaccuucuaccccaacgaguaccgggccagcaaguccagcuacaccgcccaggaguucaaccuccugaacgaccugaacaaccucacggugccgaccgagaccaagaagcuguccgaggagcagaagaaggucaucguggaguacgccaaggaggcgaagacccugggggccagcacgcuccugaaguacaucgugaagaugaucgacgccuccgucgaccagaucagcggcuaccgcguggacgugaacaacaagcccgagaugcacaccuucgaggucuaccggaagaugcagucccuggagaccaucagcgugggcgagcucagccgcaacgugcuggacgagcuggcccacauccucacccugaacacggagcgggaggggaucgaggaggccaucaacuccaagcugaugggcgucuucagccaggaccaggugcucgagcugguccaguuccgcaagaacaacuccagccuguucuccaagggguggcacaacuucagccucaagcugaugauggagcugauccccgagcucuacgagaccuccgaggagcagaugaccauccugacccggcugggcaagcagaaguccaaggagacgagcaagcgcaccaaguacaucgacgagaaggagcucaccgaggagaucuacaaccccgugguggccaagagcguccggcaggcgaucaagaucaucaacgaggccaccaagaagcacgggaucuucgacaacaucgugaucgagauggcccgcgagaacaacgaggaggacgccaagaaggacuacaucaagcggcagaaggcgaaccaggacgagaagaacgccgccauggagaaggccgccuuccaguacaacggcaagaaggagcugccgggcaacaucuucaacgggcacaaggagcuggcgacgaagauccgccuguggcaccagcagggcgagaagugccucuacaccgggaagaccauccccaucuccgaccugauccacaaccaguacaaguacgagaucgaccacauccugccccucagccuguccuucgacgacagccuguccaacaaggugcucguccacgccaccgccaaccaggagaagggccagcggacgcccuuccaggcccuggacagcauggacgacgcgugguccuaccgcgaguucaagagcuacgugaaggaccugaagucccucagcaacaagaagaaggacuaccugcugaccgaggaggacaucagcaagaucgaggugaagcagaaguucaucgagcggaaccucgucgacacccgcuacuccagccggguggugcugaacgcccugcaggacuucuacaagucccaccaguucgacaccacgaucagcgucgugcgcgggcaguucaccucccagcuccggcgcaaguggggccuggagaagucccgcgagaccuaccaccaccacgccguggacgcccugaucaucgccgcgagcagccagcuccggcuguggaagaagcagaacaacccgcugaucaccuacaaggagggccaguucgucgacucccagaccggggagaucaucagccucacggacgacgaguacaaggagcugguguucaaggcccccuacgaccacuucguggacacccugcacuccaagaccuucgaggacggcauccucuucagcuaccaggucgacuccaaguacaaccgcaagaucagcgacgccaccaucuacgccacgcggaaggccaagcuggacaaggacaaguccgaggagaccuacgugcuggggaagaucaaggacaucuacagccaggcgggcuacgacgccuucaucaagaucuacaacaaggacaagcgcaaguuccucauguaccacaaggacccccagaccuucgagaaggugaucgaggagauccugcggaccuaccccuccaaggagcgcaacgacaagaacaaggaggucccgugcaaccccuucgagaaguaccggcaggagaacggccccauccgcaaguacagcaagaaggggaacggccccgagaucaagugccugaaguacuacgacaacaagcucgggaacuacaucgacaucagcccggacggcuccgacaaccagguggugcugcagagccugaagcccuggcggacggacgucuacuucaaccaccagaccaaggaguacgagcucauggggcugaaguacuccgaccugagcuucgagaagggcuccggcaaguacagcaucuccaacgagaaguacaacagcaucaagcgcaucgagggggugaacgagcaguccgaguucaaguucacccucuacaagaacgaccugauccugaucaaggacagcgagaacaacgagcagaagcuguuccgguucaacucccgcaacgacaccgccaagcacuacguggagcucaagcccuacgacaaggcccgguucgacggccagcaggagcugaucacgauccucgggaacgucgccaagggcgggcagugccugaagggccugaacaagagcaacaucuccaucuucaaggugaagaccgacgugcucggcaagaagcacaucaucaagaaggagggggacgagcccaagcugaaguucuga

SEQ ID NO: 1631 - RNA, 3366 nt, Artificial Sequence
  Cas9 variant
auggccgacaagacccugggcgcccucaccuucggguucgacaucggcaucgcgagcgugggguggugcguccugggcgagaaccgcaucguggaccugggggugcgggccuucgacaaggccgagacggccaaggagggcgagucccucaaccuggcccgccggaccgcgcgccugaugcggcgccggcuccgccggcgcgccuggcggcugaccaagcuggcccgccuccugaagcgggagggccugaucgccgacgcguuccagaugcaccagcccagcgccaccuccccguggaagcuccgcgucgaggcccuggaccggcgccugacggacgacgagugggcccgggugaucuaccaccucugcaagcaccgcggguuccacuggaucagccgggccgaggagaagaaggcggagggcgacgccaagggggaguccggccgcgugaagaaggggcugagcgacacccagcggcgcaugggcgagaagggcuaccgcuccgccgccgagaugguccuggccgaguuccccgaggcgcagcggaacaagcagggggacuacggcaaggcccucagccgcgugcugcuguccgaggagcucgcccugcuguuccggcgccagcgggagcucgggcacacccacgccagcaaggagcuggaggccgcgauccugggcaacggcgaccgcaagggcggccucuucugggcccagaagccgccccuggccggggccgaccugcucaagaugcuggggaagugcaccuucgagaaggacgaguaccgggcccccaaggcguccuucacggccgagcgccacguguggcugacccggcucaacaaccugcgcgucgugguggacgggaccacccggccccugacggaggacgagcgccgggucgcccucccccugcccuacggcuacgccgacgcgaagcugaccuacaagcagcuccgcgccgcccugagcaaggccggccuguccaacuucagcuucgccgggaucgcggacgacaaggagaaggacacccucaccaagcugccggccugggagacgcuguccaagacccucaagggcaaggggcuggagaccgagugggagggcauggccggggccgccaccggcggcgaccccacgcugcucgacgagaucagccgggugcuguccguguacaaggacggggacgaggucgacguggagcugcgcaagcugccccuccccggcggggagaagaugguggagacccugagcgagaucuccuucgacaaguuccacgcgcugagccucaaggcccugcggaagaucgucccgcacauggagaccggccugcgcuacgacgaggccugcgccgccgcgggguaccaccacagccagcuccacgaggccggcgccggcgggcagaaguaccugccgcccuucuacacccggcgcgacaaggacggccgcaugguguucgacgaggagcuggacgugccccggaaccccgucgugcuccgcgcccugaaccaggcgcggaaggugcugaacgcccucguccgcgccuacgggucccccagcgccgugcacaucgagauggcccgggaccuguccaagccccuggucggccaccccacgccgaacggcggguacaucgagggccgccgggacaucgagaagcuccagaaggaguaccgcgagcggaacgagaaggacaaggcggccuucgccgccgagcacgggaucgccgccaagagccgcgaguucgagaaguuccagcuguaccgggagcagcagggcaagugcgccuacucccugaagccccucgaccugcaccgcgugcugcacgacaucggguacgccgagguggaccacgcccuccccuacagccgguccuacgacgacggcaagaacaacaagguccuggugcugaccgaggagaaccgcaacaagggcaaccggaccgccuacgaguaccucugcgcguuccccgggggcgagaacggggagcgcuggcggaacuucguggccuacgucgagagcaacaaguccuaccgccuggccaagcggacccgccugcuccggaaggacuucggcgggaaggccgcggaggaguuccgcgagcgcaaccugaacgacacgcgguacaucugcaaguucuucaagaacuucguggagcgcuuccugcagcucaaggugggcgccgacggcaccgccgccaagcggugcgucgugcugagcgggcagaccaccgccuuccugcgcgcgcgguggggccuccugaaggugcgcggggccuccgaccggcaccacgcccuggacgccgccgucguggcggccugcagccacggcauggugaagcgccucgccgacuacucccggacgaaggagcuggccaagguccgcgacggguucccggaccccgagaccggcgagaucguggaccccgccauguuccagcagcugcacgcgcacuuccccgacccguggccccacuuccggggcgagcucgaggcccgccugcagcuggacgacagcgccgagcuccgggcccagcuggagauguucgggaccuaccccgccgaggcgcuggagacccuccgcccgcuguucgugucccgggcgccccagcgccggaacggcggggccgcccacaaggagacgaucuacgcgcagcccgagcgccugaaggagcagggcggggucacccagaaggugagccucgccucccugaagcccaccgacaucgacaagcugaucgacccgcaccggaacgagaagcucuacgccgccauccgcgcccgccuggaggcgcacggcggcaagagcgacaaggccuuccccgccgacaacccccugcggaagcccgaccgcgacgggaacccgaccggccccaucgugcgggccgucaccauggugaucgacaagcucuccgggauccagauccgcggcggcaucgccaagaacgacacgaugcugcggguggacgucuuccgccacaagaaggacgggaaguuccaccuggugccccucuacgugcaccacgcggucgcccaggagcugcccaaccgggccaucguggccuucaaggacgaggacgaguggacccugaucgacgacaacuuccacuuccucuucagcuuccacccgaacgacuucauccgcaucacccagaagaacaaggcccccauccugggcuacuacgcgagcugccaccgggggaccggcaaccugaaccucugggcccacgaccgcaaccagaagguggggaaggacggccagaucgagggcaucggggucaagacggccguggcccuggagaaguuccacguggacguccugggcaacaucuaccccgcgcccccggagcagcggcacgggcucgccuga

SEQ ID NO: 1632 - RNA, 3366 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgccgggugcgccugaaccgccucuucgaggaguccggccugaucaccgacuucaccaagaucagcaucaaccugaacccguaccagcuccgggugaaggggcugaccgacgagcuguccaacgaggagcuguucaucgcccugaagaacauggucaagcaccggggcaucagcuaccuggacgacgccuccgacgacgggaacagcuccgugggcgacuacgcccagaucgugaaggagaacagcaagcagcucgagacgaagacccccgggcagauccagcuggagcgcuaccagaccuacggccagcugcggggcgacuucaccgucgagaaggacgggaagaagcaccgccucaucaacguguuccccacguccgccuaccggagcgaggcgcugcgcauccugcagacccagcaggaguucaacccccagaucaccgacgaguucaucaaccgguaccucgagauccugaccggcaagcgcaaguacuaccacgggccgggcaacgagaagucccggacggacuacggccgcuaccgcaccagcggggagacccuggacaacaucuucggcauccucaucgggaagugcaccuucuaccccgacgaguuccgggccgccaaggccuccuacacggcgcaggaguucaaccugcugaacgaccucaacaaccugaccgugcccaccgagaccaagaagcugagcaaggagcagaagaaccagaucaucaacuacgucaagaacgagaaggccaugggccccgccaagcuguucaaguacaucgccaagcuccuguccugcgacguggccgacaucaagggguaccgcaucgacaagagcggcaaggcggagauccacacguucgaggccuaccggaagaugaagacccucgagacccuggacaucgagcagauggaccgcgagacccuggacaagcucgccuacgugcugacgcugaacaccgagcgggagggcauccaggaggcccucgagcacgaguucgccgacggguccuucagccagaagcaggucgacgagcuggugcaguuccgcaaggcgaacagcuccaucuucggcaagggguggcacaacuucagcgugaagcugaugauggagcucaucccggagcuguacgagaccuccgaggagcagaugaccauccugacgcggcucggcaagcagaagaccaccagcuccagcaacaagaccaaguacaucgacgagaagcugcugacggaggagaucuacaaccccgucguggccaaguccgugcgccaggccaucaagaucgucaacgccgccaucaaggaguacggggacuucgacaacaucgugaucgagauggcgcgggagaccaacgaggacgacgagaagaaggccauccagaagauccagaaggccaacaaggacgagaaggacgccgccaugcucaaggcggccaaccaguacaacggcaaggccgagcugccccacagcguguuccacggccacaagcagcuggccaccaagauccgccuguggcaccagcagggggagcggugccucuacaccggcaagacgaucuccauccacgaccugaucaacaacagcaaccaguucgaggucgaccacauccugccccucuccaucaccuucgacgacagccuggcgaacaaggugcuggucuacgccaccgccaaccaggagaaggggcagcgcaccccguaccaggcccucgacuccauggacgacgccuggagcuuccgggagcugaaggcguucgugcgcgaguccaagacccugagcaacaagaagaaggaguaccuccugacggaggaggacaucuccaaguucgacgugcggaagaaguucaucgagcgcaaccuggucgacacccgguacgccagccgcguggugcucaacgcccugcaggagcacuuccgggcccacaagaucgacaccaaggucuccguggugcgcggccaguucaccagccagcugcgccggcacugggggaucgagaagacgcgcgacaccuaccaccaccacgccgucgacgcgcucaucaucgccgccagcucccagcugaaccuguggaagaagcagaagaacacccucgugagcuacuccgaggaccagcugcuggacaucgagaccggcgagcucaucagcgacgacgaguacaaggaguccguguucaaggcccccuaccagcacuucgucgacacgcucaagagcaaggaguucgaggacuccauccuguucagcuaccagguggacuccaaguucaaccggaagaucagcgacgccaccaucuacgcgacccgccaggccaaggugggcaaggacaaggccgacgagaccuacguccucgggaagaucaaggacaucuacacgcaggacggcuacgacgccuucaugaagaucuacaagaaggacaaguccaaguuccugauguaccggcacgacccccagaccuucgagaaggugaucgagcccauccuggagaacuacccgaacaagcagaucaacgagaaggggaaggaggugcccugcaaccccuuccucaaguacaaggaggagcacggcuacauccgcaaguacagcaagaagggcaacgggcccgagaucaagucccugaaguacuacgacagcaagcugggcaaccacaucgacaucaccccgaaggacuccaacaacaaggucgugcuccagagcgugucccccuggcgggcggacgucuacuucaacaagaccacggggaaguacgagauccugggccugaaguacgccgaccuccaguucgagaaggggaccggcaccuacaagaucagccaggagaaguacaacgacaucaagaagaaggagggcguggacagcgacuccgaguucaaguucacccuguacaagaacgaccugcuccuggugaaggacacggagaccaaggagcagcagcuguuccgcuuccucagccggaccaugcccaagcagaagcacuacgucgagcugaagcccuacgacaagcagaaguucgagggcggggaggcccugaucaaggugcucgggaacguggccaacuccggccagugcaagaaggggcugggcaagagcaacaucuccaucuacaagguccgcaccgacgugcugggcaaccagcacaucaucaagaacgagggggacaagccgaagcucgacuucuga

SEQ ID NO: 1633 - RNA, 3366 nt, Artificial Sequence
  Cas9 variant
augaacggccuggugcucgggcuggacaucggcaucgggagcgucggcguggggauccugaacaaggacaccggcgagaucauccacgccaacucccgcaucuuccccgccgcgaccgccgacaacaacgugguccggcgcagcucccggcagggccgccggcucaaccaccgcaagaagcaccggagcgugcgccugaaggaccuguucgaguacuacgaccuccugacggacuucuccaaggugagcaucaaccugaacccguaccggcuccgcgucgacgggcugaaccagcagcugaccaacgaggagcuguucaucgcccucaagaacaucgugaagcggcgcggcaucuccuaccuggacgacgccagcgaggacgggggcgccguguccagcgacuacgggaaggcggucgaggagaaccggaagcuccuggccgagcagacccccggccagauccagcuggagcgcuucgagaaguacggccaggugcgcggggacuucaccguggucgagaacggcgagaagcggcggcucaucaacguguucuccacgagcgccuacaagaaggaggccgagcgcauccugcggaagcagcaggaguacaacaaccagaucauggacgaguucaucgcggacuaccugaccauccucaccgggaagcgcaaguacuaccacggccccggcaacgagaagucccggaccgacuacgggcgcuuccgcacggacggcaccacccuggacaacaucuucgggauccugaucggcaagugcaccuucuaccccgaggaguaccgggccagcaaggccuccuacacggcccaggaguucaaccuccugaacgaccugaacaaccucaccgugccgaccgagaccaagaagcugagcgaggagcagaagaagacgaucgucgaguacgccaaguccgcgaagacccugggggccagcacccuccugaaguacaucgccaagaugaucgacgccuccguggaccagauccgcggcuaccggguggacgucaacaacaagcccgagaugcacaccuucgagguguaccgcaagaugcagcugcucgagacgauccccgugggcgaguucagccgggagguccuggacgagcuggcccacauccucacccugaacaccgagcgcgaggggaucgaggaggcgaucaacaccaagcugauggacguguucagccaggaccagauccucgagcuggugcaguuccggaagaacaacuccagccuguucuccaagggcuggcacaacuucagccucaagcugaugaucgagcugauccccgagcucuacgagacguccgaggagcagauggccauccugacccgccuggggaagcagaaguucaaggagaccagcaagcggaccaaguacaucgacgagcaggaggucacggaggagaucuacaacccgguggucgccaaguccgugcgccaggccaucaagaucaucaacgaggccaccaagaaguacggcaucuucgacaacaucgugaucgagauggcgcgggagaacaacgaggaggaggccaagaaggacuacaucaagcgccagaaggccaaccacgacgagaagaacgccgccauggagaaggcggccuuccaguacaacggggagaaggagcuccccgacagcaucuuccacggccacaaggagcuggccaccaagguccggcuguggcaccagcagggcgagaagugccuguacaccgggaagaacauccccaucuccgaccucauccacaaccaguacaaguacgagaucgaccacauccugccccugagccucuccuucgacgacagccuguccaacaaggugcuggugcucgccacggcgaaccaggagaagggccgccggaccccguuccaggcccuggacagcauggacgacgccugguccuaccgcgaguucaagagcuacgucaaggacuccaagagccuggggaacaagaagaaggacuaccuccugaccgaggaggacaucuccaagaucgaggugaagcagaaguucaucgagcggaaccugguggacacccgcuacagcagccgggucgugcucaacacgcugcaggacuucuacaaggcccacaaguucgacaccaccaucuccgugguccgcggccaguucaccagccagcugcgccggaagugggggcucgagaagucccgcgagaccuaccaccaccacgccguggacgcgcugaucaucgccgccagcucccagcugcggcucuggaagaagcagaacaacccccugaucagcuacaaggagggccaguucguggacuccgagacgggcgagaucaucagccugaccgacgacgaguacaaggagcucgucuucaaggcccccuacgaccacuucguggacacccugcgcuccaagaaguucgaggacagcauccuguucuccuaccagguggacagcaaguucaaccggaagaucuccgacgccaccaucuacgcgacgcgcaaggccaagcucgacaaggacaagagcgaggagaccuacguccuggggaagaucaaggacaucuacucccagagcggcuacgacgccuucaucaagaucuacaacaaggacaaguccaaguuccugauguaccacaaggacccccagaccuucgagaaggugaucgaggagauccuccggaccuacccgagcaaggaguucaacgagaagaacaaggaggugagcugcaaccccuucgagaaguacaagcaggagaacgggcccauccgcaaguacuccaagaagggcaacggccccgagaucaagagccugaaguacuacgacaagaacaucccggaguccuucaucaacaucacgcccagcaacuccaagaacaaggucauccugcggcagcucaaccccuggcgcaccgacguguacuucaaccaccagaccgagaaguacgagcugcuggggcucaaguacgccgaccugcaguucgagaagaagaccggcacguacagcaucaccaucgacaaguacaacgagaucaaggagaaggaggggguguccgagcacagcgaguucaaguucacccuguacaagaacgaccuccugcugaucaaggacaccgagaucaaggaggagcagaucuuccgguuccucucccgcacgaugcccaaccagaagcacuacgucgagcugaagccguacuacaagggcaacuucgaggggaaggagcggaucaagguguucaacaccaccagcaacggccgcugccugaagggccuccggaagaaggggcuguccaucuacaagaucaagaccgacgugcugggcaacaagcacuucaucaagaaggagggggagaagcccaagcucaaguucuga

SEQ ID NO: 1634 - RNA, 3369 nt, Artificial Sequence
  Cas9 variant
augaacggcaagauccuggggcucgacaucggcguggccagcgucggggugggcauccuggacaagaagaccggggagaucauccacgccuccagccgcaucuuccccgcggccaccgccgacuccaacguggagcggcgcggcuuccggcagggccgccggcuggggcgccggaagaagcaccgcaagguccggcucgccgaccuguucagcgacacgggccugaucaccgacuucuccaaggugagcaucaaccucaacccguacgagcugcgcaucaaggggcugaacgagaagcucaccaacgaggagcuguucaucgcccugaagaacaucgugaagcggcgcggcaucuccuaccucgacgacgcgaacgaggacggggagagcuccagcuccgaguacggcaaggccgucgaggagaaccggaagcugcuggccgacaagacccccggccagauccagcucgagcgcuucgagaaguacgggcagguccggggcgacuucacgaucgaggagaacggggagaagcaccgccugcugaacguguucagcaccuccgccuacaagaaggaggcggagcggauccucaccaagcagcaggacuacaaccaggacaucaccgacgaguucauccaggccuaccugacgauccugaccggcaagcgcaaguacuaccacggccccgggaacgagaagucccggaccgacuacggccgcuuccggaccgacgggacgacccucgacaacaucuucggcauccugaucgggaagugcaccuucuaccccgaggaguaccgcgccgccaaggccagcuacaccgcgcaggaguucaaccugcucaacgaccugaacaaccugacggugccgaccgagaccaagaagcucagcgaggagcagaagcgccagaucaucgaguacgccaagggcgccaagacccugggcgccgccacgcugcucaaguacaucgcgaagcugguggacggguccguggaggacaucaagggcuaccggaucgacaagagcgagaagcccgagaugcacaccuucgacaucuaccgcaagaugcagacccuggagaccgucgacguggagaagcucucccgggaggugcuggacgagcuggcccacauccucacgcugaacaccgagcgcgaggggaucgaggaggccaucaaggucagcuucaucaagcgggaguucgagcaggaccagaucgccgagcuggugagcuuccgcaaguccaacagcucccucuucggcaagggguggcacaacuucagcaucaagcugaugaccgagcugauccccgagcucuacgagaccuccgaggagcagaugacgauccugacccggcugggcaagcagaagaccaaggcccgcagcaagcggaccaaguacaucgacgagaaggagcucacggacgagaucuacaaccccguggucgcgaaguccgugcgccaggccaucaagaucaucaaccuggccaccaagaaguacggcguguucgacaacaucgucaucgagauggcccgggagaacaacgaggaggacgccaagaaggacuacgugaagcgccagaaggcgaacgaggacgagaagaacgccgccauggagaaggccgcgcaccaguacaacgggaagaaggagcugccggacaacguguuccacggccacaaggagcucgccaccaagauccggcuguggcaccagcagggggagaagugccuguacaccggcaagaacauccccaucagcgaccugauccacaaccaguacaaguacgagaucgaccacauccucccccugucccugagcuucgacgacucccucgccaacaagguccuggugcuggccacggccaaccaggagaaggggcagcgcacccccuuccaggcgcucgacagcauggacgacgccugguccuaccgggaguucaaggccuacguccgcggcgcccgggcccugagcaacaagaagaaggacuaccugcucaacgaggaggacaucaacaagaucgaggugaagcagaaguucaucgagcgcaaccugguggacacccgguacuccagccgcgucgugcugaacgcgcuccaggacuucuacaagcugaacgacuucgacaccaagaucuccgugguccgcggccaguucaccagccagcugcggcgcaaguggcggaucgacaagucccgcgagacguaccaccaccacgccguggacgcccucaucaucgccgccagcagccagcugcggcuguggaagaagcaggggaacccgcucaucuccuacaaggagaaccaguucguggacagcgagaccggcgagaucaucucccugaccgacgacgaguacaaggagcuggucuuccgcgcgcccuacgaccacuucguggacaccgugagcuccaagaaguucgaggaccggauccucuucagcuaccaggucgacuccaaguacaaccgcaagaucagcgacgccacgaucuacuccacccggaaggccaagcuggggaaggacaagagcgaggagaccuacgugcugggcaagaucaaggacaucuacacccagacgggcuacgacgccuucaucaagcucuacaagaaggacaaguccaaguuccugauguaccacaaggaccccaucaccuucgagaaggugaucgaggagauccugaagaccuaccccgacaaggagaucaacgagaaggggaaggaggucgcgugcaacccguucgagaaguaccgccaggagaacggcccccuccggaaguacagcaagaaggggaagggccccgagaucaagucccugaaguacuacgacaacaagcuggggaaccacaucgacaucacccccgacaacagcgagaaccaggugauccuccagucccugaagccguggcgcacggacguguacuucaaccacaagaccaagaucuacgagcugaugggccucaaguacagcgaccuguccuucgagaagggcagcgggaaguaccggaucagccuggacaaguacaacgucaucaagaagaaggagggcgugcacaaggaguccgaguucaaguucacccucuacaagaacgaccugauccugaucaaggaccucgagaaguccgagcagcagcuguuccgcuacaacagccggaacgacaccagcaagcacuacguggagcugaagcccuacgacaaggccaaguucgaggggaaccagccccucauggcccuguucggcaacgucgccaagggcgggcagugccugaagggccucaacaaggccaacaucuccaucuacaaggugcagacggacgugcuggggaacaagcgcuucaucaagaaggagggcgacgcgcccaagcuggaguucuga

SEQ ID NO: 1635 - RNA, 3369 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucguccggcgcaccaaccggcagggccgccggcugacgcgccggaagaagcaccgcaucgugcggcugaaccgccucuucgaggaguccggccugaucaccgacuucaccaagaucagcaucaaccugaacccguaccagcuccgggugaaggggcugaccgacgagcuguccaacgaggagcuguucaucgcccucaagaacauggucaagcaccgcggcaucagcuaccuggacgacgccuccgacgacgggaacagcuccgugggcgacuacgcccagaucgugaaggagaacagcaagcagcucgagacgaagacccccgggcagauccagcuggagcgguaccagaccuacggccagcugcgcggcgacuucaccgucgagaaggacgggaagaagcaccggcucaucaacguguuccccacguccgccuaccgcagcgaggcgcugcggauccugcagacccagcaggaguucaacucccagaucaccgacgaguucaucaaccgcuaccucgagauccugaccggcaagcggaaguacuaccacgggcccggcaacgagaagucccgcacggacuacggccgguaccgcaccaacggggagacccuggacaacaucuucggcauccucaucgggaagugcaccuucuacccggacgaguuccgcgccgccaaggccagcuacacggcgcaggaguucaaccugcugaacgaccucaacaaccugaccgugcccaccgagaccaagaagcugagcaaggagcagaagaaccagaucaucaacuacgucaagaacgagaaggugaugggccccgccaagcuguucaaguacaucgccaagcuccuguccugcgacguggccgacaucaaggggcaccggaucgacaagagcggcaaggccgagauccacacguucgaggcguaccgcaagaugaagacccucgagacccuggacaucgagcagauggaccgggagacccuggacaagcucgccuacguccugacgcugaacaccgagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacgcgccucggcaagcagaagaccaccagcuccagcaacaagaccaaguacaucgacgagaagcugcugacggaggagaucuacaacccggugguggcgaaguccguccggcaggccaucaagaucgugaacgccgccaucaaggaguacggggacuucgacaacaucgugaucgagauggcccgcgagaccaacgaggacgacgagaagaaggcgauccagaagauccagaaggccaacaaggacgagaaggacgccgccaugcucaaggccgcgaaccaguacaacggcaaggccgagcugccccacagcgucuuccacggccacaagcagcuggccaccaagauccggcuguggcaccagcagggggagcgcugccucuacaccggcaagacgaucuccauccacgaccugaucaacaaccccaaccaguucgagguggaccacauccugccccucagcaucaccuucgacgacucccuggccaacaagguccugguguacgcgaccgccaaccaggagaaggggcagcggaccccguaccaggcccucgacagcauggacgacgccugguccuuccgcgagcugaaggccuucgugcgggagagcaagacccuguccaacaagaagaaggaguaccuccugacggaggaggacaucagcaaguucgacguccgcaagaaguucaucgagcggaaccugguggacacccgcuacgcgucccgggugguccucaacgcccugcaggagcacuuccgcgcccacaagaucgacaccaaggugagcgugguccggggccaguucaccucccagcugcgccgccacugggggaucgagaagacgcgggacaccuaccaccaccacgccguggacgcccucaucaucgcggccagcagccagcugaaccuguggaagaagcagaagaacacccucguguccuacagcgaggagcagcugcuggacaucgagaccggcgagcucaucuccgacgacgaguacaaggagagcgucuucaaggcccccuaccagcacuucguggacacgcugaaguccaaggaguucgaggacagcauccuguucuccuaccagguggacagcaaguucaaccgcaagaucuccgacgccaccaucuacgccacccggcaggcgaaggucggcaaggacaagaaggacgagaccuacgugcucgggaagaucaaggacaucuacacgcaggacggcuacgacgccuucaugaagaucuacaagaaggacaagagcaaguuccugauguaccgccacgacccccagaccuucgagaaggugaucgagcccauccuggagaacuacccgaacaaggagaugaacgagaaggggaaggagguccccugcaaccccuuccucaaguacaaggaggagcacggcuacauccggaaguacuccaagaagggcaacgggcccgagaucaagagccugaaguacuacgacuccaagcugcucggcaacccgaucgacaucacccccgagaacagcaagaacaagguggugcugcagucccugaagcccuggcgcaccgacgucuacuucaacaagaacacggggaaguacgagauccucggccugaaguacgccgaccugcaguucgagaagaagaccgggaccuacaagaucagccaggagaaguacaacggcaucaugaaggaggagggcguggacuccgacagcgaguucaaguucacccucuacaagaacgaccugcugcucgugaaggacacggagaccaaggagcagcagcuguuccgguuccugagccgcaccaugcccaacgucaaguacuacguggagcucaagccguacuccaaggacaaguucgagaagaacgagagccugaucgagauccugggguccgccgacaagagcggccggugcaucaaggggcucggcaaguccaacaucagcaucuacaaggugcgcaccgacguccuggggaaccagcacaucaucaagaacgagggcgacaagcccaagcuggacuucuga

SEQ ID NO: 1636 - RNA, 3369 nt, Artificial Sequence
  Cas9 variant
augagcaacggcaagauccuggggcucgacaucggcaucgccuccgugggggucggcgugaucgacgcccagaccggggagaucauccacgcgagcucccgcaucuuccccagcgccaacgccgccaacaacgccgagcggcgcaccuuccggggcucccgccggcugauccgccggaagaagcaccgcaucaagcggcuggacgaccucuucaacgacuuccacaucaaccuggacggcgagaugagcacggacaacccguacgugcugcgcgucaaggggcucucccagaagcugaccguggaggagcuguacaucagcaucaagaacaucaugaagcggcgcggcaucuccuaccucgacgacgcggagagcgacaacgaggccgggcgguccgacuacgccaaggccaucgagcgcaaccggcagcugcugaccagcaagacccccggcgagauccagcucgagcgccuggagaaguacgggcagcugcggggcaacuucacgaucaucgacgaggagggccagucccagcagaucaucaacguguucagcaccuccgacuacgucaaggagguggagaagauccucgacugccagaagauguaccacaaguucaucagcgacgaguucugcgacaagcugaucgagcugcuccgcgagaagcggaaguacuacguggggcccggcaacgagaagucccgcaccgacuacgggaucuaccggaccgacggcacgacccuggagaaccuguucggcauccucaucgggaagugcaccuucuaccccgaccaguaccgcagcucccgcgcgagcuacaccgcccaggaguucaacuuccugaacgaccugaacaaccucacggucccgaccgagaccaagaagcugagccaggagcagaaggaguuccuggugaacuacgccaaggagaccuccgugcucggcgccgggaagauccugcagcagaucgccaagcuggcggacugcaaggucgaggacauccggggcuaccgccucgacaacaaggacaagcccgagcugcacaucuucgagacguaccgggccaugaaggggcuggugccccucguggacaucggcguccugagccgcgagcagcuggacauccucgccgacauccugacccugaacaccgacuucgagggcauccgggaggcccucaagaagcagcugcccaacguguucgacgagaagcaggucaaggggcuggccuccuuccgcaagagcaagucccagcuguucgcgaagggcuggcacaaccucagccagaagaucaugcuggaggugaucccggagcucuacgccaccuccgacgagcagaugacgauccugacccggcuggggaaguucgagaaguccagcguggccgaguaccccagcuccaucaacguggacgagaucaccgacgagaucuacaaccccgucguggccaagagcauccgccagaccaucaagaucaucaacgccuccaucaagaaguggggcgaguucgaccagaucgugaucgagaugccccgggaccgcaacgaggacgaggagaagaagcggaucgcggacgggcagaaggccaacgccaaggagaaggccgacagcauccuccgcgccgcggagcuguacugcgccggcaagguccugccggacuacguguacaacggccacaaccagcuggccacgaagauccggcucugguaccagcagggggagcgcugcaucuacaccggccagcccaucuccauccacgaccugauccacaaccagaaccaguacgagaucgaccacauccugccccucagccugaccuucgacgacucccugagcaacaagguccucgugcuggccaccgcgaaccaggagaaggcccagcggacgcccuacaacuaccugaaguccgccaccagcgccuggagcuaccgcgaguucaaggacuacgugaccaagcggaaggggaucggcaagaagaagugcgaguaccucaccuucgaggaggacaucaacggguucgagguccgcuccaaguucauccagcggaaccugguggacacgcgcuacgccagcaaggugauccugaacgcgcuccaggacuacuucaagaucuccggcauccagaccaaggucagcguggugcgcggccaguucaccucccagcugcggcacaagugggggaucgagaagacccgcgagacguaccaccaccacgccgucgacgcccugaucaucgccgccagcucccagcuccggcuguggaagaagcaggagagcccgcuggugguggacuaccaggagggccgccaggucgaccucgagaccggggagauccuggagcugaccgacgagcaguacaaggagcucguguaccagccgcccuaccagggcuucgugaacaccaucuccagcuccgcguucgacaacgagauccuguucagcuaccaggucgacuccaaggugaaccggaagaucagcgacgccaccaucuacgccacgcgcaacgcccagcugggcaaggacaagaccgaggggaucuacgugcucggcaagaucaaggacaucuacacccaggccggguacgaggcguuccugaagcgguacaccaaggacaagacguccuuccugauguaccacaaggaccucgacaccugggagaaggucaucgagaucauccugcgcgacuaccgggaguacgacgagaagggcaaggagaucgggaaccccuucgagcgcuaccggcgcgagaacggcuacgugaagaaguacagccggaagggcaacgggaccgccaucaagucccugaaguacuacgacaacaagcucggcaaccacaucgacaucacccccgagaacagccgcaacgccgugguccugcagagccugaagcccuggcggacggacguguacuucaacaaggagaccgggaaguacgaguuccucggcaucaaguacuccgaccugagcuucgagaaggggaccggcgaguacggcaucucccaggagaaguacgacagcaucaagaucgccgaggggguggcgaagaaguccaucuucaaguucacccuguacaagcaggaccuccuguucaucaaggacaucgagaacaacuucggcaagcugcuccgcuucacgagcaagaacgacaccuccaagcacuacgucgagcugaagcccuacgacaagaacaaguucgggaccgaggagccccugcucccggugcugggcaacguggccaagagcgggcagugcaucaagggccugaacaaguccaacaucagcaucuacaagguccggaccgacauccucggcuaccgccacuucaucaagcaggagggggagcacccccagcugaaguucaagaaguga

SEQ ID NO: 1637 - RNA, 3369 nt, Artificial Sequence
  Cas9 variant
augagcaacggcaagauccuggggcucgacaucggcaucgccuccgugggggucggcgugaucgacgcccagaccggggagaucauccacgcgagcucccgcaucuuccccagcgccaacgccgccaacaacgccgagcggcgcaccuuccggggcucccgccggcugauccgccggaagaagcaccgcaucaagcggcuggacgaccucuucaacgacuuccacaucaaccuggacggcgagaugagcacggacaacccguacgugcugcgcgucaaggggcucucccagaagcugaccguggaggagcuguacaucagcaucaagaacaucaugaagcggcgcggcaucuccuaccucgacgacgcggagagcgacaacgaggccgggcgguccgacuacgccaaggccaucgagcgcaaccggcagcugcugaccagcaagacccccggcgagauccagcucgagcgccuggagaaguacgggcagcugcggggcaacuucacgaucaucgacgaggagggccagucccagcagaucaucaacguguucagcaccuccgacuacgucaaggagguggagaagauccucgacugccagaagauguaccacaaguucaucagcgacgaguucugcgacaagcugaucgagcugcuccgcgagaagcggaaguacuacguggggcccggcaacgagaagucccgcaccgacuacgggaucuaccggaccgacggcacgacccuggagaaccuguucggcauccucaucgggaagugcaccuucuaccccgaccaguaccgcagcucccgcgcgagcuacaccgcccaggaguucaacuuccugaacgaccugaacaaccucacggucccgaccgagaccaagaagcugagccaggagcagaaggaguuccuggugaacuacgccaaggagaccuccgugcucggcgccgggaagauccugcagcagaucgccaagcuggcggacugcaaggucgaggacauccggggcuaccgccucgacaacaaggacaagcccgagcugcacacguucgagaccuaccgggccaugaaggggcuggugccccucguggacaucggcguccugagccgcgagcagcuggacauccucgccgacauccugacccugaacaccgacuucgagggcauccgggaggcccucaagaagcagcugcccaacguguucgacgagaagcaggucaaggggcuggccuccuuccgcaagagcaagucccagcuguucgcgaagggcuggcacaaccucagccagaagaucaugcuggaggugaucccggagcucuacgccacguccgacgagcagaugaccauccugacccggcuggggaaguucgagaaguccagcguggccgaguaccccagcuccaucaacguggacgagaucaccgacgagaucuacaaccccgucguggccaagagcauccgccagacgaucaagaucaucaacgccuccaucaagaaguggggcgaguucgaccagaucgugaucgagaugccccgggaccgcaacgaggacgaggagaagaagcggaucgcggacgggcagaaggccaacgccaaggagaaggccgacagcauccuccgcgccgcggagcuguacugcgccggcaagguccugccggacuacguguacaacggccacaaccagcuggccaccaagauccggcucugguaccagcagggggagcgcugcaucuacaccggccagcccaucuccauccacgaccugauccacaaccagaaccaguacgagaucgaccacauccugccccucagccugaccuucgacgacucccugagcaacaagguccucgugcuggccacggcgaaccaggagaaggcccagcggacccccuacaacuaccugaaguccgccaccagcgccuggagcuaccgcgaguucaaggacuacgugaccaagcggaaggggaucggcaagaagaagugcgaguaccucacguucgaggaggacaucaacggguucgagguccgcuccaaguucauccagcggaaccugguggacacccgcuacgccagcaaggugauccugaacgcgcuccaggacuacuucaagaucuccggcauccagaccaaggucagcguggugcgcggccaguucaccucccagcugcggcacaagugggggaucgagaagacgcgcgagaccuaccaccaccacgccgucgacgcccugaucaucgccgccagcucccagcuccggcuguggaagaagcaggagagcccgcuggugguggacuaccaggagggccgccaggucgaccucgagaccggggagauccuggagcugaccgacgagcaguacaaggagcucguguaccagccgcccuaccagggcuucgugaacaccaucuccagcuccgcguucgacaacgagauccuguucagcuaccaggucgacuccaaggugaaccggaagaucagcgacgccacgaucuacgccacccgcaacgcccagcugggcaaggacaagaccgaggggaucuacgugcucggcaagaucaaggacaucuacacccaggccggguacgaggcguuccugaagcgguacacgaaggacaagaccuccuuccugauguaccacaaggaccucgacaccugggagaaggucaucgagaucauccugcgcgacuaccgggaguacgacgagaagggcaaggagaucgggaaccccuucgagcgcuaccggcgcgagaacggcuacgugaagaaguacagccggaagggcaacgggaccgccaucaagucccugaaguacuacgacaacaagcucggcaaccacaucgacaucacgcccgagaacagccgcaacgccgugguccugcagagccugaagcccuggcggaccgacguguacuucaacaaggagaccgggaaguacgaguuccucggcaucaaguacuccgaccugagcuucgagaaggggaccggcgaguacggcaucucccaggagaaguacgacagcaucaagaucgccgaggggguggcgaagaaguccaucuucaaguucacgcuguacaagcaggaccuccuguucaucaaggacaucgagaacaacuucggcaagcugcuccgcuucaccagcaagaacgacaccuccaagcacuacgucgagcugaagcccuacgacaagaacaaguucgggaccgaggagccccugcucccggugcugggcaacguggccaagagcgggcagugcaucaagggccugaacaaguccaacaucagcaucuacaagguccggacggacauccucggcuaccgccacuucaucaagcaggagggggagcacccccagcugaaguucaagaaguga

SEQ ID NO: 1638 - RNA, 3372 nt, Artificial Sequence
  Cas9 variant
auggccaagauccugggccucgaccuggggaccaacagcaucggcugggcccugaucgacgacgugcagaacaagauccucggggucggcucccgcaucuuccccauggggguggagaaccugggcgacggcgacggggagaucagcaagaacgcgucccggaccggcacgcgcggggugcggcgccaguucuuccggcgccggcugcgcaagaagguccuccugaaggcccugagcgagaacaacaugugcccgaugaucaccuccgacuucgacaacuggaagaagaccaagcaguuccccagcgagaagcucgccuccugguucgcccugaaccccuacgagcugcggaacaaggcccucagcgagaagcugacccuggaggagaucggccgcaucuucuaccaccucauccagcggcgcggguuccuguccaacagccggaagggcggcacggacgacggggcgaucuucaagggcaaccccaaggaggggaagaucggcaucaccgacacccaggaguccauccaggacaagacccugggcagcuaccucuucgagaucuacccgaaggagaaccagcccuuccagaacgggcuggagcgcauccggaaccgcuacacggugcggaagauguacguggacgaguucgagaugaucugggagaagcaggcccaguacuacuccaaccugaacgaggaccucaagacccuguucggcgggcgcaagcuggacggcuacaaggaggacgggauccucuuccaccagcggccccugcgcagccagaagcaccuggucggcaacugcguguucgagcccaacaagaccaagugcccgaucuccgccauccccuucgagcaguuccggguguggcagugggucaacaccguggaguacaacggcaagaagaucagccagguggagaaggagaagaucgucgaguuccucuacgccaacgacaagacggacuucaagaagauccgcaaggcgaucgggaaggaguccaccgaguucaaguucaacuacaaggacgacgacaagaucgugggcaccuacaccgugagccaccuguccaacaagaaguacuucgggaagaagugguucgaguucagcgagaaggagcaggaggacaucuggcacauccuguacuucuucgacagcaaguccaaccucaaggaguacgccaucaagaacuggaacuucacggaggagcaggccgagagcaucgccaaguucaacgucaaggacggcuacuccagccugucccgcaaggccaucagcaacauccugcccuuccucaagcugggguucaccuacgacguggcggugguccugggcggcaucaagaacguguucgggcacgagugggagaagcucuccgacgagaagcggaacuuccugaucgacaacguggagggcaucguccgcagcaagaccaagggcggguucaucgacgugaucaaggacauccugcggaacgacuacaacaucuccgacaaccagcuccgcaagcuguaccaccacagcgccaccaucuacguggccgagcugcucgagaagcugcccgucgggaaggaggccgacaaggagauccaguccauccggaacccgaucgugaucacggcccuguucgagcuccgcaagcuggucaacgagcugaucgacgacuucggcagcaucgacgagaucaagguggagauggcgcgggaccucaagaucuccaagagccagcgcaacaagauccggcgcgagcagaagcggcuggagcgcgagaacgaccgggugaaggcccgccugcuggaggagggccagcggaucacccacgacaacauccuccuguacaagcugugggaggagugcaagaagaccugccccuacaccgggaaccccaucccccucuacaagcuguucacgggcgagauccagaucgagcacauccacccguggucccgcagccugaacgacuccuucgccaacaagacccucugcuacgccgacgagaaccggaagaagggggacaagacccccuacgaguucuacggcaacgacgagagcaacugguccgccaucaaggagcgcgcgcugaagcuguucagcgacaccaaggaguaccccaacgccuaccagaaguucaagcgguucguccagcacaaguucgacgacgacuucagcucccgccagcucaacgacacgcgcuacaucagcaaggaggccaagaacuaccuguccaagaucugcaagaagguggccgugagccccggccaggccaccuccaaccugcggcagaagugggggaugaacaacauccucaacgacgagaacgagaagacccgcgaggaccaccggcaccacgcgaucgacgcccuggucauggccugcaccaagaucagcuacgugcaggagcuguccaaguggaaccgcuacaaccggaacgccgagcucaagaaguucccgcugcccugggagacguucuggagcgacgcgaaccgcgccguggacaagauccugaucucccacaagaaggucagcaacgacaucaccggccggacccacaucuccgagaagaacgggaagaaguacaagaacgugggcguggccgcccgcgggcagcuccacaaggagaccgucuacggcaagcggacguucaacggcgaggaggccuuccacgugcgcaagaccaucgacagccugaccaccgagaagcagcuggagaagguggucgacgaguccaucaagcuccugaucaagaagcgggugcaggagcucgggggcuucgugaagggggcgauccccgccaacaccuucuucgucguggacgagaacggcaucaagcagccccagaucuuccugccgaacaagaacggggcccccgugcccguccugaaggugcgcaugaaggagaacaucggcggcgccgagaagcugaaggagaacgugaaccagugggucaacccccggaacaaccaccacgugcucaucuacaaggacgagaaggggaaccugaaggaggagguggucacguucuggaccgugguggagcgcaagcggaccggccagagcgccuaccagcugccguucgacgggaaggagaucgucaccacgcuccacaucaacgacauguuccugcugggccucaacgaggaggagaucaacugggagaaccccgacuacgaggugcugaaggagcaccuguaccgcgugcagaaguucaccuccggggacuacuacuuccggaucgcgaagaccagcuccauccagaacgccaucgagaagcagcagaucaacagcuucggcuucggcaagaacggguggagcacccacaaccccaucaaggucaagaucuccgugagcggcaagaucuccaagguguga

SEQ ID NO: 1639 - RNA, 3372 nt, Artificial Sequence
  Cas9 variant
augaacggccuggugcucgggcuggacaucggcaucgggagcgucggcguggggauccugaacaaggacaccggcgagaucauccacaccaacucccgcaucuuccccgccgccacggcggacaacaacguggagcggcgcaacagccggcaggcccgccggcucaaccgccggaagaagcaccgcggcgcccggcugcacgaccuguucgaggacuacgaccuccugaucgacuucuccaaggucagcaucaaccugaacccguaccgccuccgggugcaggggcuggacaacccccugaccaccgaggagcuguucaucgcccucaagaacaucgugaagcgccggggcaucuccuaccuggacgacgccagcgagaacgggggcgcggucuccagcgacuacgggaaggccguggaggagaaccgcaagcuccuggccgagcagacccccggccagauccagcuggagcgguucgagaaguacggccaggugcgcggggacuucacggucgaggagaagggcgacaagcaccggcucaucaacguguucuccaccagcgccuaccgcaaggaggcggagcggauccugcgcaagcagcaggaguucaacaaccagaucaccgacaaguucaucgaggacuaccugaagauccucaccgagaagcggaaguacuaccacgggcccggcaacgagaagucccgcacggacuacggccgcuuccggaccgacgggaccacccuggacaacaucuucggcauccugaucgggaagugcacguucuacccgaacgaguaccgcgccagcaaggccuccuacaccgcccaggaguucaaccuccugaacgaccugaacaaccucaccgugcccaccgagacgaagaagcugagcgaggagcagaagaagaccaucgucgaguacgccaaguccgcgaagacccugggcgccagcacccuccugaaguacaucgccaagaugaucgacgccuccguggaccagauccggggguaccgcguggacgucaacaacaagcccgagaugcacacguucgagguguaccggaagaugcagagccuggagaccauccccgugggcgaguucucccgcgagguccucgacgagcuggcccacauccugacccucaacaccgagcgggagggcaucgaggaggcgaucaacacgaagcugauggacguguucagccaggaccagauccuggagcucgugcaguuccgcaagaacaacagcucccuguucagcaagggguggcacaacuucucccugaagcucaugauggagcugaucccggagcuguacgagaccagcgaggagcagauggccauccucacccggcugggcaagcagaaguucaaggagaccuccaagcgcacgaaguacaucgacgagaaggaggucaccgaggagaucuacaaccccgugguggccaagagcguccggcaggccaucaagaucaucaacgaggccaccaagaaguacgggaucuucgacaacaucgugaucgagauggcgcgcgagaacaacgaggaggacgccaagaaggacuacaucaagcggcagaaggccaaccacgacgagaagaacgccgccauggagaaggcggccuuccaguacaacggcaagaaggagcugcccgacuccaucuuccacgggcacaaggagcucgccaccaagauccgccuguggcaccagcagggcgagaagugccuguacacgggcaagaacauccccaucagcgaccugauccacaaccaguacaaguacgagaucgaccacauccucccgcugucccugagcuucgacgacucccucagcaacaagguccuggugcuggccaccgcgaaccaggagaaggggcagcggacccccuuccaggcccucgacuccauggacgacgccuggagcuaccgcgaguucaaguccuacgugaaggacagcaagcugcugggcaacaagaagaaggacuaccuccugaccgaggaggacaucuccaagaucgaggucaagcagaaguucaucgagcggaaccugguggacacgcgcuacagcucccgggugguccucaacacccugcaggacuucuacaaggcccacaaguucgacaccaccaucagcguggugcgcgggcaguucaccagccagcugcgccggaaguggggccucgagaagucccgcgagacguaccaccaccacgccgucgacgcgcugaucaucgccgccagcucccagcugcggcucuggaagaagcaggccaacccccugaucagcuacaaggaggaccaguucguggacuccgagaccggggagaucaucagccugaccgacgacaaguacaaggagcucguguucaaggcccccuacgcgcacuucgucgacacccuguccagcaagaaguucgaggacuccauccuguucagcuaccagguggacuccaaguacaaccgcaagaucagcgacgccacgaucuacgccacccggaaggugaagcucgacaaggacaaguccgaggagaccuacguccugggcaagaucaaggacaucuacagccaggccggcuacgacgccuucaucaagaucuacaacaaggacaaguccaaguuccugauguaccacaaggacccgcagaccuucgagaaggugaucgaggagauccuccgcacguaccccagcaaggaguucaacgagaagaacaaggaggugcccugcaaccccuucgagaaguaccggcaggagaacgggccgauccgcaaguacuccaagaagggcaacgggcccgagaucaagagccugaaguacuacgacaagaacauccccgagagcuucaucaacaucacccccuccaacagcaagaacaaggucauccugcggcagcucaacccguggcgcaccgacguguacuucaaccaccagaccgagaaguacgagcugcugggccucaaguacgcggaccugcaguucgagaagaagacgggcaccuacuccaucaccaucgacaaguacaacgagaucaaggagaaggagggggugggcgagcagagcgaguucaaguucacccuguacaagaacgaccuccugcugaucaaggacacgaagaacaacgagaagcagaucuuccgguuccucucccgcaccaugcccaacgucaagcacuacguggagcugaagcccuacgacaaggccaaguucgacgggaaccagccccugaucaccaucuucggcaacguggccaagggcgggcagugccucaagggccugaacaagagcaacaucuccaucuucaaggucaagaccgacgugcuggggaacaagcacuucaucacgaaggagggcgagaagccgaagcucaaguucuga

SEQ ID NO: 1640 - RNA, 3378 nt, Artificial Sequence
  Cas9 variant
augaacggccuggugcucgggcuggacaucggcaucgccagcgucggggugggcauccugaacaaggagaccggggagaucauccacgugaacucccgcaucuuccccgccgcgaccgccgacagcaacgucgagcggcgcggcuuccggcagggccgccggcucgggcgccggaagaagcaccgcuccgcccggcugaacgaccuguucgaggaguucggcuucaucacggacuucagcgccgugccgcucaaccugaaccccuacgcccugcgcgugaaggggcucuccgaggagcugaccaacgaggagcuguucaucgcgcucaagaacaucaucaagcggcgcggcaucagcuaccuggacgacgccuccgaggacggggagaccgccagcaacgaguacggcaaggccgucgaggagaaccggaagcugcucgcggacaagacccccggccagauccagcuggagcgcuucgagaaguacgggcagguccggggcgacuucacggugguggagaacggggagaaccaccgccugaucaacguguucuccaccagcgccuacaagaaggaggccgagcggauccuccgccggcagcaggaguucaacgugcgcaucuccgacgaguucaucgaggccuaccugaccauccugaccggcaagcggaaguacuaccacggccccgggaacgagaagucccgcacggacuacggccgcuuccggaccgacgggaccacccucgacaacaucuucggcauccugaucgggaagugcacguucuacccggacgaguaccgcgccgcgaaggccagcuacaccgcccaggaguucaaccugcucaacgaccugaacaaccugaccguccccaccgagacgaagaagcuccggcccgagcagaagcgccagaucguggaguacgcccggaccgccaagacccugggcacccccacgcugcucaaguacaucgcgaagcugguggacggcagcaucgacgacaucaagggguaccgcaucgacaaguccgacaagccggagaugcacaccuucgacgccuaccggaagaugcgcacccuggagcucgucgacguggacauccugagccgggagacccuggacgaccucgccuacauccugacgcugaacaccgaguccgagggcauccucgaggcccugaacagcaagaugcccgggaccuucaccaaggagcagaucgacgagcugauccaguuccgcaagaagaacuccgccguguucggcaagggguggcacaacuucagccucaagcugaugaacgagcugauccccgagcucuacgagacgagcgaggagcagaugaccauccugacccggcugggcaagcagcgcucccgggagaucagcaagcgcaccaaguacaucgacgagaaggagcucacggacgagaucuacaaccccgucguggcgaaguccgugcggcaggccaucaagaucaucaaccuggccaccaagaaguacggcaucuucgacaacaucgucaucgagauggcccgcgagagcaacgaggacgacgagaagaaggccauccagaacgugcagaaggcgaacgaggacgagaagaaggccgccauggagaaggccgcggaccuguacaacgggaagaaggagcugccggacuccaucuuccacggccacaaggagcucgccaccaagauccggcuguggcaccagcagggggagcgcugccuguacaccggcaagaacaucagcauccacgaccucauccacaacccccaccaguacgagaucgaccacauccugccccugucccucagcuucgacgacgggcuggccaacaaggugcugguccucgccacggccaaccaggagaagggccagcggacccccuuccaggcgcuggacuccauggacgacgccuggagcuacaucgaguucaagcaguacgugcgcaacuccaagagccuguccaacaagaagaaggacuaccuccugaccgaggaggacaucagcaagaucgaggucaagcagaaguucaucgagcgcaaccugguggacacccgguacuccagccgcgugguccucaacacccugcaggaguucuacaagacgaacgacuucgacaccaagaucuccguggugcggggccaguucaccagccagcugcgccggaaguggaagaucgagaagucccgcgacaccuaccaccaccacgccgucgacgcccucaucaucgccgcgagcagccagcugcggcuguggaagaagcagaacaacccgcucaucuccuaccgcgaggggcagcugguggaccccgagacgggcgagauccugagccucaccgacgacgaguacaaggagcuggugcugcggccgcccuacgacuacuucgucgacacccucaaguccaagagcuucgaggacuccauccuguucagcuaccagguggacuccaaguacaaccgcaagaucagcgacgccaccaucuacgggacgcggaaggcccagcugggcaaggacaagcaggaggagaccuacgugcucggcaagaucaaggacaucuacucccagaagggguacgaggacuucaucaagcgcuacaagaaggacaccacccaguuccugauguaccacaaggacccccagacguucgccaaggucaucgaggagauccugaagaccuaccccgacaaggagcucaacgagaagggcaaggagauccccugcaaccccuucgagaaguaccggcaggagaacgggccgauccgcaaguacagcaagaagggcaaggggcccgagaucaagucccugaaguacuacgacaacaagcugggcaaccacaucgacaucacccccgugaacagccagaaccaggugguccuccagucccugaagcccuggcggaccgacguguacuucaacccgcagacgagcaaguacgagcugaugggccucaaguacuccgaccugcgcuucgagaaggggagcggcuccuacgggaucagccccgagaaguacaacaaggugaaggccaaggagggcgucgacgaggacagcgaguucaaguucacccuguacaagaacgaccucauccugaucaaggacaccgagaccggggagcagcagcuguuccgguacggcucccgcaacgacacgagcaagcacuacguggagcucaagcccuacgagaaggcgaaguucgagggcaaccagcagcugaugaaccugcucgggaccguggccaagggcgggcagugccugaagggcaucaacaagccgaaccuguccaucuacaaggucaagaccgacgugcucgggaacaaguacuucaucaagaaggagggcgaccagccccagcugaacuucaagaagaagaucuga

SEQ ID NO: 1641 - RNA, 3378 nt, Artificial Sequence
  Cas9 variant
augaccagcaagcaggagaaccugggcgcccucaccuucgggcuggacaucggcaucgccuccguggggugggcgguccugggcgagaaccgcaucaucgaccucggggugcggugcuucgacaaggccgagacggccaaggagggcgagagccugaaccuggcccgccggauggcccgccuccugcggcgccggcugcgccggcgcgcguggcggcucaccaagcuggcccgccugcucaagcgggagggccugaucgccgacgccaaccuguucaagaacaagaucgagaagaacacccccgugcccaaguccagcuggcagcuccgcgucgacgcgcuggaccggaagcugaacgccgaggagugggcccgcgugaucuaccaccucugcaagcaccggggguuccacuggaucucccgcgccgaggagaaggccgcggagagcgacuccaagggcgagagcgggaaggugaagcagggccuggccgggaccaagaagcugaugcaggagaagaacuaccggacggccgccgagaugguccucgccgaguuccccgaggcgcagcgcaacaagcagggcgacuacuccaaggcccugagccggauccugcucggcgacgagcugaagacccuguucgagcaccagcgcaagcucgacucccccuucgccaccgagaagcuggaggccgccauccuggggaacggcgaccgcaagagcggccucuucugggcgcagaaccccgcccuggccggguccgaccugcucaagaugcugggcuacugcaccuucgagaagacggaguaccgggccccgaaggccagcuucaccgcggagcgccacguguggcugacccggcucaacaaccugcgcaucguggucgacgggaccacgcggccccugaacgaggccgagcgccggaucgcccuccugaugcccuaccagcaggccggcgacuucaccuacaagcagcugcgcaccgcgcucaccaaggccggguuccugcccgaguccuuccgguacacgggccugagcuacgccuccgggcagaaggccggcgagaagaccaaggacccggagagcgccgcgcucgugaaguuccccgccuggcaggagcugcgcaagacccuggagaagaaggagcucgccuccgaguggcagaagaucagcaccgacgcccuggacggcaagccccagcugcuggaccagaucgccugggugcucagcgucuacaaggacgacgacgaggugaaggcggagcuguccaagcugaaccuccccaacgccgagaagaugaucgacgcccugcuggacauccgguucgacaaguucagcaaccucucccugaaggcccugugcaagaucgugccgcucauggagcaggggcagcgcuacgacgaggccaucgcgaacauccccgaguacggccaccacagccagcugcacaaggucggggccggcgagcacaaguaccugccgcccuucuacaaggagcgggacaagacggggcgcaugguguucaacgacgacauggacaucccccggaaccccgugguccuccgcgcccugaaccaggcccggaagguggugaacgcgcugaucaagaaguacgacagcccccacgagguccacaucgagauggcccgcgaccucucccggccccuggacgagcgccgcgagguggagaagcugcagaaggaguuccgggacaacaacgagaagggcaaggcccaguucgcccaggacuucaacaucgugggcgccgucaaggggaaggaguucgagaaguaccagcucuaccgcgagcagcagggcaagugcgcguacuccaucgagccgauggacauccaccggcuguucgagcagggguacguggagaucgaccacgcccugcccuacagccgcuccuucgacgacagcaagaacaaccggguccucgugcuggccaaggagaaccgcgacaagggcaaccggacccccuucgaguaccucgggggcaaggacaacuccgagcccuggcgccaguucguggccuucgucgagggcaacaaggccuaccggcuggcgaagcgcagccggcugcugcgcaaggacuucggggacaaggaggccaaggaguuccgggagcgcaaccucaacgacacccgguacaucugcaaguucuucaagaacuacguggagcaguaccugcagcugcacgaggacuccgaggccaagcgcugcgugguccucagcggccagaugaccuccuuccugcgggcccgcugggggcuggugaaggugcggggcgacagcgaccgccaccacgcccucgacgcggccgucguggccgccugcucccacggcauggugaagcggcugagcgacuacucccgccgcaaggagcuggagcagguccgggagggguucguggacguggacacgggcgagaucgucaacccggcgauguuccagcagguccaggagcacuuccccaaccccuggccccacuuccgcgacgaggugaagcuccggcugagcauggacgacccggcccugcuccgcagcgagauggagaaguucgggaccuacacccccgaggcccugcaggcccugcacccccucuucgugucccgggccccgcagcgccggaacagcggcgcggcccacaaggacaccaucuacgcccagcccaagcgccugguggcccagggcggggugacgcagaaggucgcccugaccucccucacccugaaggaccuggacaagcucaucgacccccaccggaacgacaagcuguacaccgcgauccgcgcccggcuggagcagcacggcgggaagggcgacaaggccuuccccagcuccaacccgcuccgcaagcccgacagcgaggggaaccccacgggccccaucgugcgcggggugaccauggucaucgacaagcuguccggcaucccgauccggggcgggaucgccaagaacgacagcauggugcggguggacgucuucaccaaggccaacaaguuccaccuggugcccguguacguccaccacaccguggcgaaggcccuccccaaccgcgccguggucgccuucaaggacgaggacgaguggacgcugaucgacgacuccuucgacuucugcuucagccugcaccccaacgaccucguccaggugcagcagaagggcaaggccgggaugaucggcuacuacuccagcugccaccgggggaccggcaacaucaaccugugggcgcacgaccgcaaccuccaggugggcaaggacgggaugaucgagggcaucggggugaagaccgcccugucccuggagaaguucaacguggacguccugggcaaccgguacccggccccgcccgagaagcgccgcgaccucgccuga

SEQ ID NO: 1642 - RNA, 3378 nt, Artificial Sequence
  Cas9 variant
augaccgaccgcaucagccugggccucgacaucgggguggccuccgucggcuucagcgugcuggacaucgacaaggggaaggugaucgagcugggcgcccgccucuucaacgcgaccgucgccgccgggaaccaggaccggcgggacaugcgcggcucccggcgccugcugaaccggaacaagcagcgccggaaggacgugagcaagcuguuccaggaguacggccuccuggacaacuucgaccgcgacaacuuccacacggccuucaacaacaacuggaaccccuacgagcuccgggugaaggggcugaccaagcagcugaacaaggaggagcucgccgacucccuguaccagaucaucaagcgccggggcaucagcuacgcgcugaaggacgccgacgccaacgaggacgggaccgacuacuccagcucccucaagaucaacagccaggagcugaucgagaagaccccggcccagauccagcugcagcgccucaacgacuacggcaagguccgggggaaggugaucgugggcgacgacaucgacgaccagaagguccugcugaacguguuccccacgaacgcguacgagaaggaggcccgccagaucaucgccacccagcagcaguucuaccccgagauccucaccggcgaguucgugaaggaguacugccagauccugacccggaagcgcgacuacuucgucgggcccggcaacgagaagucccggacggacuacgggaucuacaagaccgacggccgcacccuggacaaccucuucgaggagcugaucggccacgacaagaucuacccggacgagcugcgggccagcgccgcguccuacaccgcccagcuguucaacgugcucaacgaccugaacaaccuccgcauccugagcuacgaggacgggaagcugacgcagaucgacaaggagaagaucaucgccgagaucaagaacaacaccaccguggucaacaugcucaacgugaucaagaaggugaccggcugccagaaggacgacaucaagggguuccgccugaacgagaaggacaagcccgagaucuccagcaugcccaucuaccggaaggcccacaaggacuuccugaaggucggcaucgacaucacggacuggcccaucgacuucaucgaccgccucuccuucauccugacccugaacaccgagaacggggagauccggaagcagaucaacaagcgccucgugccggacuucgacuuccugaacgacgaccuggugcagcucaucaucgacaacaaggacagcuucgacaucaagaccaacaacaaguggcaccgguucucccugaagacgaugaacaagcugauccccaccaugaucgagcgccccgucgagcagaugacccuccugaccgagaugggccugaucaagaaggacacgaagcgguucgagggcaacaaguaccuccccuacaaggagaucgccaacgacaucuucaacccgguggcgagcaagagcgugcgcgaggcccugaagaucgucaacgccgugcugaagaaguacgggcacaucgaguacaucgucaucgagaugccccgggacaagaaccuggacgaggagcgcaagcagaucgccgacuuccagaagaagaacaagaagaucaaggacgccgcguucaacgccuucgugaaggccgugggcuccaagaagaacgucaagaucgcccucagcaagaaccggaagcugcagauggggauccgccuguggcaccagcagcagggcaucgaccccuacaacggggaggagaucaacgccaacgaccucaucuccaaccccgacaaguucgagaucgaccacaucaucccgcagagcaucuccuucgacgacggcaucaacaacaagacccugugcuucgcgagcaugaaccaggugaagggccagaagacccccuacgaguuccugaacgaggggcacggccagggguacgccaaguucaaggccaucguguccaagaacaagaacuucagcaaggccaagcgggacaacuaccucuucgaggagaacgucuccaacaucgagacccgcaagcgguuccugagccgcaaccugguggacacgcgguacuccagccgcgugguccucaacucccugcaggaguucuuccacgagaaguccgacgacaccaaggugaccgugauccggggcaaguucaccagcaacaugcgcaagcacuggcacaucgacaagacgcgcgacaccuuccaccaccacgcgaucgacgccagcaucaucgccgccacccccuuccugcggauguggaagaagggguccaccaucuuccccacgaagaucaacgagaccagcaucgacaucgagaccggcgagauccucgacgacaagaacuucgacaaggucauguacgaggagccguacuccggcuucaucagcgagaucaugaacgccgacgaccgcaucaaguucagccaccagguggacaagaagaugaaccggaagguguccgacgcgaccaucuacagcacccgcaucgggaagcuguccaaggacaagaaggacgccgaguacgucguggccaaggugaaggacaucuacagcgucgacggcuacgagaacuucaagaagguguacaagaaggacaagacgaaguuccugcucuacaaguacgacccccggaccuucuccgagcuggagaagaucgugaucgacuaccccgacaagaucgagaagguccagaccaacgggaagaucaaggccguggacaucagccccuucgagcuguaccgccgggacaacggcauggugcgcaaguacuccaagaagaccggcccggccaucaagcagcucaaguaccuggacaagaagcuggggagccacaucgacaucacgcccaagaacgcgaacaacaagcacgucgugcuccagucccugaagcccuggcggaccgacguguaccugaaccacgagaccggcgaguacgagaucauggggaucaaguacagcgaccucaaguucaacaagaacgagggcuacgggaucaagaaggacaaguaccugaagaucaagaacaucgagggcgucuccgagaacagcgaguucauguucucccuguaccgcaaggaccggaucaaggugcaggacauggagaccaacgagagcguggagcuccuguucuggucccgcaacuucagcaacaagaaguacgccgagcugaagcccaucucccagaucgacaacgacaagguccucccgaucuacggccgggggcgccugaucaagcggcugauccccaagaacugcaagaucuggaaggugaacacgagcauccucggcgacaccuacuaccuggagaaggagagcaacuacccccagaagauccuggacuga

SEQ ID NO: 1643 - RNA, 3381 nt, Artificial Sequence
  Cas9 variant
augaacggccuggugcucgggcuggacaucggcaucgccagcgucggggugggcauccugaacaaggagaccggggagaucauccacgccaacucccgcaucuuccccgcggccaccgccgacagcaacguggagcggcgcggcuuccggcagggccgccggcucgggcgccggaagaagcaccgcuccgcccggcugaacaaccuguucgaggaguucggcuucaucacggacuucagcgccaucccgcucaaccugaaccccuacgcgcugcgcgucaaggggcucuccgaggagcugaccaacgaggagcuguucaucgcccucaagaacaucaucaagcggcgcggcaucagcuaccuggacgacgccuccgaggacggggagaccgccagcaacgaguacggcaaggcgguggaggagaaccggaagcugcucgccgacaagacccccggccagauccagcuggagcgcuucgagaaguacgggcagguccggggcgacuucacggugguggagaacggggagaaccaccgccugaucaacguguucuccaccagcgccuacaagaaggaggccgagcggauccuccgccggcagcaggaguucaacguccgcaucuccgacgaguucaucgaggccuaccugaccauccugaccggcaagcggaaguacuaccacggccccgggaacgagaagucccgcacggacuacggccgcuuccggaccgacgggaccacccucgacaacaucuucggcauccugaucgggaagugcacguucuacccggacgaguaccgcgcggccaaggccagcuacaccgcccaggaguucaaccugcucaacgaccugaacaaccugaccgugcccaccgagacgaagaagcucagccccgagcagaagcggcagaucguggaguacgcccgcaccgcgaagacccugggcacccccacgcugcucaaguacaucgccaagcuggucgacggcuccaucgacgacaucaagggguaccggaucgacaagagcgacaagccggagaugaugcacaccuucgacgccuaccgcaagaugcggacccuggaccucgugaacaucgacgcccugucccgcgagacccuggacgaccucgcccacauccugacgcugaacaccgagagcgagggcauccucgaggcgcugaacuccaagaugcccagcaccuucaccaaggagcagaucgacgagcugauccaguuccggaagaagaacagcgccguguucgggaagggcuggcacaacuucucccucaagcugaugaacgagcugaucagcgagcucuacgagacguccgaggagcagaugaccauccugacccgccuggggaagcagcggagccgcgagaucuccaagcggaccaaguacaucgacgagaaggagcucacggaggagaucuacaaccccgucguggccaagagcgugcgccaggccaucaagaucaucaacgaggccaccaagcgguacggcaucuucgacaacaucgucaucgagauggcgcgcgagaacaacgaggaggacgccaagaaggacuacaucaagcggcagaaggccaaccaggacgagaagaacgccuccauggagaaggcggccuuccaguacaacggcaagaaggagcugcccgacagcaucuuccacgggcacaaggagcuggccaccaagauccgccuguggcaccagcagggcgagcggugccucuacaccgggaagaacaucuccauccgcgaccugauccacaacccgcaccaguacgagaucgaccacauccugccccucagccuguccuucgacgacggccuggccaacaaggugcucgugcuggccacggcgaaccaggagaaggggcagcgcacccccuuccaggccaucgacagcauggacgacgccugguccuaccgggaguucaagcaguacguccgcaacagcaagucccugagcaacaagaagaaggacuaccuccugaccgaggaggacaucuccaagaucgaggugaagcagaaguucaucgagcggaaccugguggacacccgcuacagcucccgggucgugcucaacacccugcaggaguucuacaagacgaacgacuucgacaccaagaucagcgucgugcgcggccaguucaccagccagcugcggcgcaaguggaagaucgagaagucccgggacaccuaccaccaccacgccguggacgcccucaucaucgcggccagcucccagcugcgccuguggaagaagcagaacaacccccucaucagcuacaaggagggccaguucgucgacccggagacgggggagauccugucccugaccgacgacgaguacaaggagcucguguuccggccgcccuacgacuacuucguggacacccucaagagcaaguccuucgaggacagcauccuguucuccuaccaggucgacagcaaguacaaccgcaagaucuccgacgccaccaucuacggcacgcggaaggcccagcucgggaaggacaagcaggaggagaccuacgugcugggcaagaucaaggacaucuacagccagaagggcuacgaggacuucaucaagcgcuacaacaaggacgagacccaguuccugaucuaccacaaggacccccagaccuucgagaaggugaucgaggagauccucaagacguaccccgacaaggagcugaacgagaaggggaaggagauccccugcaaccccuucgagaaguaccggcaggagaacggccccauccgcaaguacuccaagaaggggaagggcccggagaucaagauccugaaguacuacgacaacaagcucgggaaccacaucgacaucacccccgucaacagccagaaccagguggugcugcagucccugaagcccuggcggaccgacgucuacuucaacccccgcaccagcaaguacgagcucaugggccugaaguacuccgaccugcgguucgagaagggcagcgggagcuacggcaucuccccggagaaguacaacaaggugaaggccaaggagggggugaacgaggacagcgaguucaaguucacgcucuacaagaacgaccugauccugaucaaggacaccgagaccggcgagcagcagcuguuccgcuacgggucccggaacgacaccagcaagcacuacgucgagcugaagcccuacgagaaggcgaaguucgagggcaaccagcagcugaugaaccuccugggcacgguggccaagggcgggcagugccugaaggggaucaacaagcccaaccucuccaucuacaaggugaagaccgacguccugggcaacaaguacuucaucaagaaggagggggaccagccgcagcugaacuucaagaagaaguucuga

SEQ ID NO: 1644 - RNA, 3381 nt, Artificial Sequence
  Cas9 variant
auggccagcaagcacgagaaccugggcgcccucaccuucgggcuggacaucggcaucgcguccguggggugggccguccugggcgagaaccgcaucaucgaccucggggugcggugcuucgacaaggccgagaccgccaaggagggcgagagccugaaccuggcccgccggacggcgcgccuccugcggcgccggcugcgccggcgcgccuggcggcucaccaagcuggcccgccugcucaagcgggagggccugaucgccgacaccaacguguuccagaagcccuucaaccugaaggacgcgaacgagaaggggcucuccuucuggcagcugcgcgucgacgcccuggaccggaagcucagcgccgaggagugggcccgcgugaucuaccaccugugcaagcaccggggcuuccacuggaucucccgcgccgaggagaaggcggccgagggggacagcaaguccgagggcgggaaggugaagcagggccuggccggcaccaagaagcucaugcaggagaagaacuaccggacggccgccgagaugguccugaccgaguuccccgaggcgcagcgcaacaagcagggggacuacagcaaggcccugucccggauccuccugggcgacgagaugacccagcuguucaagcaccagcgcgagcucgggaacccccacgccaccgagaagcuggaggccgccauccugggcaacggcgaccacaagagcggccucuucugggcgcagaaccccgcccuggccgggaacgaccugcucaagaugcuggggcacugcacguucgagaaggccgaguaccgcgugcccaaggccuccuucaccgcggagcggcacguguggcugacccgccucaacaaccugcggaucgucguggacggcaccacgcgcccgcugaacgaggccgagcggcaccucgcccugcugaugcccuaccagcaggccggggaccucaccuacaagcagcugcgcaccgcgcugaccaaggccggcuaccuccccgagagcuuccgguacacgggccuggccuacgccuccgggcagaaggccgacgagaaggcgaaggaccccgagagcgccccgcuggugaagcuccccgccuggcacgagcugcgcaagacccuggagaagaaggagcuggccuccgaguggcagaagaucagcuccgacgcccucgacggcaagccccagcugcuggaccagaucgcguggguccucagcguguacaaggacgacaccgagguggaggccgagcugugcaagcugaaccuccccaacgccgagaagaugaucgacgcccugcuggacauccgguucgacaaguucuccaaccucagccugaaggcccugcgccagaucgucccgcucauggagcaggggcagcgguacgacgaggcgguggccaacauccccgaguacggccaccacagccagcugcacgaggugggggccggcgagcacaaguaccugccgcccuucuacaaggagcgcgacaagaccggccggauggucuucaacgacgacauggacaucccccgcaaccccguggugcuccgggcccugaaccaggcgcgcaaggucgugaacgcccugaucaaggaguacgggagcccccacgaggugcacaucgagauggcccgggaccucucccgcccccuggacgagcggcgcgacgucgagaagcugcagaaggaguuccgcgaccggaacgagaaggacaaggcccucuucgcccaggacuucaacaucgugggcgcggucaaggggaaggaguucgagaaguaccagcuguaccgcgagcagcagggcaagugcgccuacuccaucgagccgauggacauccaccggcuguucgagcagggguacguggagaucgaccacgcccuccccuacagccgcuccuucgacgacagcaagaacaaccgggugcugguccuggccaaggagaaccgcgacaagggcaaccggacgcccuucgaguaccucggcgggaaggacaacuccgagcgcuggcggcaguucguggccuucguggagggcaacaagagcuaccgccuggcgaagcggucccgccugcuccggaaggacuucgggaaggacgaggccaagggcuuccgcgagcggaaccugaacgacacccgcuacaucugccgguucuucaagaacuacgucgagcaguaccugcagcuccacgaggacagcgacgccaagcgcugcguggugcuguccggccagaugaccagcuuccugcgggcccgcugggggcucgucaaggugcggggcgacuccgaccgccaccacgcccuggacggggcgaucguggccgccugcagccacuccauggucaagcgccugagcgacuacucccggcgcaaggagcucgagcagguccgggccggcuucguggacguggacaccggggagaucgugaaccccgcgauguuccagcagguccaggagcacuucccgaaccccuggccccacuuccgcgacgaggugaagcugcggcugaacguggacgaccccgcccuccugcacagcgagaugaaccgcuucggcacguacuccccggaggcccugaaggcccuccggccccuguucaucagccgcgcgccccagcggcgcaacagcggcgccgcccacaaggacaccaucuacgcccagccggagcggcugguggcccagggcggggucacccagaaggugccccucaccucccugacgcugaaggaccucgacaagcugaucgacccccaccgcaacgagaagcuguacagcgccauccggauccgccucgagcagcacgggggcaagggggacaaggcguuccccgccuccaacccgcugcggaagcccgacagcgagggcaaccccaccggccccaucgugcgcggggucaccauggugaucgacaagcuguccggcaucccgauccgcgggggcaucgccaagaacgacagcauggugcgggucgacguguucaccaaggccgggaaguuccaccucgugcccgucuacgugcaccacgccguggcgaagguccugcccaaccgggccgugguggccuacaaggacgagacggaguggacccugaucgacgacggcuucgacuucugcuucuccauguaccccaacgaccuccugcgcaucaagcugcgcaacgccagccaccucggcuacuacgccuccugcaaccggagcaccggggcgaucaaccuguggucccacgaccgcaaccagcaggucggcaaggacgggaugaucgagagcaucggcgugaagaccgcccugaacguggagaagcucaacaucgacguccuggggaaccgguacccggccccgcccgagaagcgccgggaccuggccuga

SEQ ID NO: 1645 - RNA, 3384 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaacgucgagcggcgcaucaaccggcagggccgccggcucacccgccggaagaagcaccgccgggugcgccugaaccaccuguucgaggaguccggccucaucacggacuucaccaacgugagcaucaaccugaacccguaccagcugcgggucaaggggcucaccgacgagcuguccaacgaggagcuguucaucgcccucaagaacauggugaagcaccgcggcaucagcuaccuggacgacgccuccgacgacgggaacagcuccgugggcgacuacgcccagaucgucaaggagaacagcaagcagcuggagaccaagacgcccgggcagauccagcucgagcgguaccagaaguacggccagcugcgcggcgacuucaccguggaggaggacgggaagaagcaccggcugaucaacguguuccccaccuccgccuaccgcgcggaggcccuccggauccugcagacccagcaggaguucaacccccagaucacggacgaguucaucaacagcuaccugcagauccucaccggcaagcgcaaguacuaccacgggccgggcaacgagaagucccggaccgacuacggccgcuacaccacgaagaaggacagcgaggacgaguacaucacccuggacaacaucuucgggauccugaucggcaagugcaccuucuaccccgaggaguaccgggccgccaaggcguccuacaccgcccaggaguucaaccuccugaacgaccugaacaaccucacgguccccaccgagaccaagaagcugagcgaggagcagaagaaccagaucaucaccaacgugaagaacgagaaggccauggggcccgccaagcuguucaaguacaucgccaagcuccuguccugcgacguggcggacaucaagggcuaccgcaucgacaagagcgacaaggccgagauccacacguucgaggccuaccgcaagaugaagacccuggccaccaucgacaucgagcagauggagcgggagaaccucgacaagcuggccuacguccugacccucaacacggagaaggaggggauccaggaggcgcuggagcacgaguucgccgacggcaccuucucccaggagcagaucgacgagcuggugcaguuccgcaaggccaacagcagcaucuucggcaagggguggcacuccuucagcgugaagcucaugauggagcugaucccggagcuguacgccaccuccgaggagcagaugaccauccucacgcggcugggcaagcagaagaccaccagcuccagcaacaagaccaaguacaucgacgagaagcagcugacggaggagaucuacaaccccgucgccgcgaaguccgugcgccaggccaucaagaucgugaacgccgccaucaaggaguacggggacuucgacaacaucgucaucgagauggcccgggagaccaacgaggacgacgagaagaaggcgauccagaagauccagaaggccaacaaggacgagaaggacgccgccaugcucaaggcggccaaccaguacaacggcaaggccgagcugccccacagcguguuccacgggcacaagcagcuggccaccaagauccgccucuggcaccagcagggcgagcggugccuguacaccggcaagacgaucuccauccacgaccugaucaacaacagcaaccaguucgagaucgaccacauccugccccucuccaucaccuucgacgacagccuggccaacaaggugcuggucuacgcgaccgccaaccaggagaaggggcagcgcaccccguaccaggcccucgacuccauggacgacgccuggagcuuccgggagcugaaggccuucgugcgcgacuccaaggcgcugagcaacaagaagaaggaguaccuccugaccgaggaggacaucuccaaguucgacguccggaagaaguucaucgagcgcaaccugguggacacgcgguacgccagccgcgugguccucaacgcccugcaggagcacuuccgggugcacaagaccgacaccaagguguccgucgugcgcggccaguucaccagccagcugcggcgccacugggggaucgagaagacgcgggacaccuaccaccaccacgccguggacgcccucaucaucgcggccagcucccagcugaaccuguggaagaagcagaagaacacccucgucagcuacuccgaggaccagcugcuggacaucgagaccggcgagcucaucagcgacgacgaguacaaggaguccguguucaaggcccccuaccagcacuucguggacacgcucaagagcaaggaguucgaggacuccauccuguucagcuaccaggucgacuccaaguucaaccgcaagaucagcgacgccaccaucuacgcgacccgccaggccaagguggggaaggacaagaaggacgagaccuacgugcucggcaagaucaaggacaucuacucccagacgggcuacgacgccuucaucaagaucuacaagaaggacaagagcaaguuccugauguaccggcacgacccccagaccuucgagaaggucaucgagcccauccuggagaacuacccgaacaaggagcucaacgagaaggggaaggaggugcccugcaaccccuuccugaaguacaaggaggaccacggcuacauccgcaaguacuccaagaaggggaacggccccgagaucaagagccugaaguacuacgacuccaagcucggcaaccacaucgacaucaccccgaagaacagcaacaacaaggugguccugcaguccgugagccccuggcgggccgacguguacuucaacaagaccacggggaaguacgagauccugggccucaaguacgccgaccugaaguucgagaaggggaccggcaccuacaagaucagcgaggagaaguacaacgacaucaagaucaaggagggggucgacuccgacagcgaguucaaguucacccuguacaagaacgaccuccugcugaucaaggacacggagaccaaggagcagcagcuguuccgcuuccugucccggaccaugcccaacgugaagcacuacguggagcugaagcccuacgacaagcagaaguucgacgacaacgaggagcucaucaagauccugggcaucgucgcgaagggcgggcagugcaagaagggcgugagcaagccgaacaucuccaucuacaagauccgcaccgacgugcuggggaaccagcacaucaucaagaacgagggcgacaagcccaagcucgacuucuga

SEQ ID NO: 1646 - RNA, 3384 nt, Artificial Sequence
  Cas9 variant
augaacggccuggugcucgggcuggacaucggcaucgccagcgucggggugggcauccuggagaaggacuccgggaagaucauccacgccaacagccgcaucuuccccgcggccaccgccgacaacaacguggagcggcgcaccucccggcaggcccgccggcucaaccgccggaagaagcaccgcagcguccggcugcacgaccuguucgaggaguacggccuccugacggacuucuccaaggugagcaucaaccugaacccguaccagauccgcgugcagggccucgacaagcggcugaccaacgaggagcuguucaucgcccucaagaacaucgucaagcgccgggggaucuccuaccuggacgacgcgagcgaggacggcggggccguguccagcgacuacggcaaggccguggaggagaaccgcaagcugcucgcccagcagacccccgggcagauccagcuggaccgguucgagaaguacggccagguccgcggcgacuucaccgugguggagaacggggagaagcggcgccugaucaacgucuucuccacgagcgcguaccggaaggaggccgagcgcauccuccggaagcagcaggaguucaacaacaagaucaccgagggcuucaucgaggacuaccugaccauccugaccgggaagcgcaaguacuaccacggccccggcaacgagaagucccgcacggacuacgggcgguacaccaccaagaaggacagccagggcgaguacaucacccucgacaacaucuucgggauccugaucggcaagugcacguucuaccccgacgaguaccgcgccuccaaggccagcuacaccgcccaggaguucaaccugcucaacgaccugaacaaccugaccgugccgaccgagacgaagaagcucuccguggagcagaagaagaccaucgucgaguacgcgaagaccgccaagacccugggggccagcacgcugcucaaguacaucgccaagcugaucggcguguccguggaccagauccacggcuaccggaucgaccccaacgagaagcccgagaugcacaccuucgaggucuaccgcaagaugcagagccuggagaccauccggguggaggagcucccccgcaaggugaucgacgagcuggcccacauccugacccucaacacggagcgggaggggaucgaggaggcgaucaacgccaagcugaaggacaucuucagccaggaccagguccuggagcucgugcaguuccgcaagaacaacuccagccuguucuccaagggcuggcacaacuucagccugaagcucaugauggagcugaucccggagcuguacgagaccuccgaggagcagaugaccauccucacccggcuggggaagcagaaguccaaggagacgagcaagcgcaccaaguacaucgacgagaaggagcugaccgaggagaucuacaaccccguggucgccaagagcgugcggcaggccaucaagaucaucaacgaggccaccaagcgcuacggcaucuucgacaacaucgucaucgagauggcgcgggagaacaacgaggaggacgccaagaaggaguacaucaagcgccagaaggccaaccucgacgagaagaacgccgccauggagaaggcggccuuccaguacaacgggaagaaggagcugcccgacaacguguuccacggccacaaggagcuggccacgaagauccggcuguggcaccagcagggcgagaagugccucuacaccgggaagaacauccccaucuccgaccugauccagaaccgcuacaaguacgagaucgaccacauccugccgcucagccuguccuucgacgacagccuguccaacaaggugcucguccuggccaccgcgaaccaggagaagggccagcggacccccuuccaggcccuggacagcauggacuacgccugguccuaccgcgaguucaagagcuacgugaaggacuccaagcuccugagcaacaagaagaaggacuaccugcucacggaggaggacaucuccaagaucgaggugaagcagaaguucaucgagcggaaccuggucgacacccgcuacagcagccgcguggugcugaacgcccuccaggacuucuacaaggagcaccaguucgacaccaccaucuccgucgugcgggggcaguucaccagccagcugcgccggaaguggggcaucgagaagucccgcgagacguaccaccaccacgccguggacgcgcugaucaucgccgccagcucccagcuccggcuguggaagaagcacaacaacccccugaucagcuacaaggaggagcaguucgucgacuccgagaccggggagaucaucagcauguccgacgacgaguacaaggagcucguguucaaggcccccuacgaccacuucguggacacccucaagagcaagaaguucgaggacuccauccuguucagcuaccaggucgacuccaaguacaaccgcaagaucagcgacgccaccaucuacgcgacgcggaaggccaagcuggacaaggacaaguccgaggagaccuacgugcugggcaagaucaaggacaucuacagccaggccggcuacgacaccuucaucaagaucuacaacaaggacaagucccgcuuccugauguaccacaaggacccgcagaccuucgagaaggugaucgaggagauccuccggacguaccccagcaaggagcugaacgagaagaacaaggagguccccugcaaccccuucgagaaguaccgccaggagaacgggccgauccggaaguacagccgcaagggcaacgggcccgagaucaagucccugaaguacuacgacaacaagcucggcaaccacaucgacaucacccccaacgagagcaugaaccagguggugcugcagucccugaagcccuggcggaccgacgucuucuucaaccaccagaccgagaaguacgagcucaugggccugaaguacagcgaccugaacuucgagaagggguccggcaaguacagcaucucccucgagaaguacaacagcaucaagaugaacgaggggguguccgaggagagcgaguucaaguucacgcuguacaagaacgaccugauccucaucaaggacgcccugaccaaggaggcccagaucuuccgcuacggcucccggaacgacaccagcaagcacuacguggagcugaagccguacgacauguccaaguucgagggggacgagcgccucaucaagguccugggcaccguggcgaagggcgggcggugcaucaagggccugaacaagaaggacaucagcaucuucaaggugaagacggacguccucgggaacaagcacuucaucaagaaggagggcgaggagcccaagcugaaguucuga

SEQ ID NO: 1647 - RNA, 3387 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccaagcgccgggccgggcgcacgacccggcgccggcucucccgcaaccgguggcgccugagcuuccugcgggacuucuucgagucccacaucaccccgaccgaccccaacuucuucaugcgccagaaguacagcgagaucucccccaaggacaaggcgcgguacaaguacgagaagcgccucuucaacgaccggacggacgccgaguucuaccagcaguacagcaccauguaccaccuccgcaaccggcugaugaccgaccccucccgcgccgacgugcgggagaucuacuucgccauccaccacauccucaagagccgcggccacuuccugaccccgggggacgcgaaggacuucaacacgaacgacgucgcccuggacgagaucuuccccgcccugcaggacgccuacgcccagguguaccccgaccugggcaucaccuucgacgaggacaaggcgaacgaguucaagaccauccugcucaacgagaucgccaccuccaucgacacgcagcgggcccuggugaagcugcuccuggccgaggaggacgacaaggacauccugaagcagcagaagcagguccucaccgaguucgccaaggcggugguggggcugaagaccaagcugaaccucgcccugggcaccgaggucgacagcuccgaggccacggccuggaacuucagccugggccagcucgacgacaagugggccgggaucgaguccgcgaugaccgacgagggcaccgagauccuggaccagauccgcgaccuguaccgcgcccggcuccugaacgggaucgugcccaccggcaagacgcugagccaggccaagguggacgacuacacccagcaccacgaggaccuccagcuguucaaggccuaccugaagcagcucgaggacgacggcaccgccaaggcgauccgccagcuguacgaccgguacaucgacggggacgacgccgccccguuccugcgcgagaacuucgucaaggcccucaccaaggacgugacggcgcaccccaacaccaagucccccgagcugcuggagcggcucgcccagcccgacuucaugcugaagcagcgcaacaaggccaacggcgccaucccggugcagaugcagcagcgggagcuggaccagaucaucaagaaccaggccgucuacuacgacuggcucgcggcccccaaccccguggagaagcaccgcaagagcaugcccuaccagcuggacgagcugcucaacuuccggaucccguacuacguggggccccuggucaccgccaaggagcagaaggccgcccagggcgggguguucgcguggauggugcgcaaggaccccgagggcaacaucacccccuacaacuucgacgagaaggucgaccgggaggccuccgccaacacguucauccagcgcaugaagaccaccgacaccuaccugaucggcgaggacgugcugccgaagcagagccuccuguaccagcgguacgaggugcugaacgagcucaacaacguccgcgugaacaacgagaagcugagcaucgagcagaagcagcaggucauccgggagcuguucgagcgccacaacuccgugacgaucaagcaguucgccgagaaccuccgggcccacggggacuacgcgcacauccccgagauccgcggccuggccgacgagaagcgguuccugagcucccucagcaccuaccgccagcugaagucccugcuccccgaggccaucgacgaccccgccaagcaggcggacaucgagaacaucaucgccuggagcaccguguucgaggacgccgccaucuucaagaccaagcugaaggagaucuccuggcuggggagcgaggccaucacgaagcucuccaacauccgcuaccggggcugggggcaguucagccgcaaguuccugaacggccugacccucggcaacgggcacaccaucauccaggagcugcugcucuccaccaacaaccugaugcagauccugaccgacgagacgcuccagaagaagaugaccgagcugaacgcggacaagcugaagaccgccaacaucaacgacgccaucgacaacgccuacaccagcccguccaacaagaaggcccuccggcagguccugcgcgugguggacgacaucaagcgggcggccgacggccaggaccccagcuggcuguacgucgagacggccgacgggggcgggacccccggcaagcgcacccgggcccgccagcaccagcuccaggagaucuacgccaacgcggcccacgagcugaucgacaccgccgugcggggcgagcuggaggacaagaucuccgacaaggccgacuucaacgaccgccucgugcuguacuucaugcagggcgggcgggacaucuacacgggggcgccccugaacaucgaccagcucagcuccuacgacaucgaccacauccugccgcagagccugaucaaggacaacucccucgacaaccgcguccuggugcacgccaucaucaaccgggagaagaacgccaccuucgccagcaccaucuacgcccagaagaugaacgcgaccuggcgccaguggcacgaggccggccugaucagcggccggaagcuccgcaaccugcagaugcggcccgaccagaucgacaaguacgccuccggguucguggcccgccagcuggucgagacgcggcagaucaucaagcucaccgagcagaucguggccgcgcaguaccccgacaccaagaucaucgccgugaaggccggccugagccaccagcugcgcgaggagcucgaguucccgaagaaccgggacgucaaccacuaccaccacgccuucgacgccuuccuggcggcccgcaucgggaccuaccugcucaagcgcuuccccaaccugcaggccuucuucacguacggcaaguucaccaaggccgacgugaagaagcugcggggguucaacuucauccgcgacaucacccacgccgaggacaagaucguggcgaaggacaccggcgaggucgugugggacaagcagcgggacguggacgagcucgaccgcaucuacaacuucaagcggaugcugaucacgcacgagguccgcuucgagaccgccgaccuguucaagcagaccguguacggcgcccgggacuccaaggaggccgggggcagcaagcagcucauccccaagaagaaggacauccagcugaucuucaugggggcgaucuccgagcgcacccggcccauccugccgcucuga

SEQ ID NO: 1648 - RNA, 3387 nt, Artificial Sequence
  Cas9 variant
auggacgagaagauggacuaccgcaucggccuggacaucgggaucgccagcgugggcugggccguccuccagaacaacuccgacgacgagcccgugcggaucguggaccuggggguccgcaucuucgacaccgcggagaucccgaagaccggcgagagccuggccgggccccggcgcgccgcccggacgacccgccggcgccuccggcgccggaagcaccgccuggaccggaucaaguggcuguucgagaaccagggccucaucaacaucgacgacuuccugaagcgcuacaacauggccggccugcccgacguguaccagcuccgguacgaggcgcuggaccgcaagcugaccgacgaggagcucgcccaggugcugcugcacaucgccaagcaccggggguuccgcuccacccggaaggccgagacggcggccaaggagaacggcgccguccucaaggccaccgacgagaaccagaagcgcaugcaggagaagggguaccggaccgugggcgagaugaucuaccuggacgaggccuuccgcaucgggugcagcugguccgagaagggcuacauccugacgccccgcaacaaggcggagaacuaccagcacaccaugcuccgggccaugcugguggaggaggucaaggagaucuucagcucccagcgccggcugggcaacaagaaggccaccgaggagcucgaggagaaguaccuggagaucaugaccagccagcgcuccuucgaccuggggccgggcaugcagcccgacgggaagcccagccccuacgccauggagggcuucuccgaccgggugggcaagugcaccuuccucggggaccagggcgagcugcgcggggccaagggcacguacaccgcggaguacuucguggcccugcagaagaucaaccacaccaagcucgucaaccaggacggggagacccggaacuucacggaggaggagcgccgggcccugacccugcuccuguucacccagaaggaggugaaguacgccgccgugcgcaagaagcugggccucccggaggacauccuguucuacaaccugaacuacaagaaggcggccaccaaggaggagcagcagaaggagaaccagaacacggagaaggccaaguucaucggcaugcccuacuaccacgacuacaagaagugccucgaggagcgggucaaguaccugaccgagaacgaggugcgcgaccuguucgacgagaucgggaugauccugaccugcuacaagaacgacgacagccggaccgagcgccucgccaagcugggccucgugcccaucgagauggaggggcugcuggccuacacgcccaccaaguuccagcaccucuccaugaaggcgaugcggaacaucaucccguuccuggagaagggcaugaccuacgacaaggccugcgaggaggccggguacgacuucaaggccgacagcaagggcaccaagcagaagcugcucacgggcgagaacgucaaccagaccaucaacgagaucaccaaccccguggugaagcgcuccgucagccagaccgugaaggugaucaacgcgaucauccggacguacgggagcccccaggccaucaacaucgagcuggcccgcgagauguccaagaccuucgaggagcggcgcaagaucaagggcgacauggagaagcgccagaagaacaacgaggacgucaagaagcagauccaggagcuggggaagcugucccccaccggccaggacauccucaaguaccggcuguggcaggagcagcaggggaucugcauguacagcggcaagaccaucccgcuggaggagcuguucaagcccggcuacgacaucgaccacauccuccccuacagcaucacguucgacgacuccuuccgcaacaaggugcuggucaccagccaggagaaccggcagaaggggaaccgcacccccuacgaguacaugggcaacgacgagcagcgguggaacgaguucgagacccgcgugaagaccacgauccgggacuacaagaagcagcagaagcuccugaagaagcacuucuccgaggaggagcgcagcgaguucaaggagcggaaccugaccgacaccaaguacaucaccacggugaucuacaacaugauccgccagaaccucgagauggccccgcugaaccggcccgagaagaagaagcagguccgcgccgugaacggggcgaucaccgccuaccugcggaagcgcuggggccucccccagaagaaccgggagaccgacacccaccacgccauggacgccguggucaucgccugcugcacggacggcaugauccagaagaucucccgcuacaccaaggugcgggagcgcugcuacagcaaggggaccgaguucguggacgcggagaccggcgagaucuuccggcccgaggacuacucccgcgccgagugggacgagaucuucgggguccacaucccgaagcccugggagacguuccgggccgagcuggacgugcgcaugggcgacgaccccaagggguuccuggacacccacagcgacguggcccucgagcuggacuaccccgaguacaucuacgagaaccugcgcccgaucuucgucucccggaugcccaaccacaaggugaccggcgccgcgcacgccgacaccauccgcagcccccggcacuucaaggacgagggcaucgugcucacgaagaccgcccugaccgaccugaagcucgacaaggacggggagaucgacggcuacuacaacccgcaguccgaccugcugcucuacgaggcccugaagaagcagcugcuccuguacgggaacgacgcgaagaaggccuucgcccaggacuuccacaagcccaaggccgacggcaccgaggggcccgucgugcgcaaggugaagauccagaagaagcagacgaugggcgucuucguggacagcggcaacgggaucgccgagaacggcgggauggugcggaucgacgucuuccgcgugaacggcaaguacuacuucgugcccgucuacaccgcggacguggugaagaagguccugccgaaccgggccuccaccgccaacaagcccuacagcgaguggcgcaccauggaggacaaggacuuccucuucucccuguacagccgggaccuggugcacaucaaguccaagaaggggauccccaucaagaacguggacggcagccucggcgaguccaaggaggucuacgccuacuacaucggggccgacaucagcggcgcgaagaucgaggggaaggcccacgacagccgcuacacguuccggggcaucggggugcagaagcuggagcugaucgagaagugccagguggacauccucggccacaucuccaccgucaagaacgagaagcgcaugggcuucagcuga

SEQ ID NO: 1649 - RNA, 3387 nt, Artificial Sequence
  Cas9 variant
augaacgacaagaaccagaaguaccgccugggccucgaccuggggaccaacagcaucggcuggugcaucuacucccuggacgugaacaacaagcccgagacccucaucgacauggggguccggaucuucagcgacggccgcgacccgaagacgaaggagccccuggccguggagcggcgcaccgcccgggggcugcgccggauccuccaccgccggaagcugcgccggcgccagauguuccggcugcuccaggagcagggccugaugcccaacgacgcguccgaggccgccgcccucaagagccucaaccccuacgagcugcgcgugaaggcccuggacaccaagcucgagccguacgagcugggccgggcgcuguucaaccucuccguccgccggggguucaagagcaaccgcaaggaggccgugcaggagaaggagaaggacucccagaacgacgccaagagccagaacgagaagugcgagcaccuggccaaggcgaucaaggacuccggcugccggacccugggggaguuccucuggaagcacaagaacacggagacccagcagaccgagaacgacgcccgcaacaucggcaugcgguucgugcccgggcgcagcaacuacuaccccacccgccggauguacgucgaggaguucgacgccauccgcaaggcccaggagcccuacuacuccggcgugaacugggacgcccugcacgagaagcuguucuaccagcggccgcuccgcgcgcaggagcggggcaagugccgcuacaugcccgacaaggagcggacguucaaggccaugcccugcagccagaagauccgcauccugcaggagguguacaacauggacuacaucgacgaguacgggaagaccaucccccuggaggaggcccagaccgacucccucaucagccugcuggacaagcgggagaagcucuccuucaaggccaugaagaaggagcugggcaucgacgagagcugcaccuucaaccuggagcgcgggggccgggaguaccuccagggcaacgccgcggccgucaagcugcgcaacaagaagcgguucggggagcugugggacucccucagccuggccaagcaggacgccaucguggagaagcugaucacggccgacgaggacgcggagaucaucuccaugcucgcccaguacaaccugaccgacgagcagaagaagaacaucgccgugaccguccugccgagcggcaccgccaugcucugcaaggaggugacggagaugcuggugcagaagauggagcagaacaagaucccccugaccgucgccgugcagaugcucggguacaccuacgcggaccagagcgugcgcgaggaggacacccugcccuacuacggcgccauccugacgggguccaccaugggcgcccaccccgaggccgacgagagcgagccggagcucaaguacggcaagaucuccaaccccaccguccacguggcgcugaaccagacccggacgguggucaacgcccugaucaaggccuacgggaagccccagcagaucgugguggagcugagccgcgaccucaaggccucccgggaggccaaggcgcgcauccagaagaccaucaccaugaaccagaagcggaacgagcgcgacaacaagaacaucaccgacaucacgaagauccccuacccgaaccgcaacgaccggcugaaguaccgccugugggaggagcucggcagcggguccaacagcuucucccggaagugccuguacugcggcaagcccaucagcggguccgagaucuucaccgagaacaucgagaucgagcacauccugcccuucggccgcacccucuucgacggcgagaccaacaagacggucgcccacaccgacugcaaccgggacaagggggaccgcagccccuucgaggccuucggcuccagcccgaacggguacaacuggcacgagaucugcgcccgggccaacucccugaagaaccccgcgaagcgcacccuguucgccgagaacgccauggagaaguucgagaaggacaacagcuucauccagcggcagcucaccgacaacgccuaccugucccgcagcgcccugcgguaccuccgcugcaucugcaaggacgugugguccaucaacggcgggaugacgaagcugcugcgggacaaguggaacaucgacagcauccucaagcgcaagaucgacgaccccgagaucgcgcacuucgagcugaagaacgaccagaucggccaguacaagaagaaccgguacgaccaccgccaccacgcccuggacgccagcgucaucgcccucaucgaccgggcgauggugcaggagaucucccagcugaacaagauccgccugaagaaccggaucgaggcgccccagaugccggugcuccgcagcgagcugaucgagaaggucaagcacaucaccguguccuucaagcccgaccacggccggcaggggaagcugagcaaggagacccuccugggcaagaucaagaagaucgagaagguggacaucgacuccauccagaccgacgacaucgccagcaucaaggacgacgccauccgcacccgcuucgagacgaagcggcgcgagcugggggacaucaccaaggccaaggccgcccucaagaccgaguuccccaagcuggacgucuucaagaccuacuacgugucccggacgccgaucgugagccugaccgagaagaacaucaacuccaucgucgacgagaagaucaaggagaagcucaagaccuucaucaaggagcacgccgaccugagcuucgccgagcagcugcagaaguucuccgagaccgaguggaucggcaagcccagcgccgcgggcaagcccgggaagaaguaccgcaucgagaaggugcggugcaucaacuggggccagacgcccaucaccaucaccuccagcgccgugccgcgcuaccucugccccgaggacuaccuggccgccgucguguggcagauccccuccaagaagaaggacaccgagcccgaguacaaggccacguuccugcggcgcgacgaguucgacgugaacaacaagccgaagaagcucgagaagccccacgacgcggcccaguacaucugcaugcuguacaaggacgacuaccuggaguucaccgagagcggggccacccaccucugccggaucgccggccugcccgcgucccagaacaacaagaucgacauccgccccaucuacgccgucagcgacugcaaggacuggaucaucgccaccaacgagaacaugcuggagccgugcuggaagccccagaaggaggagaagcggaucagcgugaacgugcuguucgggaagcacaaggcccgcuccgucacggugaaccccaucggccggguguuccgcaaguga

SEQ ID NO: 1650 - RNA, 3387 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaacgucgagcggcgcaccaaccggcagggccgccggcucacgcgccggaagaagcaccgccgggugcgccugaaccaccuguucgaggaguccggccucaucaccgacuucaccaaggugagcaucaaccugaacccguaccagcugcgggucaaggggcucaucgacgagcuguccaacgaggagcuguucaucgcccucaagaacauggugaagcaccgcggcaucagcuaccuggacgacgccuccgacgacgggaacagcuccgugggcgacuacgcccagaucgucaaggagaacagcaagcagcuggagaccaagacgcccgggcagauccagcucgagcgguaccagaaguacggccagcugcgcggcgacuucaccguggaggaggacgggaagaagcaccggcugaucaacguguuccccaccuccgccuaccgcagcgaggcgcuccggauccugcagacccagaaggaguucaacccccagaucacggacgaguucaucaaccgcuaccuggagauccucaccggcaagcggaaguacuaccacgggccgggcaacgagaagucccgcaccgacuacggccgguacaccacgaagaaggacagcgagaacgaguacaucacccuggacaacaucuucgggauccugaucggcaagugcaccuucuaccccgaggaguaccgcgccgccaaggccuccuacaccgcgcaggaguucaaccuccugaacgaccugaacaaccucacgguccccaccgagaccaagaagcugagcgaggagcagaagaaccagaucaucaacuacgugaagaacgagaaggccauggggcccgccaagcuguucaaguacaucgccaagcuccuguccugcgacguggccgacaucaagggcuaccgcaucgacaagagcgacaaggcggagauccacaccuucgaggccuaccggaagaugaagacgcuggagaccaucgacuucgagaagaugucccgcgaccagcucgacaagcuggccuacguccugacccucaacaccgagcgggaggggauccaggaggcccuggaccacgaguucgccgacggcaacuucagccaggagcagaucgacgagcuggugcaguuccgcaaggcgaacagcuccaucuucggcaagggguggcacaacuucagcgugaagcucaugauggagcugaucccggagcuguacgccacguccgaggagcagaugaccauccucacccggcugggcaagcagaagaccacgagcuccagcaacaagaccaaguacaucgacgagaagcugcucaccgaggagaucuacaaccccgucguggccaaguccgugcgccaggccaucaagaucgucaacgccgcgaucaaggaguacggggacuucgacaacaucgugaucgagauggcccgggagaccaacgaggacgacgagaagaaggccauccagaagauccagaaggccaacaaggacgagaaggacgccgcgaugcugaaggccgccaaccaguacaacggccgcgccgagcugccccacagcguguuccacgggcacaagcagcucgcgacgaagauccggcuguggcaccagcagggcgagcgcugccuguacaccggcaagaccaucuccauccacgaccugaucaacaaccccaaccaguucgagaucgaccacauccucccgcugagcaucaccuucgacgacucccuggccaacaagguccucguguacgccacggccaaccaggagaaggggcagcggacccccuaccaggcccuggacagcauggacgacgcgugguccuuccgcgagcugaaggccuucguccgggagagcaagucccucagcaacaagaagaaggaguaccugcugaccgaggaggacaucucccgcuucgacgugcggaagaaguucaucgagcgcaaccucguggacacccgguacgccagccgcgucgugcugaacgcccugcaggagcacuuccgggcccacaagaccgacacgaagguguccgucgugcgcggccaguucaccagccagcuccgccggcacugggggaucgagaagacccgcgacaccuaccaccaccacgcgguggacgcccugaucaucgccgccagcucccagcugaaccucuggaagaagcagaagaacacgcuggucaacuacagcgagaaccagcugcucgacaucgagaccggcgagcugaucuccgacgacgaguacaaggagagcguguucaaggcccccuaccagcacuucguggacacccugaaguccaaggaguucgaggacagcauccucuucuccuaccaggucgacagcaaguucaaccggaagaucuccgacgcgaccaucuacgccacgcgccaggccaagguggggaaggacaagaaggacgagaccuacgugcugggcaagaucaaggacaucuacagccagaccggcuacgacgccuucaucaagaucuaccagaaggacaaguccaaguuccugauguaccggcacgacccccagaccuucgagaaggucaucgagccgauccucgagaacuaccccaacaaggagaugaacgagaaggggaaggaggugcccugcaaccccuuccugaaguacaaggaggagcacggcgacuacauccgcaaguacagcaagaaggggaacggcccggagaucaagucccugaaguacuacgacagcaagcucggcaaccacaucgacaucacgcccaaggacuccaacaacaaggugguccugcagagcgugucccccuggcgggcggacguguacuucaacaagaccaccgggaaguacgagauccugggccucaaguacgccgaccugcaguucgagaaggggaccggcacguacaagaucagccaggagaaguacaacgucaucaagaagaaggaggggguggacagcgacuccgaguucaaguucacccuguacaagaacgaccuccugcugaucaaggacaccgagaccaaggagcagcagcuguuccgcuuccucagccggacgaagcccaacgugaagcacuacgucgagcugaagccguacgacaagcagaaguucgagggcaacgagucccucaucaacgugcugggcgccguggccaagggcgggcagugccagaaggggaucaacaagcccaacaucagcaucuacaagguccgcaccgacgugcugggcaaccagcacaucaucaagaacgagggggacaagcccaagcucgacuucuga

SEQ ID NO: 1651 - RNA, 3387 nt, Artificial Sequence
  Cas9 variant
auggacgagaagauggacuaccgcaucggccuggacaucgggaucgccagcgugggcugggccguccuccagaacaacuccgacgacgagcccgugcggaucguggaccuggggguccgcaucuucgacaccgcggagaucccgaagaccggcgagagccuggccgggccccggcgcgccgcccggacgacccgccggcgccuccggcgccggaagcaccgccuggaccggaucaaguggcuguucgagaaccagggccucaucaacaucgacgacuuccugaagcgcuacaacauggccggccugcccgacguguaccagcuccgguacgaggcgcuggaccgcaagcugaccgacgaggagcucgcccaggugcugcugcacaucgccaagcaccggggguuccgcuccacccggaaggccgagacggcggccaaggagaacggcgccguccucaaggccaccgacgagaaccagaagcgcaugcaggagaagggguaccggaccgugggcgagaugaucuaccuggacgaggccuuccgcaccgggugcagcugguccgagaagggcuacauccugacgccccgcaacaaggcggagaacuaccagcacaccaugcuccgggccaugcugguggaggaggucaaggagaucuucagcucccagcgccggcugggcaacgagaaggccaccgaggagcucgaggagaaguaccuggagaucaugaccagccagcgcuccuucgaccuggggccgggcaugcagcccgacgggaagcccagccccuacgccauggagggcuucuccgaccgggugggcaagugcacguuccucggggaccagggcgagcugcgcggggccaagggcaccuacaccgcggaguacuucguggcccugcagaagaucaaccacaccaagcucgucaaccaggacggggagacgcggaacuucaccgaggaggagcgccgggcccugacccugcuccuguucacccagaaggaggugaaguacgccgccgugcgcaagaagcugggccucccggaggacauccuguucuacaaccugaacuacaagaaggcggccacgaaggaggagcagcagaaggagaaccagaacaccgagaaggccaaguucaucggcaugcccuacuaccacgacuacaagaagugccucgaggagcgggucaaguaccugaccgagaacgaggugcgcgaccuguucgacgagaucgggaccauccucacgugcuacaagaacgacgacagccggaccgagcgccuggccaagcugggccucgugcccaucgagauggaggggcugcuggccuacacccccaccaaguuccagcaccucuccaugaaggcgaugcggaacaucaucccguuccuggagaagggcaugacguacgacaaggccugcgaggaggccggguacgacuucaaggccgacagcaagggcaucaagcagaagcugcucaccggcgagaaggucaaccagaccaucaacgagaucaccaaccccguggugaagcgcuccgucagccagacggugaaggugaucaacgcgaucauccggaccuacgggagcccccaggccaucaacaucgagcuggcccgcgagauguccaagaccuucgaggagcggcgcaagaucaagggcgacauggagaagcgccagaagaacaacgaggacgucaagaagcagauccaggagcuggggaagcugucccccaccggccaggacauccucaaguaccggcuguggcaggagcagcaggggaucugcauguacagcggcaagacgaucccgcuggaggagcuguucaagcccggcuacgacaucgaccacauccuccccuacagcaucaccuucgacgacuccuuccgcaacaaggugcuggucaccagccaggagaaccggcagaaggggaaccgcacccccuacgaguacaugggcaacgacgagcagcgguggaacgaguucgagacccgcgugaagacgaccauccgggacuacaagaagcagcagaagcuccugaagaagcacuucuccgaggaggagcgcagcgaguucaaggagcggaaccugaccgacaccaaguacaucacgaccgugaucuacaacaugauccgccagaaccucgagauggccccgcugaaccggcccgagaagaagaagcagguccgcgccgugaacggggcgaucaccgccuaccugcggaagcgcuggggccucccccagaagaaccgggagaccgacacgcaccacgccauggacgccguggucaucgccugcugcaccgacggcaugauccagaagaucucccgcuacaccaaggugcgggagcgcugcuacagcaaggggaccgaguucguggacgcggagacgggcgagaucuuccggcccgaggacuacucccgcgccgagugggacgagaucuucgggguccacaucccgaagcccugggagaccuuccgggccgagcuggacgugcgcaugggcgacgaccccaagggguuccuggacacccacagcgacguggcccucgagcuggacuaccccgaguacaucuacgagaaccugcgcccgaucuucgucucccggaugcccaaccacaaggugaccggcgccgcgcacgccgacacgauccgcagcccccggcacuucaaggacgagggcaucgugcucaccaagaccgcccugaccgaccugaagcucgacaaggacggggagaucgacggcuacuacaacccgcaguccgaccugcugcucuacgaggcccugaagaagcagcugcuccuguacgggaacgacgcgaagaaggccuucgcccaggacuuccacaagcccaaggccgacggcacggaggggcccgucgugcgcaaggugaagauccagaagaagcagaccaugggcgucuucguggacagcggcaacgggaucgccgagaacggcgggauggugcggaucgacgucuuccacgugaacggcaaguacuacuucgugcccgucuacaccgcggacguggugaagaagguccugccgaaccgcgccgccaccgcccacaagcccuacggggaguggaaggugauggaggacaaggacuuccucuucucccuguacagccgggaccugauccacaucaaguccaagaaggacauccccaucaagauggugaacggcggcauggaggggaucaaggagacguacgccuacuacaucggcgcggacaucagcgccgccaacauccaggggaucgcccacgacucccgcuacaaguuccggggccucgggauccagagccuggacguccuggagaagugccagaucgacgugcucggccacguguccgucgugcgcagcgagaagcggaugggcuucagcuga

SEQ ID NO: 1652 - RNA, 3387 nt, Artificial Sequence
  Cas9 variant
augagcgaccuggugcucggccuggacaucgggaucggcuccgucggggugggcauccugaacaaggugaccggggagaucguccacaagaacgcccgcaucuuccccgccgcgcaggccgagaacaacguggagcggcgcaccaaccggcagggccgccggcucacgcgccggaagaagcaccgccgggugcgccugaaccacaucuucgaggagagcggccugaucaccgacuucaccaaggucuccaucaaccucaacccguaccagcugcgggugaaggggcugaccgacgagcucagcaacgaggagcuguucaucgcccugaagaacauggugaagcaccgcggcaucuccuaccucgacgacgccagcgacgacgggaacuccagcgucggcgacuacgcccagaucgugaaggagaacuccaagcagcuggagacgaagacccccgggcagauccagcuggagcgguaccagaaguacggccagcuccgcggcgacuucaccaucgaggaggacgggaagaagcaccggcugaucaacguguuccccaccagcgcguaccgcgccgaggcccugcggauccuccagacgcagcaggaguucaacccccagaucaccgacgaguucaucaacuccuaccugcagauccugaccggcaagcgcaaguacuaccacgggccgggcaacgagaagucccggaccgacuacggccgcuacacgaccaagaaggacagcgaggacgaguacaucacccucgacaacaucuucgggauccugaucggcaagugcaccuucuaccccgaggaguaccgggccgcgaaggccagcuacacggcccaggaguucaaccugcucaacgaccugaacaaccugaccguccccaccgagaccaagaagcucuccgaggagcagaagaaccagaucaucacguacgugaagaacgagaaggccauggggcccgccaagcuguucaaguacaucgcgaagcugcucgccugcgacguggccgacaucaagggcuaccgcaucgacaagagcgacaagccggagauccacaccuucgaggccuaccgcaagaugaagacccuggagaccaucgacgucgagcagauggagcgggagaagcuggacaagcucgccuacgugcugacgcugaacaccgagcgcgaggggauccaggaggcgaucgagcacgaguucuccgacggcaccuucagccaggagcaggucgacgagcucgugcaguuccggaaguccaacagcagcaucuucggcaagggguggcacaacuucuccgugaagcugaugauggagcugauccccgagcucuacgccaccagcgaggagcagaugacgauccugacccgccugggcaagcagaagcggaccuccagcuccaacaagaccaaguacaucgacgagaagcgccucacggaggagaucuacaaccccguggucgccaagagcgugcggcaggccaucaagaucgugaacgccgcgaucaaggaguacggggacuucgacaacaucgucaucgagauggcccgcgagaugaacgaggacgacgagaagaaggccaucaagaagauccaggaggccaacaaguccgagaaggacgccgcgaugcggaaggccgccaaccaguacaacggcaaggccgagcugccccacagcguguuccacgggcacaagcagcuggcgaccaagauccgccucuggcaccagcagggcgagcggugccuguacaccggcaagaccaucuccauccacgaccugaucaacaacccgaaccaguucgagaucgaccacauccucccccugagcaucacguucgacgacucccuggccaacaagguccugguguacgccaccgccaaccaggagaaggggcagcgcacccccuaccaggcccucgacagcauggacgacgcgugguccuuccgggagcugaaggccuucgugcgcgagagcaagacccuguccaacaagaagaaggaguaccuccugaccgaggaggacaucagcaaguucgacguccggaagaaguucaucgagcgcaaccugguggacacgcgguacgccucccgcgugguccucaacgcccugcaggagcacuuccgggcccgcaagaucgacaccaaggugagcgugguccgcggccaguucaccucccagcugcggcgccacugggggaucgacaagacccgggacacguaccaccaccacgcgguggacgcccucaucaucgccgccagcagccagcugaaccuguggaagaagcagaagaacacccucguguccuacagcgaggaccagcugcuggacaucgagaccggcgagcucaucuccgacgacgaguacaaggagagcgucuucaaggcccccuaccagcacuucguggacacccugaaguccaaggaguucgaggacagcauccuguucuccuaccagguggacagcaaguucaaccgcaagaucuccgacgcgacgaucuacgccacccggcaggccaaggucgggaaggacaagaaggacgagaccuacgugcucggcaagaucaaggacaucuacagccaggccggcuacgacgcguucaucaagaucuaccagaaggacaaguccaaguuccugauguaccgccacgacccgcagaccuucgagaaggugaucgagcccauccuggagaacuaccccaacaaggagaugaacgagaaggggaaggagguccccugcaacccguuccucaaguacaaggaggagcacggcgacuacauccggaaguacagcaagaaggggaacggccccgagaucaagucccugaaguacuacgacagcaagcugggcaaccacaucgacaucacgcccaagaacuccaacaacaagguggugcuccagagcgucucccccuggcgcgccgacguguacuucaacaagaccaccgggaaguacgagauccugggccugaaguacgccgaccuccaguucgagaaggggaccggcacguacaagaucagccaggagaaguacaacgacaucaagaagaaggaggggguggacagcgacuccgaguucaaguucacccuguacaagaacgaccugcuccugaucaaggacaccgagaccaaggagcagcagcuguuccgguuccucagccgcuccaugccgaacaagaagcacuacgucgagcugaagcccuacagcaaggacaaguucgagaagaacgagacgcugaucgagauccucggccccaccgacaaguccggccggugcaucaaggggcuggccaagagcaaccuguccaucuucaaggugcgcaccgacauccucggcaaccagcacaucaucaagaacgagggggacaagcccaagcuggacuucuga

SEQ ID NO: 1653 - RNA, 3387 nt, Artificial Sequence
  Cas9 variant
augaccaagauccugggccucgaccuggggaccaacagcaucggcugggccguggucgacgagaagaaggagaagauccuggggaugggcucccgcaucuuccccgaggggguggugaacaucggcgagggcgaggggcgggagacgagcaagaacgccucccgcaccgacgcgcggggcacccgccggcaguucuuccgccggcgccuccggaagcgcuaccugcugcgggagcucgccaagaaggggcugugcccgaucaacuacacccuggucaaggaguggaacgaggcccagaucuucaagaacaagcagcuccaggagugguucaagcugaaccccuacgagcugcgcagcaaggccauccaggagaagaucucccucgaggagcugggccggaucuucuaccacuucauccagcgccggggguuccagagcaacucccgcagcgccggcguggacaacaucgagaaguccgugaucuucaagggcgacacgaagaccgggaagaucggcaucagcgagacccuggaguccaucaagaacaccaagacgcucgggagcuaccugcacaccaucuaccccaagcagaacaagcccuacuccggccacaaggagcggauccgcaaccgguacaccacccgccagauguacaucuacgaguucgagacgaucugggaguaccagaagcaguucuacagcgagcuguccaacgagcucaagaccguccugggcgggcggaagaaggacggcuacaaggaggacgggauccuguuccaccagcgcccgcuccgcagccagaagcaccuggugggcuacugcuccuucgagcccaagaagaccaagugccagaucaacaccauccccuucgagcuguuccggaucuaccagugggugaacacggucgacugcaacgagaaggugaccagcgaggaccgcgggaagaugguggagcuccugcuguccaaggagaaggucagcuucaaggagauccggaaggugaucaacaagagcgacggcuacuaccaguucaacuacaagaacgacgacaagaucgugggcuccuacaccaucagcaaccucuccaacaagaaguucuucgggaagaagugguucgacuucagcgacaaggagcaggaggacaucuggcacguccuguccuucuucgacgaccgcgacaagcugaagcaguacgcgaucaaguacuggggcuucaacgaggagaaggccgugaagaucagcaaguucaaccucaaggagggguacuccaaccugagccggaaggccauccacaacauccugcccuuccucaagcugggcuucauguacgacguggccgucgggcugggcggcgugaagaacgcgcucgccgacaaguggaucgagaacgagcaguucauccuggacaacgugccguccgucgugcgcagcaacuucaagggcggguacaucgagccccugaagcagaugcucaaguacgaguucgacguguccgacaagcagcugcugaagcucuaccaccacagcuccgccaucgagaccacggagcugcugaagaagcuccccaucaacagcgaggccgacaaggagauccaguccaucaagaaccccgucgugaucaccgcccuguucgagauccggaagcuggucaacgagaucaucgacaccuacgggaaguucgacgagaucaagguggagcucgcgcgcgaccugaaggccagcaaguccaagcgguacgacacccgccgggagcagcugcgccuggagaaggagaacgaccggaucaagaucgagcucgagaaccugggccagcgcaucaaccacaucacgauccugaaguacaagcucugggaggagugcgacaagcggugcccguucaccgggaagaacaucgaggugaacgagcuguucagcggcgagguccagaucgagcacaucuuccccuggucccgcagccugaacgacagcuucaugaacaagacccucugcuucgccgacgagaaccgggccaagggcaacaagacccccuacgaguucuacuccgagcagggggagcagaagugggaggagaucaagauccaggcccugagcugcuucaagaacaagcccaacuacccgaacgcguaccagaaguucaagcaguucgugaagaagaagcacgacgaggacuucaucucccgccagcugaacgacacgcgguacaucagcaaggaggccaagaacuaccucuccaagaucugcaacaacgugcaggucgcccccggccagaugaccgccacccugcgccacaagugggggcugaacaccauccucaacaaggacgacgacacgaagacccgcgacgaccaccggcaccacgccaucgacgcgcuggugauggccugcagcacccgcucccaccuccaggagcugagcaagcggaaccgcuaccagaaggacuacgaguucaaggacuuccccaugcccuggcaguucuuccggcaggacgccgagaaguccguggagcagauccuggucagccacaagaagcugaacaccauccucacggugcgcacccacaagaccaagaagaacggcguggucuacaagaacaucggcguggccgcccgggggcagcugcacaaggagaccguguucggcaagcgcaccgcgccggacgggaucgaggccuaccacguccggaagcccaucgagucccugagcacgcacaagcacaucaacaaggugguggacgagaccauccgccuccugauccugaagcaggucaacaagcucggcggguucgugaagggcaagauccccgagggcaccuucuacaacaccgacgagaacgggaacaagcagccccagaucuuccugccgaacaagaacggcaaccccgugcccaucaagaagauccggcugcgcgagaacaucgggggcgccgagcagcucaaguccacggucaaccagcacgugaacccccggagcaaccaccacgugcugaucuacaaggacuucgacgacaaccugaaggagaaggucgugaccuucuggaccgccguggagcgcaagaagcagaagcaggcggucuuccagcucccggagaacgggaaggagaucgugaccacgcugcagaucaacgacauguuccugcucggccugaaggacgacgagaucaacugggagcaccccaaguucacccugcucaaggagcaccuguaccgggugcagaaguucaccuccggcgacuacuacuuccgcaagcacaucgagagcaaccugaacggggagcucggcaaggccuaccaguacaucaagggguucggcgaggggaagaccggcuggaagacguucaaccccaucaagaucaaggucuccgugagcggcaagaucgagaagguguga

SEQ ID NO: 1654 - RNA, 3390 nt, Artificial Sequence
  Cas9 variant
augaacggccuggugcucgggcuggacaucggcaucgccagcgucggggccggcauccugaagaaggacaccggggagaucauccacgcgaacucccgccucuuccccgccgccaccgccgacaacaacgugcugcggcgcagcucccggcaggcccgccggagcacgcgccggaagcgccaccgggcggugcgccugcacgaccucuucgaggacuacggccugcugaccgacuucuccaaggucagcaucaaccucaacccguacaagcugcggguggagggcauggacauccagcugaccaccgaggagcuguucaucgcccucaagaacaucaucaagcgccgggggaucuccuaccuggacgacgccagcgaggacggcgugacggucuccagcgacuacgggaaggccguggaggagaaccgcaagcuccuguccgagcagacccccggccagauccagcuggagcgguucgagaaguacggccaggugcgcggggacuucaccgucgaggagaacggcgagaagcggcgccucaucaacguguucagcaccuccacguaccggaaggaggcggagcgcauccugcggaagcagcaggaguucaacaacaagaucaccgacgacuucaucgacgacuaccugaccauccucaccgggaagcgcaaguacuaccacggccccgggaacaagaagucccgcacggacuacggccgguacaccaccaagaaggacagcgagggcaaguacaucacccuggacaacaucuucggggugcugaucggcaagugcacguucuaccccgacgaguaccgcgccagcaaggccuccuacaccgcccaggaguucaaccuccugaacgaccugaacaaccucaccgucccgaccgagacgaagaagcugagcgagaagcagaagaagaccaucguggaguacgccaagaccgcgaagacccugggggccuccacgcuccugaaguacaucgccaagaugguggacgccagcgucgaccagauccacggcuaccggguggacgugaacaagaagcccgagaugcacaccuucgacgucuaccgcaagaugcagagccuggagaccuucaacgugaacgagaugccccgggaggugcucgacgagcuggcccacauccugacccucaacacggagcgcgaggggaucgaggaggcgaucaacaccaagcugaagggcaccuucaaccaggaccagguccuggagcucgugcaguuccggaagaacaacuccagccuguucuccaagggcuggcacaacuucagccugaagcucaugauggagcugauccccgagcuguacgccaccuccgaggagcagaugacgauccucacccgccuggggaagcagaaguccaaggagaucagcaagcggaccaaguacaucgacgagaaggagaucaccgaggagaucuacaacccgguggucgccaagagcgugcgccaggccaucaagaucaucaacgaggccacgaagcaguacggcaucuucgaccacaucgucaucgagauggcgcggcugaccaacgaggaggacgccaagaaggacuacaucaagcgccagaaggccaaccucgacgagaagaacgccgccauggagaaggcggccuuccaguacaacgggaagaaggagcugcccgacuccaucuuccacggccacaaggagcuggccaccaagauccggcuguggcaccagcagggggagaagugccucuacaccggcaagaacauccccaucagcgaccugauccagaaccaguacaaguacgagaucgaccacauccugccccucucccugagcuucgacgacucccugagcaacaaggugcucgugcuggccaccgcgaaccaggagaagggccagcgcacgccguuccaggcccuggaccggauggacgacgccugguccuaccgcgaguucaagagcuacgucaaggacuccaagcuccuggggaacaagaagaaggacuaccugcucaccgaggaggacaucagcaagaucgaggugaagcagaaguucaucgagcggaaccugguggacacccgcuacuccagccgggucgugcugaacgcccuccaggacuucuacaagaaccaccacuucgacaccacgaucagcgugguccgcggccaguucaccucccagcugcgccggaagugggggcuggagaagucccgcgagaccuaccaccaccacgccguggacgcgcucaucaucgccgccagcagccagcugcggcuguggaagaagcagaacaacccccucaucuucuacaaggagggccaguucguggacuccgagaccggggagauccugagccugaacgacgacgaguacaaggagcucgucuucaaggcccccuacgaccacuucguggacacgcugcgcuccaagaccuucgaggacagcauccuguucuccuaccagguggacagcaaguacaaccggaagaucuccgacgccaccaucuacgcgacccgcaaggccaagcucgacaaggacaagagcaaggagacguacguccuguccaagaucaaggacaucuacagccaggccggcuacgacgccuucaucaagaucuacaacaaggacaaguccaaguuccugauguaccacaaggacagccagaccuucgagaaggugaucgaggagauccuccggaccuaccccuccaaggaguucaacgacaagaacaaggaggugccgugcaaccccuucgagaaguaccgccaggagaacggccccauccggaaguacagcaagaaggggaacggccccgagaucaagagccugaaguacuacgacaagaacaucccggaguccuucaucaacaucacccccagcaacuccaagaacaaggucauccugcgccagcucaaccccuggcggacggacguguacuucaaccaccagaccgagaaguacgagcugcuggggcucaaguacgccgaccugcaguucgagaagaagaccggcaccuacagcaucacgaucgacaaguacaacgagaucaaggagaaggagggcgugggggagcaguccgaguucaaguucacccuguacaagaacgaccuccugcugaucaaggacaccaagaacaacgagaagcagaucuuccgcuuccucagccggaccaugcccaacgucaagcacuacguggagcugaagccguacaacaaggcgaaguucgacggcaaccagccccugaucacgaucuucgggaacguggccaagggcgggcagugccucaagggccugaacaagcccaacaucuccaucuacaagaucaagaccgacguccugggcaacaaguacuucaucaagaaggagggggacaagcccaagcucaaguucuga

SEQ ID NO: 1655 - RNA, 3390 nt, Artificial Sequence
  Cas9 variant
auggccgaccgcaucagccugggccucgacaucgggguggccuccgucggcuucagcgugcuggacaucgacaaggggaaggugaucgagcugggcucccgccucuucaacgcgaccgucgccgaggggaaccaggaccggcggagcaugcgcggcgcccggcgccugcugaaccggaacaagcagcgccggcaggacaccggcaagcuguuccagaaguucgggcuccuggacaacuucaacaaggacaacuucuacgacacguucaaccagaacuggaaccccuacgagcuccgcgugaagggccugaccgagcaccugaccaagaaggagcucgccgagucccuguaccagaucgugaagcaccgggggaucagcuacgcccugaaggacgcggacgccgacgagggcgggaccgacuacuccgccagccucaagaucaacucccaggagcuggccgagaagacgccggcgcagauccagcugcagcgccucaacgacuacggcaagguccggggccagguggugaucggggacgaccccgacaaccagaagguccugcugaacguguuccccaccagcgccuacgagaaggaggccaagcagaucaucgccacccagaagcaguucuaccccgagauccucaccgacgaguucacgaaggaguacugcaagauccugacccgcaagcgggacuacuucgugggcccggggaacgagaagucccgcaccgacuacggcaucuacaagaccgacggccggacgcuggacaaccucuucgaggagcugaucgggcacgacaagaucuaccccgacgagcugcgcgccagcgcggccuccuacaccgcccagcuguucaacguccucaacgaccugaacaaccuccggauccugagcuacgaggacggcaagcugaccaaggaggacaaggagaagaucaucgccgagaucaaguccaacaccacgaccaucaacaugcucaacgugaucaagaagguggccgggugcagcaaggaggacaucaagggcuuccgcgucaacgagaaggacaagcccgagaucuccagcauggcgguguaccggaaggugcacaaggaccugcugaaggucgggguggacaucuccgacuggcccguggaguucaucgacaagcucagcuucauccugacccugaacaccgagaacggcgagauccgcaagcagcucaacaaccgccuggucccggaguucgacuuccugaacgacgaccucauccagcugaucaucgacaacaaggacagcuucgagaucaagacgaacaacaaguggcaccgguucucccugaagaccaugaacaagcucaugcccgagaugcuggagcgccccguggagcagaugacccugcucaacgagaugggccuggugaagaaggacaagaagcgguucgagaacaacaaguaccugcccuacaaggagaucgccaaggacaucuucaacccggucgccagcaaguccgugcgcgaggcccugaagaucgucaacgccgugcucaagaaguacgggcacaucgacuaccuggugaucgagaugccccgggacaagaaccugaaggaggagcaggacaacaucaaggaguuccagaacaagaacaagaaggcgaaggacgccgccuucgaggccuucgucaagagcgugggcuccgagcagcgcgugaaggaggcccucagcaagaaccggaagcugcagaugaagaugcgccugugguaccagcagcaggagaucgaccccuacaacggggagaccaucgacgcgacggaccucaucaacaaccccgacaaguucgagaucgaccacaucaucccgcaguccaucagcuucgacgacuccaucaacaacaagacccugugcuucgccagcaugaaccaggucaagggccagaagacccccuacgaguucaugcuggaggggcacggccagggcuacgacaaguucaaggccaccgugcucgacaacaagaacuucgaccggaacaagcgcaagaacuaccuguucgaggagaacguguccgacaucgagacgcggaagcgcuuccugagccggaaccucgucgacacccgcuacuccagccggguggugcugaacucccugcaggacuucuuccacgagaaguccgccgacaccaaggucaccgugauccgcgggaaguucacgagcaacaugcggaagcacuggcacaucgacaagacccgcgagaccuuccaccaccacgcgaucgacgccagcaucaucgccgccacccccuuccuccggauguggaagaagggcgggacgaucuuccccgugaaggucggcgaggaguccaucgacaucgagaccggggagauccuggacgacaagaaguucgacaaggugauguacgaggagccguacaacggcuucgugagcgagaucaugaacgccgacgaccgcaucaaguucagccaccaggucgacaagaagaugaaccgcaagguguccgacgcgaccaucuacagcacccggaccggcaagcuggccaaggacaagaaggacgccgaguacaucguggccaaggucaaggacaucuacuccguggacggguucaagaaguucaagaagguguacgacaaggacaagagcaaguuccuccuguacaaguacgacccccgcacguucuccgagcuggagcggaucaucagcgacugccccgacaaggucgagaaggugcagaccaacggcaaggugaaggccgucgacgugucccccuucgagauguaccgccgguaccacgggaugaucaagaaguacagcaagaagggcaacggcccggcgaucaagcagcucaaguaccuggacaagaagcuggggucccacaucgacaucacccccgccaacgccaacggcaagcacgugauccuccagagccugaagcccuggcgcaccgacgucuaccugaaccacgagacgggggaguacgagaucaugggcaucaaguacuccgaccucaaguucaacaagaacgugggguacggcaucaagaaggacaaguaccuggagaucaagaagaacgaggaggugagcgagaaguccgaguucauguucagccuguaccggaaggaccgcguccggauccagaacaugaagaccggcgaguccguggagcuccuguucuggagccgcaacuucuccaacaagaaguacgccgagcugaagcccaucuucaaguucgugaccgaggacgacgacuggccggucuacgggcacgccaagacccagauccucaagcggcuggugcccaaggacugcaagaucuggaaggugaacacgaccauccugggcgaccccuacuaccucgagaaggagagcgacaacccgaaggacauccuggacuga

SEQ ID NO: 1656 - RNA, 3390 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgggaucgugacggacuuccggaaccugaaccugaaccccuacgagcuccgcgucaagggccugaccgagcagcugaccaacgaggagcuguucgcggcccuccggaccaucagcaagcgccgggggaucuccuaccuggacgacgccgaggacgacagcacgggcuccaccgacuacgccaagagcaucgacgagaaccgccggcuccugaagaccaagaccccggggcagauccagcuggagcgccucgagaaguacggccagcugcggggcaacuucacgguguacgacgagaacggggaggcgcaccgccugaucaacguguucuccaccagcgacuacgagaaggaggcccggaagauccucgagacccaggccgacuacaacaagaagaucaccgccgaguucaucgacgacuacgucgagauccugacgcagaagcgcaaguacuaccacggccccgggaacgagaagucccgcaccgacuacggccgguuccgcaccgacggcaccacgcuggagaacaucuucgggauccucaucggcaagugcagcuucuaccccgacgaguaccgggccuccaaggcgagcuacaccgcccaggaguacaacuuccugaacgaccugaacaaccucaaggugcccaccgagaccgggaagcuguccacggagcagaaggaggcccugguggaguucgccaagagcaccgccacccucggcccggcgaagcugcugaaggagaucgccaagauccucgacugcaaggucgacgagaucaagggguaccgcgaggacgacaagggcaagcccgaccugcacaccuucgagcccuaccggaagcugaaguucaaccucgacuccgugaacaucgacgaccugagccgcgaggugcuggacaagcucgccgacauccugacgcugaacaccgagcgggagggcaucgaggacgccaucaagcgcaaccuccccaaccaguucaccgaggagcagaucuccgagaucaucaacguccgcaagagccagagcaccgccuucaacaagggguggcacuccuucagcgcgaagcugaugaacgagcugaucccggagcucuacgccacguccgacgagcagaugaccauccugacccggcuggagaaguucaaggugaagaagaaguccagcaagaacaucaagaccaucgacgagaaggagaucacggacgagaucuacaaccccguggucgccaagagcgugcggcagaccaucaagaucaucaacgccgccgugaagaaguacggcgacuucgacaagaucgucaucgagaugccccgcgacaagaacgcggacgacgagaagaaguucaucgacaagcggaacaaggagaacaagaaggagaaggacgacgcccucaagcgcgccgccuaccuguacaacgggaccgacaagcugcccgacgagguguuccacgagaacaagcagcucgagaccaagauccggcugugguaccagcagggcgagcgcugccuguacuccgggaagccgauccccauccaggagcuggugcacaacagcaacaacuucgagaucgaccacauccucccccugucccugagcuucgacgacucccucgcgaacaagguccugguguacagcuggacgaaccaggagaagggccagcggacccccuaccaggucaucgacuccauggacgccgccuggagcuuccgcgagaugaaggacuacgugcugaagcagaagggccucgggaagaagaagcgggacuaccugcugaccaccgagaacaucgacaagaucgaggugaagaagaaguucaucgagcgcaaccucgucgacacccgcuacgccucccggguggugcugaacagccugcaguccgcccuccgcgagcugggcaaggacacgaaggucagcguggugcgggggcaguucaccucccagcugcgccggaaguggaagaucgacaagagccgcgagaccuaccaccaccacgcggucgacgcccucaucaucgccgccagcucccagcugaagcugugggagaagcaggacaacccgauguucguggacuacggcaacaaccagguggucgacaagcagaccggggagauccucagcguguccgacgacgaguacaaggagcugguguuccagccgcccuaccagggcuucgucaacacgaucagcuccaagggcuucgaggacgagauccuguucagcuaccagguggacuccaaguacaaccggaaggugagcgacgccaccaucuacuccacccgcaaggcgaagaucgggaaggacaagaaggaggagaccuacguccucggcaagaucaaggacaucuacagccagaacggguucgacacguucgugaagaaguacaacaaggacaagacccaguuccugauguaccagaaggacccccugaccugggagaacgugaucgaggucauccuccgggacuaccccaccacgaagaaguccgaggacggcaagaacgacgugaagugcaaccccuucgaggaguaccgccgggagaacggccugaucugcaaguacagcaagaaggggaagggcacccccaucaagucccugaaguacuacgacaagaagcucgggaacugcaucgacaucacgccccaggagagcaagaaccgcgugguccugcggcagaucuccccguggcgcgccgacaucuacuucaaccccgagacccugaaguacgagcucaugggccugaaguacagcgaccuguccuucgagaaggggaccggcaaguaccacaucagccaggagaaguacgacgccaucaaggagaaggagggcguggggaaggacagcgaguucaaguucacccucuaccggaacgaccugauccugaucaaggacacccucaacaacugcgagcgcaugcugcgguucggcuccaagaacgacaccagcaagcacuacguggagcugaagccccucgagaaggggacguucgacuccgaggaggagauccugcccguccugggcaagguggccaagagcgggcaguucaucaagggccucaacaagccgaacaucuccaucuacaaggugcgcaccgacguccugggcaacaaguacuucgugaagaaggagggggacaagcccaagcuggacuucaagaacaacaagaaguga

SEQ ID NO: 1657 - RNA, 3390 nt, Artificial Sequence
  Cas9 variant
augagcaacggcaagauccuggggcucgacaucggcguggccuccgucggggugggcaucaucgacagcaagaccgggaacgugauccacgccaacucccgccuguucagcgcggccaacgccgagaacaacgccgagcggcgcggcuuccggggcgcccgccggcugacccgccggaagaagcaccgcgucaagcgggugcgcgaccucuucgagaaguacgacaucuccacggacuuccggaaccugaaccugaaccccuacgagcuccgcgugaaggggcugaccgagcagcugaccaacgaggagcuguucgcggcccuccggaccaucgccaagcgccggggcaucagcuaccuggacgacgccgaggacgacuccacggggagcuccgacuacgccaagagcaucgacgagaaccgccggcuccugaagaccaagaccccgggccagauccagcuggagcgccucgagaaguacgggcagcugcggggcaacuucaccgucuacgacgagaacggcgaggcgcaccgccugaucaacguguucuccacgagcgacuacaagaacgaggcccggaagauccucgagacccaguccaacuacaacaagcagaucaccgacgaguucaucgaggacuacaucgagauccugacccagaagcgcaaguacuaccacgggcccggcaacgagaagucccgcacggacuacgggcgguuccgcaccgacggcaccacccuggagaacaucuucggcauccucaucgggaagugcagcuucuaccccgaggaguaccgggccagcaaggccuccuacacggcgcaggaguucaacuuccugaacgaccugaacaaccucaaggugcccaccgagaccggcaagcugagcaccgagcagaaggaguaccuggucgacuucgccaagaaguccaaggcccucggggccagcaagcugcugaaggagaucgccaagaucguggacugcagcguggacgacaucaagggcuaccgcgucgacaacaaggacaagccggaccuccacacguucgagcccuaccggaagcugaaguucaaccuguccagcaucgacaucgacgagcucucccgcgagacccuggacaagcuggcggacauccucacccugaacaccgagcgggaggggaucgaggacgccaucaagcgcaaccugcccagccaguucacggaggagcagaucuccgagaucgugcagauccggaagaaccagagcuccgccuucaacaagggcuggcacagcuucuccgccaagcucaugaacgagcugauccccgagcuguacgugaccagcgaggagcagaugaccauccucacccgccuggagaaguucaaggucaacaagaaguccagcaagaacacgaagaccaucgacgagaaggagaucaccgacgagaucuacaacccggugguggccaaguccguccggcagaccaucaagaucaucaacgcggccgugaagaaguacggcgacuucgacaagaucgugaucgagaugccccgcgacaagaacgccgaggacgagaagaaguucaucgacaagaagcagaaggagaacaagaaggagaaggacgacagccugaagcgggccgccuuccucuacaacgggacggacaaccugcccgacggcgucuuccacgggaacaaggagcugaagaccaagauccgccucugguaccagcagggcgagcggugccuguacuccgggaagcugaucagcauccacgaccuggugcacaacuccaacaaguucgagaucgaccacauccucccccugagccuguccuucgacgacagccucgcgaacaaggugcuggucuacgccuggaccaaccaggagaagggccagaagaccccguaccaggugaucgacagcauggacacggccugguccuuccgcgagaugaaggacuacguccugaagcagaagggccucgggaagaagaagugcgaguaccugcugaccaccgagaacaucgacaagaucgaggugaagaagaaguucaucgagcggaaccucguggacacccgcuacgccagccgggucgugcugaacucccugcagaccgcgcucaaggagcugggcaaggacacgaaggugagcgucgugcgcgggcaguucaccucccagcugcgccggaaguggaacaucgacaagagccgcgagaccuaccaccaccacgccguggacgcccucaucaucgccgccuccagccagcugaagcuguggcagaagcaggagaaccccauguucgaguccuacggcgagaaccaggucgugaacaaggagaccggggagauccucagcaucuccgacgacaaguacaaggagcugguguuccagccgcccuaccagggcuucgucaacacgaucagcuccaagggcuucgaggacgagauccuguucagcuaccagguggacuccaaguucaaccggaaggugagcgacgcgaccaucuacuccacccgcaaggccaagcucgggaaggacaagaaggacgagaccuacguccugggcaagaucaaggacaucuacagccaggacggguucgacacguucaucaagcgguacaagaaggacaagacccaguuccugauguaccagaaggacccccucaccugggagaacgugaucgaggugauccugcgcgacuaccccagcgagaagcuguccgaggacggcaagaagaccgucaagugcaaccccuucgaggaguaccggcgcgagaacggccucaucugcaaguacagcaagaaggggaacggcacgcccaucaagucccugaaguacuacgacaagaagcuggggaacugcaucgacaucaccccggagaaguccaagaaccggguggugcuccgccagaucagccccuggcgggccgacaucuacuucaaccuggagacccugaaguacgagcucaugggccugaaguacagcgaccuguccuucgagaaggggaccggcaaguaccacaucagccaggagaaguacgacgccauccgcgagaaggagggcaucgggaagaaguccgaguucaaguucacgcucuaccggaacgaccugauccugaucaaggacacccucaacaacugcgagcgcaugcugcgguucggcagcaagaacgacaccuccaagcacuacgucgagcugaagccccucgagaaggggaccuucgacagcgaggaggagauccugcccgugcugggcaagguggccaaguccgggcaguucaucaagggccucaacaagccgaacaucagcaucuacaagguccgcacggacgugcugggcaacaaguucuucaucaagaaggagggggacaagcccaagcuggacuucaagaacaacaacaaguga

SEQ ID NO: 1658 - RNA, 3390 nt, Artificial Sequence
  Cas9 variant
augagcaacggcaagauccuggggcucgacaucggcguggccuccgucggggugggcaucaucgacgccaagaccgggaacgugauccacgcgaacagccgccuguucuccgccgccaacgccgagaacaacgccgagcggcgcggcuuccggggcgcgcgccggcugacccgccggaagaagcaccgcgucaagcgggugcgcgaccucuucgagaaguacgacaucagcacggacuuccggaaccugaaccugaaccccuacgagcuccgcgugaaggggcugaccgagcagcugaccaacgaggagcuguucgccgcccuccggaccaucgccaagcgccggggcaucuccuaccuggacgacgcggaggacgacagcacgggguccagcgacuacgccaaguccaucgacgagaaccgccggcuccugaagaccaagaccccgggccagauccagcuggagcgccucgagaaguacgggcagcugcggggcaacuucaccgucuacgacgagaacggcgaggcccaccgccugaucaacguguucagcacguccgacuacaagaacgaggcccggaagauccucgagacccagagcaacuacaacaagcagaucaccgacgaguucaucgaggacuacaucgagauccugacccagaagcgcaaguacuaccacgggcccggcaacgagaagucccgcacggacuacgggcgguuccgcaccgacggcaccacccuggagaacaucuucggcauccucaucgggaagugcagcuucuaccccgaggaguaccgggccuccaaggcgagcuacacggcccaggaguucaacuuccugaacgaccugaacaaccucaaggugcccaccgagaccggcaagcuguccaccgagcagaaggaguaccuggucgacuucgccaagaaguccaaggcccucggggccagcaagcugcugaaggagaucgcgaagaucguggacugcagcguggacgacaucaagggcuaccgcgucgacaacaaggacaagccggaccuccacacguucgagcccuaccggaagcugaaguucaaccugagcuccaucgacaucgacgagcucagccgcgagacccuggacaagcuggccgacauccucacccugaacaccgagcgggaggggaucgaggacacgaucaagcgcaaccugcccucccaguucaccgaggagcagaucagcgagaucgugcagauccggaagaaccaguccagcgccuucaacaagggcuggcacuccuucagcgccaagcucaugaacgagcugauccccgagcuguacgugaccuccgaggagcagaugaccauccucacgcgccuggagaaguucaaggucaacaagaaguccagcaagaacaccaagaccaucgacgagaaggagaucaccgacgagaucuacaacccggugguggccaagagcguccggcagacgaucaagaucaucaacgcggccgugaagaaguacggcgacuucgacaagaucgugaucgagaugccccgcgacaagaacgccgaggacgagaagaaguucaucgacaagaaggagaaggagaacaagaaggagaaggacgacucccugaagcgggccgccuuccucuacaacgggaccgacaaccugcccgacggcgucuuccacgggaacaaggagcugaagaccaagauccgccucugguaccagcagggcgagcggugccuguacagcgggaagcugaucuccauccacgaccuggugcacaacagcaacaaguucgagaucgaccacauccucccccugucccugagcuucgacgacucccucgcgaacaaggugcuggucuacgccuggaccaaccaggagaagggccagaagacgccguaccaggugaucgacagcauggacgccgccuggagcuuccgcgagaugaaggacuacguccugaagcagaagggcaucgggaagaagaagcgggaguaccuccugaccaccgagaacaucgacaagaucgaggugaagaagaaguucaucgagcgcaaccugguggacacccgguacgcgucccgcgucgugcucaacagccugcagaccgcccugaaggagcucggcaaggacacgaagguguccgucgugcgcgggcaguucaccagccagcugcggcgcaaguggaagaucgacaagucccgggagaccuaccaccaccacgccguggacgcccugaucaucgccgcgagcggccagcucaagcuguggcagaagcacgagaaccugauguucgagaacuacggggagaaccaggucgugaacaaggagaccggcgagauccucuccaucagcgacgacgaguacaaggagcugguguuccagccgcccuaccagggcuucgucaacacgaucuccagcaagaccuucgaggacgagauccuguucuccuaccagguggacagcaaguucaaccgcaagguguccgacgccaccaucuacagcacccggaaggccaagcucgggaaggacaagaaggaggagacguacguccugggcaagaucaaggacaucuacacccaggacggguucgacaccuucaucaagcgcuacaagaaggacaagacccaguuccugauguaccagaaggacccccucacgugggagaacgugaucgaggugauccugcgggacuaccccuccgagaagcugagcgaggacggcaagaagaccgucaagugcaaccccuucgaggaguaccgccgggagaacggccucaucugcaaguacuccaagaaggggaacggcacccccaucaagagccugaaguacuacgacaagaagcuggggaacugcaucgacaucacccccgagaaguccaagaaccgcguggugcuccggcagaucagcccguggcgcgccgacaucuacuucaaccuggagacgcugaaguacgagcucaugggccugaaguacagcgaccuguccuucgagaaggggaccggcaaguaccacaucagccaggagaaguacgacgccauccgggagaaggagggcaucgggaagaaguccgaguucaaguucacccucuaccgcaacgaccugauccugaucaaggacacccucaacaacugcgagcggaugcugcgcuucggcagcaagaacgacacguccaagcacuacgucgagcugaagccccucgagaaggggaccuucgacagcgaggaggagauccugcccgugcugggcaagguggcgaaguccgggcaguucaucaagggccucaacaagcccaacaucagcaucuacaagguccggaccgacgugcugggcaacaaguucuucaucaagaaggagggggacaagccgaagcuggacuucaagaacaacaacaaguga

SEQ ID NO: 1659 - RNA, 3393 nt, Artificial Sequence
  Cas9 variant
augaacaagauccugggccucgaccuggggaccaacagcaucggcugggcccugaucgagaacaacaucauccucgggaugggcucccgcguguuccccgagggggucgugaaccugggcgagggcgaggggcgggagaccagcaagaacgccucccgcacggaggcgcggggcgugcgccggcagaucuuccgccggcgccugcggaagcgcuaccuccugaaggagcuggccaagcacaaccucugcccgaucagccccacccugaucaaggacuggaacgggaccgacaucuucaagaacgagcugaucauccagugguuccagcucaaccccuacgagcugcgggccaaggccauccaggaggagaucacccugaucgagcucggccgcaucuucuaccacaugauccagcggcgcggguuccuguccaacagccgguccgccggcgcggacgucaaggagacgagcaccaucuucaagggcgacgccaagaucgggaagaucggcaucuccgacacccucaagagcaucgagcagaacaagacccucggguccuuccugcacagcauccagcccaaggagaacgagccguucuccggcgagcuggagcgcauccggaaccgcuacacgacccggcagauguacaucgacgaguucgagaccaucugggaguuccagaagcaguaccacagcgagcucaacuccaaccugaagaccauccugggcgggcgcaagaaggacaacuacaaggaggacggcgugcuguuccaccagcggccccugcgcagccagaagcaccuggugggguucugcuccuucgagcccaagaagacgaagugcaagcucagcgccauccccuucgagcuguuccgcaucuaccagugggucaacacccuguccuacgacgugaacggcgugcggcagaagaucacccaggaggagcgcaagaagaucaucgaccuccugcugagcaaggagaagccgagcuucaaggagauccggaaggccaucgggaagcucgacggcuccuaccaguucaacuacaaggacgacgacaagaucgucggcagccacaccaucuccaaccugagcaacaagaaguucuucgggaacaagugguucgacuucuccgagaaggagcaggagaacaucuggcacauccugagcuucuucgacgaccgcgagaagcucaaggaguacgcgaucaagaacugguccuucgacgaggagcgggccgugaagaucagcaaguucaaccugaaggacggcuacuccaaccugagccgcaaggccauccucaacauccugcccuuccugcagaagggguucauguacgacguggccgucggccucgccggggugaagaacacgcuguccgugaacugggaggagcacgagcaguucguccuggacaacgugcccgagaucgugcggagcaaccucaagggcggcuacaucgagccccugaagaacaugcugaagaacgaguucaacugcaacgacaagcagcucgagaagcuguaccaccacuccagcgcgaucgagaccgagaacauccuggaccgccugccggucaaccuccacgccgaccgggagauccagaagaucaagaaccccguggugaucaccgcccuguucgagauccgcaagcuggucaacgaggugaucgacaccuacgggaagcccaacgagaucaagguggagcucgcccgggaccugaaggccuccaagagcaaccgccuggaggcgcggaagcgccagaaggaccucgagaagcagaacgaccgggucaagcuggagcuggagaaccucaaccagcgcuccaaccacaucaacauccugaaguacaagcugugggaggagugcaaccacacgugccccuucaccggccagaucaucaccaucagccagcuguucaccggggaggugcagaucgagcacaucuucccguggucccggagccugaacgacagcuucaacaacaagacgcugugcuucgccgacgagaaccgcgccaagggcaacaagacccccuacgagcucuacuccgagcagggggaccagaagugggaggccaucaagcugcaggcccugagcugcuucaagaccaaggcgaacuaccccaacugcuacaacaaguucaagcacuucgucaagaagaagcacgacgaggacuucaucucccggcagcucaacgacacccgcuacaucagcaaggaggccaagaacuaccuguccaagaucugcagcaacgugcugguggcccccggccagaugacggccacccuccgccaccacuggggccugaacuccauccugaaccucgaggacgacaccaagacccgggacgaccaccgccaccacgccaucgacgcgcuggucauggccugcagcacgcggucccaccuccaggagcucagcaagcgcaaccgguacaacaagaacuacgaccugaaggacuucccggaccccuggcagaacuuccgccaggacgccgagaacgccguggcgcagauccuggugucccacaagaaguccaagagccuccugaccguccggacccacaagaccaucaagaaggggguggagcacaagaacaucggcguggccgcccgcgggcagcugcacaaggagagcgucuacggccuccggaaggcccccaacuccaacaaggccuuccacauccgcaagccccuggagagccugacgaccgagaagcagcucgagaagaucguggacgacuccauccggcugcugauccucaagcgcaucaacaucaucggcggguucaucaagggcaagaucccgaaggagaccuucuucguggucgacgagaacgggaucaagcagccccagaucuuccugcccaaccggaacggcaaccccgugccgaucaagaaggugcgcauccgggagaacaucgggggcgcggagaagcugaaggagaacaccaaccaguacgucaacccccgcagcaaccaccacgugaucguguacgaggacagcaacggcgggcucaaggacgacgucgugaccuucuggacggccguggagcggaagcgccagggccaggacgucuucaagcugcccaacgacggggagaagaucguguccacccugcagaucaacgacauguuccuccugggccugaacgacgacgacaucaucacccucaccagcaaggagcugaagaagcaccuguucaaggugcagacgcucuccagcuccuucuacgaguuccggcugagcaccgacuccacccagaacaagaacaccaacagcacggucuuccgccggauccaguccuucgggaugggcaagaccggcuggaaggccuucaacccgaucaaggugaagcugaacagcaucggggaggugaagaucaucuga

SEQ ID NO: 1660 - RNA, 3393 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgggaucgugacggacuuccggaaccugaaccugaaccccuacgagcuccgcgucaagggccugaccgagcagcugaccaacgaggagcuguucgcggcccuccggaccaucagcaagcgccgggggaucuccuaccuggacgacgccgaggacgacagcacgggcuccaccgacuacgccaagagcaucgacgagaaccgccggcuccugaagaccaagaccccggggcagauccagcuggagcgccucgagaaguacggccagcugcggggcaacuucacgguguacgacgagaacggggaggcgcaccgccugaucaacguguucuccaccagcgacuacgagaaggaggcccggaagauccucgagacccaggccgacuacaacaagaagaucaccgccgaguucaucgacgacuacgucgagauccugacgcagaagcgcaaguacuaccacggccccgggaacgagaagucccgcaccgacuacggccgguuccgcaccgacggcaccacgcuggagaacaucuucgggauccucaucggcaagugcagcuucuaccccgacgaguaccgggccuccaaggcgagcuacaccgcccaggaguacaacuuccugaacgaccugaacaaccucaaggugcccaccgagaccgggaagcuguccacggagcagaaggaggcccugguggaguucgccaagagcaccgccacccucggcccggcgaagcugcugaaggagaucgccaagauccucgacugcaaggucgacgagaucaagggguaccgcgaggacgacaagggcaagcccgaccugcacaccuucgagcccuaccggaagcugaaguucaaccucgacuccgugaacaucgacgaccugagccgcgaggugcuggacaagcucgccgacauccugacgcugaacaccgagcgggagggcaucgaggacgccaucaagcgcaaccuccccaaccaguucaccgaggagcagaucuccgagaucaucaacguccgcaagagccagagcaccgccuucaacaagggguggcacuccuucagcgcgaagcugaugaacgagcugaucccggagcucuacgccacguccgacgagcagaugaccauccugacccggcuggagaaguucaaggugaagaagaaguccagcaagaacaucaagaccaucgacgagaaggagaucacggacgagaucuacaaccccguggucgccaagagcgugcggcagaccaucaagaucaucaacgccgccgugaagaaguacggcgacuucgacaagaucgucaucgagaugccccgcgacaagaacgcggacgacgagaagaaguucaucgacaagcggaacaaggagaacaagaaggagaaggacgacgcccucaagcgcgccgccuaccuguacaacgggaccgacaagcugcccgacgagguguuccacggcaacaagcagcucgagaccaagauccggcugugguaccagcagggggagcgcugccuguacuccggcaagccgauccccauccaggagcuggugcacaacagcaacaacuucgagaucgaccacauccucccccugucccugagcuucgacgacucccucgcgaacaagguccugguguacagcuggacgaaccaggagaagggccagcggacccccuaccaggucaucgacuccauggacgccgccuggagcuuccgcgagaugaaggacuacgugcugaagcagaaggggcucggcaagaagaagcgggacuaccugcugaccaccgagaacaucgacaagaucgaggugaagaagaaguucaucgagcgcaaccucgucgacacccgcuacgccucccggguggugcugaacagccugcaguccgcccuccgcgagcuggggaaggacacgaaggucagcguggugcggggccaguucaccucccagcugcgccggaaguggaagaucgacaagagccgcgagaccuaccaccaccacgcggucgacgcccucaucaucgccgccagcucccagcugaagcugugggagaagcaggacaacccgauguucguggacuacgggaacaaccagguggucgacaagcagaccggcgagauccucagcguguccgacaacgaguacaaggagcugguguuccagccgcccuaccagggcuucgucaacacgaucagcuccaagggguucgaggacgagauccuguucagcuaccagguggacuccaaguacaaccggaaggugagcgacgccaccaucuacuccacccgcaaggcgaagaucggcaaggacaagaaggaggagaccuacguccucgggaagaucaaggacaucuacagccagaacggcuucgacacguucgugaagaaguacaacaaggacaagacccaguuccugauguaccagaaggacccccugaccugggagaacgugaucgaggucauccucggcgacuaccccaccacgaagaaguccgaggacgggaagaacgacgugaagugcaaccccuucgaggaguaccggcgcgagaacggccugaucugcaaguacagcaagaaggggaagggcacccccaucaagucccugaaguacuacgacaagaagcucgggaacugcaucgacaucacccccgaggagagccggaacaaggugauccugcaguccaucaacccguggcgcgccgacgucuacuucaaccccgagacccugaaguacgagcucaugggccugaaguacagcgaccuguccuucgagaagggcacggggaacuaccacaucagccaggagaaguacgacgccaucaaggagaaggagggcaucgggaagaaguccgaguucaaguucacccucuaccggaacgaccugauccugaucaaggacaucgccagcggcgagcaggagaucuaccgcuuccucagccggaccaugcccaacgugaaccacuacguggagcugaagcccuacgacaaggagaaguucgacaacguccaggagcugguggaggcccucggggaggcggacaaggugggccgcugcaucaagggccugaacaagccgaacaucuccaucuacaagguccggaccgacgugcuggggaacaaguacuucgugaagaaggagggcgacaagcccaagcucgacuucaagaacaacaagaaguga

SEQ ID NO: 1661 - RNA, 3393 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgagaucgugacggacuuccggaaccugaaccugaaccccuacgagcuccgcgucaaggggcugaccgagcagcugaccaacgaggagcuguucgcggcccuccggaccaucagcaagcgccggggcaucuccuaccuggacgacgccgaggacgacagcacgggguccaccgacuacgccaagagcaucgacgagaaccgccggcuccugaagaccaagaccccgggccagauccagcuggagcgccucgagaaguacgggcagcugcggggcaacuucacgguguacgacgagaacggcgaggcgcaccgccugaucaacguguucuccaccagcgacuacgagaaggaggcccggaagauccucgagacccaggccgacuacaacaagaagaucaccgccgaguucaucgacgacuacgucgagauccugacgcagaagcgcaaguacuaccacgggcccggcaacgagaagucccgcaccgacuacgggcgguuccgcaccgacggcaccacgcuggagaacaucuucggcauccucaucgggaagugcagcuucuaccccgacgaguaccgggccuccaaggcgagcuacaccgcccaggaguacaacuuccugaacgaccugaacaaccucaaggugcccaccgagaccggcaagcuguccacggagcagaaggaggcccugguggaguucgccaagagcaccgccacccucgggccggcgaagcugcugaaggagaucgccaagauccucgacugcaaggucgacgagaucaagggcuaccgcgaggacgacaaggggaagcccgaccugcacaccuucgagcccuaccggaagcugaaguucaaccucgacuccgugaacaucgacgaccugagccgcgaggugcuggacaagcucgccgacauccugacgcugaacaccgagcgggagggcaucgaggacgccauccgccacaaccuccccaaccaguucaccgagggccagaucuccgagaucaucaagguccgcaagagccagagcaccgccuucaacaagggguggcacuccuucagcgcgaagcugaugaacgagcugaucccggagcucuacgccacguccgacgagcagaugaccauccugacccggcuggagaaguucaaggugaacaagaaguccagcaagaacaccaagacgaucgacgagaaggaggugaccgacgagaucuacaaccccgucguggccaagagcgugcggcagaccaucaagaucaucaacgccgccgucaagaaguacggcgacuucgacaagaucgugaucgagaugccccgcgacaagaacgcggacgacgagaagaaguucaucgacaagcggaacaaggagaacaagaaggagaaggacgacgcccucaagcgcgccgccuaccuguacaacgggaccgacaagcugcccgacgagguguuccacggcaacaagcagcucgagacgaagauccggcugugguaccagcagggggagcgcugccuguacuccggcaagccgauccccauccaggagcugguccacaacagcaacaacuucgagaucgaccacauccucccccugucccugagcuucgacgacucccucgcgaacaaggugcuggucuacgccuggaccaaccaggagaagggccagaagacccccuaccaggugaucgacagcauggacgccgccugguccuuccgggagaugaaggacuacgugcugaagcagaaggggcucggcaagaagaagcgcgacuaccugcugaccaccgagaacaucgacaagaucgaggucaagaagaaguucaucgagcggaaccucguggacacgcgcuacgccagccgcgugguccugaacucccugcagagcgcgcuccgggagcuggggaaggacaccaagaucuccgugauccgcggccaguucaccagccagcugcggcgcaaguggaagaucgacaagucccgggagaccuaccaccaccacgccguggacgcccucaucaucgccgccagcagccagcugaagcugugggagaagcaggacaacccgauguucgucgacuacgggaacaaccaggugguggacaagcagacgggcgagauccucuccgucagcgacgacgaguacaaggagcugguguuccagccgcccuaccagggcuucgugaacaugaucuccagcaagggguucgaggacgagauccuguucuccuaccaggucgacagcaaguacaaccgcaagguguccgacgcgaccaucuacagcacccggaaggccaagaucggcaaggacaagaaggaggagaccuacgugcucgggaagaucaaggacaucuacucccagaacggcuucgacacguucaucaagaaguacaacaaggacaagacccaguuccugauguaccagaaggacccccugaccugggagaacgucaucgaggugauccuccgcgacuaccccaccacgaagaaguccgaggacggcaagaacgacgugaagugcaaccccuucgaggaguaccggcgcgagaacgggcuggucugcaaguacagcaagaagggcaaggggacccccaucaagagccugaaguacuacgacaagaagcucggcaacugcaucgacaucacccccgagggguccaagaacgagguggugcugcagagccugaacccguggcgggccgacgucuacuucaaccccgagacccucaaguacgagcugcugggccucaaguacuccgaccugagcuucgagaagggcacggggaaguaccacaucucccaggagaaguacgacgugaucaaggagaaggagggcaucgggaagaaguccgaguucaaguucacccuguaccgcaacgaccucauccugaucaaggacaccgccagcggcgagcaggagaucuaccgguuccugagccgcaccaugcccaacgugaagcacuacgccgagcucaagcccuacgacaaggagaaguucgacaacguccaggagcugguggaggcgcugggggaggccgacaaggugggccggugcaucaagggccucaacaagagcaaccuguccaucuacaagguccgcacggacgugcuggggaacaaguacuucgugaagaaggagggcgacaagccgaagcucgacuucaagaacaacaagaaguga

SEQ ID NO: 1662 - RNA, 3393 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgggaucgugacggacuuccggaaccugaaccugaaccccuacgagcuccgcgucaagggccugaccgagcagcugaccaacgaggagcuguucgcggcccuccggaccaucagcaagcgccgggggaucuccuaccuggacgacgccgaggacgacagcacgggcuccaccgacuacgccaagagcaucgacgagaaccgccggcuccugaagaccaagaccccggggcagauccagcuggagcgccucgagaaguacggccagcugcggggcaacuucacgguguacgacgagaacggggaggcgcaccgccugaucaacguguucuccaccagcgacuacgagaaggaggcccggaagauccucgagacccaggccgacuacaacaagaagaucaccgccgaguucaucgacgacuacgucgagauccugacgcagaagcgcaaguacuaccacggccccgggaacgagaagucccgcaccgacuacggccgguuccgcaccgacggcaccacgcuggagaacaucuucgggauccucaucggcaagugcaacuucuaccccgacgaguaccgggccagcaaggcguccuacaccgcccaggaguacaacuuccugaacgaccugaacaaccucaaggugcccaccgagaccgggaagcugagcacggagcagaaggagucccugguggaguucgccaagaacaccgccauccucggcccggccaagcugcugaaggagaucgcgaagauccucgacugcaaggucgacgagaucaagggguaccgcgaggacgacaagggcaagcccgaccugcacaccuucgagcccuaccggaagcugaaguucaaccucgacagcgugaacaucgacuaccugucccgcgaggugcuggacaagcucgccgacauccugacccugaacacggagcgggagggcaucgaggacgccaucaagcgcaaccuccccaaccaguucaccgaggagcagaucagcgagaucaucaacguccggaagucccagagcaccgccuucaacaagggguggcacagcuucuccgccaagcugaugaacgagcugaucccggagcucuacgcgaccagcgacgagcagaugacgauccugacccgccuggagaaguucaaggugaagaagaaguccagcaagaacaucaagaccaucgacgagaaggagaucaccgacgagaucuacaaccccguggucgccaaguccgugcggcagacgaucaagaucaucaacgccgccgugaagaaguacggcgacuucgacaagaucgucaucgagaugccccgcgacaagaacgccgacgacgagaagaaguucaucaacaagcggaacaaggagaacaagaaggagaaggacgacgcgcucaagcgcgccgccuaccuguacaacgggaccgacaagcugcccgacgagguguuccacggcaacaagcagcucgagaccaagauccggcugugguaccagcagggggagcgcugccuguacagcggcaagccgauccccauccaggagcuggugcacaacuccaacaacuucgagaucgaccacauccucccccugagccuguccuucgacgacagccucgccaacaagguccugguguacuccuggaccaaccaggagaagggccagaagacgcccuaccaggucaucgacagcauggacgcggccugguccuuccgggagaugaaggaguacgugcugaagcagaaggggcucggcaagaagaagcgcgacuaccugcugaccaccgagaacaucgacaagaucgaggugaagaagaaguucaucgagcggaaccucgucgacacccgcuacgccagccgcguggugcugaacucccugcagagcgcccuccgggagcuggggaaggacaccaaggucuccguggugcgcggccaguucacgagccagcugcggcgcaaguggaagaucgacaagucccgggagaccuaccaccaccacgccgucgacgcgcucaucaucgccgccagcagccagcugaagcugugggagaagcaggacaacccgauguucguggacuacgggaacaaccagguggucgacaagcagaccggcgagauccucuccgugagcgacaacgaguacaaggagcugguguuccagccgcccuaccagggcuucgucaacaccaucuccagcaagggguucgaggacgagauccuguucuccuaccagguggacagcaaguacaaccgcaagguguccgacgccacgaucuacagcacccggaaggccaagaucggcaaggacaagaaggaggagaccuacguccucgggaagaucaaggacaucuacucccagaacggcuucgacaccuucgugaagaaguacaacaaggacaagacgcaguuccugauguaccagaaggacccccugaccugggagaacgugaucgaggucauccucggcgacuaccccaccaccaagaaguccgaggacgggaagaacgacgugaagugcaaccccuucgaggaguaccgccgggagaacggccugaucugcaaguacagcaagaaggggaagggcacgcccaucaagagccugaaguacuacgacaagaagcucgggaacugcaucgacaucacccccgaggagucccgcaacaaggugauccugcagagcaucaacccguggcgggcggacgucuacuucaaccccgagacccugaaguacgagcucaugggccugaaguacuccgaccugagcuucgagaagggcaccgggaacuaccacaucucccaggagaaguacgacgccaucaaggagaaggagggcaucgggaagaaguccgaguucaaguucacgcucuaccgcaacgaccugauccugaucaaggacaucgccagcggcgagcaggagaucuaccgguuccucagccgcaccaugcccaacgugaaccacuacguggagcugaagcccuacgacaaggagaaguucgacaacguccaggagcugguggaggcccucggggaggccgacaaggugggccggugcaucaagagccugaacaagccgaacaucuccaucuacaagguccgcaccgacgugcugggcaacaaguacuucgugaagaaggagggggacaagcccaagcucgacuucaagaacaacaagaaguga

SEQ ID NO: 1663 - RNA, 3393 nt, Artificial Sequence
  Cas9 variant
augagcaacggcaagauccuggggcucgacaucggcguggccuccgucggggugggcaucaucgacgccaagaccgggaaggugauccacgcgagcucccgccuguucagcgccgccaacgccgagaacaacgccgagcggcgcggcuuccggggcgcgcgccggcugacccgccggaagaagcaccgcaucaagcggguccgcgaccucuucgagaaguacgagaucgugacggacuucuccaaccugaaccugaaccccuacgagcuccgggugaaggggcugaccgagcagcugaccaacgaggagcuguucgccgcccuccgcaccaucgccaagcggcgcggcaucagcuaccuggacgacgcggaggacgacuccacggggagcuccgacuacgccaagagcaucgaggagaaccggcgccuccugaagaacaugaccccgggccagauccagcuggagcggcucgagaaguacgggcagcugcgcggcaacuucaccgucuacgacgagaacggcgaggcccaccggcugaucaacguguucuccaccagcgacuacaagaacgaggcccgcaagauccucgagacgcaguccaacuacaacaagcagaucaccgacgaguucaucgaggacuacaucgagauccugacccagaagcggaaguacuaccacgggcccggcaacgagaagucccgcaccgacuacgggcgcuaccggacggacggcaccacccuggagaacaucuucggcauccucaucgggaagugcaccuucuaccccgacgaguaccgcacgagcaaggccagcuacaccgcgcaggaguacaacuuccugaacgaccugaacaaccucaaggugcccaccgagaccggcaagcuguccacggagcagaagcacuaccuggucgacuucgccaagagcuccaaggcccucgggguggccaagcugcugaaggagaucgccaagaucguggagugcagcgucgacgacaucaagggcuaccgggaggacaacaaggggaagccggaccuccacaccuucgagcccuaccgcaagcugaaguucaaccugagccucaucgacaucgacgagcugucccgggagacccuggacaagcucgcggacauccugacccugaacacggagcgcgagggcaucgaggacgccaucaagcggaaccuccccaaccaguucaccgaggagcagaucguggagcuggugaacguccgcaagaaccagagcuccgccuucaacaagggcuggcacagcuucuccgugaagcugaugaacgagcucauccccgagcuguacgccagcuccgaggagcagaugaccauccugacccggcucgagaaguucaaggugaacaagaaguccagcgagaacacgaagaccaucaacgagaaggagaucaccgacgagaucuacaacccggucguggccaagagcgugucccagaccgucaagaucaucaacgcggccgugaagaaguacggggacuucgacaagaucgugaucgagaugccccgcgacaagaacgccgacgacgagaagaaguucaucgacaagaagcagaaggagaacgccaaggaggucgaggacgcccugaagcgggcggccuaccuguacaacggcacggacaagcuccccgacgggguguuccacggcaacaagcagcugaagaccaagauccgccugugguaccagcagggggagcggugccuguacagcggcaagcccaucuccauccaggaccucguccacaacagcaacaacuucgagaucgaccacauccugccgcugucccucagcuucgacgacucccuggccaacaaggugcugguguacgccuggaccaaccaggagaagggccagaagacccccuaccaggucaucgacagcauggacgcggccugguccuuccgcgagaugaaggacuacgugcucaaccagaaggggaucggcaagaagaagcgggaguaccugcugacgaccgagaacaucgacaagaucgaggugaagaagaaguucaucgagcgcaaccucgucgacacccgguacgccagccgcguggugcugaacagcauccaggccgcccugaaggagcucgacaaggacaccaaggucuccgugauccgggggcaguucaccagccagcugcgccgcaaguggaagaucgacaagucccgggagacguaccaccaccacgcgguggacgcccugaucaucgccgccagcucccagcucaagcuguggcagaagcaggagaaccccauguucgucgacuacggcgagaaccagguggugaacaaggagaccggggagauccugagcgucuccgacgacgacuacaaggagcucguguuccagcccccguaccagggcuucgugaacaccaucagcuccaaggccuucgaggacgagauccuguucagcuaccaggucgacuccaaguacaaccgcaaggugagcgacgcgaccaucuacuccacgcggaaggccaagcugggcaaggacaagaaggaggagaccuacgugcucgggaagaucaaggacaucuacagccaggacggcuucgacgccuucaucaagcgcuacaagaaggacaagacccaguuccugauguaccagaaggaccccgucaccugggagaacgugaucgaggugauccugcgggacuaccccuccgagaagcucagcgaggacgggaagaagaacgucaagugcaaccccuucgaggaguaccgccgggagaacggccugaucugcaaguacuccaagaagggcaaggggacgccgaucaagagccugaaguacuacgacaagaagcucggcaacugcaucgacaucacccccaaggggagcaagaacgagguggugcugcagucccugaaccccuggcgcgccgaccucuacuucaaccccgacacccugaaguacgagcugaugggccucaaguacagcgaccuguccuucgagaaggggaccggcaaguaccacaucagccaggagcgguacgacgagaucaaggucaaggagggcaucgggaagaacuccgaguucaaguucacgcuguaccgcaacgaccucauccugaucaaggacaccgagagcggcgaggaggagcuguaccgguuccucucccgcaccaugccgaacgugaagcacuacguggagcugaagcccuacgacaaggagcgguacgacgggggccaggagcugaugaaggucuucgggaacguggccaacggcggccagugccucaagagccugaacaaguccaaccugagcaucuacaaggugcgcaccgacguccucgggaacaaguucuucaucaagaaggagggcgacaagcccaagcuggacuucaagaacaacaagaaguga

SEQ ID NO: 1664 - RNA, 3393 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgggaucgugacggacuuccggaaccugaaccugaaccccuacgagcuccgcgucaagggccugaccgagcagcugaagaacgaggagcuguucgcggcccuccggaccaucagcaagcgccgggggaucuccuaccuggacgacgccgaggacgacagcaccggcuccacggacuacgccaagagcaucgacgagaaccgccggcuccugaagaacaagaccccggggcagauccagcuggagcgccucgagaaguacggccagcugcggggcaacuucaccguguacgacgagaacggggaggcgcaccgccugaucaacguguucuccaccagcgacuacgagaaggaggcccggaagauccucgagacgcaggccgacuacaacaagaagaucaccgccgaguucaucgacgacuacgucgagauccugacccagaagcgcaaguacuaccacggccccgggaacgagaagucccgcaccgacuacggccgguuccgcacggacggcaccacccuggagaacaucuucgggauccucaucggcaagugcaacuucuaccccgacgaguaccgggccagcaaggcguccuacaccgcccaggaguacaacuuccugaacgaccugaacaaccucaaggugagcacggagaccgggaagcuguccaccgagcagaaggagagccugguggaguucgccaagaacaccgccacgcucggccccgccaagcugcugaaggagaucgcgaagauccucgacugcaaggucgacgagaucaagggguaccgcgaggacgacaagggcaagccggaccugcacaccuucgagcccuaccggaagcugaaguucaaccucgaguccaucaacaucgacgaccugagccgcgaggugaucgacaagcuggccgacauccucacccugaacaccgagcgggagggcaucgaggacgccaucaagcgcaaccugcccaaccaguucacggaggagcagaucuccgagaucaucaaggugcgcaagagccagagcaccgccuucaacaagggguggcacuccuucagcgccaagcucaugaacgagcugauccccgagcuguacgcgaccuccgacgagcagaugaccauccucacgcggcuggagaaguucaaggucaacaagaaguccagcaagaacaccaagaccaucgacgagaaggaggugaccgacgagaucuacaacccgguggucgccaagagcgugcggcagacgaucaagaucaucaacgccgccgugaagaaguacggcgacuucgacaagaucgucaucgagaugccccgcgacaagaacgccgacgacgagaagaaguucaucgacaagcggaacaaggagaacaagaaggagaaggacgacgcgcugaagcgcgccgccuaccucuacaacuccagcgacaagcugcccgacgagguguuccacgggaacaagcagcuggagaccaagauccggcucugguaccagcagggcgagcgcugccuguacuccgggaagcccaucagcauccaggagcuggugcacaacuccaacaacuucgagaucgaccacauccugccgcucagccuguccuucgacgacagccuggccaacaagguccucguguacgcguggaccaaccaggagaagggccagaagacccccuaccaggucaucgacuccauggacgccgccuggagcuuccgggagaugaaggacuacgugcugaagcagaagggccuggggaagaagaagcgcgacuaccuccugacgaccgagaacaucgacaagaucgaggugaagaagaaguucaucgagcggaaccuggucgacacccgcuacgccucccgcguggugcucaacagccugcaguccgcccugcgggagcucggcaaggacaccaaggucagcguggugcgcgggcaguucaccagccagcugcggcgcaaguggaagaucgacaagucccgggagacguaccaccaccacgcggucgacgcccugaucaucgccgccagcucccagcucaagcugugggagaagcaggacaaccccauguucguggacuacggcaagaaccagguggucgacaagcagaccggggagauccugagcguguccgacgacgaguacaaggagcucguguuccagcccccguaccagggcuucgucaacaccaucagcuccaagggcuucgaggacgagauccuguucagcuaccagguggacuccaaguacaaccgcaaggugagcgacgccaccaucuacuccacgcggaaggcgaagaucgggaaggacaagaaggaggagaccuacguccugggcaagaucaaggacaucuacagccagaacggguucgacaccuucaucaagaaguacaacaaggacaagacccaguuccucauguaccagaaggacucccugacgugggagaacgugaucgaggugauccugcgcgacuaccccaccaccaagaaguccgaggacggcaagaacgacgucaagugcaaccccuucgaggaguaccggcgcgagaacggccucaucugcaaguacagcaagaaggggaagggcacccccaucaagagccugaaguacuacgacaagaagcuggggaacugcaucgacaucacgccggaggagucccggaacaaggugauccuccagagcaucaaccccuggcgcgccgacguguacuucaaccccgagacccugaaguacgagcugaugggccucaaguacagcgaccuguccuucgagaaggggaccggcaacuaccacaucagccaggagaaguacgacgccaucaaggagaaggagggcaucgggaagaaguccgaguucaaguucacccuguaccggaacgaccucauccugaucaaggacaucgccagcggcgagcaggagaucuaccgcuuccugucccggacgaugcccaacgucaaccacuacguggagcucaagccguacgacaaggagaaguucgacaacgugcaggagcuggucgaggcccugggggaggcggacaaggugggccgcugcaucaaggggcucaacaagcccaacaucagcaucuacaaggugcggaccgacguccugggcaacaaguacuucgugaagaagaagggcgacaagcccaagcuggacuucaagaacaacaagaaguga

SEQ ID NO: 1665 - RNA, 3393 nt, Artificial Sequence
  Cas9 variant
augaccaacggcaagauccuggggcucgacaucggcaucgccagcgugggggucggcaucaucgaggccaagaccgggaagguggugcacgcgaacucccgccuguucagcgccgccaacgccgagaacaacgccgagcggcgcggcuuccggggcucccgccggcugaaccgccggaagaagcaccgcgucaagcgggugcgcgaccucuucgagaaguacgggaucgugacggacuuccggaaccugaaccugaaccccuacgagcuccgcgucaagggccugaccgagcagcugaccaacgaggagcuguucgcggcccuccggaccaucagcaagcgccgggggaucuccuaccuggacgacgccgaggacgacagcacgggcuccaccgacuacgccaagagcaucgacgagaaccgccggcuccugaagaccaagaccccggggcagauccagcuggagcgccucgagaaguacggccagcugcggggcaacuucacgguguacgacgagaacggggaggcgcaccgccugaucaacguguucuccaccagcgacuacgagaaggaggcccggaagauccucgagacccaggccgacuacaacaagaagaucaccgccgaguucaucgacgacuacgucgagauccugacgcagaagcgcaaguacuaccacggccccgggaacgagaagucccgcaccgacuacggccgguuccgcaccgacggcaccacgcuggagaacaucuucgggauccucaucggcaagugcagcuucuaccccgacgaguaccgggccuccaaggcgagcuacaccgcccaggaguacaacuuccugaacgaccugaacaaccucaaggugcccaccgagaccgggaagcuguccacggagcagaaggaggcccugguggaguucgccaagagcaccgccacccucggcccggcgaagcugcugaaggagaucgccaagauccucgacugcaaggucgacgagaucaagggguaccgcgaggacgacaagggcaagcccgaccugcacaccuucgagcccuaccggaagcugaaguucaaccucgacuccgugaacaucgacuaccugagccgcgaggugcuggacaagcucgccggcauccugacgcugaacaccgagcgggaggggaucgaggacgccaucaagcgcaaccuccccaaccaguucaccgaggagcagaucuccgagaucaucaacguccgcaagagccagagcaccgccuucaacaagggcuggcacuccuucagcgcgaagcugaugaacgagcugaucccggagcucuacgccacguccgacgagcagaugaccauccugacccggcuggagaaguucaaggugaagaagaaguccagcaagaacaucaagaccaucgacgagaaggagaucacggacgagaucuacaaccccguggucgccaagagcgugcggcagaccaucaagaucaucaacgccgccgugaagaaguacggggacuucgacaagaucgucaucgagaugccccgcgacaagaacgcggacgacgagaagaaguucaucaacaagcggaacaaggagaacaagaaggagaaggacgacgcccucaagcgcgccgccuaccuguacaacggcaccgacaagcugcccgacgagguguuccacgggaacaagcagcucgagaccaagauccggcugugguaccagcagggcgagcgcugccuguacuccggcaagccgauccccauccaggagcuggugcacaacagcaacaacuucgagaucgaccacauccucccccugucccugagcuucgacgacucccucgcgaacaagguccugguguacagcuggacgaaccaggagaaggggcagaagacccccuaccaggucaucgacuccauggacgccgccuggagcuuccgggagaugaaggaguacgugcugaagcagaagggccucgggaagaagaagcgcgacuaccugcugaccaccgagaacaucgacaagaucgaggugaagaagaaguucaucgagcggaaccucgucgacacccgcuacgccucccgcguggugcugaacagccugcaguccgcccuccgggagcugggcaaggacacgaaggucagcguggugcgcgggcaguucaccucccagcugcggcgcaaguggaagaucgacaagagccgggagaccuaccaccaccacgcggucgacgcccucaucaucgccgccagcucccagcugaagcugugggagaagcaggacaacccgauguucguggacuacggcaacaaccagguggucgacaagcagaccggcgagauccucagcguguccgacaacgaguacaaggagcugguguuccagccgcccuaccagggguucgucaacacgaucagcuccaagggcuucgaggacgagauccuguucagcuaccagguggacuccaaguacaaccgcaaggugagcgacgccaccaucuacuccacccggaaggcgaagaucgggaaggacaagaaggaggagaccuacguccucggcaagaucaaggacaucuacagccagaacggcuucgacacguucgugaagaaguacaacaaggacaagacccaguuccugauguaccagaaggacccccugaccugggagaacgugaucgaggucauccucggggacuaccccaccacgaagaaguccgaggacggcaagaacgacgugaagugcaaccccuucgaggaguaccgccgggagaacgggcugaucugcaaguacagcaagaagggcaaggggacccccaucaagucccugaaguacuacgacaagaagcucggcaacugcaucgacaucacccccgaggagagccgcaacaaggugauccugcaguccaucaacccguggcgggccgacgucuacuucaaccccgagacccugaaguacgagcucaugggccugaaguacagcgaccuguccuucgagaaggggacgggcaacuaccacaucagccaggagaaguacgacgccaucaaggagaaggaggggaucggcaagaaguccgaguucaaguucacccucuaccgcaacgaccugauccugaucaaggacaucgccagcggggagcaggagaucuaccgguuccucagccgcaccaugcccaacgugaaccacuacguggagcugaagcccuacgacaaggagaaguucgacaacguccaggagcugguggaggcccucggcgaggcggacaaggugggccggugcaucaaggggcugaacaagccgaacaucuccaucuacaagguccgcaccgacgugcugggcaacaaguacuucgugaagaaggagggggacaagcccaagcucgacuucaagaacaacaagaaguga

SEQ ID NO: 1666 - RNA, 3396 nt, Artificial Sequence
  Cas9 variant
auggcccagcacguguucggccuggacaucgggaucgccagcgucggcugggcgauccucggggagcagcgcaucaucgaccugggcgugcggugcuucgacaaggccgagaccgccaaggagggggacccccugaaccucacccgccggcaggcccgccugcugcggcgccggcucuaccgccgggccuggcgccugacgcagcugucccggcuccugaagcgcaagggccugaucgcggacgccaagcuguucgccaaggcccccagcuacggcgacuccgcgugggagcugcggcgccaggggcuggaccggcuccugacgccccuggagugggcccgcgugaucuaccaccagugcaagcaccggggcuuccacuggaccagcaaggccgaggaggccaaggccgacuccgacgcggagggcgggcgcgucaagcaggggcucgcccacaccaaggcccugaugcaggccaagaacuaccggagcgccgcggagauggugcuggccgaguuccccgacgcccagcgcaacaagcggggccaguacgacaaggcccucucccgcgugcugcugggcgaggagcucgcccugcuguucgcgacccagcgccggcucgggaacccccacgccagcgacuucuucgagaagcugauccugggcgacggggaccgcaaguccggccucuucuggcagcagaagccggcccugagcggcgccgaccugcucaagaugcuggggaagugcaccuucgagaagggcgaguaccgggcccccaaggcguccuucagcgucgagcgccacguguggcugacccggcucaacaaccugcgcaucguggucgacgggcggucccgcccccugaacgaggccgagcggcaggccgcccuccugcugcccuaccagaccgagacgagcaaguacaagacccucaagaacgcguucaucaaggccggccuguggggcgacggggugcgcuucggcgggcuggccuacccgucccaggcccagaucgacgccgagaagaccaaggaccccgaggaccaguuccucgugaagcugcccgcguggcacgagcugcggaaggccuucaaggccgccggccacgaggcccucuggcagcagaucagcacccccgcgcuggacggggacccgacgcugcuggaccagaucgccaccguccucuccguguacaaggacggcgccgaggugguccagcagcugcgccagcuggcccuccccgagcccgccgcgagcaucgccgugcuggagaagaucuccuucgacaaguucagcagccugucccucaaggcccugcggcgcaucgugccccugaugcagagcgggcuccgguacgacgaggccgucgcgcagaucccggaguacggccaccacucccagcgcaucgagcccggcgccgccaagcaccuguaccugccgcccuucuacgaggcccagcggaaguacgccgggaagggcgaccacaucgggagcaugcaguuccgcgacgacgcggacaucccccggaaccccguggugcuccgcgcccugaaccaggcccgcaaggucgugaacgcccugauccgggaguacggcucccccaucgccgugaacaucgagauggcgcgcgaccucagccggccccuggacgagcgcaacaaggucaagcgggcccaggaggaguuccgcgaccggaacgaccgcgcccgguccgaguucgagcgcgacuucggguacaagccgaaggccgccgcguucgagaaguggaugcuguaccgggagcagcucggccagugcgccuacagccagcagccccuggacauccagcgcgugcuggacgaccacaacuacgcccaggucgaccacgcccuccccuacucccggagcuacgacgacuccaagaacaacaaggugcuggugcugacccacgagaaccagaacaagggcaaccgcaccgcguucgaguaccucacgagcuuccccgacggggaggacggcgagcgguggcgcaccuucgucgccugggugcaggggaacaaggccuaccggauggccaagcgcaaccggcugcugcgcaagaacuacggcguggacgaguccaagggcuucaucgaccggaaccucaacgacacccgcuacaucugcaaguucuucaagaacuacgucgaggagcaccuccagcuggccgcgcgcgccgacggggacaccgcccggcgcugcgugguggucaacggccagcucacggccuuccugcgggcccgcugggggcugaccaaggugcggggcgacagcgaccgccaccacgcgcucgacgccgccguggucgccgccugcacccacgggauggugaaggcgcuggccgacuacucccggcgcaaggagaucagcuuccugcaggagggcuucccggaccccgagaccggcgagauccucaaccccgccgccuucgaccgggcccgccagcacuucccggagcccuggacgcacuucgcgcacgagcugaaggcccggcuguucaccgacgaccucgccgcccugcgcgaggacaugcagcggcugggguccuacaccaccgaggaccucggccgccugcggacgcuguucgugagccgcgcgccccagcggcgcuccgggggcgccguccacaaggagaccaucuacgcccagcccgagagccucaagcagcagggcggggugaucgagaagauccugcugaccagccucaagcugcaggacuucgacaagcugcucaacccggaguccaacgaccacuucguggagccccaccggaacgagcgccuguacgccgccauccgccagcggcuggagcaguucggcgggcgcgcggacaaggccuucggccccgacaaccucuuccacaagcccgacaagaacaaccagccgaccgggcccgucgugcggagcaucaagcuggugcgcggcaagcagacggggauccccauccggggcggccuggccaagaacgacuccaugcuccgcgucgacaucuucaccaaggccgggaaguuccaccuggugcccguguacguccaccaccgggugaccggccugccgaaccgcgccaucguggcguucaaggacgaggacgaguggacccucaucgacgagagcuucgccuuccuguucuccgucuaccccaacgacuacgugaaggugacgcugaagaaggagcagcagagcggguacuacuccggcgccgaccggagcaccggggccaugaaccucugggcccacgaccgcgcggccuccgucggcaaggacggccugauccgggggaucggcgugaagaccgcccugagcguggagaaguucaacgucgacgugcucgggcgcaucuaccuggccccgcccgagacccgguccggccuggcguga

SEQ ID NO: 1667 - RNA, 3399 nt, Artificial Sequence
  Cas9 variant
auggcccaguacguguucggccuggacaucgggaucgccagcgucggcugggcggugcucgacgcccagcgcaucguggaccuggggguccggugcuucgacaaggccgagaccgccaaggagggcgacccccugaaccucacccgccggcaggcccgccugcugcggcgccggcucuaccgccgggcguggcgccugacgcagcuggcccggcuguucaagcgcgaggggcugaucgacgacgccaagcuguucgccaaggcgccguccuggaccgagaacgccugggagcuccggcugcgcggccuggaccaccuccugacgccccuggagugggcccgggugaucuaccaccucugcaagcaccgcggcuuccacuggaccagcaaggccgaggaggccaaggcggaguccgacgccgagggcgggcgggugaagcaggggcuggcccacaccaaggcccugaugcaggucaagaacuaccgcagcaccgccgagauggugcucgcggaguuccccggcgcccagcggaacaagcgcgggcaguacgacaaggcccugucccgggugcugcucggcgaggagcuggcccuccucuucgccacccagcgccgccugggcaacccccacgcgagcgagcacuucgagcagcugauccucgggcacggcgaccggaaguccgggcuguucuggcagcagaagccggcccugagcggcgccgaccuccugaagaugcugggcaagugcaccuucgagaagacggaguaccgcgcccccaaggccuccuucagcgcggagcggcacgucuggcucacccgccugaacaaccugcggaucgugguggacgggcgcgcccggccccucaacgacgccgagcgccaggccgcgcugcugcuccccuaccagaccgagaccuucaaguacaagacgcugaaggccgccuucgucaaggugggccuguggggcgacggggugcgguucgggggccucgccuacccgucccaggcccaggcggaggccgagaaggccaaggaccccgaggaccaguuccuggucaagcugcccgccuggcacgagcuccgcaaggccuucaaggcggccggccacgaggcccuguggcagcagaucagcaugcccgcccuggaggaggacccgacccugcucgaccagaucgccaccgugcuguccguguacaaggacgggaccgaggucgugcagcagcugcggcagcucgcgcugcccgagcccgacgccagcaucgccgugcuggagaagauccgcuucgacaaguucuccagccucucccugaaggcccugcggcgcaucgucccccucaugcagggcgggcugcgguacgacgaggcgguggcccagaucccggaguacggccaccacagccagcgcaucgaccccggggccacgcggcaccuguaccucccgcccuucuacgaggcccagcgcaaguacgccggcaagggcgaccggaucggguccaugcaguuccgcgaggacgcggacgugccccgcaaccccgucgugcugcgggcccugaaccaggcccgcaaggucgugaacgcccucauccgggaguacggcagccccguggccgucaacaucgagauggcgcgcgaccugagccggccccuggacgagcgcaacaaggugaagcgggcccaggaggaguuccgcgaccggaacgacaaggcccgcuccgaguucgagcgggacuucggguacaagccgaagggcgccguguucgagaaguggaugcucuaccgcgagcagcuggggcagugcgccuacagccagcagccccuggacauccagcggguccucgacgaccccaacuacgcccagguggaccacgcccugcccuacucccgcagcuacgacgacuccaagaacaacaaggugcugguccucacccgggagaaccagaacaagggcaaccgcaccccguucgaguaccugaccagcuuccccggcggggaggacggcgagcgguggcgcgccuucguggccugggugcaggggaacaaggcguaccggauggccaagcgcaaccggcugcuccgcaagaacuacggcacggacgagucccgcggcuucaucgaccggaaccugaacgacacccgcuacaucugcaaguucuucaagaacuacgucgaggagcaccuccagcuggccgcccggaccgacggggacaccgcccgccggugcgugguggucaacggccagcugacggcguuccugcgcgcccggugggggcucgccaaggugcgcggcgacagcgaccggcaccacgcccuggacgccgcgguggucgccgccugcacccacgggauggugaaggcccuggccgacuacucccgccggaaggagaucgcguuccuccaggagggcuuccccgacccggagaccggcgagauccugaaccuggccgccuucgaccgcgcccgggagcacuuccccgagcccuggccccacuucgcccacgagcucaaggcgcgccuguucaucgacgaccugguggcccuccgggaggacaugcagcaccuggggagcuacgcccaggacgaccuggaccgccuccggacccuguucgucucccgcgccccgcagcggcgcaacggcggggcggugcacaagggcacgaucuacgcccagcccgagaaccugaagcagcaggggagcaccaucgagaagauccuccugaccggccugaagcuccaggacuucgacaagcugcugaaccccgaguccagcgaccacuucguggagccccaccgcaacgagcggcucuacgccgccauccgccggcgccuggaggaguucggcgggaaggccgacaaggcguucggcccggacaagcccuucuacaagcccgacaagaacgggcagcccaccggcccgaucguccgguccaucaagcuggugcgcgggaagcagacgggcauccccauccggggcgggcucgccaagaacgacagcaugcugcgcguggacgucuucaccaaggccggcaaguuccaccuggugcccguguacguccaccaccgggugaccgggcuccccgaccgcgccaucguggccuucaaggacgaggaggaguggacccugaucgacgaguccuacgcguuccuguucagcgucuacccgaacgacuucgugugcgugcagcagcggggcaagccccucaucgagggguacuacgccggccuggaccgcgccaacggcaacaucaacgucugggcccacgaccgggccgcguccguggggaaggacggccugauccgcgggaucggcgugaagacggcccucagccuggagaagcugaacgucgacgugcucggccggaucuaccccgcgcccccggagacccgccgggggcuggccuga

SEQ ID NO: 1668 - RNA, 3399 nt, Artificial Sequence
  Cas9 variant
augaagaagauccugggcguggaccucgggaucaccagcuucggcuacgccauccugcaggagaccgggaaggaccuguaccgcugccucgacaacuccgucgugaugcggaacaaccccuacgacgagaaguccggcgaguccagccaguccauccgcagcacgcagaaguccaugcggcgccugaucgagaagcggaagaagcgcauccggugcguggcccagaccauggagcgcuacgggauccuggacuacagcgagaccaugaagaucaacgacccgaagaacaaccccaucaagaaccgguggcagcuccgcgcggucgacgccuggaagcggccccugagcccccaggagcuguucgccaucuucgcccacauggccaagcaccgcggcuacaagagcaucgcgaccgaggaccucaucuacgagcuggagcuggagcucggccugaacgacccggagaaggaguccgagaagaaggccgacgagcggcgccagguguacaacgcccugcggcaccucgaggagcugcgcaagaaguacgggggcgagacgaucgcccagaccauccaccgggcgguggaggccggggaccugcgcagcuaccggaaccacgacgacuacgagaagaugauccgccgggaggacaucgaggaggagaucgagaagguccuccugcgccaggccgagcugggcgcccucgggcugcccgaggagcaggucuccgagcugaucgacgagcucaaggccugcaucaccgaccaggagaugcccaccaucgacgagagccuguucggcaagugcacguucuacaaggacgagcuggcggcccccgccuacuccuaccucuacgaccuguaccgccuguacaagaagcucgccgaccugaacaucgacggcuacgaggugacccaggaggaccgggagaaggugaucgaguggguggagaagaagaucgcccaggggaagaaccugaagaagaucacccacaaggaccuccgcaagauccugggccuggcgccggagcagaagaucuucgggguggaggacgagcggaucgucaagggcaagaaggagccccgcaccuucgugcccuucuucuuccucgccgacaucgccaaguucaaggagcuguucgccagcauccagaagcaccccgacgcccugcagaucuuccgggagcucgcggagauccugcagcgcuccaagacgccgcaggaggcccuggaccggcuccgcgcccugauggccggcaaggggaucgacaccgacgaccgggagcugcucgagcuguucaagaacaagcgcagcggcacccgggagcugucccaccgcuacauccucgaggcccugccccuguuccuggagggguacgacgagaaggaggugcagcggauccucggcuucgacgaccgcgaggacuacagccgguaccccaagagccugcgccaccuccaccuccgggaggggaaccuguucgagaaggaggagaaccccaucaacaaccacgcggucaagucccuggccagcugggcccugggccugaucgccgaccuguccuggcgcuacggcccguucgacgagaucauccucgagaccacgcgggacgcgcugcccgagaagauccgcaaggagaucgacaaggccaugcgcgagcgggagaaggcccuggacaagaucaucgggaaguacaagaaggaguuccccagcaucgacaagcgccucgcccggaagauccagcugugggagcgccagaagggccuggaccucuacuccgggaaggugaucaaccugagccagcugcucgacggcuccgccgacaucgagcacaucgugccccagagccugggcgggcuguccaccgacuacaacaccaucgucacccucaagagcgugaacgcggccaagggcaaccggcugccgggggacuggcuggccggcaaccccgacuaccgcgagcggaucgggaugcucuccgagaagggccugaucgacuggaagaagcgcaagaaccugcucgcccagagccuggacgagaucuacacggagaacacccacuccaaggggauccgggccaccagcuaccuggaggcgcucguggcccagguccugaagcgcuacuaccccuuccccgacccggagcugcggaagaacggcaucggcgugcgcaugauccccgggaaggugaccuccaagacgcggagccuccugggcaucaaguccaagagccgcgagaccaacuuccaccacgccgaggacgcccugauccucuccacccugacccggggguggcagaaccgccugcaccggaugcuccgcgacaacuacggcaagagcgaggccgagcugaaggagcuguggaagaaguacaugccccacaucgagggccucacgcuggcggacuacaucgacgaggccuuccggcgcuucaugagcaagggggaggagucccuguucuaccgggacauguucgacaccauccgcagcaucuccuacugggucgacaagaagccccucagcgccuccagccacaaggagaccguguacuccagccgccacgaggucccgacccugcggaagaacauccuggaggccuucgacucccucaacgugaucaaggaccgccacaagcugacgaccgaggaguucaugaagcgguacgacaaggagauccgccagaagcuguggcuccaccggaucggcaacaccaacgacgagagcuaccgcgcgguggaggagcgggccacccagaucgcccagauccugacgcgcuaccagcugauggacgcccagaacgacaaggagaucgacgagaaguuccagcaggcccucaaggagcugaucaccucccccaucgaggucaccgggaagcugcuccggaagaugcgcuucguguacgacaagcugaacgcgaugcagaucgaccggggccugguggagaccgacaagaacaugcucgggauccacaucagcaagggccccaacgagaagcugaucuuccgccggauggacgucaacaacgcccacgagcugcagaaggagcgcuccggcauccucugcuaccugaacgagaugcuguucaucuucaacaagaaggggcucauccacuacggcugccugcggagcuaccuggagaaggggcagggcuccaaguacaucgcccucuucaacccgcgcuuccccgccaaccccaaggcccagcccagcaaguucaccuccgacagcaagaucaagcaggucgggaucggcagcgcgacgggcaucaucaaggcccaccuggaccuggacgggcacgugcgguccuacgagguguucggcacccucccggaggggagcaucgagugguucaaggaggaguccggcuacgggcgcguggaggacgacccccaccacuga

SEQ ID NO: 1669 - RNA, 3402 nt, Artificial Sequence
  Cas9 variant
auggaccugaacuaccgcaucggccucgacaucgggaucgccagcgugggcugggccguccuggagaacaacuccaaggacgagcccgugcggaucguggaccuggggguccgccucuucgaggcggccgaggugccgaagaccggcgccgcccuggccgagccccggcgcgaggcgcggaccacgcgccggcgccugcggcgccggaagcaccgccucgagcggaugaaguggcugcugcaggaguacgggcucauccagaccgaggaguucaugaagcgcuaccacagcgccggccugcccgacguguaccggcugcgcuacgagggccucgagcggaagcugaaggacgaggagcuggcccagauccucauccacaucgggaagcaccgcggcuuccgguccacccgcaaggccgagcugaaggacaagaacgacaaggagaccggggcgguccugagcgccacgcgggagaacgagaagcucauggaggagcacggcuaccgcaccgccggggagaugaucuacaaggacgacaaguuccgcaccggcugcaccuggaaggaggagggcuaccggcugacgccccgcaacaaggagggggacuacaagaacaccaugcugcgggcccuccuggaggacgaggugaaggugaucuucgacugccagcgcaaguucggcaaccagaaggccuccgaggagcuggagaaggcguaccucgccaucaugaccagccagcgguccuucgacauggggccgggcaagcagcccgacggcagcgccucccccuacgccauggagggguucggcgaccgcgucgggcugugcgcccuggagccccgggagaagcaggagccgcgcgcgcccaaggccgccuacaccagcgagcuguucguggcccugcagaagaucaaccaccuccggaucacggagaagaacggcaaggggcgcggccucaccuccgaggagcgggagcgccugagcgaccugcuccacaagaagaaggagcugaccuacggcgccgugcggaaggagcugcagcucgaccugcgcuaccgguucaacacccugaacuacuccagcaagaagaugacggaggaggagaagaucaaggacgcggagaaggccaaguucgucuccauggugagccacuacgaguaccgcaagcggauguccgggaugcucgagcagcugagccccgaggagcaggccgaccugauggacgaggugggcaagauccucacccuguacaagaacgacgacacccgcucccgggaguuccagaagcuggggcucgacagcgagaucaccgaggagcugcuggagcucaacccccgcggcuuccagcacgucagccugaaggccaugaagaagcugaugccguaccugaaggaggggcucacguacgacaaggccugcgcggaggccggcuacgacuuccagggcuccgugcagaaggagcgcagccggcugcugaaggggaaggagaucaccgacaucaucaacgacaucaacaaccccguggucaagcgcuccgugagccagaccgugaaggucaucaacgccaucauccagaaguacggcagcccccaggccgugaacaucgagcucgcgcgggagaugucccgcaacuacgacgagcggcgcaagauggagaagcagaugaaggaccggcaguccgagaacgagcgcgccaagaaggagauccaggagcuggggaacgccuuccccaccggccaggacauccugaaguaccggcucuggcacgaccaggacgggaucugcauguacagcgccaagcgcaucccgcuggccgagcuguucacgggcgcguacgacaucgaccacauccuccccuacuccaucaccuucgacgacagcuaccggaacaaggugcuggucaccuccgaggagaaccgccagaagggcaaccggauccccuacgaguacuucgggagcgacuccgagcgcuggagcaaguucgagacccuggugaacucccggauccgcgacuaccggaagcagcagaaccuccugaagcagagcuucacggaggaggagcgcaaggaguucaagcagcggaaccugaacgacaccaaguacaucacccgcgucaucuacaacaugauccgggagaaccucgcccuggcccccuacaacuccccgggcaagaagaagcaggucuucgccgugaacgggggcgugaccgccuaccugcgcaagcgcuggggcaugagcgcgaaggaccgguccaucgacacgcaccacgcccgcgacgccguggugaucgccugcugcaccgacgggaugauccagaagaucagccggaacauccagggccgcgagcuccuguacgcccggggguucaccgcggucgacguggagaccggcgagaaguucacgcgcgacgacuucacccgggaccagugggacgagaucuucggggugcagguccccaagcccugggaguacuucaacgaggagcuggacauccgccucggcgagaaccccguggaguucaucgagacccacagcgacgugucccggaagcuggacuacccggccugguucuacgagaacaacaucauccgccccgucuucgugagccggaugcccaaccgcaaggugaccggcgccgcccacgcggacaccauccggagcccccgccacuaccaggagacgggguccguccugaccaagaccgcccucaucgaccugaagcugaacaagaagaccggcgagaucgagaacuacuacaagccggaguccgacacgcuccuguacaacgcccugaaggagcggcucgagcuguacgggggcgacgggaagaaggccuucgaggagcccuucuacaagcccaaggccgacggcagccgcggcaaccuggugcggaaggugaagaccuacgacaagcucacccugggggucuacgugaacucccagcacggcaucgcggccaacgccaacgggagcauggugcgcgucgacguguuccggguguccggcaaguacuacuucgucccgguguacaucgccgacgugguccgcaagcgccugcccaugaaggccguggugcaggggaagcaguacaucgacuggaaggagauggaggacaaggacuucaucuucagccucuacacccgggaccugaucuccuucaagagcaagaacggcaagaaggucacgugcguggacggcaccuccaaggcggugaacgaggagaucgucuacuacuacggggccaacaucagcaccgccuccuucagcggcaagucccacaacgggagcuucgaguucaccagccugggcauccaggggcucgaguaccugaagaaguaccagguggacgugcugggcaacgucuccgaggugaagcgcgagaagcggaugggcuuccgcuga

SEQ ID NO: 1670 - RNA, 3402 nt, Artificial Sequence
  Cas9 variant
augggcggguucgagguggaccgcaagaucagccugggccucgacaucggggucuccagcgugggcuacuccgugaucgacgucgacaccgggaaggugcuggagcugggcagccggcucaucaacggcaagaucgggaccgagaaccaggcccgccgggagaugcgcggcacgcggcgccugaucaaccggaagaagcagcgccggaaggacaccgugaagcuguucaacgaguucaagcucaucgacuccaagaaggacgagcacuacuucgaccacuucgccaacaacagcgaccccuacgagcugcgcgucaaggggcuguccgagaagcucagccuguccgagaucgcggacggccuguaccacaucgugaagcggcgcgggaucagcuacgaccucaaggacgccgacgaggaguccgagggcagcgaguacgagaacggccugaagaucaacaacuccgagcugaagaaccagaccccggcccagauccagcucaagcggcugaacgaguacggggccauccgcggcaagguggucaucgacgaggagaagauccugcucaacguguuccccaccaaggccuaccuggacgaggcgaagcggaucaucgagaagcagcgcgaguucuaccccgggauccugacggaggaguucgaggagaaguacugccagauccucacccggaagcgcgacuacuucgugggccccggcagcgagaagucccggaccgacuacgggaucuacaaggaggacggccgcacccugaacaaccuguucgaggagcucaucgggcacgacaagaucuacccggaggagcugcgggccagcggcgccuccuucacggcccagcuguucaacguccucaacgaccugaacaaccugcacaucagcuccuacgaggaccagaagcucaccaccgagaacaaggagcagaucaucagcgagcucaagagcaccacguccaacgugaacaugaugaagcugauccagaagaucgcggggugcgaggagagcgacaucuccggcuaccgcaccgacaagaacuacaagcccgagaucagcuccaugcgcaucuaccggaaggugcacaagaagcuccuggagagcgagaucgacaucaccaacuggcccgacgacuucaucaacaagcuguccuucauccucacccugaacacggagaacggcgagauccgcaaccagcugaagaaccggcuccagcccgaguacgacuuccugaccgacgagcugauccagaccaucaucgacaacaaggagagcuucgacaucaaguccaacaacaaguggcaccgcuucagcaucaagaccauggagcuccugaucccggagaugaucaagcggcccgucgagcagaugacgcugaucaacgagauggggcucaucaagaacuccggcaagaaguucagcaacuacaaguaccugcccuacaagaagaucgccgaggacaucuacaaccccguggccuccaagagcgugcgcgaggcccugaagaucgucaacgccauccucaaggaguacgggcacaucgaguacaucgugguggagaugccgcgggacaagaacgaggacgaggcgaaggaccagaucgagaaguuccagaaggccaacggccgccugaaggacgccgcccuggaggaguucaccgaggccaucggggacaaguccaccgucgacaagaagcugggcgugcaccggagcaagcuccuguucaagauccgccugugguaccagcagcggggcauggaccucuacgaggggaagcccaucuccgcgguggaccugcugaacaaccccgacagcuuccagaucgaccacaucaucccccaguccgucagcuucgacgacagcuucaacaacaagacccucugcaacuccggccugaaccagaucaaggacaagaagacgccguucgaguacaugaacgagggguacggccagggguucgacagcaugaaggccauggugaugaagaacccccgcaucgaccacaacaagcggaagaacuaccuguucuccgagaacgucagcgacaucgagacccgcaagcgguucaucucccgcaaccucguggacacccgguacgccagccgcgugguccugaacaaccugcaggaguucuucaaggagaaggaguccgacaccaagaucagcaucauccggggcaaguucacguccaaccuccgcaagcacuggaagaucaacaagaaccgcgacaccuaccaccaccacgccaucgacgccaccaucaucgcggccacccccuuccugaacaucuggaagaagggcagcuccaucuuccccagcaacguggaguccgaggacuucuucgacaucaagacggggaagaucaucggcaacgacgaguucaacaaguacgccuacgacgagccguacaacggguucuacaacgagcugcggaacgccaccgaccgcaucaaguucagccaccagaucgacaagaagaugaaccggaagguguccgacagcaccaucuacuccacccgcgucgccaagagccccaagaacaagaaggagagcgaguacaucguggcgaagaucaagaacaucuacgacgccgacgaguacgccaaguucaagcggaucuacgacaaggacaagacgaaguuccuccugaacaaguacgacccccgcuccuucaaccaccuggagaagaucaugaacaccuaccccgacagcaucgagcggaccauguccaacaacaaggugaaggucgugcgcaucagcccguucgagcucuaccggcaggaccacggccccgugaagaaguacuccaagaagaacaacggccccgagaucaagcagcugaaguaccuggacaagaaggucgggagcuccaucgacgugacccccgacaacgccaagaacaagcacgugauccucaagagccugaagccguggcgcaccgacaucuaccugaaccacgagacgggcgaguacgagaucauggggaucaaguacuccgaccucaaguucaacaagggcgagggguacggcaucaagaaggcgaaguaccuggagaucaagcaccgggagaaggucagcgacgacuccgaguucauguucacccuguacaagaagaaccgcaucaagguggagaacauggagaccgacgagagcguggagaugcuguucuggucccggaccauggacagccagaagggcuacgccgagcugaagcccaucuacaaguacaagacggaggacgacaacuggcccaucuacgggaacgccaagaagcagaucaucaagaagcugaucccgaagaacugcaagaucuggaaggucaacaccgacgugcucggcaaccccuucuacguggagaaggagggggaguaccccaaggacguccuggacuga

SEQ ID NO: 1671 - RNA, 3405 nt, Artificial Sequence
  Cas9 variant
augaacggccuggugcucgggcuggacaucggcaucgccagcgucggggugggcauccuggagaagaacuccgggaagaucgugcacgccagcucccgcaucuuccccgcggccaccgccgacaacaacgucgagcggcgcaagaaccggcaggcccgccggcuccaccgccggaagaagcaccgcggcgcccggcugaaggaccuguucgaguacuacggccuccugaccgacuucagcaagguguccaucaaccugaacccguaccgccuccggguggacgggcuggaccagcagcugacgaacgaggagcuguucaucgcgcucaagaacaucgucaagcgccggggcaucagcuaccuggacgacgccuccgaggacgggggcaccgugagcuccgacuacgggaaggccguggaggagaaccgcaagcuccuggccgagcagacccccggccagauccagcuggagcgguucgagaaguacggccagcuccgcggggacuucaccgucguggagaacagcgagaagugccggcugaucaacguguucuccacgagcgcguacaagaaggaggccgagcgcauccugcggaagcagcaggaguucaacaaccagaucaccgacgaguucaucgaggacuaccucaagauccugaccggcaagcgcaaguacuaccacgggcccggcaacgagaagucccggaccgacuacggccgcuuccgcacggacggggccacccuggacaacaucuucggcauccucaucgggaagugcaccuucuaccccaacgaguaccgggccagcaaggccuccuacaccgcgcaggaguucaaccugcugaacgaccucaacaaccugacggucccgaccgagaccaagaagcugagcgaggagcagaagaagaccaucaucgaguacgccaaguccgccaagacgcucggcgccagcacccugcugaaguacaucgccaagaugaucgacgcguccguggaccagauccgcggguaccggguggacgucaacaacaagcccgagaugcacaccuucgagguguaccgcaagaugcagagccucgagaccaucagcgugggcgagcugucccggaacauccuggacgagcucgcccacauccugacgcugaacaccgagcgcgagggcaucgaggaggccaucaacaccaagcuccgggacagcuucucccaggaccagguccuggagcuggugcaguuccgcaagaacaacagcucccucuucagcaagggguggcacaacuucucccugaagcugaugauggagcucauccccgagcuguacgagaccagcgaggagcagaugacgauccugacccggcucggcaagcagaaguccaaggagaccagcaagcgcaccaaguacaucgacgagaaggaggugacggaggagaucuacaaccccgucguggccaaguccgugcggcaggccaucaagaucaucaacgaggcgaccaagaagcacgggaucuucgacaacaucgucaucgagauggcccgcgagaacaacgaggaggacgccaagaaggacuacaucaagcggcagaaggccaaccaggacgagaaguacgccgcgauggagaaggccgccuuccaguacaacggcaagaaggagcugccggacaacaucuuccacgggcacaaggagcuggccaccaagauccgccuguggcaccagcagggcgagaagugccucuacaccggcaagagcauccccaucuccgaccugauccacaaccaguacaaguacgagaucgaccacauccugccccucagccuguccuucgacgacagccuguccaacaaggugcucguccuggcgacggccaaccaggagaaggggcagcggacccccuuccaggcccuggacagcauggacgacgccugguccuaccgcgaguucaagagcuacgugaaggagagcaagcuccugggcaacaagaagaaggaguaccugcucaccgaggaggacaucuccaagaucgaggugaagcagaaguucaucgagcggaaccuggucgacacccgcuacagcucccggguggugcugaacgcccuccaggacuucuacaagaaccacaacuucgacacgaccaucagcgucgugcgcgggcaguucaccucccagcugcgccggaaguggggccuggagaagucccgcgagaccuaccaccaccacgcgguggacgcccucaucaucgccgccagcagccagcugcggcuguggaagaagcagaacaacccgcucaucgccuacaaggaggggcaguucgucgacucccagaccggcgagaucaucagccugacggacgacgaguacaaggagcugguguucaaggcgcccuacgaccacuucguggacacccucuccagcaagaccuucgaggacuccauccuguucagcuaccaggucgacuccaaguucaaccgcaagaucagcgacgccaccaucuacgccacgcggaaggccaagcuggacaaggagaagaaggaguacaccuacacccucggcaagaucaaggacaucuacucccuggggaccaagacgcccagcaagaccggcuucuacaaguuccuggaccucuacaacaaggacaagagccaguuccugauguuccagaaggaccgcaagaccugggacgaggugaucgagaagaucauggagcaguaccggcccuucaaggaguacgacaaggccgggaagcugguggacuucaacccguucgagaaguaccgccaggagaacggccccauccggaaguacuccaagaagggcaacgggcccgagaucaagagccucaaguacuacgacauccugcugggcaagcacaagaacaucacccccgaggggucccgcaacacggucgcgcuccugagccugaacccguggcggaccgacguguacuacaacauggagaccaagaaguacgaguuccucggccugaaguacgccgaccugcccuucgaggagggcggggccuacggcaucuccaccgagacguacaacgagcuccgcgagaaggaggggaucggcaagaacagcgaguucaaguucacccuguacaagaacgaccugauccucaucaaggacaccgagaccaacugccagcaguucuuccgguucuggucccgcacggggaaggacaaccccaagagcuucgagaagcacaagaucgagcugaagcccuacgagaaggccaaguucgagaagggcgaggagcuggaggugcucgggaaggucccgcccuccagcaaccaguuccagaagaacaugcagaucgagaaccuguccaucuacaaggugaagaccgacgugcugggcaacaagcacuucaucaagaaggagggcgacaagcccaagcucaaguucuga

SEQ ID NO: 1672 - RNA, 3405 nt, Artificial Sequence
  Cas9 variant
augaacggccuggugcucgggcuggacaucggcaucgccagcgucggggugggcauccuggagaagaacuccgggaagaucauccacgccaacagccgccucuuccccgcggccaccgccgacaacaacguggagcggcgcaagaaccggcaggcccgccggcugaaccgccggaagaagcaccgcggcguccgguuccaggaccuguucgaggacuacggccuccugaccgacuucuccaaggugagcaucaaccugaacccguaccgccuccggguggacgggcugaaccagcagcugacgaacgaggagcuguucaucgcccucaagaacaucgucaagcgccggggcaucuccuaccuggacgacgcgagcgaggacgggggcgccguguccagcgacuacgggaaggccguggaggagaaccgcaagcuccuggccgagcagacccccggccagauccagcuggagcgguucgagaaguacggccagguccgcggggacuucaccgugguggagaacggcgagaagcuccggcugaucaacgucuucuccaccagcgcguacaagaaggaggccgagcgcauccugcggaagcagcaggaguucaacaaccagaucacggacgaguucaucgaggacuaccucaagauccugaccgggaagcgcaaguacuaccacggccccggcaacgagaagucccggaccgacuacgggcgcuuccgcaccgacggcacgacccuggacaacaucuucgggauccucaucggcaagugcaccuucuaccccgaggaguaccgggccagcaaggccuccuacaccgcccaggaguucaaccugcugaacgaccucaacaaccugacggugccgaccgagaccaagaagcugagcgaggagcagaagaaggugaucgucgaguacgcgaaggaggccaagacccucggggccuccacgcugcugaaguacaucgccaagaugaucgacgccagcguggaccagauccgcggcuaccggguggacgucaacaacaagcccgagaugcacaccuucgagguguaccgcaagaugcagucccucgagaccaucagcgugggcgagcugucccggaacguccuggacgagcucgcgcacauccugacccugaacacggagcgcgaggggauggaggaggccaucaacaccaagcucaaggacagcuucagccaggaccaggugcuggagcuggugcaguuccggaagaacaacuccagccucuucuccaagggcuggcacaacuucagccugaagcugaugauggagcucauccccgagcuguacgagaccuccgaggagcagaugaccauccugacgcgccucgggaagcagaaguccaaggagaccagcaagcggaccaaguacaucgacgagaaggagcugaccgaggagaucuacaaccccgucguggccaagagcguccgccaggccaucaagaucaucaacgaggccacgaagaagcacggcaucuucgacaacaucgugaucgagauggcgcgggagaacaacgaggaggacgccaagaaggacuacaucaagcgccagaaggccaaccaggacgagaagaacgccgccauggagaaggcggccuuccaguacaacgggaagaaggagcugccggacaacaucuuccacggccacaaggagcuggccaccaagauccggcucuggcaccagcagggcgagaagugccuguacaccgggaagaccauccccaucuccgaccugauccacaaccaguacaaguacgagaucgaccacauccucccccugagccuguccuucgacgacagccucuccaacaaggugcugguccuggccacggcgaaccaggagaagggccagcgcacccccuuccaggcccucgacagcauggacgacgccugguccuaccgggaguucaagagcuacgugaaggaguccaagcugcuggggaacaagaagaaggaguaccuccugaccgaggaggacaucagcaagaucgaggugaagcagaaguucaucgagcgcaaccugaucgacacccgguacuccagccgcgucgugcucaacgcccugcaggacuucuacaaggcccacaaguucgacacgaccaucagcgugguccggggccaguucaccucccagcugcgccgcaagugggggcucgagaagucccgggagaccuaccaccaccacgcgguggacgcccugaucaucgccgccagcagccagcugcgccucuggaagaagcagaacaacucccugaucagcuacaaggagggccaguucguggacuccgagaccggcgagaucaucagccugacggacgacgaguacaaggagcucgucuucaaggccccguacgaccacuucguggacacccugcgguccaagaaguucgaggacagcauccuguucuccuaccagguggacagcaaguucaaccgcaagaucuccgacgcgaccaucuacgccacccggaaggccaagcucgacaaggagaagaaggaguacacguacacccuggggaagaucaaggacaucuacagccugggcaccaaggcccccuccaagaccggguucuacaaguuccucgaccuguacaacaaggacaagagccaguuccugauguuccagaaggaccgcaagacgugggacgaggucaucgagaagaucauggagcaguaccggcccuucaaggaguacgacaagaccggcaagcucguggacuucaaccccuucgagaaguaccgccaggagaacggcccgauccggaaguacuccaagaaggggaacggccccgagaucaagagccugaaguacuacgacauccugcucgggaagcacaagaacaucacccccgagggcagccgcaacaccguggcccugcugucccucaaccccuggcggacggacgucuacuacaacauggagaccaagaaguacgaguuccuggggcugaaguacgcggaccucccguucgaggagggcggcgccuacgggaucagcaccgagaccuacaacgagcugcgcgagaaggagggcaucgggaagaacuccgaguucaaguucacgcuguacaagaacgaccucauccugaucaaggacaccgagaccaacugccagcagaucuuccgguucuggagccgcaccggcaaggacaaccccaaguccuucgagaagcacaagaucgagcugaagcccuacgagaaggcccgguucgagaagggggaggagcucaaggugcugggcaaggugcccccgagcuccaaccagcugcagaagaacaugcagaucgagaaccucagcaucuacaaggucaagacggacgugcugggcaacaagcacuucaucaagaaggagggggacgagcccaagcugaaguucuga

SEQ ID NO: 1673 - RNA, 3405 nt, Artificial Sequence
  Cas9 variant
augaacggccuggugcucgggcuggacaucggcaucgccagcgucggggugggcauccuggagaagaacuccgggaagaucauccacgagaacagccgccucuuccccgccgcgaccgccgacaacaacguggagcggcgcaagaaccggcaggcccgccggcugaaccgccggaagaagcaccgcggcguccgguuccaggaccuguucgaggacuacggccuccugaccgacuucuccaaggugagcaucaaccugaaccccuaccgccuccggguggacgggcugaaccagcagcugacgaacgaggagcuguucaucgcccucaagaacaucgucaagcgccggggcaucuccuaccuggacgacgccagcgaggacgggggcaccgugcccuccgacuacgggaaggcggugaaggagaaccgcaagcuccuggccgagaagacccccggccagauccagcuggagcgguucgagaaguacggccagcuccgcggggacuucaccgucgaggagaacggcgagaagugccggcugaucaacguguucagcacguccgccuacaagaaggaggccgagcgcauccugcggaagcagcaggaguucaacaaccagaucaccaacgaguucaucgaggacuaccucaagauccugaccgggaagcgcaaguacuaccacggccccggcaacgagaagucccggaccgacuacgggcgcuuccgcacggacggcaccacccuggacaacaucuucgggauccucaucggcaagugcaccuucuacccggaggaguaccgggugagcaaggcgagcuacacggcccaggaguucaacauccugaacgaccugaacaaccucaccguccccaccgagaccaagaagcuguccgaggagcagaagaaggacaucguggaguacgccaaggagacgaagacccugggggccagcacccuccugaaguacaucgccaagaugaucgacgcguccguggaccagauccgcggcuaccgggucgacgugaacaacaagcccgagaugcacaccuucgagguguaccgcaagaugcagagccuggagacgaucuccgucggcgagcucagccggaacgugcuggacgagcuggcccacauccucacccugaacaccgagcgcgaggggaucgaggaggccaucaacaccaagcugaugggcguguucucccaggaccagguccucgagcuggugcaguuccggaagaacaacagcagccuguucuccaagggguggcacaacuucagccucaagcugaugauggagcugauccccgagcucuacgagacguccgaggagcagaugaccauccugacccgccugggcaagcagaaguccaaggagaccagcaagcggacgaaguacaucgacgagaaggaggugaccgaggagaucuacaacccggucguggccaagagcguccgccaggccaucaagaucaucaacgaggcgaccaagaaguacgggaucuucgacaacaucgugaucgagauggcccgggagaacaacgaggaggacgccaagaaggacuacaucaagcgccagaaggccaaccaggacgagaagaacgccgcgauggagaaggccgccuuccaguacaacggcaagaaggagcuccccgacuccaucuuccacggccacaaggagcuggccaccaagauccggcuguggcaccagcagggggagaagugccuguacacgggcaagaacauccccaucagcgaccucauccacaaccaguacaaguacgagaucgaccacauccugccccugucccucagcuucgacgacucccugagcaacaaggugcugguccucgccaccgcgaaccaggagaaggggcagcgcaccccguuccaggcccuggacuccauggacgacgccuggagcuaccgggaguucaaguccuacgugaaggacagcaagcugcucuccaacaagaagaaggacuaccugcugaccgaggaggacaucagcaagaucgaggugaagcagaaguucaucgagcgcaaccucgucgacacgcgguacuccagccgcguggugcugaacgcccugcaggacuucuacaaggcgcacaaguucgacaccaccaucagcgucgugcggggccaguucaccucccagcuccgccgcaagugggggcuggagaagucccgggagaccuaccaccaccacgccguggacgcccugaucaucgccgccagcagccagcuccgccuguggaagaagcagaacaacccccugaucacguacaaggagggccaguucgucgacuccgagaccggcgagaucaucagccucaccgacgacgaguacaaggagcugguguucaaggcgcccuacgaccacuucguggacacccugcgguccaagacguucgaggacagcauccucuucuccuaccaggucgacagcaaguucaaccgcaagaucuccgacgccaccaucuacgccacccggaaggccaagcuggacaaggagaagaaggaguacaccuacacgcuggggaagaucaaggacaucuacagccucggcaccaagacccccuccaagaccggguucuacaaguuccuggaccuguacaacaaggacaagagccaguuccucauguuccagaaggaccgcaagacgugggacgaggugaucgagaagaucauggagcaguaccggccguucaaggaguacgacaagaccggcaagcugguggacuucaaccccuucgagaaguaccgccaggagaacggccccaucugcaaguacuccaagaaggggaacggccccgagaucaagagccugaaguacuacgacauccuccuggggaagcacaagaacaucaccccggagggcucccggaacaccgucgcccugcucagccugaaccccuggcgcacggacguguacuacaacauggagaccaagaaguacgaguuccuggggcucaaguacgcggaccugcccuucgagaagggcggcgccuacgggaucagcaccgagaccuacaacaagcugcgggagaaggagggcaucgggaagaacuccgaguucaaguucacgcucuacaagaacgaccugauccugaucaaggacaccgagaccaacugccagcagaucuuccgcuucuggagccggaccggcaaggacaaccccaaguccuucgagaagcacaagaucgagcucaagccguacgagaaggcccgcuucgagaagggggaggagcuggaggugcugggcaaggucccgcccagcuccaaccaguuccagaagaacaugcagaucgagaaccucagcaucuacaaggugaagacggacgugcugggcaagaagcacaucaucaagaaggagggggacgagcccaagcugaaguucuga

SEQ ID NO: 1674 - RNA, 3405 nt, Artificial Sequence
  Cas9 variant
augaaguacaucgagagcguguccaucggcuucgacaucggggucggcagcgugggguacgccgugaucaacuccaagaccaagcagauccuggagagcggcgucuccaucuuccccgccgcgguggcccagaagaacguggagcgccgggagagccgccagucccggcgccuccggcgccggcgcgucaaccggcugaacgaccugaagaagcuccugaagaagaacggguucaucccgagccccaacaagaaccccuacgagauccgcgugcggggccuggagcaccagcucucccgcgacgagaucgccaucgccgugcugcacaucgccaagcggcgcggcaucagcuacucccuggacgacgucguggacgagaacgugaccgacuucaaggggaagaucgcgaagaaccaggaggcccucaagaacaagacgcccggcgagauccaguacgagcggcugcugaaguacgggaagguccgcggcaccgugaccaacuacguggaguacgacgagcagccggaguacuuccucaacgucuuccccaacagcgccuacguggacgaggccaagcggauccugaccugccagaagcaguacuaccccgagaucacggacgaccugaucgagaacaucgugaagaucaucucccgcaagcgggcguacuacaucgggcccggcaacgagaagucccgcaccgacuacggcaucuaccggaccaacggggagacccucgagaacaucuucgagauccugaucggcaaggacagcgucaacccggacgagcugcgcgcccccgccaacagccucacggcccagguguacaaccugcugaacgaccucaccaacauccgcuacaacggguccgagcggcugacccccgagcagaagcaggacauccugagcgagcuccugaccacggagaagaccgugcagaugcugaacgucaucgccaagaaggugaacgugaagaaggaggagaucuccggcuuccgcaccaagaaggacgacaagcccgacuuccacacccucgaggucuaccggaaggugcgcaagcacaugcugaacaagggcaucgacaucaacgaguggccgacggagugcuucgacgagcuggcguucaucuucaaccucaacaccgagaucggggagauccggaaccgcaucagcgagaaggucgugcccaaguacgacuucaucaccaaccagaucguggacgaccugcuggaggaccccaagaucuucgccaucagcaccucccagaaguggcaccgguucagcaucaagacgaugaacguccucauccccgagcugcugaacggcuacaacgagcagaugaccauccucacccgcauggggcugcuggaggacuccaagaacgacuacagcaacaucgacaagaucgacaucaagaacgugaccgagaacaucuacaacccggugguccggaaguccaucaagaagugccucaagaucuucaacgagcuguacaagaaguaccccaacaucagcgacguggugaucgagcugccccgcgaggacaaccccgaggacgcccggaagcucaucaagaagaugcagaaggagaaccuggucgagaaggacacgucccuggaggccuuccgcaaggaggccaaccucagcgagaacggccugaucgacuuccugcggaaggggaagaaccgcgcgcucaagauccggcugugguaccagcaggagggcaagugccuguacaccggcgagccgauccuggccgaggaccucugcaagaacgaggccaacuacgacaucgaccacaucauccccaucuccgugagcuucgacgacuccaucaacaacaaggugcugugcagcucccacuucaaccgcuucgagaaggagaagaagacccccuucgaguacuucagcaacaaguccagccaccuggggcgguacuccaacuucgacgaguuccgcgccagcgucaacgccaacaagcggaucuccgacgugaagcgcaagaaccuccugagcaaggagcugcucagcgaccuggacacccgcaagaaguucaucgcgcggaaccugguggacacgcgcuacgccucccgggucguguucaacgagcucacccaguucuucgccagcaagaaggccgacaccaagguggccgucauccgcggcaaguucaccucccagcugcggcgcgcguggcagcugaacaagagccgggacacguaccaccaccacgccguggacgccgcccucaucggggugacccccuuccugaagaucuggcgcuccggcaagaccaucuacccgcggaagaugaccgaggcgcagacggacuucgagcugaacgagaucaccaccaacgacgaguucaaggagagcuacuaccagcuccccugcccccaguuccuggacuaccugacccagaugcaggagaaccucaagaucaacuucgaggucgacaagaagaugaaccgcaagaucuccgacgccaugaucuacagcucccggaagaagaagcugagcaaggacaagaaggagaaggaguacucccuggggaccaucaacgacaucuacagcgacgccggcuacuccaaguucaagaacaucuacaagaaggacaaggagaaguuccucauguaccaccuggaccacaagagcuucgagauccuggaggacaucaucucccaguaccccgacaaggaggaguacaucgacagcgagggcaaggugaagcagcgcgccguguccccguucgagaucuaccggcgcaaguacggguacauccggaaguacagcaagaagaacaacggccccaucaucaagaacaugaaguacuacaacgagaaccuccccaagaucuacaucgacaucacgccgaagcagagcaucgacaagaaggucuaccugaccaacaucucccccuggcgcaccgacguguacuacaaccggagccagaacuccuaccacaucauggggaucaaguacagcgaccugcgcuacaucgacggcaaguacgggauccccaagaacguguacgagaagaucaagcuccgggagaagauccccuccgagagcgaguucugcuucucccuguacaagaacgaccgcgucaagaucaucgacccgaacaagaacgaggagaucgagcugcgguucaacagccgcacccuccccuccgugcugaacuacguggaguucaagccccuguuccaggagagcuacaacucccucacgcugcugcccgucuucagcaagaccaccuccgagggccgcaucaucaagaaguucacccgggaggacaacaucguguacaaggugaacacggacgagcucggcaacccguacuacauccugaaggagagccagaaccccaagaacaucaucgacaacuccaacaagaccgaguga

SEQ ID NO: 1675 - RNA, 3405 nt, Artificial Sequence
  Cas9 variant
augaacggccuggugcucgggcuggacaucggcaucgccagcgagggggucggcauccuggagaagaacuccgggaagaucauccacgccaacagccgccucuuccccgcggccaccgccgacaacaacguggagcggcgcaagaaccggcaggcccgccggcugaaccgccggaagaagcaccgcggcgugcgguuccaggaccuguucgaggacuacggccuccugaccgacuucuccaaggucagcaucaaccugaacccguaccgccuccggguggacgggcugaaccagcagcugacgaacgaggagcuguucaucgcccucaagaacaucgugaagcgccggggcaucuccuaccuggacgacgcgagcgaggacgggggcgccgucuccagcgacuacgggaaggccguggaggagaaccgcaagcuccuggccgagcagacccccggccagauccagcuggagcgguucgagaaguacggccaggugcgcggggacuucaccgucguggagaacggcgagaagcuccggcugaucaacguguucuccaccagcgcguacaagaaggaggccgagcgcauccugcggaagcagcaggaguucaacaaccagaucacggacgaguucaucgaggacuaccucaagauccugaccgggaagcgcaaguacuaccacggccccggcaacgagaagucccggaccgacuacgggcgcuuccgcaccgacggcacgacccuggacaacaucuucgggauccucaucggcaagugcaccuucuaccccgaggaguaccgggccagcaaggccuccuacaccgcccaggaguucaaccugcugaacgaccucaacaaccugacggucccgaccgagaccaagaagcugagcgaggagcagaagaaggugaucguggaguacgcgaaggaggccaagacccucggggccuccacgcugcugaaguacaucgccaagaugaucgacgccagcgucgaccagauccgcggcuaccggguggacgugaacaacaagcccgagaugcacaccuucgaggucuaccgcaagaugcagucccucgagaccaucagcgugggcgagcugucccggaacgugcuggacgagcucgcgcacauccugacccugaacacggagcgcgaggggauggaggaggccaucaacaccaagcucaaggacagcuucagccaggaccagguccuggagcuggugcaguuccggaagaacaacuccagccucuucuccaagggcuggcacaacuucagccugaagcugaugauggagcucauccccgagcuguacgagaccuccgaggagcagaugaccauccugacgcgccucgggaagcagaaguccaaggagaccagcaagcggaccaaguacaucgacgagaaggagcugaccgaggagaucuacaaccccguggucgccaagagcgugcgccaggccaucaagaucaucaacgaggccacgaagaagcacggcaucuucgacaacaucgucaucgagauggcgcgggagaacaacgaggaggacgccaagaaggacuacaucaagcgccagaaggccaaccaggacgagaagaacgccgccauggagaaggcggccuuccaguacaacgggaagaaggagcugccggacaacaucuuccacggccacaaggagcuggccaccaagauccggcucuggcaccagcagggcgagaagugccuguacaccgggaagaccauccccaucuccgaccugaucuacaaccaguacaaguacgagaucgaccacauccucccccugagccuguccuucgacgacagccucuccaacaaggugcuggcccuggcgacggccaaccaggagaagggccagcgcacccccuuccaggcccucgacagcauggacgacgccugguccuaccgggaguucaagagcuacgugaaggaccugaagucccugagcaacaagaagaaggacuaccuccugaccgaggaggacaucuccaagaucgaggucaagcagaaguucaucgagcgcaaccugguggacacccgguacagcagccgcgugguccucaacgcccugcaggacuucuacaagucccaccaguucgacacgaccaucagcguggugcgggggcaguucaccucccagcugcgccgcaaguggggccucgagaagucccgggagaccuaccaccaccacgcggucgacgcccugaucaucgccgccagcagccagcugcgccucuggaagaagcagaacaacccgcugaucaccuacaaggaggggcaguucguggacucccagacgggcgagaucaucagccugaccgacgacgaguacaaggagcucguguucaaggcccccuacgaccacuucgucgacacccuguccagcaagaccuucgaggacuccauccuguucagcuaccagguggacuccaaguucaaccggaagaucagcgacgcgacgaucuacgccacccgcaaggccaagcucgacaaggagaagaaggaguacaccuacacccugggcaagaucaaggacaucuacucccuggggacgaagacccccagcaagaccggcuucuacaaguuccucgaccuguacaacaaggacaagucccaguuccugauguuccagaaggaccggaagaccugggacgaggugaucgagaagaucauggagcaguaccgccccuucaaggaguacgacaagacggggaagcucgucgacuucaacccguucgagaaguaccggcaggagaacgagcccauccgcaaguacagcaagaagggcaacggccccgagaucaagagccugaaguacuacgacauccugcucgggaagcacaagaacaucacccccgagggcucccggaacaccguggcccugcugagccucaacccguggcgcaccgacguguacuacaacauggagacgaagaaguacgaguuccuggggcugaaguacgccgaccuccccuucgaggagggcggggcguacggcaucuccaccgagaccuacaacgagcugcgggagaaggagggcaucgggaagaacagcgaguucaaguucacccuguacaagaacgaccucauccugaucaaggacacggagaccaacugccagcagaucuuccgcuucuggucccggaccggcaaggacaaccccaagagcuucgagaagcacaagaucgagcugaagcccuacgagaaggcccgcuucgagaagggggaggagcucgagguccugggcaaggugccgcccuccagcaaccagcugcagaagaacaugcagaucgagaaccucuccaucuacaaggugaagaccgacguccuggggaacaagcacuucaucaagaaggagggcgacaagcccaagcugaaguucuga

SEQ ID NO: 1676 - RNA, 3408 nt, Artificial Sequence
  Cas9 variant
augagcgaccuggugcucggccuggacaucgggaucggcuccgucggggugggcauccugaacaaggugaccggggagaucauccacaagaacagccgcaucuuccccgcggcccaggcggagaacaaccucgagcggcgcaccaaccggcagggccgccggcugacgcgccggaagaagcaccgccggguccgccugaaccaccucuucgaggaguccggccugaucaccgacuucaccaaggugagcaucaaccugaacccguaccagcuccgggugaaggggcugaccgccgagcuguccaacgaggagcuguucaucgcccucaagaacauggucaagcaccgcggcaucagcuaccuggacgacgccuccgacgacgggaacagcuccgugggcgacuacgcccagaucgugaaggagaacagcaagcagcucgagacgaagacccccgggcagauccagcuggagcgguaccagaaguacggccagcugcgcggcgacuucaccgucgaggaggacgggcggaagcaccgccucaucaacguguuccccaccuccgcguaccacgccgaggcccugcggauccugcagacgcagcaggaguucaacccccagaucaccgacgaguucaucaacagcuaccucgagauccugaccggcaagcgcaaguacuaccacgggccgggcaacgagaagucccggaccgacuacggcaaguacacgaccaagaaggacgcccaggggcaguacaucacccugaacaacaucuucggcauccucaucgggaagugcaccuucuaccccgaggaguaccgcgcggccaaggccagcuacacggcccaggaguucaaccugcugaacgaccucaacaaccugaccgugcccaccgagaccaagaagcuguccgaggagcagaaguaccagaucaucacguacgucaagaacgagaaggccaugggccccgcgaagcuguucaaguacaucgccaagcuccuggccugcgacaucgccgacaucaagggguaccggaucgacaagagcgacaaggccgagauccacaccuucgaggcguaccgcaagaugaagacccucgagaccaucgacaucgagcagaucgagcgcgagaagcuggacaagcuggccuacgugcucacgcugaacaccgagcgggagggcauccaggaggcccuggaccacgaguucgccgacggcaccuucucccaggagcaggucgacgagcucgugcaguuccgcaaggccaacagcuccaucuucgggaagggcuggcacagcuucagcgugaagcugaugauggagcugaucccggagcucuacgcgaccuccgaggagcagaugacgauccugacccggcuggggaagcagaagaccaccagcuccagcaacaagacgaaguacaucgacgagaagcagcucaccgaggagaucuacaaccccguggucgccaaguccgugcgccaggccaucaagaucgugaacgccgccaucaagaaguacggcgacuucgacaacaucgucaucgagauggcgcgggagaccaacgaggacgacgagaagaaggccauccagaagauccagaaggccaacaaggccgagaaggacgcggccaugcgcaaggccgccaaccaguacaacgggaaggccgagcugccccacagcguguuccacggccacaagcagcuggcgaccaagauccggcucuggcaccagcagggcgagcgcugccuguacacggggaagaccaucuccauccacgaccugaucaacaaccccaaccaguucgagaucgaccacauccugccgcucagcaucaccuucgacgacucccuggccaacaaggugcuggucuacgccaccgccaaccaggagaagggccagcggacccccuaccaggcccucgacagcauggacgacgcgugguccuuccgcgagcugaaggccuucgugcgggagagcaaggcccuguccaacaagaagaaggaguaccuccugacggaggaggacaucagcaaguucgacguccgcaagaaguucaucgagcggaaccugguggacacccgcuacgccucccgggugguccucaacgcccugcaggagcacuucaaggcgcacaagaucgacaccaaggugagcgugguccgcgggcaguucaccucccagcugcggcgccacuggggcaucgacaagacgcgggacaccuaccaccaccacgccguggacgcccucaucaucgccgcgagcucccagcugaaccuguggaagaagcagaagaacacccucgugagcuacagcgaggaccagcugcuggacaucgagaccggggagcucaucuccgacgacgaguacaaggagagcgucuucaaggcccccuaccagcacuucguggacacgcugaaguccaaggaguucgaggacagcauccuguucuccuaccagguggacagcaaguucaaccgcaagaucuccgacgccaccaucuacgccacccgccaggccaaggucggcaaggacaagaaggacgagaccuacgugcucggcaagaucaaggacaucuacgcgcuggggacgaagacccccagcaagaccggcuucuacaaguuccuggaccucuacaacaaggacaagucccaguuccugguguaccagaaggaccggaagaccugggacgaggucaucgagaagaucauggagcaguaccgcccguucaaggagagcgacaagaacgggaaggagguggacuucaaccccuucgagaaguaccggaucgagaacggccccauccgcaaguacucccggaagggcaacgggcccgagaucaagagccugaaguacuacgccuccaagcucggcaaccacaucgacaucacgccgaaggacagcaacaacaaggugguccugcaguccgugagccccuggcgcgccgacguguacuucaacaagaccaccggguccuacgagauccugggccucaaguacgccgaccugcaguucgagaaggggaccggcacguaccggaucagcgaggagaaguacaacgacaucaagaagaaggagggcgucgacagcgacuccgaguucaaguucacccuguacaagaacgaccuccugcugaucaaggacaccgagaccaaggagcagcgccucuuccgguuccugagccgcuccaugcccaacaagaagcacuacguggagcugaagcccuacagcaaggacaaguucgagaagaacgagucccucaucgagauccuggggagcgccgacaaguccggccggugcaucaaggggcuggccaagagcaaccucuccaucuucaaggugcgcacggacguccugggcaaccagcacaucaucaagaacgagggggacaagccgaagcuggacuucuga

SEQ ID NO: 1677 - RNA, 3408 nt, Artificial Sequence
  Cas9 variant
augggcgugaucuuccuguacgagaacaucgucaagcccuucccgagccgcuacgacaaggccaucaugaagcggcucaaggggcgccagaccaugggcuacauccugucccuggacaucgggaucgccagcugcggcuacuccgugcucgagaccgacgcgcugggggugcccuacaagaucaagacgcugaacagcaucaucuucacccgggccgagaaccccaagaccggcgccucccucgccgagccccgccggaaguaccgcggcgcccggcgccggaagcgccggaccagcuuccgcaagcaccggacgcgccagcuguucaucaccuccgggcugcucagcaagcaggacaucgcgcgguaccugaaccagcaggagccgcacgacgacaucugggagcugcgcgucaagggccucgacgagccccugaccaaccugcagcuguuccaggugcucuacuacuucgugacccaccggggguucaaguccaaccgcaaggccgagcugaaggacaaggacaucggccccguccucaacagcaucaacgccuucaaggaggagaugcagucccacgacuaccggacgaucggggagcuguacgccaacgacccccgcuuccgggaccgcaagcacaacaaggacuacaccaacggcuuccugggcaccauccagcgcagcuggcucguggacgagaucaagaugcugcugaccaaccagcaguccuucgggaacacgcagcucaccagcgaguucaucgagcuguaccugaacaucuucaccucccagcggaacuucgacgacggcccggcgagcgggcccuacuccggcgaccucaucgacaagauggugggccccgacaccuucaaccgcagccggaagcgcgcgccccgggccacguacaccuuccaguacuucuccuuccugagcaagcugaacagccuccgcaucgccccguccaucagcgcccccuucgagacccugaccgucgaccagcgggcccugaucacgaagcgccucugggggcccgacgugaaguccgccgaccugaaguucaagcagauccggauggugcugagccuccccgagaccgcccgcuucaaccuggucaacuacggcaacaccccggagaaggcccuggagaucgaggacaagaccacguucaucuccaucaagccccuccgggagaucgagaaggcccugaccgggaccacccugcccgugagccacgaccagcucgacgcgaucgcccgcauccugacgguguacaaguccgacagcaaccggaagaccgccuuccacaaccagaccguccuguccgacgaggugaucgagcagcuccugccccugaacuucagcaaguucggccaccucuccguggagaccaugcaggagaucaucccguaccuggagcaggggauggucuacagcgacgccgccacggcggccggcuacgacuuccgcaacaaccagaucgacauggaguacauccgggacaacgugaccaaccccgugguccgccgggccguguccguggccaacaagcuggucaaggccgugguccgccgguacggcaagcccgacagcauccacaucgagcuggcgcgcgaccucucccagaacuuccaggagcgccggcaggacgaggugcgccagcagaagaacgcccgggacaacgagaagaucgccaagcgccuggaggagcuggggauccccgugaacggcgucaacaucaccaagaugaagcucuacgacgagcagcacgggaucgaccuguacgaccugagcaccaacgccuccauggcggugacggacaucuucagcgacgaccgguacgagaucgaccacaucaucccguacuccgugagcuucgacgacagcuacaccaacaagguccucguguccgccaaggccaaccgcgagaagcgggaccgcauccccauggagguguucggcaacgacagcgagcggcgccggcaguucgagaaccgcgucaacaccaacaucaccaaccugcggaagaagcgcaaccugcucaaggagaccuucuccgacgaggacaaggccaaguggaagucccggaacaucaacgacacgcgcuaccugaaccggauccugaugaacuaccucagccagaacguggaguucaccgacgugcugagcgacgccaagcacgucaucgcgcugaacggggccgugaccgccaagauccgcucccgguggggcaucaccaaggugcgcgccgccggcgaccuccaccacgcggucgacgccguggugaucgggugcgucacggacgcccugauccaggccgugacccgguacgccaaguaccaggagcgccgcgacaacaaggcggccgccgagcaggaccuggccgagaacaaccccgaggagcucgacgcgaagcaguuccggaagguguucaacgacuacccccugccguggcccgaguuccgcgaggagcugaugggccgggucagcuccgaccccagccagaucauggccgggcgccaguggucccacuacaccgccgaggagaucagcgagcucaagcagccguucguggugcggguccccaaccaccgcaucgugggccccgccacccuggacacgguguacgggcagcccaacccggacgacggccugaucacccagcggguccgcaucaccgaccucaagccccagaagaacaaggacggcgaggacaucaucaaggccggggcgaacguguacgagcuggccgccgacggcgggaacaagcugguguacgaguccauccucgacgcccugcaggucgccggcggcgacgggaagaaggcguuccccaccggccggcugcucgugcgcagccccauccaggacaucccgguggagcggguccgcgugacguccaaggccacccuggugguccccguggggcccaagagcguggccgccaacggcuccaugguccggaucgacguguacaagacccccaagaaguacguguucgucccgaucuacgugcgcgacaccgugaaggccgagcugcccgaccgggcggucgcccccgugaagcccuacagccagugguaccagcuccagccgaaggaccaguuccuguucagccuguucgccaacgaccucauccgcuucaagcacccccgcgggguguccacgaaggagauccugaccgacggcagccaggagaagggcaagcggaccgacgucgugggguacuucaccggcgccgacaucgcgacggccuccaucgccaucgaggggcccgaccggagcuucuccgcccgcggcaucggguucgccagccugaagaacguggagaagcucaccgucaacuacuucggcgagcugcacuccgugcacgagacccagcccaugcaguuccgcggccagcggggguga

SEQ ID NO: 1678 - RNA, 3411 nt, Artificial Sequence
  Cas9 variant
augaacggccuggugcucgggcuggacaucggcaucgccagcgucggggugggcauccuggagaaggacaccgggaagaucauccacgccuccagccgccucuuccccgcggccaccgccgacaacaacguggagcggcgcuccaaccggcagggccgccggcugaaccgccggaagaagcaccgcagcguccggcugcaggaccucuucgaguccuacggccugcugacggacuucagcaagcucuccaucaaccugaacccguaccagcugcgcgugcaggggauggagaaccagcucaccaacgaggagcuguucaucgcccugaagaacaucgugaagcggcgcggcaucagcuaccucgacgacgccuccgaggacgggggcaccgucagcuccgacuacgggaaggcgguggaggagaaccggcgccugcugaccgagaagacgcccggccagauccagcucgagcgguucgagaaguacggccagcugcgcggggacuucaccguggaggagaacggcgagaagcggcgccugaucaacgucuucagcaccuccgccuaccggaaggaggccgagcgcauccuccggaagcagcaggaguucaacaacaagaucaccgacgaguucaucgaggacuaccugacgauccugaccgggaagcgcaaguacuaccacggccccggcaacgagaagucccgcaccgacuacgggcgguuccgcaccgacggcacgacccucgacaacaucuucgggauccugaucggcaagugcaccuucuaccccgaggaguaccgggccagcaaggcgagcuacaccgcccaggaguucaaccugcucaacgaccugaacaaccugacggugccgaccgagaccaagaagcucuccgaggagcagaagaagaccaucaucgaguacgccaagagcgccaagacgcugggggccuccacccugcucaaguacaucgcgaagaugaucgacgccagcguggaccagauccgcggcuaccgggucgacgugaacaacaagcccgagaugcacaccuucgagguguaccgcaagaugcagagccuggagaccaucaaggucgaggagcugccccggaaggugcucgacgagcuggcccacauccugacgcucaacaccgagcgcgagggcaucgaggaggccaucaacuccaagcugaaggacaccuucaaccgggaccaggugcuggagcucguccaguuccgcaagaacaacagcucccuguucagcaagggguggcacaacuucucccugaagcucaugauggagcugauccccgagcuguacgagaccagcgaggagcagaugacgauccucacccggcugggcaagcagcgcuccaaggagaccagcaagcggaccaaguacaucgacgagaaggagcugacggaggagaucuacaacccggugguggccaaguccguccgccaggcgaucaagaucaucaacgaggccaccaagaaguacgggaucuucgacaacaucgugaucgagauggcccgggagaacaacgaggaggacgccaagaagaacuacaucaagcagcagaaggccaaccaggacgagaagaacgcggccauggagaaggccgccuuccaguacaacggcaagaaggagcugcccgacaacaucuuccacgggcacauggagcucgccaccaagauccgccuguggcaccagcagggcgagaagugccuguacaccggcaagaacauccagaucagcgaccucauccacaaccaguacaaguacgagaucgaccacauccugccccugucccucagcuucgacgacucccugagcaacaaggugcugguccucgcgacggccaaccaggagaaggggcagcggacccccuuccaggcccuggacuccauggacgacgccuggagcuaccgcgaguucaaguccuacgugaaggagagcaagcugcucggcaacaagaagaaggacuaccugcugaccgaggaggacaucuccaagaucgaggucaagcagaaguucaucgagaagaaccucguggacacccgguacagcagccgcgugguccugaacgcgcugcaggacuucuacaagaagcaccaguucgacaccacgaucuccguggugcgcgggcaguucaccagccagcuccggcgcaaguggaagcuggagaagucccgggacaccuaccaccaccacgccgucgacgcccugaucaucgccgccagcucccagcuccgccuguggaagaagcacaacaacccgcugaucagcuacaaggacggccaguucguggacuccgagaccggggagaucgugagccucuccaacgaggaguacaaggagcuggucuucaaggcgcccuacgaccacuucguggacacgcugcggagcaagaaguucgaggacuccauccucuucagcuaccagguggacuccaaguacaaccgcaagaucagcgacgccaccaucuacgccacccggaaggccaagcuggacaaggacaagaaggaguacaccuacacgcugggcaagaucaaggacaucuacgcccucggcaccaagacccccuccaagaccggguucuacaaguuccuggaccuguacaagacggacaagagccaguuccucauguaccagaaggaccgcaagaccugggacgaggucaucgagaagaucaucgagcaguaccggcccuucaaggaguacgacaagaacggcaaggagguggacuucaacccguucgagaaguaccgcaucgagaacgggcccauccggaaguacucccgcaagggcaacggcagcgugaucaagagcaugaaguacuacgacaaccugcuggggaaguucgucgacaucacccccuccgagagcaagaaccccguggcgcuccugucccugaacccguggcggaccgacguguacuacaaccccgagacgcgcaaguacgaguuccucggccugaaguacgccgaccugugcuucgggaagggcgggagcuacggcaucuccgaggucaaguacaacaagauccgggagaaggagggcaucgggaaggagagcgaguucaaguucacccucuacaagaacgaccugauccugaucaaggacaccgagaccaacugccagcaguucuuccgcuucuggucccggacgggcaaggacaaccccaagagcuucgagaagcacaagaucgagcucaagcccuacgagaaggccaaguucgagaagggggaggagcuggaggugcugggcaaggugccgcccuccagcaaccaguuccagaagaacaugcagaucgagaaccucuccaucuacaaggucaagaccgacgugcuggggaacaagcacuucaucaagaaggagggcgacgagcccaagcugaaguucaagaaguga

SEQ ID NO: 1679 - RNA, 3411 nt, Artificial Sequence
  Cas9 variant
augaacggccuggugcucgggcuggacaucggcaucgccagcgucggggugggcauccugaagaaggacaccggggagaucauccacaccaacucccgccucuucagcgccgcgacggccgacuccaacaucgagcggcgccggcaccgcggcggcaagcggcugacccgccggaagaagcaccgcagcauccggcugcacgaccucuucgaggacuccgggcugcugaccgacuucagcaagguguccaucaaccucaaccccuaccagcugcgcguccagggccuggacaaccagcucaccaacgaggagcuguucaucgcccugaagaacaucgugaagcggcgcgggaucagcuaccucgacgacgccuccgaggacggcgggacggugagcuccgacuacggcaaggccgucgaggagaaccggaagcugcuggcggagcagaccccgggccagauccagcucgaccgcuucgagaaguacgggcagguccggggcgacuucaccgugguggagaacggggagaagcgccggcugaucaacguguucaccacgagcgccuacuccaaggaggccgagcgcauccugcggaagcagcaggaguucaacaagaagaucaccgacgaguucaucgagaacuaccucaccauccugaccggcaagcgcaaguacuaccacggccccgggaacgagaagucccggacggacuacggccgcuacaccaccaagaaggaccccgaggggaaguacaucacccuggacaacaucuucggcauccucaucgggaagugcacguucuaccccgacgaguaccgcgccagcaaggcgagcuacaccgcccaggaguucaaccugcugaacgaccucaacaaccugaccgugccgaccgagacgaagaagcuguccgaggagcagaagaagaccaucaucaaguacgccaagaccgccaagacccucggcgccagcacgcugcugaaguacaucgcgaagcucaucggcgccuccgucgaccagauccacggguaccggaucgaccccaacaagaagcccgagaugcacaccuucgagaccuaccgcaagaugcagagccuggagaccaucagcguggaggagaucccccggaaggugcuggacgagcucgcccacauccugacgcugaacaccgagcgcgagggcaucgaggaggccaucaacgccacccucaaggacaccuucucccaggaccagguccuggagcuggugcaguuccggaagaacaacagcucccucuucagcaagggguggcacaacuucucccugaagcugaugauggagcucaucccggagcuguacgagacgagcgaggagcagaugaccauccugacccgccucggcaagcagaaguccaaggagaccagcaagcggacgaaguacaucgacgagaaggagcugaccgaggagaucuacaaccccguggucgcgaaguccgugcgccaggccaucaagaucaucaacgaggccaccaagaaguacgggaucuucgacaacaucgugaucgagauggcccgggagaacaacgaggaggacgccaagaagggcuacaacgagcgccagaaggcgaaccuggacgagaagaaguccgccauggagaaggccgccuuccaguacaacggcaagaaggagcugcccgacaacgucuuccacgggcacaaggagcucgccaccaagauccggcuguggcaccagcagggcgagaagugccuguacaccgggaagaacauccccaucagcgaccucauccagaaccaguacaaguacgagaucgaccacauccugccgcugagccucuccuucgacgacagccuguccaacaaggugcuggugcucgcgacggccaaccaggagaagggccagcgcacccccuuccaggcccuggacagcauggacgacgccugguccuaccgggaguucaagagcuacgucaaggaccugaagcuccuguccaacaagaagaaggacuaccugcucaccgaggaggacaucagcaagaucgaggugaagcagaaguucaucgagcgcaaccuggucgacacccgguacagcucccgcguggugcugaacgcgcuccaggacuucuacaaggagcaccaguucgacacgaccaucagcgucgugcgggggcaguucaccucccagcugcgccggaaguggggccuggagaagucccgcgagaccuaccaccaccacgccguggacgcccucaucaucgccgccagcagccagcugcgccuguggaagaagcagaacaacccccucaucuccuacaaggagggccaguucgucgaccaggagacgggggagaucaucagccuguccgacgacgaguacaaggagcugguguucaaggcgcccuacgaccacuucguggacacccucaagagcaagaaguucgaggacuccauccuguucagcuaccaggucgacuccaaguacaaccggaagaucagcgacgccaccaucuacgccacccgcaaggccaagcuggacaaggagaagaaggaguacacguacacccucggcaagaucaaggacaucuacgcccugggguccgagaagcugaagaccggcuucuacaaguuccuccaccuguacaagaaggacaagagccaguuccugauguaccagaaggaccggaagaccugggacgaggugaucgagaagauccucgagcaguaccgcccguucaaggagaaggacaagaacggcaaggagguggacuucaaccccuucgagaaguaccggaucgagaacgggcccauccacaaguacucccgcaagggcaacgggcccgucaucaagagccugaaguacuacgacaagaacaucccggagagcuucaucaacaucacgcccuccaacagcaagaacaaggugauccugcggcagcucaaccccuggcgcaccgacguguacuucaaccaccagaccgagaaguacgagcugcugggccucaaguacgcgcaccuccaguucgagaagaagaccgggaacuacuccaucacgaucgacaaguacaacgagaucaaggagaaggagggcgucagcgagcaguccgaguucaaguucacccugcacaagaacgaccuccugcugaucaaggacaccgagaccaaggagcagcagcuguuccgguuccugagccgcacgaagcccaacgugaagcacuacguggagcugaagccguacucccgggacgaguucgagaagaacgagcgccucaucgagauccugggcagcgucgacaaguccgggcgguucgugaagggccugggcaagagcaaccucuccaucuacaaggugcgcaccgacguccuggggaaccagcacaucaucaagaaggagggggaggagcccaagcugaaguucuga

SEQ ID NO: 1680 - RNA, 3411 nt, Artificial Sequence
  Cas9 variant
augaacggccuggugcucgggcuggacaucggcaucgccagcgucggggugggcauccuggagaaggacaccgggaagaucauccacgccuccagccgccucuuccccgcggccaccgccgacaacaacguggagcggcgcuccaaccggcagggccgccggcugaaccgccggaagaagcaccgcagcguccggcugcaggaccucuucgagggcuacgggcugcugacggacuucuccaaggugagcaugaaccucaacccguaccagcugcgcgugcagggcauggagaaccagcugaccaacgaggagcuguucgucgcccucaagaacaucgugaagcggcgcgggaucuccuaccuggacgacgccagcgaggacggcgggaccguguccagcgacuacggcaaggcggucgaggagaaccggaagcuccuggccgagaagacccccggccagauccagcuggagcgcuucgagaaguacgggcagcuccggggcgacuucacgguggaggagaacggggagaagcaccgccugaucaacguguucuccaccagcgccuaccggaaggaggccgagcgcauccugcggaagcagcaggaguucaacuccaagaucaccgacgaguucaucgaggacuaccucaucauccugaccggcaagcgcaaguacuaccacggccccgggaacgagaagucccggacggacuacggccgcuuccgcaccgacgggaccacccuggacaacaucuucggcauccucaucgggaagugcacguucuacaccgaggaguaccgggcgagcaaggccagcuacaccgcccaggaguucaaccugcugaacgaccucaacaaccugaccguccccacggagaccaagaagcuguccgaggagcagaagaagcucaucaucgaguacgccaagagcgccaagacccugggcgcguccacccugcucaaguacaucgccaagaugaucgacgccagcguggaccagauccgcggcuaccggguggacgucaacaacaagccggagaugcacacguucgagguguaccgcaagaugcagagccuggagaccaucaagguggaggagcugccccggaagguccucgacgagcuggcccacauccugacccucaacaccgagcgcgaggggaucgaggaggccaucaacuccaagcugaaggacaucuucaaccgggaccaggugcuggagcucgugcaguuccgcaagaacaacagcucccuguucagcaagggcuggcacaacuucuccaucaagcugaugauggagcucauccccgagcuguacgagacgagcgaggagcagaugaccauccugacccggcucgggaagcagcgcuccaaggagaccagcaagcggacgaaguacaucgacgagaaggagcugaccgaggagaucuacaaccccgucguggcgaaguccgugcgccaggccaucaagaucaucaacgaggccaccaagaaguacggcaucuucgacaacaucgucaucgagauggcccgggagaacaacgaggaggacgccaagaaggacuacaucaagcgccagaaggcgaaccaggacgagaagaacgccgccauggagaaggccgccuuccaguacaacgggaagaaggagcugccggacaacaucuuccacggccacaaggagcugaccacgaagauccggcucuggcaccagcagggcgagaagugccuguacaccgggaagaacauccccaucagcgaccugauccacaaccaguacaaguacgagaucgaccacauccucccccugucccugagcuucgacgacucccucagcaacaaggugcugguccuggcgaccgccaaccaggagaagggccagcgcacccccuuccaggcccucgacuccauggacgacgccuggagcuaccgggaguucaaguccuacgugaaggacagcaagcugcuguccaacaagaagaaggacuaccuccugacggaggaggacaucagcaagaucgaggugaagcagaaguucaucgagcgcaaccuggucgacacccgguacagcucccgcguggugcucaacgcgcugcaggacuucuacaagagccaccagcuggacaccaccaucuccgucgugcgcgggcaguucaccagccagcuccggcgcaaguggggcaucgagaagucccgggagacguaccaccaccacgccguggacgcccugaucaucgccgccagcucccagcugcgccucuggaagaagcacagcaacccgcugaucgcguacaaggaggggcaguucgucgacuccgagaccggcgagaucgugagccuguccgacgaggaguacaaggagcucguguucaaggcccccuacgaccacuucgucgacacccugcggagcaagaaguucgaggacuccauccuguucagcuaccagguggacuccaaguacaaccgcaagaucagcgacgccaccaucuacgccacgcggaaggccaagcucgacaaggagaagaaggaguacaccuacacccugggcaagaucaaggacaucuacgcgcuggggaccaagacgcccuccaagaccggcuucuacaaguuccucgaccuguacaagaccgacaagagccaguuccugauguaccagaaggaccgcaagaccugggacgaggugaucgagaagaucaucgagcaguaccggcccuucaaggaguacgacaagaacgggaaggaggucgacuucaacccguucgagaaguaccgcaucggcaacggccccauccggaaguacagcaagaaggggaacggccccgagaucaagucccucaaguacuacgacauccugcuggggaagcacaagaacaucacgcccgacggcagccgcaacaccguggcccuccugucccugaacccguggcggaccgacguguacuacaacagcgagaccaagaaguacgaguuccucgggcugaaguacgccgaccugugcuucgaggagggcggcgccuacgggaucuccgaggucaaguacaagaagauccgcgagaaggagggcaucgggaagaacagcgaguucaaguucacgcucuacaagaacgaccugauccugaucaaggacaccgagaccaacugccagcaguucuuccgguucuggucccgcaccggcaaggacaaccccaagagcuucgagaagcacaagaucgagcucaagcccuacgagaaggccaaguucgagaagggggaggagcugaaggugcugggcaaggugcccccguccagcaaccaguuccagaagaacaugcagaucgagaaccucuccaucuacaaggucaagacggacauccugggcaacaagcacuucaucaagaaggagggggacgagcccaagcugaaguucaagaaguga

SEQ ID NO: 1681 - RNA, 3420 nt, Artificial Sequence
  Cas9 variant
augagcgaccuggugcucggccuggacaucgggaucggcuccgucggggugggcauccugaacaaggugaccggggagaucauccacaagaacagccgcaucuuccccgccgcccaggcggagaacaaccucgagcggcgcaccaaccggcagggccgccggcugacgcgccggaagaagcaccgccggguccgccugaaccaccucuucgaggaguccggccugaucaccgacuucaccaaggugagcaucaaccugaaccccuaccagcuccgggugaaggggcugaccgccgagcuguccaacgaggagcuguucaucgcccugaagaacauggucaagcaccgcggcaucagcuaccuggacgacgccuccgacgacgggaacagcuccgugggcgacuacgcccagaucgugaaggagaacagcaagcagcucgagacgaagacccccgggcagauccagcuggagcgguaccagaaguacggccagcugcgcggcgacuucaccgucgaggaggacgggcggaagcaccgccucaucaacguguuccccaccuccgcguaccacgccgaggcccugcggauccugcagacgcagcaggaguucaacccccagaucaccgacgaguucaucaacagcuaccucgagauccugaccggcaagcgcaaguacuaccacgggccgggcaacgagaagucccggaccgacuacggcaaguacacgaccaagaaggacgcccaggggcaguacaucacccugaacaacaucuucggcauccucaucgggaagugcaccuucuaccccgaggaguaccgcgcggccaaggccagcuacacggcccaggaguucaaccugcugaacgaccucaacaaccugaccgugcccaccgagaccaagaagcuguccgaggagcagaaguaccagaucaucacguacgucaagaacgagaaggccaugggccccgcgaagcuguucaaguacaucgccaagcuccugagcugcgacguggccgacaucaagggguaccggaucgacaaguccgacaaggccgagauccacaccuucgaggccuaccgcaagaugaagacccucgagacccuggacgugaagaagauggcgcgcgaggagcuggacaagcucgccuacguccugacgcugaacaccgagcgggagggcauccaggaggcccucgaccacgaguucgccgacggcaccuucagccaggagcaggucgacgagcuggugcaguuccgcaaggccaacuccagcaucuucgggaagggcuggcacagcuucuccgugaagcugaugauggagcucaucccggagcuguacgcgaccagcgaggagcagaugacgauccugacccggcucgggaagcagaagaccaccuccagcuccaacaagacgaaguacaucgacgagaagcagcugaccgaggagaucuacaaccccgugguggccaagagcguccgccaggccaucaagaucgugaacgccgccaucaagaaguacggcgacuucgacaacaucgugaucgagauggcgcgggagaccaacgaggacgacgagaagaaggccauccagaagauccagaaggccaacaaggccgagaaggacgcggccaugcgcaaggccgccaaccaguacaacgggaaggccgagcugccccacuccgucuuccacggccacaagcagcucgcgaccaagauccggcuguggcaccagcagggcgagcgcugccuguacacggggaagaccaucagcauccacgaccugaucaacaaccccaaccaguucgagaucgaccacauccucccgcuguccaucaccuucgacgacagccuggccaacaaggugcucgucuacgccaccgccaaccaggagaagggccagcggacccccuaccaggcccuggacuccauggacgacgcguggagcuuccgcgagcugaaggccuucgugcgggaguccaaggcccucagcaacaagaagaaggaguaccugcugacggaggaggacaucuccaaguucgacgugcgcaagaaguucaucgagcggaaccucgucgacacccgcuacgccagccggguggugcugaacgcccugcaggagcacuuccgcacccacaagaucgacaccaaggucuccguggugcgggggcaguucacgagccagcuccgccggcacuggggcaucgagaagacccgcgacaccuaccaccaccacgcggucgacgcccugaucaucgccgccuccagccagcugaaccucuggaagaagcagaagaacacccuggugagcuacuccgaggaccagcugcucgacaucgagacgggggagcugaucagcgacgacgaguacaaggaguccguguucaaggcgcccuaccagcacuucgucgacacccucaagagcaaggaguucgaggacuccauccucuucagcuaccagguggacuccaaguucaaccgcaagaucagcgacgccaccaucuacgccacccggaaggccaagcuggacaaggagaagaaggaguacacguacacccugggcaagaucaaggacaucuacgcccucggcaccaagacccccuccaagacgggguucuacaaguuccuggaccuguacaagaaggacaagagccaguuccucauguaccagaaggaccgccggaccugggacgaggugaucgagaagauccuggagcaguaccgcccguucaaggagaaggacaagaacggcaaggaggucgacuucaaccccuucgagaaguaccggaucgagaacgggcccauccgcaaguacucccggaagggcaacggccccgagaucaagagccugaaguacuacgacaaccuccuggggcgcuucguggacaucaccccguccgagagcaagaaccccguggcgcugcucucccugaaccccuggcggaccgacgucuacuacaacacggagacccgcaaguacgaguuccugggccucaaguacgccgaccugugcuucgagaagggcgggagcuacgggaucuccaaggugaaguacaacaagauccgggagaaggagggcaucggcaagaacagcgaguucaaguucacccuguacaagaacgaccucauccugaucaaggacaccgagacgaaccgccagcagaucuuccgguucuggagccgcaccgggaaggacaaccccaaguccuucgagaagcacaagcuggagcucaagccguacgagaagacccgguucgagaagggcgaggagcugaaggugcuggggaaggucccgcccagcuccaaccgccuccagaagaacaugcagaucgagaaccugagcaucuacaaggugcggaccgacgugcugggcaaccagcacaucaucaagaacgagggggacaagcccaagcucgacuucuga

SEQ ID NO: 1682 - RNA, 3420 nt, Artificial Sequence
  Cas9 variant
augaacuacuacaacggcuucaucaucaccgagaacgccauggccagcaagcacgagaaccugggggcgcucaccuucggccuggacaucgggaucgccuccgugggcugggccguccugggggagaaccgcaucaucgaccucggcgugcggugcuucgacaaggccgagacggccaaggagggcgagagccugaaccuggcgcgccggaccgcccgccuccugcggcgccggcugcgccggcgcgccuggcggcucaccaagcuggcccgccugcucaagcgggaggggcugaucgcggacaccaacguguuccagaagcccuucaaccugaaggacgccaacgagaagggccucuccuucuggcagcugcgcgucgacgcccuggaccggaagcucagcgccgaggagugggcccgcgugaucuaccaccugugcaagcaccggggguuccacuggaucucccgcgcggaggagaaggccgccgagggcgacagcaaguccgagggcgggaaggugaagcagggccuggccgggacgaagaagcucaugcaggagaagaacuaccggaccgccgcggagaugguccugaccgaguuccccgaggcccagcgcaacaagcagggcgacuacagcaaggcccugucccggauccuccugggggacgagaugacccagcuguucaagcaccagcgcgagcucggcaacccccacgccacggagaagcuggaggccgcgauccugggcaacggggaccacaagagcggccucuucugggcccagaaccccgcccuggccgggaacgaccugcucaagaugcugggccacugcaccuucgagaaggccgaguaccgcgugcccaaggcguccuucaccgccgagcggcacguguggcugacccgccucaacaaccugcggaucgucguggacgggacgacccgcccgcugaacgaggccgagcggcaccucgcccugcugaugcccuaccagcaggcgggcgaccucaccuacaagcagcugcgcaccgcccugacgaaggccggcuaccuccccgagagcuuccgguacaccgggcuggccuacgccuccggccagaaggcggacgagaaggccaaggaccccgagagcgccccgcuggugaagcuccccgccuggcacgagcugcgcaagacccuggagaagaaggagcuggccuccgaguggcagaagaucagcuccgacgcgcucgacgggaagccccagcugcuggaccagaucgccuggguccucagcguguacaaggacgacaccgagguggaggccgagcugugcaagcugaaccuccccaacgccgagaagaugaucgacgcccugcuggacauccgguucgacaaguucuccaaccucagccugaaggcgcugcgccagaucgucccgcucauggagcagggccagcgguacgacgaggccguggccaacauccccgaguacgggcaccacagccagcugcacgaggugggcgccggcgagcacaaguaccugccgcccuucuacaaggagcgcgacaagacggggcggauggucuucaacgacgacauggacaucccccgcaaccccguggugcuccgggcgcugaaccaggcccgcaaggucgugaacgcccugaucaaggaguacggcagcccccacgaggugcacaucgagauggcccgggaccucucccgcccccuggacgagcggcgcgacgucgagaagcugcagaaggaguuccgcgaccggaacgagaaggacaaggcccucuucgcgcaggacuucaacaucgugggggccgucaagggcaaggaguucgagaaguaccagcuguaccgcgagcagcaggggaagugcgccuacuccaucgagccgauggacauccaccggcuguucgagcagggcuacguggagaucgaccacgcccuccccuacagccgcuccuucgacgacagcaagaacaaccgggugcugguccuggccaaggagaaccgcgacaagggcaaccggacccccuucgaguaccucgggggcaaggacaacuccgagcgcuggcggcaguucguggcguucguggaggggaacaagagcuaccgccuggccaagcggucccgccugcuccggaaggacuucggcaaggacgaggccaagggcuuccgcgagcggaaccugaacgacacccgcuacaucugccgguucuucaagaacuacgucgagcaguaccugcagcuccacgaggacagcgacgccaagcgcugcguggugcuguccgggcagaugaccagcuuccugcgggcccgcuggggccucgucaaggugcgcggggacuccgaccggcaccacgcgcuggacggcgccaucguggccgccugcagccacuccauggucaagcgccugagcgacuacucccggcgcaaggagcucgagcagguccgggcgggguucguggacguggacacgggcgagaucgugaaccccgccauguuccagcagguccaggagcacuucccgaaccccuggccccacuuccgcgacgaggugaagcugcggcugaacguggacgaccccgcccuccugcacagcgagaugaaccgcuucggcaccuacuccccggaggcccugaaggcccuccggccccuguucaucagccgcgcgccccagcggcgcaacagcggggccgcccacaaggacaccaucuacgcccagccggagcggcugguggcccagggcggggucacccagaaggugccccucacgucccugacccugaaggaccucgacaagcugaucgacccccaccgcaacgagaagcuguacagcgcgauccggauccgccucgagcagcacggcgggaagggcgacaaggccuuccccgccuccaacccgcugcggaagcccgacagcgagggcaaccccaccgggcccaucgugcgcggcgucaccauggugaucgacaagcuguccgggaucccgauccggggcgggaucgccaagaacgacagcauggugcgcgucgacguguucacgaaggccggcaaguuccaccucgugcccgucuacgugcaccacgcgguggccaagguccugcccaaccgggccgugguggccuacaaggacgagaccgaguggacccugaucgacgacggcuucgacuucugcuucuccauguaccccaacgaccuccugcgcaucaagcugcgcaacgccagccaccucggguacuacgcguccugcaaccggagcaccggcgccaucaaccuguggucccacgaccgcaaccagcaggucgggaaggacggcaugaucgagagcaucggggugaagacggcccugaacguggagaagcucaacaucgacguccugggcaaccgguacccggccccgcccgagaagcgccgggaccuggcguga

SEQ ID NO: 1683 - RNA, 3423 nt, Artificial Sequence
  Cas9 variant
augaagaacaugaccaaggugaacgucggccuggacguggggaucagcuccgccggcuggagcgugaucaacgccgagaccaaccagauccucgaguccgggguccgccuguucagcggcuccgacgcggacgagaacgugaaccggcgcaaccagcggcaggggcgccggcuguuccgccggcgcaagcuccggauccaggaggccaagaaguaccuggagaacguguuccagcugaaggacaucgagcccaaggacgaguggaacccguacgagauccgcguccgggcccucaacgagaaggugagcaaggaggagcuguccaucgcccugcucaacaucgugaagcaccgcggcaucagcuacgagcuggaggacgucacggacgaggagggcaccaacacccaguccuuccagagcgggcuggacuacaaccggcgccuccugaagaccaagacggugggcgagauccaguacgaccggcugcagaaguacggccaggugcgcgggcagauccagaccgaggacgggcuccugaucaacaucuuccccaccaagaacuacgucgaggagguggagcggauccuggagacccagaagaaguaccaccccgagaucgacgacguguucaucgagaagaucaucuccuucgucacgcgcaagcgggaguacuucgugggccccggcaacgagaagucccgcaccgacuacgggaucuaccgggagaacggcgagacccucgacaaccuguucgagauccugaucgggaaggacaaguucuacccggaggaguaccgcgccgcgggcagcagcuacaccgcccagaucuucaaccuccugaacgaccugaacaaccuccgcauccccacgaccgaggaccaccaccugaccaaggcccagaaggaggagaucaucaccgagcugaagaacacgucccggcucagcggcgggaugcugaagcugaucuccaaggugaccaaggcccccaaggaggagaucagcggcuaccgcaaggacgagaaggacaagcccgaccuccacucccuggcguacuaccggaagcagaagaacaugcuggagaaggaggggauccagaucgccgacuucagcgaggagcuccuggacgagcuggccaccaugaugacccucaacacggagccgggcgagauccgcaagcagcugaacaagaucaccaaccaguacgacauccugacccccgaggucaucgaggugcucgugaagaaccacaccgccuucgucgccacgagcaaccacaaguggcaccgguucucccugaagcugaugaaggaguucauccccgagcuccuggagaccagcaaggagcaguccaccauccugugcgagcgcggguucauccagaaccgggcgagcuaccucgacgagaaccaccacuucaacuacgccgagcugcgcgagaaccuguacaaccccguggugcggaaguccacgugcgagaugcucaaggucuucaccgccauccaggagaaguacccgaacauccagaacgugaucgucgagcugccccgcgagaccaacgaggacgagcagaagcggaagaucaagaagaucaacgacaacaacgccaagcgcaagaaggagauccugaaggaggcccaggcgcagagcggccuguccgaggaggcccucgaggagaagcugcugaagaccaagggccucuaccugaagcugaugcucugguacgagcaggaggggaagugcguguacagcggccaggagaucccccuguccgaccugcuccagaacaagggcggguacgagguggaccacaucauccccaucagcaucuccuucgacgaccggcugugcaacaagguccuggugcgccagcagcucaacagccagaaguccaaccagaccccguucgaguacaugacgacccacaccgacgggcaccugagcuuccacgagcugaaggagcucgugggcaagaacaagcgguucuccaaggagaagcgcgagcugcugcucgccgagaucuacagcaacgacaucgagacccggaagcgcuucaucaaccggaaccuggucgacacguccuacaccgcccgcaucgugcugaacgcccuccagcaguacaagaaggagaaccagcugagcaugaacguguccgucgugcgcggcgcgaugaccaacauccugcggaagaaggugaagcucgacaagacccgcgagaccuuccaccaccacgccaucgacgccagccugauggccgucauccccaacaucgaguucuucaaggagcggaaggaguggcugcccaagagcgccaacgaggaggugguggaggucgagguguccgaggaggagacgaugcccgagaaggaguucaaggugaagaugcgccucccggagagcuucauccaggacguccagauccugcagcggaacuccuucgcgaaggaggaggugagcgggccccagacccgcgagcggaaccugaagaucaaguucucccaccagguggaccagaagaugaaccgcaaggucgccgacgacaccaucuacggcacccggcaggcccagcucgggaaggacaagaaggaggagacguacgugaucggcaagaucaaggacaucuacaacuacgacgaguacgugcgcuucaagaagcgguacgacaagaacaaggagagcuuccugauguaccaccacgacccccagaccuucgagaagcuggaggagauccucgcccaguaccccgaguacaucgaggacgagaaggggaagaagaagaaggucuccccguucgcgcuguaccgcgaggagaacggccccgugaccaaguacgccaagaagaacaacggccccgugaucaagcagcugaaguacuacgacagcaagcucaaccggaagaucgacaucucccacaaguacagcaccaagaaccgccaggucgugcugcagucccugaagcccuaccggacggacguguaccgcaaccaggacaccggggaguacacccucgucggcaucgaccagaacgacgggaaguucgugaacggccacuacggcauccccaagagccgguacgaggagaucaaggccaacaacaagcuguccgagcacgacgaguucguguucagccuguacaagaacuccauggucaaggugaucgacgagaacggggagagcaucgugguccgcuaccucucccggagcaugccgaaccgcaagaacaacgccgagaucaagcccguggagaaguaccaguucgaggacggcgagguggucccgguguacgggaagugccggaagcagaugcagaccguguucgucaagaagggcuggacgcugcugaaggggaacaccgacauccucggcaacaccuacuucguggagaaggagagcgagaaccccaagaagaugaucgacgacaaguga

SEQ ID NO: 1684 - RNA, 3423 nt, Artificial Sequence
  Cas9 variant
augcgcgagaacggcagcgacgagcggcgccggaacauggacgagaagauggacuaccgcaucgggcuggacaucggcaucgccuccguggggugggccguccuccagaacaacagcgacgacgagcccgugcggaucguggaccugggcguccgcaucuucgacaccgcggagaucccgaagaccggggagucccuggccggcccccggcgcgccgcccggacgacccgccggcgccuccggcgccggaagcaccgccuggaccggaucaaguggcuguucgagaaccagggccucaucaacaucgacgacuuccugaagcgcuacaacauggccgggcugcccgacguguaccagcuccgguacgaggcgcuggaccgcaagcugaccgacgaggagcucgcccaggugcugcugcacaucgccaagcaccggggcuuccgcagcacccgcaaggccgagacggcggccaaggagaacggggccguccucaaggccaccgacgagaaccagaagcggaugcaggagaagggcuaccgcaccgugggggagaugaucuaccuggacgaggccuuccggaccggcugcuccuggagcgagaagggcuacauccugacgccccgcaacaaggcggagaacuaccagcacaccaugcuccgggccaugcugguggaggaggucaaggagaucuucuccagccagcgccggcuggggaacgagaaggccaccgaggagcucgaggagaaguaccuggagaucaugaccucccagcgcagcuucgaccugggcccggggaugcagcccgacggcaagcccucccccuacgccauggagggcuucagcgaccggguggggaagugcacguuccucggcgaccagggggagcugcgcggcgccaaggggaccuacaccgcggaguacuucguggcccugcagaagaucaaccacaccaagcucgucaaccaggacggcgagacgcggaacuucaccgaggaggagcgccgggcccugacccugcuccuguucacccagaaggaggugaaguacgccgccgugcgcaagaagcugggccucccggaggacauccuguucuacaaccugaacuacaagaaggcggccacgaaggaggagcagcagaaggagaaccagaacaccgagaaggccaaguucaucgggaugcccuacuaccacgacuacaagaagugccucgaggagcgggucaaguaccugaccgagaacgaggugcgcgaccuguucgacgagaucggcaugauccugaccugcuacaagaacgacgacucccggacggagcgccucgccaagcuggggcucgugcccaucgagauggagggccugcuggccuacacccccaccaaguuccagcaccucagcaugaaggcgaugcggaacaucaucccguuccuggagaaggggaugaccuacgacaaggccugcgaggaggccggcuacgacuucaaggccgacuccaagggcacgaagcagaagcugcucaccggggagaacgucaaccagaccaucaacgagaucaccaaccccguggugaagcgcagcgucucccagacggugaaggugaucaacgcgaucauccgcaccuacggcagcccccaggccaucaacaucgagcuggcccgggagauguccaagaccuucgaggagcgccggaagaucaagggggacauggagaagcgccagaagaacaacgaggacgucaagaagcagauccaggagcugggcaagcugagccccaccgggcaggacauccucaaguaccggcuguggcaggagcagcagggcaucugcauguacagcggcaagacgaucccgcuggaggagcuguucaagcccggguacgacaucgaccacauccuccccuacuccaucaccuucgacgacagcuuccgcaacaaggugcuggucaccucccaggagaaccggcagaagggcaaccgcacccccuacgaguacauggggaacgacgagcagcgguggaacgaguucgagacccgcgugaagacgaccauccgggacuacaagaagcagcagaagcuccugaagaagcacuucagcgaggaggagcgcuccgaguucaaggagcggaaccugaccgacaccaaguacaucacgaccgugaucuacaacaugauccgccagaaccucgagauggccccgcugaaccggcccgagaagaagaagcagguccgcgccgugaacggcgcgaucaccgccuaccugcggaagcgcuggggccucccccagaagaaccgggagaccgacacgcaccacgccauggacgccguggucaucgccugcugcaccgacgggaugauccagaagaucagccgcuacaccaaggugcgggagcgcugcuacuccaagggcaccgaguucguggacgcggagacgggggagaucuuccgccccgaggacuacagccgggccgagugggacgagaucuucggcguccacaucccgaagcccugggagaccuuccgcgccgagcuggacgugcggaugggggacgaccccaagggcuuccuggacacccacuccgacguggcccucgagcuggacuaccccgaguacaucuacgagaaccugcgcccgaucuucgucagccggaugcccaaccacaaggugaccggcgccgcgcacgccgacacgauccgcagcccccggcacuucaaggacgaggggaucgugcucaccaagaccgcccugaccgaccugaagcucgacaaggacggcgagaucgacggguacuacaacccgcaguccgaccugcugcucuacgaggcccugaagaagcagcugcuccuguacggcaacgacgcgaagaaggccuucgcccaggacuuccacaagcccaaggccgacgggacggagggccccgucgugcgcaaggugaagauccagaagaagcagaccaugggcgucuucguggacuccgggaacggcaucgccgagaacgggggcauggugcggaucgacgucuuccgcgugaacgggaaguacuacuucgugcccgucuacaccgcggacguggugaagaagguccugccgaaccgggccagcaccgcccacaagcccuacggcgaguggaaggugauggaggacaaggacuuccucuucucccuguacagccgcgaccugauccacaucaaguccaagaaggacauccccaucaagauggugaacggcgggauggagggcaucaaggagacguacgccuacuacaucggggccgacaucagcgcggccaacauccagggcaucgcccacgacucccgguacaaguuccgcgggcucggcauccagagccuggacguccuggagaagugccagaucgacgugcucggccacgugagcgucgugcgguccgagaagcgcaugggguucagcuga

SEQ ID NO: 1685 - RNA, 3423 nt, Artificial Sequence
  Cas9 variant
augaacggccuggugcucgggcuggacaucggcaucgccagcgucggggugggcauccuggagaagaacuccgggaagaucgugcacgccagcucccgcaucuuccccgcggccaccgccgacaacaacgucgagcggcgcaagaaccggcaggcccgccggcucaaccgccggaagaagcaccgcggcgugcgguuccaggaccuguucgaggacuacggccugcucaccgacuucagcaagguguccaucaaccugaacccguaccgccugcgggucgacgggcucaaccagcagcugacgaacgaggagcuguucaucgcccucaagaacaucgugaagcgccggggcaucagcuaccuggacgacgcguccgaggacgggggcaccgugagcuccgacuacgggaaggccgucgaggagaaccgcaagcugcucgccgagaagacccccggccagauccagcuggagcgguucgagaaguacggccagcugcgcggggacuucaccgugguggagaacggcgagaagugccggcucaucaacgucuucagcacguccgccuacaagaaggaggcggagcgcauccugcggaagcagcaggacuucaacaaccagaucaccgacgaguucaucgaggacuaccugaagauccucaccgggaagcgcaaguacuaccacggccccggcaacgagaagucccggaccgacuacgggcgcuacacgacccacaaggacagcaagggcgaguacgugacccuggacaacaucuucggggugcugaucggcaagugcaccuucuaccccaacgaguaccgcgccagcaaggccuccuacacggcccaggaguucaaccuccugaacgaccugaacaaccucaccgucccgaccgagaccaagaagcugagcgaggagcagaagaagacgaucaucgaguacgccaaguccgcgaagacccugggggccagcacccuccugaaguacaucgccaagaugaucgacaccuccguggaccagauccggggcuaccgcguggacgucaacaacaagcccgagauccacacguucgagguguaccggaagaugcagagccuggagaccaucagcgugggcgagcucucccgcaacguccuggacgagcuggcccacauccucacccugaacaccgagcgggaggggaucgaggaggccaucaacacgaagcugaaggacagcuucucccaggaccaggugcucgagcuggugcaguuccgcaagaacaacagcucccuguucagcaagggcuggcacaacuucucccucaagcugaugauggagcugauccccgagcucuacgagaccagcgaggagcagaugaccauccugacccggcuggggaagcagaaguccaaggagacgagcaagcgcaccaaguacaucgacgagaaggagcucaccgaggagaucuacaaccccgucguggcgaaguccguccggcaggccaucaagaucaucaacgaggccaccaagaagcacggcaucuucgacaacaucgugaucgagauggcccgcgagaacaacgaggaggacgccaagaaggacuacaucaagcggcagaaggcgaaccaggacgagaaguacgccgccauggagaaggccgccuuccaguacaacgggaagaaggagcugccggacaacaucuuccacggccacaaggagcuggcgacgaagauccgccuguggcaccagcagggcgagaagugccucuacaccggcaagagcauccccaucuccgaccugauccacaaccaguacaaguacgagaucgaccacauccugccccucagccuguccuucgacgacagccuguccaacaaggugcucguccuggccaccgccaaccaggagaaggggcagcggacccccuuccaggcccuggacagcauggacgacgcgugguccuaccgcgaguucaagagcuacgugaaggagagcaagcuccuggggaacaagaagaaggaguaccugcucacggaggaggacaucuccaagaucgaggugaagcagaaguucaucgagcggaaccuggucgacacccgcuacagcucccggguggugcugaacgcccuccaggacuucuacaagaaccacaacuucgacaccaccaucagcgucgugcgcggccaguucaccucccagcugcggcgcaagugggggcuggagaagucccgcgagacguaccaccaccacgccguggacgcccucaucaucgccgcgagcagccagcugcggcuguggaagaagcagaacaacccgcucaucgccuacaaggagggccaguucgucgacucccagaccggcgagaucaucagccugaccgacgacgaguacaaggagcugguguucaaggcccccuacgaccacuucguggacacccucuccagcaagacguucgaggacuccauccuguucagcuaccaggucgacuccaaguucaaccgcaagaucagcgacgccaccaucuacgccacccggaaggcgaagcuggacaaggagaagaaggaguacaccuacacgcucgggaagaucaaggacaucuacucccugggcaccaagacccccagcaagaccggguucuacaaguuccuggaccucuacaacaaggacaagagccaguuccugauguuccagaaggaccgcaagacgugggacgaggugaucgagaagaucauggagcaguaccggcccuucaaggaguacgacaaggccggcaagcugguggacuucaacccguucgagaaguaccgccaggagaacggccccauccggaaguacuccaagaaggggaacggccccgagaucaagagccucaaguacuacgacauccugcuggggaagcacaagaacaucacccccgagggcucccgcaacaccgucgcccuccugagccugaacccguggcggaccgacguguacuacaacauggagacgaagaaguacgaguuccucgggcugaaguacgccgaccugcccuucgaggagggcggcgccuacgggaucuccaccgagaccuacaacgagcuccgcgagaaggagggcaucgggaagaacagcgaguucaaguucacccuguacaagaacgaccugauccucaucaaggacacggagaccaacugccagcaguucuuccgguucuggucccgcaccggcaaggacaaccccaagagcuucgagaagcacaagaucgagcugaagcccuacgagaaggcgaaguucgagaagggggaggagcuggaggugcucggcaaggucccgcccuccagcaaccaguuccagaagaacaugcagaucgagaaccuguccaucuacaaggugaagaccgacgugcugggcaacaagcacuucaucaagaaggagggggacaagcccaagcucaaguucuga

SEQ ID NO: 1686 - RNA, 3423 nt, Artificial Sequence
  Cas9 variant
augaacggccuggugcucgggcuggacaucggcaucgccagcgucggggugggcauccugaagaaggacaucggggagaucauccacaccaacucccgccucuucagcgccgcgaccgccgacuccaacaucgagcggcgcggccaccggggcgggaagcgccugacgcggcgcaagaagcaccggagcauccgccugcacgaccucuucgaggacuucggccugcugaccgacuucuccaaggugagcaucaaccucaaccccuaccagcugcggguccaggggcuggacaaccagcucaccaacgaggagcuguucaucgcccugaagaacaucgugaagcgccggggcaucuccuaccucgacgacgccagcgaggacgggggcaccguguccagcgacuacggcaaggccgucgaggagaaccgcaagcugcuggcggagcagacgccggggcagauccagcucgaccgguucgagaaguacggccaggugcgcggggacuucaacguggucgagaacggcgagaagcggcgccugaucaacguguucaccaccuccgccuacagcaaggaggccgagcggauccugcgcaagcagcaggaguucaacaagaagaucaccgacgaguucaucgaggacuaccucacgauccugaccggcaagcggaaguacuaccacgggcccggcaacgagaagucccgcaccgacuacgggcgguacaccacgaagaaggaccccgagggcaaguacaucacccuggacaacaucuucgggauccucaucggcaagugcaccuucuaccccgacgaguaccgcgccagcaaggcguccuacaccgcccaggaguucaaccugcugaacgaccucaacaaccugacggugccgaccgagaccaagaagcugagcgaggagcagaagaagaccaucaucaaguacgccaagacggccaagacccucggcgccuccacccugcugaaguacaucgcgaagcucaucggggccagcgucgaccagauccacggcuaccgcaucgaccccaacaagaagcccgagaugcacaccuucgagacguaccggaagaugcagucccuggagaccaucagcguggaggagcugccccgcaaggugcucgacgagcuggcccacauccugacccucaacaccgagcgggaggggaucgaggaggccaucaacgccacgcugaaggacaccuucagccaggaccagguccuggagcucgugcaguuccgcaagaacaacuccagccuguucuccaagggcuggcacagcuucucccugaagcucaugauggagcugaucccggagcuguacgagaccagcgaggagcagaugaccauccucacgcggcuggggaagcagaaguccaaggagaccagcaagcgcaccaaguacaucgacgagaaggagcugaccgaggagaucuacaaccccguggucgcgaaguccgugcggcaggccaucaagaucaucaacgaggccacgaagaaguacggcaucuucgacaacaucgugaucgagauggcccgcgagaacaacgaggaggacgccaagaaggaguacaucaagcggcagaaggcgaaccuggacgagaagaacgccgccauggagaaggccgccuuccaguacaacggcaagaaggagcuccccgacaacgucuuccacgggcacaaggagcuggcgaccaagauccgccuguggcaccagcagggcgagaagugccucuacaccgggaagaacauccccaucagcgaccugauccagaaccaguacaaguacgagaucgaccacauccugccgcucucccugagcuucgacgacucccugagcaacaaggugcucgugcuggccaccgccaaccaggagaagggccagcggacccccuuccaggcccuggacuccauggacgacgcguggagcuaccgcgaguucaaguccuacgucaaggacagcaagcuccuggggaacaagaagaaggaguaccugcucacggaggaggacaucuccaagaucgaggugaagcagaaguucaucgagcggaaccuggucgacacccgcuacagcagccggguggugcugaacgcccuccaggacuucuacaaggagcaccaguucgacaccaccaucuccgucgugcgcggccaguucacgagccagcugcggcgcaaguggggccuggagaagucccgggagaccuaccaccaccacgccguggacgcccucaucaucgccgcgagcucccagcugcgccuguggaagaagcagaacaacccccucaucagcuacaccgaggggcaguucgucgaccaggugaccggcgagaucaucucccugagcgacgacgaguacaaggagcugguguucaaggcccccuacgaccacuucgucgacacgcucaaguccaagaaguucgaggacagcauccuguucuccuaccagguggacagcaaguacaaccgcaagaucuccgacgccaccaucuacgccacccggaaggccaagcuggacaaggagaacaaggaguacaccuacacgcucgggaagaucaaggacaucuacgcgcugggcaccaagagcccguccaagaccggcuucuacaaguuccuggaccucuacaacaaggacaagagccaguuccugauguuccagaaggaccgcaagaccugggacgaggugaucgagaagaucaucgagcaguaccggcccuucaaggaguacgacgagaacgggaaggaggucgacuucaaccccuucgagaaguaccgcaucgagaacggccccauccggaaguacuccaagaaggggaacggcccggagaucaagagccugaaguacuacgacaaccuccuggggaaguucguggacaucacgcccagcgaguccaagaaccccguggcccugcucagccugaaccccuggcgcaccgacgucuacuacaacaccgagaccuccaaguacgaguuccugggccucaaguacgccgaccugugcuucgagaagggcggggccuacggcaucagcgaggugaaguacaacaagauccgggagaaggaggggaucggcaaggaguccgaguucaaguucacgcuguacaagaacgaccucauccugaucaaggacaccgagaccaacugccagcagaucuuccgcuucuggagccggaccgggaaggacaacccgaaguccuucgagaagcacaagaucgagcugaagcccuacgagaaggcccgcuucgagaagggcgaggagcucgaggugcugggcaaggucccgcccagcuccaaccagcugcagaagaacaugcagaucgagaaccucagcaucuacaaggugaagacggacgugcuggggaacaagcacuucaucaagaaggagggcgaggagcccaagcugaaguucuga

SEQ ID NO: 1687 - RNA, 3423 nt, Artificial Sequence
  Cas9 variant
auggaggagaacuuccaguaccgcaucggccuggacaucgggaucaccagcgugggcugggccguccuccagaacaacucccaggacgagcccgugcggaucaccgaccugggggugcgcaucuucgacgucgccgagaacccgaagaacggcgacgcgcuggccgcgccccggcgcgacgcccggacgacccgccggcgccuccggcgccggcgccaccggcuggagcgcaucaaguuccugcuccaggagaacgggcugaucgagauggacagcuucauggagcgguacuacaagggcaaccugcccgacguguaccagcuccgcuacgagggccuggaccggaagcugaaggacgaggagcucgcccaggugcugauccacaucgccaagcaccgcggguuccgguccacccgcaaggccgagaccaagggcaaggagggcggggccguccugaaggccacgaccgagaaccagaagaucaugcaggagaagggguaccggaccgugggcgagaugcucuaccuggacgaggcguuccacaccgagugccuguggaacgagaagggcuacgugcucacgccccgcaaccgcccggacgacuacaagcacaccauccugcggagcaugcuggucgaggaggugcacgccaucuucgccgcccagcgcgcccucgggaacgagaaggcgaccgaggagcuggagaacgccuacguggagaucaugaccucccagcggagcuucgacaugggccccgggcugcagcccgacggcaagcccuccccguacgccauggagggcuucggggaccgcgucggcaagugcacguucgagaaggacgaguaccgggcccccaaggccaccuacaccgcggagcuguucguggcccuccagaagaucaaccacaccaagcugaucgacgaguucgggacgggccgcuucuucaccgaggaggagcggaagaccaucaucgaccuccugcugagcgggaaggagcucaaguacggcaccauccgcaagaagcugaacaucgaccccucccugaaguucaacagccucaacuacuccgccaagaaggagggcgagacggaggaggagcgggugcgcgacaccgagaaggccaaguucgccagcauguucuggaccuacgaguacuccaagugccugaaggaccggaacgaggagaugaccgucgggcagaaggcggaccugcucgaccgcaucggcgagauccugacggccuacaagaacgacgacagccgguccagccgccuggaggaccucgggcugucccgggaggagaucgacggccugcucgagcugagccccgccaaguaccagcgcgugucccugaaggccaugcggaagaugcagccguaccucgaggacgggcugaucuacgacaaggccugcgaggcggccggcuacgacuuccgcgcccugaacgacggcaacaagaagcaccuccugaagggggaggagaucaacgccaucgugaacgacaucaccaaccccgucgugaagcggagcgugagccagaccaucaaggucaucaacgcgaucauccagaaguacggcagcccccaggccgugaacaucgagcuggcccgcgagauguccaagaacuuccaggaccgcaccaaccuggagaaggagaugaagaagcggcagcaggagaacgagcgcgccaagcagcagaucaucgagcucgggaagcagaaccccacgggccaggacauccugaaguaccggcuguggaacgaccagggcggguacugccucuacuccggcaagaagaucccgcuggaggagcuguucgggggcggguacgacaucgaccacauccuccccuacagcaucaccuucgacgacuccuaccgcaacaaggugcuggucaccgcccaggagaaccggcagaagggcaaccgcacccccuacgaguacuucggcgcggacgagaagcacugggaggacuacgaggcccgggugcgccugcucguccgggacuacaagaagcagcagaagcugcugaagaagaacuucacggaggaggagcgcaaggaguucaaggagcggaaccucaacgacaccaaguacaucacccgcgugguguacaacaugauccggcagaaccuggagcuggagcccuucaaccacccggagaagaagaagcaggucugggccgugaacggggccgugaccagcuaccuccgcaagcgguggggccugaugcagaaggaccgcuccacggaccggcaccacgccauggacgcggucgugaucgccugcugcaccgacgggaugauccacaagaucagccgcuacaugcagggccgggagcuggccuacucccgcaacuucaaguuccccgacgaggagaccggggagauccucaaccgggacaacuucacccgcgagcagugggacgagaaguucggcgugaaggucccccugcccuggaacagcuuccgcgacgagcuggacauccggcuccugaacgaggacccgaagaacuuccugcucacccacgccgacgugcagcgcgagcuggacuaccccggcuggauguacggggaggaggagucccccaucgaggagggccgguacaucaacuacauccgcccccuguucgugagccggaugccgaaccacaaggucacgggguccgcccacgacgcgaccauccgcagcgcccgggacuacgagacccgcggcguggugaucaccaaggucccccucacggaccugaagcugaacaaggacaacgagaucgagggguacuacgacaaggacuccgaccggcuccuguaccaggcccuggugcgccagcuccugcugcacggcaacgacggcaagaaggccuucgcggaggacuuccacaagcccaaggccgacgggaccgagggcccggugguccggaaggugaagaucgagaagaagcagaccagcggggugaugguccgcggcgggaccggcaucgccgccaacggcgagauggugcggaucgacguguuccgcgagaacgggaaguacuacuucguccccguguacacggccgacgugguccggaaggugcuccccaaccgcgcggccaugaacggcaagaucgccuccgacuggaagaccauggaggacaacaacuucguguucagccuguacucccgggaccugauccacgucaagcgcaagaaggccauccccaccauccucagcagcggggccaccuucgagcaggaggaguucuacgcguacuucacgggcgccgacaucuccaccgugagcaucgccgggaucuccaacgacaacagcuucaaguuccggggccugggcauccaggggcuggagaucuucgagaagugccagguggacauccucggcaacaucuccgucgugcgccacgagaaccgccagggguuccacuga

SEQ ID NO: 1688 - RNA, 3426 nt, Artificial Sequence
  Cas9 variant
auguacagcaucggccuggacaucgggaucgccuccgugggcuacagcgucaucgagaccaacuccgggcgcaucguggagcucggcgcccggaucuucgaggcgcgcaacagcgacaacaacaaggaccggcgcgacuuccgcgggggccggcggcugauccgccggcgcaagacccggcuggacgacgccaagcgcuaccucgacgaccagggcuucaagaacgacaagucccugaucaacgugugccccuacagccugcgggucaaggggcucacggaggagcuguccaagagcgagauccgcaaggugauccugcacauccucaagaagcggggcguguccuaccugagcuccgaggaccuggacaccagcuccgucgacaacaaggacagcuucaagcaggccgugaccaagaaccuccgccagcuggacgacaagaccccggggcagauccaguacgagcggcugcaggaguccggccgcgugcggacggggaucaaccagaacggccaguaccagcucaacgucuucgacguggccagcuacgccaaggagcugaagcugauccucgagacccagcagcaguaccaccaggagaucgacgaccacuuccuggacuucuucaccaaggacggcuaccgcgaggacgcggggcugaucuaccggaagcgccccuacuacgacggccccgggaacgccgcccagaacuccagcuacggccgcugggccaacuaccagguggacggcaagcccgcggagaacaucuucgaccagcucaucgggaaggacuucaccggcaagauccgggccuccaaccuggggccgagcgcccagaaguucaaccugcucaacgaccugaacaaccugcgcaucacgacccgggaggaggagaagcucaccuucgaggagaagcaggagauccuggagguccuggagaacgaccgccccaagaccuucggcccccggaacaucgccaagaugcucaagguggacauggacgacaucaagggguggcgccugaacagcuccgacaagcccgagauccacacgaugaaggaguacaacgacaugcggcuggugcucgaggccggcggcuucgacaucaaggcgaucgaccuggaccacaucgaggagaucgccagccugaucacccucaacaccgagcgcgaggccuucgagcugucccugagcaacgagaucgacaacaaccucaagcaguuccuggucgagaacuucaacgcccugcggaagugcaagccgaacaacuccuggcacagcuucuccaaggagaaccuccagcgccugaucaccgagcuggagcacacgagcgacgagcagaacaccauccucgagcggcuggggcugaaguucgaccuccgcuccaaguacagcgaccgggacacccugcccauccacgaggugcuggaggagaucuacaaccccaccguguccaagagcguccgccagacguuccgggugcugaacgcccucgugaagaaguacggcaaggagaacaucgacuacgucaccaucgagaugccccgcgacaagaacgaggacgaccagaagaagaccauccgggagauccagaaggugaacaagaaccgcaaggacaaguccaaggaguacuuccugaagaaguccggguggagcgaggagaaguucgaggagaagcugcggaccagccgccgcuucgcguccaagcucuacuacuucuacgagcaggacggccugugcgccuacacggggcagcagauccagccggaggaccugcucaccgagcggguggaggucgaccacaucaucccccugagcgugucccuggacgacagcaucaacaacaagguccucgugaccagcgaggccaaccagaagaagggccagcgcucccccuacgacgccuucaugagcggcgacuucuccaaguaccggaccuacgacgaguacaaggccugggugcugagcaacaaguacaagaaguacaagaaggcgcugcuccuggaggagcgcaacaucuucgaccccgagcuggccaagaaguuccggcagcgcaaccucaacgacacgcgguacgccucccgcaucguccugaacgccgugcagagcuucuucuacaagaccgacaccaagacccggguggucaacggggccuucacgcacacccugcgcaagaaguggaaccucgcggacaaggaccgggagacccaccaccaccacgccaucgacgccacccugguggccgugacgccguucgucaaggcggagcgcuacgaguacuacaaggacuccgagggcaaggccagcaugguggacaccgugaccgggaccaucauccccuacuccgaguacaagaagaagaaccuguacgaccggagcaacuaccuccugauguucggcaacgaguccaccaucaaccaggagaaggaggacaagagcgccgaguucauccgcaaccugauccccgccaagaucuaccccgagaucaaguucucccaccaggucgaccgcaagagcaaccggcggcucuccgacgccacgaucuacagcacccgcuccuacaccguggagaaggggcggggcaagaacaagcgcgaggugaucgagcgggacaucaucggcaagaucaaggacaucuacaccgcggacggguacgccgaguacgucaaguacaaggacagccugcuggugaaggagaucgacgagaagacguucgagaagcucgaggccaucaucgaggaguucagcgacaccguggaggucaccgaccagcagggcaaggugaagaagguguccaagagcccguuccugcaguacugcgagaaguacgacguccccggggugaccaaguacuccaagaagaacaacggccccgugauccgcagccugaaguaccgcuacacgaagcuccggucccacaucgacaucagccccaagaacuccaagaacaccgucgcccugcugacccucgccccguggcgcaccgacguguacuacagccaggagacggcguccuaccaccuccugggccugaaguacaucgaccugagcuuccgggacgggggcuacggggugucccgcaagcgguacgaggagaucaagaagaacgagcgcauccccgaggacggcgaguucaaguucagccuguacaagaaggacuacaucgagaucgaguucgacaagaagauccuccccgggcuguaccagucccgggacgucagcgcccgcaacaaguucuccaugaagcccaucgacaaggcccaguggaccagcaaggaggacgugcugauguucggcaacgugaaggccuccggcgucuucgagaagacccucaagaagaacuacgugcugcggaaguaccacguggacguccuggggaacaaguucgaggugaaggacgagauccucaaggacauccuggaguga

SEQ ID NO: 1689 - RNA, 3429 nt, Artificial Sequence
  Cas9 variant
auguacagcgugggccuggacaucgggaucgccuccugcggcuacagcaucaucaacgacgucaacgggaacaucguggagcucggcacccugcuguucaagucccgcaacagcgacaacaacgaggagcggcgcaccaaccgggggucccgccggcucaucaaccgccggcgcacgcggcuggacgacggcaagaagcugcucgccgagaagggcuucaagcaggacagcaagcugaagcacgugugccccuacgagcugcgcgucaaggggcuccacgagaagcugacccagggcgagaucuacaagguggugcugcacauccucaagaagcgggggaucuccuaccuggacgagagcgacgagaacuccagcggcaucgacggggcguccuacaaggaccaggucaaccugaaccucaaccugcagaaggagcugaccccgggccagauccagcucaagcgccugaaggagaacggccggaucaagagcggggugaccuucgagaacggcuaccagcugaacguguucuccgucagcgccuacgccaacgagcucaacaagauccugacgaagcaguccgaguacuacagcgagaucgaccagaucuggaucgaccgcuucaccaagaacggguaccggaaggaggccggccugguguaccgcaagcggcccuacuacgacggccccgggaacgagaagaacaacuccaucuacggccgcugggccaacuucaaggaggacgggcaccccaaggagaacaucuucgaccagcucaucggccuggacagcguggacuccacccagguccgggcgagcgccagcacccugacggcccagaaguacaaccuccugaacgaccugaacaaccucaccaucaucgaggacgaccgcaaguucaccaccgacgagaagguguccaucaucaacuaccugaugacgcaggacaucacccgguucgggccgaaggagcuggccaaguucuaccagcucgagguggaccagauccgcggcuggcgcaucgacaacaagggcaaccccgagauccacagccugaaggucuaccgggacuggaagaagaucuucaacaccuccagcaucgaccugaccuccauccagacgugggugguggacgagcucgcgaacgucaucacccugaacaccgagauccccagcacccuggccacgcucaagaucaagauccccgacaucgaccagcagauccugaacuucguggagaacaacuucuacgagcugaagaagaagaccuccaagaacagcuggcacuccuucagccucaagacccugaacauccugaucccggagcuccugaacaccuccgaggagcagaacacgauccuggagcgccucaaccugaaguucgaccugaagaacaaguacgccgagaagaaccagauccccgugaaggagcugcucgagcagaucuacaaccccaccgucaccaagagcgugcaccaguccaucaagcuguucaacgagaucaucgagaaguacgggaagaacaacaucagcuacgugaccaucgagaugccccgggacaagaacgaccaggaccagaaggacacgaucaagcgcaucaacaagcugaacuccgagcggaagaacgacagcgagaaguacuuccucgagcgcuccggcugggacaccauccgguucgagagcgcccugaagaagccgcgcuucgccgagaagcuccuguucuacuacgagcagaaggggaagugcgcguacuccggccaggacauccuggccgagagccugcucaacgagagcugcgaggucgaccacaucaucccccuguccaucagcuucgacgacuccauccacaacaaggugcuggucaccgccagcuccaaccaggagaaggggcagcggacccccuacauggccuucaucgacggcgccaagcucggccagagcugggacgacuucguggcgugggugaacuccugcggguuccaccgcaagaagguccagaaccugcuguacgaggagaacaucuucaaccccgacgugcagcggggcuucgugagccgcaaccucaacgacacgcgguacgccucccgcaucguccugaacgccauccagagcuucuucuacaagcagaaggaccugaccaaggugaagguggucaacggguccuucacccacacccuccggaagaaguggggcagcucccuggacaagaaccgcgacacguaccaccaccacgccguggacgccacccugugcgcggugaccccguucaucaacaucgucaaguacgaguucuucgaggaggacgggaucaaguacaugguggaccucaccaccggcgagaagguggccuacagcgacuacaagaagaugaaguucuacgacaagcgggccuacguccccaucugggacggcuucaucaagcagcugacgcccgccaaccuguaccccaagaucaaguucucccaccagguggacagcaaguggaaccgcaagaucuccgacgccaccaucuacagcacccggaagaucguggagaccaagaucaacaagaagggggucgcgaaggagacggugaaggacaucgugaucgacaagaucaaggacaucuacaccccggagggcuggcgcaaguucaaggagaagcaggacaagcuccugaugaagaacuucgacgagaagaccuacaacaagcugaucaagaucgccaaggaguaccccgagaagaaggagguccagaccagcaacgggaaggugucccucguggaggucagccccuucaagauguacugcgaggagcagaacgugcccgccauccgcaaguacuccaagaagggcaacggcccguacauccggagccugaaguucuacgacaaggagcuggggaagcacaucaacaucacgaaggacuccuacggcaacgacaucgagcgcaccauccggaacaagaagaucauccucaagaaccagaacagcuggcgcaccgacguguacuacaacuccgucaacaacugcuacgagcugcuggggaucaaguacugccaccucaaguucuaccggggcaaguacgggauccccaagagcaucuacgacgagcugaagaaggaggacgagaucuccagcgaguccguguucaaguucagccuguaccgccacgaccgggugcgcuucgagaaggacggcgaguacaucgaggcccucuucggcuccaagaacgagagcaacaagaacuaccuggagcugucccccaucgacaagaacaaguggcucagcaaggagaacgucaaguucuucggggagguggcggccuccggccgguucaucaaggggcugaagcccggcaucaaggugaucaagcagagcaccgacuacauggggcacgucuacgccauccaccaggagaagcugaaguucgugcucuccgacgccuga

SEQ ID NO: 1690 - RNA, 3435 nt, Artificial Sequence
  Cas9 variant
augaccagcaagcaggagaagcacggcgcccugaccuucgggcucgacaucggcaucgccuccguggggugggcgguccugggcgagagccgcaucguggaccugggggugcggugcuucgacaaggccgagacggccaaggagggcgagucccucaaccugacccgccggauggcccgccugcuccggcgccggcugcgccggcgcgccuggcggcugaccaagcucgcgcgccugcugaagcgggagggccucaucgccgacgccaaccuguucaagcacaagaucgagaagaacacccccguccccaagagcuccuggcagcugcgcguggacgggcucgaccggcagcugaacgccgaggagugggcgcgcgugaucuaccaccugugcaagcaccggggcuuccacuggaucagccgcgccgaggagaaggccgccgagggggacuccaagggcgagggcgggaaggucaagcagggccucgccgggacgaagaagcugaugcaggagaaguccuaccggaccgcggccgagauggugcuggccgaguuccccgacgcccagcgcaacaagcagggcgacuacagcaaggcccucagccggauccugcugggggacgagcucaaggcgcuguucgagcaccagcgcaagcugggcaaccccguggccaccgagaagcucgaggccgccauccugggcaacggggacaagaagugcggccuguucugggcccagaaccccgcgcucgccgggaacaagcugcuggagaugcucggccgcugcaccuucgagaagaccgggggcgacgacggcaagggggaguaccgggccccgaaggccuccuucagcgccgagcgccacgucuggcugacgcaccugaacaaccuccggaucgugguggacggcaccacccgcccccugaacgaggcggagcggcgcgucgcccugcccaugcccuaccagcaggccggggaccucuccuacaagcagcugggcggggcccugaucaaggagggcuuccuccagaaggacggcuucaaguucgcggggcugccguaccccacgaagcaggccagcgaggagaaggccaaggaccccgagaccuccgugcugugcaagcuccccgccuggcacacccugcggaagacccuggagaagcacggccucgagagcgaguggcagaagcuguccacggacgcccuggacgggaagccgcagcugcucgacaacaucgcgugggugcugagcgucuacaaggacgacgacgaggugaagaccgagcugggcaagcucaaccugcccaacaccgagaagaugaucgacgcccugcucgacauccgcuucgacaaguucuccaaccugagccugaaggcccucagcaagaucgugcccuucauggagcaggggcagcgguacgacgaggccgucgccaacauccccgaguacggccaccacucccagcugcacaaggugggcgcgggggagcacaaguaccugccgcccuucuacaaggagcgcgacaagaccggccggaugguguucaacgacgacauggacaucccccgcaaccccgucgugcuccgggcccugaaccaggcccgcaagguggucaacgcccugaucaaggaguacgggagcccgcacgaggugcacaucgagauggcccgggaccucucccgcccccuggacgagcggcgcgacaucgagaagcugcagaaggaguucggcgagcggaacaagaaggacaaggagcuguucgcgcaggacuucaacaucgucggcacggugaaggggaagcaguucgagaaguaccagcucuaccgcgagcagcagggcaagugcaucuaccccagcauggacgagaagcaggggaucugcugcuacucccugaagccccucgaccugcaccgcgugcuguacgaggagggcuacgccgagaucgaccacgcccucccguacagccgguccuucgacgacagcaagaacaaccgcguccuggugcuggccaaggagaaccgggacaaggggaaccgcacccccuucgaguaccucggcgacaaggacaacuccgagcccuggcggcaguucguggcguucgucgagggcaacaaggccuaccgccuggccaagcggagccgccugcuccggaaggacuucggggacaaggaggccaaggaguuccgcgagcggaaccugaacgacacccgcuacaucugcaaguucuucaagaacuacguggagcaguaccugcagcuccacgaggacuccgaggccaagcggugcgugguccugagcggccagaugaccuccuuccugcgcgcgcggugggggcucgugaaggugcgcggcgacagcgaccggcaccacgcccuggacgccgccgucguggccgcgugcucccacgggauggugaagcgccugagcgacuacucccggcgcaaggagcucgagcagguccgggagggcuucguggacguggacacgggcgagaucgucaaccccgccauguuccagcagguccaggagcacuucccgaaccccuggccccacuuccgcgacgaggugaagcugcgccugagcaucgacgacccgacccuccugcgguccgagauggagaaguucgggaccuacacccccgagagccuggaggcccuccgcccccuguucgugagccgggccccgcagcgccggaacuccggcgccgcgcacaaggacacgaucuacgcccagccgaagcgccugguggcccagggcggggugacccagaaggucgcccucagcucccugacccugaaggaccucgacaagcugaucgacccccaccggaacgagcgccuguacgcggccauccgggcccgccucgagcagcacgggggcaagggcgacaaggccuuccccgccagcaacccccugcggaagccggacuccgaggggaaccccaccggccccaucgugcgcggggugacgauggucaucgacaagcugagcggcauccccauccgcgggggcaucgcgaagaacgacuccauggugcggguggacgucuucaccaaggccaacaaguuccaccucgugccgguguacguccaccacagcgugcugggccugcccaaccaggccaucgucgggggcaaggaggaguccgaguggacccagaucgacgacagcuucgacuggcacuucuccaucuaccccaacgaccucauccgggugacccugaagcaggaggggcgcuucggcuacuacgccggcugcgaccggagcacggccgcgauccaccugugggcccacgaccgcaaccagcaggucgggaaggacggccucauccgguccaucggggugaagaccgcccugagcaucgagaaguucaacguggacgugcugggcaaccgcuaccccgccccgcccgagaagcgccgggaccucgccuga

SEQ ID NO: 1691 - RNA, 3435 nt, Artificial Sequence
  Cas9 variant
augaccagcaagcaggagaaccugggcgcccucaccuucgggcuggacaucggcaucgccuccguggggugggcgguccugggcgagaaccgcaucaucgaccucggggugcggugcuucgacaaggccgagacggccaaggagggcgagagccugaaccugacccgccggauggcccgccuccugcggcgccggcugcgccggcgcgccuggcggcucaccaagcuggcgcgccugcucaagcgggagggccugaucgccgacgccaaccuguucaagcacaagaucgagaagaacacccccgugccgaaguccagcuggcagcuccgcgucgacgggcuggaccggcagcugaacgccgaggagugggcgcgcgugaucuaccaccucugcaagcaccggggcuuccacuggaucucccgcgccgaggagaaggccgccgagggggacagcaagggcgagggcgggaaggugaagcagggccuggccgggacgaagaagcugaugcaggagaaguccuaccggaccgcggccgagaugguccucgccgaguuccccgacgcccagcgcaacaagcagggcgacuacagcaaggcccugucccggauccugcucggggacgagcugaaggcgcuguucgagcaccagcgcaagcucggcaaccccguggccaccgagaagcuggaggccgccauccugggcaacggggacaagaagugcggccucuucugggcccagaaccccgcgcuggccgggaacaagcugcucgagaugcugggccgcugcaccuucgagaagaccgggggcgacgacggcaagggggaguaccgggccccgaaggccagcuucuccgccgagcgccacguguggcugacgcaccucaacaaccugcggaucgucguggacggcaccacccgcccccugaacgaggcggagcggcgcguggcccuccccaugcccuaccagcaggccggggaccugagcuacaagcagcugggcggggcccucaucaaggagggcuuccugcagaaggacggcuucaaguucgcggggcugccguaccccacgaagcaggccuccgaggagaaggccaaggaccccgagaccagcguccucugcaagcugcccgccuggcacacccugcggaagacccucgagaagcacggccuggaguccgaguggcagaagcugagcacggacgcccuggacgggaagccgcagcuccuggacaacaucgcgugggugcuguccguguacaaggacgacgacgaggucaagaccgagcucggcaagcugaaccugcccaacaccgagaagaugaucgacgcccuccuggacauccgcuucgacaaguucagcaaccugucccucaaggcccugagcaagaucgugcccuucauggagcaggggcagcgguacgacgaggccguggccaacauccccgaguacggccaccacagccagcugcacaaggucggcgcgggggagcacaaguaccucccgcccuucuacaaggagcgcgacaagaccggccggaugguguucaacgacgacauggacaucccccgcaaccccgugguccugcgggcccugaaccaggcccgcaagguggugaacgcccucaucaaggaguacggguccccgcacgagguccacaucgagauggcccgggaccugagccgcccccuggacgagcggcgcgacaucgagaagcuccagaaggaguucggcgagcggaacaagaaggacaaggagcuguucgcgcaggacuucaacaucgugggcacggucaaggggaagcaguucgagaaguaccagcuguaccgcgagcagcagggcaagugcaucuaccccuccauggacgagaagcaggggaucugcugcuacagccucaagccccuggaccugcaccgcgugcucuacgaggagggcuacgccgagaucgaccacgcccugccguacucccggagcuucgacgacuccaagaacaaccgcgugcugguccucgccaaggagaaccgggacaaggggaaccgcacccccuucgaguaccugggcgacaaggacaacagcgagcccuggcggcaguucguggcguucguggagggcaacaaggccuaccgccuggccaagcggucccgccuccugcggaaggacuucggggacaaggaggccaaggaguuccgcgagcggaaccugaacgacacccgcuacaucugcaaguucuucaagaacuacgucgagcaguaccuccagcugcacgaggacagcgaggccaagcggugcguggugcuguccggccagaugaccagcuuccuccgcgcgcggugggggcuggucaaggugcgcggcgacuccgaccggcaccacgcccuggacgccgccguggucgccgcgugcagccacgggauggugaagcgccucuccgacuacagccggcgcaaggagcuggagcagguccgggagggcuucguggacguggacacgggcgagaucgugaaccccgccauguuccagcagguccaggagcacuucccgaaccccuggccccacuuccgcgacgaggugaagcugcgccucuccaucgacgacccgacccugcugcggagcgagauggagaaguucgggaccuacacccccgagucccucgaggcccugcgcccccuguucgugagccgggcgccccagcgccggaacagcggcgccgcccacaaggacacgaucuacgcccagccgaagcgccucgucgcccagggcggggugacccagaagguggcccuguccagccugacccucaaggaccuggacaagcugaucgacccccaccggaacgagcgccucuacgcggccauccgggcccgccuggagcagcacgggggcaagggcgacaaggccuuccccgccuccaacccccugcggaagccggacagcgaggggaaccccaccggccccaucguccgcggggugacgauggugaucgacaagcucuccggcauccccauccgcgggggcaucgcgaagaacgacagcaugguccggguggacguguucaccaaggccaacaaguuccaccuggucccgguguacgugcaccacuccguccugggccuccccaaccaggccaucgugggcgggaaggaggagagcgaguggacccagaucgacgacuccuucgacuggcacuucagcaucuaccccaacgaccugauccgggugacccugaagcaggaggggcgcuucggcuacuacgccggcugcgaccgguccacggccgcgauccaccucugggcccacgaccgcaaccagcaggucgggaaggacggccugauccggagcaucggggugaagaccgcccuguccaucgagaaguucaacguggacguccucggcaaccgcuaccccgccccgcccgagaagcgccgggaccuggccuga

SEQ ID NO: 1692 - RNA, 3438 nt, Artificial Sequence
  Cas9 variant
augaagaccauccuggggcucgaccuggggaccaacagcaucggcugggcccuggugaaggagacggagaacuccaacgagaaguccgagaucaucaagcucgggguccgcgugaacccccugaccguggacgagaagaccaacuucgaggccggccggccgcugagcaccaacgcggaccgcacggccaagcggagcgcccgccggaaccuccagcgcuacaagcugcggcgcaagaaccugaucgaccuccugaucaagcaccggcugaucgacaaggacacgccccucaccgagaucgggaagaacaccacccaccagacccuggagcugcgcgccaaggccgcgcgggagcgcaucgagcucgaggaccuggcccgggucuuccuggccaucaacaagaagcgcggcuaccgguccagccgcaaggugaacaacgaggaggagggccagguggucgacgggauggccguggcgaagaagcucuacgacgagaaccugacccccggccaguacgccuacgagcugcucuccaaggggaagaaguacgugcccgacuucuaccggagcgaccugcaggccgaguucgacuccaucugggaguaccagaagcaguucuacgccgacauccuggacgacgagcucuacaacgcccugaagggccaggggcagcagaacagccgcaagcgguuccuggcgaucaagggcgucuacaccgccgagaacaagggcaagcgcgacgaggugaagcuccagcacuacaaguggcgguccgaggccaucacgcagaagcugagcaucgaggagguggccuacguccugguggagaucaacaacgaccucaacaaguccagcggguaccugggcgccaucuccgaccgcagcaaggagcuguacuucaacaaggagaccgugggggagaaccucuggaagcagauccagaagaacccgcacaccucccugaagaaccaggucuucuaccgccaggacuaccuggacgaguucgagcagaucugggagacccaggcgcaguuccacccccagcucacgcuggcccugaaggagcagauccgggacguggugaucuucuaccagcgcaagcucaagagccagaagggccugcuguccuucugccaguucgagagcugggagaucgagcggaaggacgagaacggcaacgucauccucaacaagaccacccagcugcccaagcgccagaccguggggcggcgcguggcccccaagagcuccccgcuguuccaggaguucaagaucuggcagaacaucaacaaccucgagaucgccaagaucagcgacggcaacuccaagaacaagaaggagacggaggcccugagcgacgacgagcggaagcuccuguucgaggagcugaaccugcgcgggaaccugucccagaaggagguccuccagauccugggccugaaggacaaggaguacaagaccaacuuccccgaggggcucgagggcaaccggaccaacgcggcccuguucaacaucuaccagcagaucgccgagaacgagggcuacggggacuggaccaagaaguccgcccaggagaucaaggaggagcugaaggccguguucccccagaucggcauccaggcggacauccucgacuucaacgccgagcuggacgggaaggaguucgagaaccaggccagcuaccagcuguggcaccuccuguacagcgccgaggaggacgacaagaucaacgaggaggaccagaucaucuacggcaacuccgcggugagccugaagaagaagcucugcgagaaguucggguucacgcccgaguacgccaaguggaucgccaacgucucccugcaggacgacuacggcaaccugagcaccaaggccaugcgcaagaucaucccguaccucaucgacggcaacgacuacuccgaggccugcgcgcuggccggguacaaccacagcaacucccugaccaaggaggagaacgacaaccgggagcgccucaacaagcuggagcugcuccccaagaacagccugcggaaccccguggucgagaagauccugaaccagauggugaacguggucaaccaggugaucgagaccuacggcaagcccgacgaggugcgcaucgagcucgcccgggagcugaagaaguccgccgaggagcgcgccgagaugacgaaggggaucaacgaggcgacccggcgcaacgaggacaucaagaagcugaucaccaagaacuucggcaucccgaaccccaccaagaacgacgucgugcgguaccgccucugggaggagcuggcgccccuggccuacaaggacguguucacggggcgccagaucaagaaggaggaccucuucagcuccaagaucgacaucgagcacaucauccccaaggcccugcuguucgacgacagcuucagcaacaagacccucgccuuccgggagaccaaccugaagaaggccgaccgcaccgccuacggcuucaucgaguccgacuacaacgccacgcuggacgacuacauccagcgggucgagacccucuacaacaacgccaagggcaccaucagcaaggggaagcgcaacaagcugcugauggcgcagaagaaccucccggacggcuucaucgagcgggaccugcgcaacucccaguacaucgccaagaaggccaagagcaugaucgagaagguguucaacgacgugaacgucaccuccgggagcaucaccgaccggcugcgcgaggacugggaccucaucaacgugaugaaggagcugaacuuccccaaguacaaggcccugggccucacggagaucgaggagcgguacgacaucggccaggagaagaccaagaagguggaggucaucaccgacuggaccaagcgcaacgaccaccggcaccacgccauggacgcgcugacgguggccuucaccaccaagucccacgugcaguaccugaacaaccucaacaccauccacagccugaagggggacgaggucgaccuggagcucuccaagcuguacggccugaagaacacgaucaccgagguggugaacaagaagcgcaaguucaucccgcccaugcccaacuuccgggaggaggccaagaagcacaucgagaccauccucgucagcaucaagaacaagaacaagguguacaccaagaacaucaacaagacgaagaaggaguccggguaccacaccaaggagcagcugacgccccgcggccagcugcacaaggagaccguguacggcaagagcaagcggcccaugaacaagcccaccaagaucaacaagaacuucucccucgagcaggcccagcugaucaucaacguccaggagaaggagcuggugcuccgccaccuggcccaguucgacaacaacccggcgguggccuucgacaccaagacccugaagaagugccacuaccucaagauggucaaccuguga

SEQ ID NO: 1693 - RNA, 3441 nt, Artificial Sequence
  Cas9 variant
augagcggcaacacccacgggccccugaccuucggcuucgacaucgggaucgccuccgugggcuggugcguccucggggagaaccgcaucgugaaccugggcgugcggugcuucgacaaggccgagacggcgaaggagggcgagagccugaaccucgcccgccggaccgcccgccugaugcggcgccggcugcgccggcgcgccuggcggcucaccaagcuggcccgccugcucaagcgggaggggcugaucgcggaggccucccgcauccacauccccagccccgucucccccuggcggcugcgcguggagggcaucgaccggcgccucaccgacgacgagugggcccgggugaucuaccaccugugcaagcaccgcggguuccacuggaucagccgggccgaggagcgcaaggcggaguccgacgccaaggagggcgggcgcgucaagaagggccugagcgacacgcagcggcgcaugaccgagaagggcuaccgguccgccgccgagauggugcucgccgaguuccccgacgcgcagcgcaacaagcagggggacuacggcaaggcccugagccggauccugcucuccgacgagcuggcccuccucuuccgccggcagcgcgagcuggggaacccgaacgccggcaacgagcuggaggccaccauccucggcaacgggaaccgcaagagcggccuguucugggagcagaagccgccccuggcgggggccgaccuccugaagaugcugggccggugcaccuucgagaagaacgaguaccgggcccccaaggccuccuucacggccgagcgccacguguggcucacccggcugaacaaccugcgcgucgugguggacgggaccacccggagccucgacgacgcggagcaccgccugguccugccgcuccccuacaagcaggccggcgacuucacguacaagcagcugcggaccgcccugaccaaggccggccuccugcccgagggguucaaguucgccggccuguccuaccccaccgggcgccagcucgacgacccgaaggcgaaggaccccgagagcgagaagcuggugcggcugcccgccuggcaggagcuccgcaagacgcugaaggacaagaaccuggagaccgagugggagggcauggccggggccgcgaccggcggcaaccccgagcuccuggacgagaucgcccgcgugcuguccgucuucaaggacggggacgaggugaccgccgagcuguggaagcucccgcugcccggcgggaaggccaugaucgacgcccugagcgagaucuccuucgacaaguuccacgcgcucagccugaaggcccugcggaagaucgugccccacauggagagcggccuccgcuacgacgaggccugcgccgucgccggguaccaccacucccagcugcacgcggccggcgccggcgagcacaaguuccugcccccguucuacagccggcgcgacaaggacgggcggaugguguucaacgaggagcucgacgugccccgcaaccccgucgugcugcgggcccugaaccaggcccgcaaggugcucaacgcgcugguccggacguacggcucccccaccgccgugcacaucgagauggcccgcgaccugagccggccgcucgacgagcgcaacaaggucaagaaggcccaggacgaguaccgggagcgcaacgagaaggacaaggcggccuucgccgccgaguacgggaucgcccccaagucccgggaguucgagaaguuccagcuguaccgcgagcagcagggcaagugcgcguacagccugaagucccucgaccugcaccgggugcugcacgacaucggcuacgccgagguggaccacgcccuccccuacagccgcuccuacgacgacagcaagaacaacaagguccuggcccugaccgaggagaaccggaacaaggggaaccgcaccgccuacgaguaccucacguccuuccccggcggggagaacggcgagcgguggcgcaacuucagcguggcgguggagaccaacaaggccuaccgccuggccaagcggacccgccugcuccggaaggacuucuccgggcgcgccgccgaggaguuccgggagcgcaaccugaacgacacccgguacaucugccgcuucuucaagaacacggucgagcgguuccugaagcucgacgcgaaggugggcgccggcgacaccgccgagaucagcgccaagcgcugcgugguccuguccgggcagaccaccgcguuccugcgggcccgcuggggccuccugaaggugcgggggaacagcgaccgccaccacgcccuggacgccgccguggucgcggccugcucccacggcauggugaagcggcucggggacuacagccgcacgaaggagcuggccaaggugcacgacggcuucccggaccccgagaccggcgagaucaucgaccccgucauguuccagcagcugcacgcccacuucccggaccccuggccccacuuccgggccgagcucgaggcgcgccugaacguggacgacaccgccgaccugcgggcccgcauggagcuguucgggaccuacgcccccgaggcccuggagacgcugcgcccccucuucgugucccgggcgccccagcgccggaacagcggcgccgcccacaaggacaccaucuacgcccagcccgagcgccugaaggagcagggcggggucacccagaaggugccccugaccagccucacccugaaggaccuggacaagcucaucgacccgcaccggaacgagaagcuguacgccgcgauccgcgcccggcuggaggcccacgggggcaaggccgacaaggcguuccccgccggcaacccccuccgcaagcccgaccgggaggggaacccgacgggccccgugguccgcaccgugaccauggugaucgacaagcuguccgggauccccguccggggcgggaucgccaagaacgacaccaugcugcgcguggacaucuuccggcacaagaaggacggcaaguuccaccucgugcccgucuacguguaccacgccguggccaaggaguucccgaaccgcgcgaucguccaggccaaggacgaggacgaguggacgcugaucgacgacaaguucgacuucugcuucagcgcccaccccaacgaccugcucaagaucacccagaaguccggcgagaccaucuucggguacuaccggggcugccacagcgggaccgccgccaucaacaucgcgcugcacgaccgcuacgccuacgccgagaagacgaccucccuggccuucagcaagaagaaccccggcaagcccaucccgaacgacaagcucggccugaucgaggggaucggcgugaagauggccgcgaacauggagaaguuccacguggacacccuggggaacaucuaccccgccccgcccgagcagcggcgcggccucgccuga

SEQ ID NO: 1694 - RNA, 3441 nt, Artificial Sequence
  Cas9 variant
auggccuaccgccugggccucgacaucgggaucaccagcgugggcugggccgucguggcgcuggagaaggacgaguccgggcugaagcccgugcggauccaggaccucggcguccgcaucuucgacaaggccgaggacagcaagaccggggccucccuggcccugccgcggcgcgaggcccggagcgcgcgccggcgcacgcggcgccggcgccaccggcucuggcgcgugaagcggcugcuggagcagcacggcauccucuccauggagcagaucgaggcccuguacgcccagcgcaccagcucccccgacguguacgcccugcgggucgcgggccucgaccgcugccugaucgccgaggagaucgcccgggugcugauccacaucgcccaccgccggggguuccagagcaaccgcaaguccgagaucaaggacagcgacgccggcaagcuccugaaggcggugcaggagaacgagaaccugaugcaguccaagggguaccgcaccgucgccgagaugcucgugagcgaggccaccaagacggacgccgagggcaagcuggugcacgggaagaagcacggcuacgucuccaacgugcggaacaaggccggcgaguaccgccacaccgugagccggcaggcgaucgucgacgaggugcgcaagaucuucgccgcccagcgggcccuggggaacgacgugauguccgaggagcucgaggacagcuaccugaagauccugugcucccagcgcaacuucgacgacggccccgggggcgacagccccuacggccacggguccgucagcccggacggcgugcggcagagcaucuacgagcgcauggugggguccugcaccuucgagaccggcgagaagcgggcgccccgcagcuccuacagcuucgagcgguuccagcuccugacgaaggucgugaaccugcgcaucuaccggcagcaggaggacgggggccgcuaccccugcgagcucacccagaccgagcgggcccgcgugaucgacugcgccuacgagcagaccaagaucacguacggcaagcugcggaagcugcucgacaugaaggacaccgaguccuucgccgggcugaccuacggccugaaccgcagccggaacaagaccgaggacacggucuucguggagaugaaguucuaccacgagguccgcaaggcccuccagcgcgccgggguguucauccaggaccuguccaucgagacccuggaccagaucggcuggauccucagcguguggaaguccgacgacaaccggcgcaagaagcugagcacccuggggcucuccgacaacgucaucgaggagcugcugccccucaacggcagcaaguucggccaccugucccugaaggcgauccggaagauccucccguuccuggaggacggguacagcuacgacguggccugcgagcuggccggcuaccaguuccaggggaagaccgaguacgugaagcagcgccuccugccgccccugggcgagggggaggucacgaaccccguggugcggcgcgcccugucccaggcgaucaaggucgugaacgccgugauccggaagcacggcagccccgaguccauccacaucgagcucgcccgcgagcugagcaagaaccuggacgagcggcgcaagaucgagaaggcccagaaggagaaccagaagaacaacgagcagaucaaggacgagauccgggagauccucggcuccgcccacgucaccgggcgcgacaucgugaaguacaagcuguucaagcagcagcaggaguucugcauguacagcggcgagaagcuggacgugacccggcuguucgagcccggguacgcggaggucgaccacaucauccccuacggcaucagcuucgacgacuccuacgacaacaaggugcuggugaagaccgagcagaaccgccagaagggcaaccggacgccccuggaguaccuccgcgacaagccggagcagaaggccaaguucaucgcccuggucgagagcaucccccugucccagaagaagaagaaccaccuccugauggacaagcgggccaucgaccuggagcaggagggguuccgcgagcggaaccucagcgacacccgcuacaucacccgggcccugaugaaccacauccaggcguggcuccucuucgacgagaccgccuccacgcgcagcaagcgcguggugugcgucaacggcgccgugaccgccuacaugcgggcccgcugggggcugaccaaggaccgggacgcgggcgacaagcaccacgccgccgacgccguggucguggcgugcaucggggacucccugauccagcgcgugaccaaguacgacaaguucaagcggaacgcccucgccgaccgcaaccgguacguccagcaggucagcaaguccgagggcaucacgcaguacguggacaaggagaccggcgagguguucaccugggagagcuucgacgagcgcaaguuccugcccaacgagccccuggagccguggcccuucuuccgggacgagcuccuggcccgccuguccgacgaccccagcaagaacauccgggccaucgggcuccugaccuacuccgagacggagcagaucgaccccaucuucgugagccgcaugccgacccggaaggugaccggcgcggcccacaaggagaccauccgcagcccccggaucgucaagguggacgacaacaaggggaccgagauccagguggucguguccaagguggcccugacggagcucaagcugaccaaggacggcgagaucaaggacuacuuccgccccgaggacgacccccggcuguacaacacccuccgcgagcggcugguccaguucgggggcgacgccaaggccgcguucaaggagccgguguacaagaucuccaaggacggcagcgugcgcacccccguccgcaaggugaagauccaggagaagcugacgcucggggugcccguccacggcgggcggggcaucgccgagaacgggggcauggugcgcaucgacguguucgccaagggcgggaaguacuacuucgucccgaucuacguggccgacgugcugaagcgggagcugcccaaccgccucgccaccgcgcacaagcccuacagcgaguggcgggucguggacgacuccuaccaguucaaguucagccuguaccccaacgacgccgucaugaucaagccgucccgcgagguggacaucaccuacaaggaccggaaggagcccgugggcugccgcaucauguacuucgucagcgccaacaucgccuccgcgagcaucucccugcggacccacgacaacagcggggagcucgagggccuggggauccagggccuggagguguucgagaaguacguggucggcccccucggggacacgcaccccguguacaaggagcgccggaugccguuccgcguggagcggaagaugaacuga

SEQ ID NO: 1695 - RNA, 3441 nt, Artificial Sequence
  Cas9 variant
auggccuaccgccugggccucgacaucgggaucaccagcgugggcugggccgucguggcgcuggagaaggacgaguccgggcugaagcccgugcggauccaggaccucggcguccgcaucuucgacaaggccgaggacagcaagaccggggccucccuggcccugccgcggcgcgaggcccggagcgcgcgccggcgcacgcggcgccggcgccaccggcucuggcgcgugaagcggcugcuggagcagcacggcauccucuccauggagcagaucgaggcccuguacgcccagcgcaccagcucccccgacguguacgcccugcgggucgcgggccucgaccgcugccugaucgccgaggagaucgcccgggugcugauccacaucgcccaccgccggggguuccagagcaaccgcaaguccgagaucaaggacagcgacgccggcaagcuccugaaggcggugcaggagaacgagaaccugaugcaguccaagggguaccgcaccgucgccgagaugcucgugagcgaggccaccaagacggacgccgagggcaagcuggugcacgggaagaagcacggcuacgucuccaacgugcggaacaaggccggcgaguaccgccacaccgugagccggcaggcgaucgucgacgaggugcgcaagaucuucgccgcccagcgggcccuggggaacgacgugauguccgaggagcucgaggacagcuaccugaagauccugugcucccagcgcaacuucgacgacggccccgggggcgacagccccuacggccacggguccgucagcccggacggcgugcggcagagcaucuacgagcgcauggugggguccugcaccuucgagaccggcgagaagcgggcgccccgcagcuccuacagcuucgagcgguuccagcuccugacgaaggucgugaaccugcgcaucuaccggcagcaggaggacgggggccgcuaccccugcgagcucacccagaccgagcgggcccgcgugaucgacugcgccuacgagcagaccaagaucacguacggcaagcugcggaagcugcucgacaugaaggacaccgaguccuucgccgggcugaccuacggccugaaccgcagccggaacaagaccgaggacacggucuucguggagaugaaguucuaccacgagguccgcaaggcccuccagcgcgccgggguguucauccaggaccuguccaucgagacccuggaccagaucggcuggauccucagcguguggaaguccgacgacaaccggcgcaagaagcugagcacccuggggcucuccgacaacgucaucgaggagcugcugccccucaacggcagcaaguucggccaccugucccugaaggcgauccggaagauccucccguuccuggaggacggguacagcuacgacguggccugcgagcuggccggcuaccaguuccaggggaagaccgaguacgugaagcagcgccuccugccgccccugggcgagggggaggucacgaaccccguggugcggcgcgcccugucccaggcgaucaaggucgugaacgccgugauccggaagcacggcagccccgaguccauccacaucgagcucgcccgcgagcugagcaagaaccuggacgagcggcgcaagaucgagaaggcccagaaggagaaccagaagaacaacgagcagaucaaggacgagauccgggagauccucggcuccgcccacgucaccgggcgcgacaucgugaaguacaagcuguucaagcagcagcaggaguucugcauguacagcggcgagaagcuggacgugacccggcuguucgagcccggguacgcggaggucgaccacaucauccccuacggcaucagcuucgacgacuccuacgacaacaaggugcuggugaagaccgagcagaaccgccagaagggcaaccggacgccccuggaguaccuccgcgacaagccggagcagaaggccaaguucaucgcccuggucgagagcaucccccugucccagaagaagaagaaccaccuccugauggacaagcgggccaucgaccuggagcaggagggguuccgcgagcggaaccucagcgacacccgcuacaucacccgggcccugaugaaccacauccaggcguggcuccucuucgacgagaccgccuccacgcgcagcaagcgcguggugugcgucaacggcgccgugaccgccuacaugcgggcccgcugggggcugaccaaggaccggaacgcgggcgacaagcaccacgccgccgacgccguggucguggcgugcaucggggacucccugauccagcgcgugaccaaguacgacaaguucaagcggaacgcccucgccgaccgcaaccgguacguccagcaggucagcaaguccgagggcaucacgcaguacguggacaaggagaccggcgagguguucaccugggagagcuucgacgagcgcaaguuccugcccaacgagccccuggagccguggcccuucuuccgggacgagcuccuggcccgccuguccgacgaccccagcaagaacauccgggccaucgggcuccugaccuacuccgagacggagcagaucgaccccaucuucgugagccgcaugccgacccggaaggugaccggcgcggcccacaaggagaccauccgcagcccccggaucgucaagguggacgacaacaaggggaccgagauccagguggucguguccaagguggcccugacggagcucaagcugaccaaggacggcgagaucaaggacuacuuccgccccgaggacgacccccggcuguacaacacccuccgcgagcggcugguccaguucgggggcgacgccaaggccgcguucaaggagccgguguacaagaucuccaaggacggcagcgugcgcacccccguccgcaaggugaagauccaggagaagcugacgcucggggugcccguccacggcgggcggggcaucgccgagaacgggggcauggugcgcaucgacguguucgccaaggacggcaaguacuacuucgucccgaucuacguggccgacgugcugaagcgggagcugcccaaccgccucgccaccgcgcacaagcccuacagcgaguggcgggucguggacgacuccuaccaguucaaguucagccuguaccccaacgacgccgucaugaucaagccgucccgcgagguggacaucaccuacaaggaccggaaggagcccguggggcugcgccucauguacuucgccggcgccgacaucagcggggcgacccugacgcugcggacccacgacaacuccggcgagcucaaggggcugggcauccagggccuggaggucuucgagaaguacgugguggggccccucggcgacacccaccccgucuacaaggagcgccggaugccguuccgcguggagcggaagaugaacuga

SEQ ID NO: 1696 - RNA, 3447 nt, Artificial Sequence
  Cas9 variant
augaccaagcugaaccagcccuacggcaucgggcucgacaucggcagcaacuccaucggguucgccguggucgacgccaacagccaccuccugcgccucaagggcgagaccgcgaucggggcccggcuguuccgcgagggccaguccgccgccgaccggcgcggcagccggacgacccgccggcgccugucccggacccgcuggcggcucagcuuccugcgcgacuucuucgccccgcacaucaccaagaucgaccccgacuucuuccugcggcagaaguacuccgagaucagccccaaggacaaggaccgcuucaaguacgagaagcggcuguucaacgaccgcacggacgcggaguucuacgaggccuaccccuccauguaccaccuccggcugcgccugaugaccgacgccagccaggccgacccgcgggagaucuuccuggcgauccaccacauccugaagucccgcgggcacuuccucacccccggcgccgccaaggacuucaacaccgacaagguggaccuggaggacaucuuccccgcccugacggaggccuacgcccagguguaccccgaccucgagcugaccuucgaccuggccaaggccgacgacuucaaggccaagcuccuggacgagcaggccaccccgagcgacacccagaaggcgcuggucaaccuccugcuguccagcgacggggagaaggagaucgugaagaagcggaagcagguccucacggaguucgccaaggccaucaccggccugaagaccaaguucaaccuggcccucgggaccgagguggacgaggccgacgcguccaacuggcaguucagcaugggccagcuggacgacaagugguccaacaucgagacgagcaugaccgaccagggcaccgagaucuucgagcagauccaggagcuguaccgcgcccgccuccugaacgggaucgugcccgccggcaugucccugagccaggccaagguggccgacuacgggcagcacaacgaggaccucgagcuguucaagaccuaccugaagaagcucaacgaccacgagcuggcgaagacgauccgggucaucuacgaccgcuacaucaacggcgacgacgccaagcccuuccugcgggaggacuucgugaaggcccucaccaaggaggugaccgcccaccccaacgaggucagcgagcagcugcugaaccgcaugggccaggcgaacuucaugcucaagcagcggaccaaggccaacggggccaucccggugcagcugcagcagcgcgagcuggaccagaucaucgccaaccaguccaaguacuacgacuggcucgccaagcccaaccccguggagaagcaccgggcgagcaagcccuaccagcuggacgagcugcugacguuccgcaucccguacuacgucggcccccucaucacccccaaggagcaggccaaguccggggagaacguguucgccuggauggugcggaaggaccccagcggcaacaucaccccguacaacuucgacgagaaggucgaccgcgaggccuccgccaacguguucauccagcggaugaagaccacggacaccuaccugaucggggaggacgugcugcccaagcagagccuccuguaccagaaguacgagguccugaacgagcucaacaacgugcgcgugaacaacgaggcgcugggcaccgaccagaagcagcggcugauccgcgaggucuucgagcggcacuccagcgugaccaucaagcaggucgccgacaaccucguggcccacggcgacuucgcccagcgccccgagauccgggggcuggccgacgagaagcgcuuccuguccagccucuccacguaccaccagcugaaggagauccugcacggcgcgaucgacgacagcaccaagcuccacgacaucgagaacaucaucaccugguccaccguguucgaggacgccgccaucuucaagacgaagcuggccgagaucgacuggcuggacgcggccaccaucaagaagcucagcaacauccgguaccgcggguggggccaguucucccgcaagcugcuggacgggcucaagcugggcaacggccagaccgucauccaggagcugaugcucagcaaccacaaccugaugcagauccugaccgacgagacccucaagacgaccauggccgagcugaaccaggacaagcugaaggccgacgacaucgaggacgugaucaacgacgccuacaccucccccagcaacaagaaggcgcuccgccaggugcugcgggucguggaggacaucaagcacgccgccaacgggcaggacccguccuggcuguacaucgagaccgccgacggccccgggacggccggcaagcggacccagagccgccagaagcagauccagaccguguacgcgaacgccgcccaggagcucaucgacagcgccguccgcggggagcuggaggacaagaucgccgacaaggcguccuucaccgaccggcuggugcucuacuucaugcagggcggccgggacaucuacacgggggcgccccugaacaucgaccagcugagccacuacgacaucgaccacauccucccccagucccugaucaaggacgacagccuggacaaccgcgugcucgucaacgccaccaucaaccgggagaagaacaacguguucaccuccacccuguucgccagcaagauggcggccacguggcgcaaguggcacgaggccggccugaucuccgggcggaagcuccgcaaccugaugcugcggccggacgagaucgacaaguucgcccacggcuucguggcccgccagcucgucgagacccggcagaucaucaagcugaccgagcagaucgcggccgcccaguaccccaacaccaagaucaucgccgugaaggccggccugagccaccagcuccgcgaggagcuggacuuccccaagaaccgggacgugaaccacuaccaccacgcguucgacgccuuccuggccgcccgcaucgggacguaccuccugaagcgguacgccaagcuggcgccguucuucaccuacggcgaguucgccaaggucgacgugaagaaguuccgcgaguucaacuucaucggggcccucaagcacgccaagaagaacaucguggccaaggacaccggcgagaucgucugggacaaggagcgggacauccaggagcuggaccgcaucuacaacuucaagcgcaugcugaucacccacgagguguacuucgagacggcggaccucuucaagcagaccaucuacgccgccaaggacuccaaggagcgcgggggcagcaagcagcugauccccaagaagcggggcuaccccacccagguguacgggggcauccacgggaagauccggcugaccuggcgcuggcucaagcugcugcggcgcaagaagauguccaucgagcucagcgagcugcagcugcucaaguga

SEQ ID NO: 1697 - RNA, 3450 nt, Artificial Sequence
  Cas9 variant
auggagcgcuaccacaucggccuggacaucgggaccagcuccaucggcugggccgugaucggggacgacuucaagaucaagcggaagaagggcaagaaccucaucgggguccgccuguucaaggagggcgacaccgccgcggagcggcgcggcuuccggacgcagcgccggcgccugaaccggcgcaaguggcggcucaagcugcuggaggagaucuucgaccccuacauggccgagguggacaaguacuucuucgcccgccucaaggagagcaaccuguccccgaaggacagcaacaagaaguaccuggggucccuccuguuccccgacaucagcgacuccaacuucuacgacaaguaccccaccaucuaccaccuccggcgcgaccugauggagaaggacaagaaguucgaccugcgggagaucuaccuggccauccaccacaucgugaaguaccgcggcaacuuccucgagaagguccccgccaagaacuacaagaacagcggggcguccaucggcuuccugcuggaggaggugaacgaccucuacgggaacaucaucggcaacgaggacguggccauccuggacaacgacaaguucgaggacgucgagaagaucauccugaacgacgagauccggaacaucgacaagcagaagaacgugggccgccuccuggugaaggacaagaaggagaagaacaucgucaccgccuucagcaaggccaucuucggguacaaguucaaccuggaggaccuccugcugaucgaguccgacgagaagaacaagcucaccuucaacgacgagaacaucgacgacaucuucaacgagcugagccacucccugaacgacaaccagauggaccuccugacgaagacccgggagaucuacuucaaguucaagcugaacaugaucgugccgaccggcuacaccaucagcgaguccaugaucgagaaguacgagaugcacaaggcgcaccucaagauguacaaggaguucaucaacacgcugaacgccaaggaccgcaagauccugaagaacgccuacagcgacuacaucaacaacgagaaggccaaggccgcgaacgcccaggagaacuucuacaagaccgugaagaagaccaucaaggagaacgacuccgacaccgccaagaagaucaucgggcucaucgacgagggcaacuucaugcccaagcagcggacgggcgagaacggggucaucccccaccagcugcaccagaucgagcuggaccgcaucaucgagaaccaggccaaguacuaccccuggcucgccgaggagaacccgguggagaagaaccgcaaguucgcgaaguacaagcuggacgagcuggugaccuuccggguccccuacuacgugggcccccucaucgacaagaccgagagcaacaagaacgagaaggagaccaaguucgccuggauggugcgcaaggccaaggggacgaucacccccuggaacuucgagaaccuggucgaccggaccgaguccgccaaccgcuucaucaagcggaugaccagcaaggacacguacaucaucggcgaggacgugcugccggccagcucccuccuguacgagaaguacaaggugcugaacgagcucaacaacaucaaggucaacaagaagaagcuggacguggagcagaagcagcacguguaccuggaccuguucaccacccgcaagaacgucaccaaggacgaccucgcgacgagccugaacugcgacguggaguccaucaccgggcugaccgacaacaagaaguucaacagcucccucagcuccuacaucgaccugaaggccauccugggcaacaucgucgacgacuacagcaagaacgaggaccucgagaagaucaucgaguacuccaccaucuucgaggacggcaacaucuacaaggagaagcugagcgagaucuccuggcugacggacgagcagaucgagaagcucagcaacauccacuucaagggguggggccggcuguccaagaagcugcucacccagaucaccaacgagaacggggagcgcaucaucgacacccuguggaacacgagcaacaacuucauccaggugaucuccgacgagagcauccaggccaagcuggccgagaucaacggcgaguacgccaacaaguacaaccucgaggacauccuggacgaggcguacaccagcccccagaacaagaaggccauccgccaggugaugaaggucguggaggacaucgagaaggccaugaagugcgagcccaccuccaucgccaucgaguucacccgggagaagcggaaguccaagcugacgaacacccgcuacaagaagaucagcgagaccuacgagaagaucaccgacgagcucaucagcgaguacgagcuggggaagcugcaguccgagcucgacagcaaggugaacaacaugcgggaccgcuacuaccuguacuucaugcagcugggccgggacauguacaccggcgagaagaugaacaucgacgagcuccaccagaaguacgacaucgaccacauccugccccaguccuucaucaaggacgacagccugaacaaccgcguccucacguccaagagcgugaacaucaaggagaaguccgacaagaccgcggccgaccuguacgccgccaagaugggggacuucuggcggaagcugcgcaagcagggccucaugaccgagcagaaguacaagaaccugcugacccggacggacagcaucaacaaguacaccaagcaguccuucaucaagcgccagcucguggagaccagccaggucgugaagcuggccgcgaacauccugcaggacaaguaccgcaacaccaagaucaucgagauccgggcccgccucaacuccgaccugcggaagaaguacgagcugaucaagaaccgcgaggugaacgacuaccaccacgccaucgacggguaccucacgaccuucgucggccaguaccuguacaagguguacccgaagcugcggagcuacuucguguacgacgacuucaagaagcucgacuccaacuaccugaagcacauggacaaguucaacuucaucuggaagcuggaggacaagaaggccgaggacgucuacgacaaggugaacgacgaguucgugcucaacguccccgagaugaaggaguacauccgcaagaucuacaacuacaaguacaugcuggugagcaaggaggugaccaccaagaacggggccuucuacgaccagacgaaguacaacgcgaagaccaucaaccugauccccaucaagaaggacaagcccaccaacaucuacggcggcuacaaggggaaggucuccagcuacaugaugcucgugaagauccagaagaagaaggaggugaucuacaaguucgucggcgugccgcggcuguggaccgacgagcuggaccgccucaucgacacggacgagaagaaggcccugcugaagaaguga

SEQ ID NO: 1698 - RNA, 3459 nt, Artificial Sequence
  Cas9 variant
augaacgccgagcacggcaaggaggggcugcucaucauggaggagaacuuccaguaccgcaucggccuggacaucgggaucaccagcgugggcugggccguccugcagaacaacucccaggacgagcccgugcggaucaccgaccucggggugcgcaucuucgacgucgcggagaacccgaagaacggcgacgcccuggccgcgccccggcgcgacgcccggacgacccgccggcgccugcggcgccggcgccaccggcucgagcgcaucaaguuccugcugcaggagaacggccucaucgagauggacagcuucauggagcgguacuacaaggggaaccugcccgacguguaccagcugcgcuacgagggccucgaccggaagcugaaggacgaggagcuggcccaggugcucauccacaucgccaagcaccgcggguuccgguccacccgcaaggccgagaccaaggagaaggagggcggggccguccugaaggcgacgaccgagaaccagaagaucaugcaggagaagggcuaccggaccgugggcgagaugcuguaccucgacgaggccuuccacaccgagugccuguggaacgagaagggguacgugcugacgccccgcaaccgcccggacgacuacaagcacaccauccuccggagcaugcuggucgaggaggugcacgccaucuucgccgcccagcgcgcgcacggcaaccagaaggccaccgaggggcuggaggaggccuacguggagaucaugaccucccagcggagcuucgacaugggccccggccuccagcccgacgggaagcccuccccguacgccauggagggcuucggggaccgcgucggcaagugcacguucgagaaggacgaguaccgggcccccaaggcgaccuacaccgccgagcuguucguggcccugcagaagaucaaccacaccaagcucaucgacgaguucgggacgggccgcuucuucagcgaggaggagcggaagaccaucaucggccugcugcucuccagcaaggagcugaaguacgggaccauccgcaagaagcugaacaucgaccccucccucaaguucaacagccugaacuacuccgccaagaaggagggcgagaccgaggaggagcgggugcuggacacggagaaggccaaguucgcgagcauguucuggaccuacgaguacuccaagugccucaaggaccgcaccgaggagaugcccgucggggagaaggccgaccuguucgaccggaucggcgagauccugaccgccuacaagaacgacgacagccgcuccagccggcucaaggagcuggggcuguccggcgaggagaucgacggccuccuggaccugagcccggccaaguaccagcgcgugagccucaaggccaugcggaagaugcagcccuaccuggaggacgggcugaucuacgacaaggcgugcgaggccgccggcuacgacuuccgcgcccucaacgacgggaacaagaagcaccuccugaagggcgaggagaucaacgcgaucgugaacgacaucacgaaccccgucgugaagcgguccgugagccagaccaucaaggucaucaacgccaucauccagaaguacggguccccgcaggccgugaacaucgagcuggcccgcgagaugagcaagaacuuccaggaccggaccaaccucgagaaggagaugaagaagcgccagcaggagaacgagcgcgccaagcagcagaucaucgagcugggcaagcagaacccgaccggccaggacauccugaaguaccggcucuggaacgaccagggcggguacugccuguacuccgggaagaagaucccccuggaggagcuguucgacggcggcuacgacaucgaccacauccugcccuacagcaucacguucgacgacuccuaccgcaacaaggugcuggucaccgcgcaggagaaccggcagaaggggaaccgcacccccuacgaguacuucggcgccgacgagaagcggugggaggacuacgaggccagcgugcgccuccugguccgggacuacaagaagcagcagaagcugcucaagaagaacuucaccgaggaggagcgcaaggaguucaaggagcggaaccugaacgacacgaaguacaucacccgcgugguguacaacaugauccggcagaaccuggagcucgagccguucaaccaccccgagaagaagaagcaggucugggccgugaacggggccgugaccuccuaccugcgcaagcgguggggccugaugcagaaggaccgcagcaccgaccggcaccacgcgauggacgccgucgugaucgccugcugcacggacgggaugauccacaagaucucccgcuacaugcagggccgggagcucgccuacagccgcaacuucaaguuccccgacgaggagaccggcgagauccugaaccgggacaacuucacccgcgagcagugggacgagaaguucggggugaaggucccccugccguggaacuccuuccgggacgagcucgacauccgccugcugaacgaggaccccaagaacuuccuccugacccacgccgacgugcagcgcgagcuggacuaccccggcuggauguacggggaggaggagagccccaucgaggagggccgguacaucaacuacauccgcccccucuucgugucccggaugcccaaccacaaggucaccgggagcgcgcacgacgccacgauccgcuccgcccgggacuacgagacccgcggcguggugaucaccaaggucccccugaccgaccugaagcucaacaaggacaacgagaucgagggcuacuacgacaaggacagcgaccggcugcuguaccaggcccucgugcgccagcugcugcuccacgggaacgacggcaagaaggcguucgccgaggacuuccacaagccgaaggccgacgggacggagggccccgugguccggaaggugaagaucgagaagaagcagaccuccggggugaugguccgcggcggcaccgggaucgccgccaacggcgagauggugcggaucgacguguuccgcgagaacgggaaguacuacuucguccccguguacaccgcggacgugguccggaaggugcugcccaaccgcgccgccacgcacaccaagccguacagcgaguggcgggugauggacgacgccaacuucgucuucagccuguacucccgcgaccucauccacgucaagagcaagaaggacaucaagaccaaccuggugaacggcgggcugcuccugcagaaggagaucuucgccuacuacaccggcgcggacaucgccacggccuccaucgccggcuucgccaacgacagcaacuucaaguuccgggggcugggcauccagucccucgagaucuucgagaagugccagguggacauccuggggaacaucagcguggugcgccacgagaaccggcaggaguuccacuga

SEQ ID NO: 1699 - RNA, 3462 nt, Artificial Sequence
  Cas9 variant
augaagaacauccugggccucgaccuggggcugagcuccaucggcuggagcgugauccgcgagaacuccgaggagcaggagcucgucgccauggggagccggguggugucccugaccgccgcggagcugagcuccuucacccagggcaacggggucagcaucaacucccagcgcacgcagaagcggacccagcgcaagggcuacgaccgguaccagcuccgccggacccugcugcgcaacaagcucgacacccugggcaugcugcccgacgacagccucuccuaccugccgaagcugcagcucugggggcugcgggccaaggccgugacgcagcgcaucgagcugaacgagcucggccgggugcugcugcaccucaaccagaagcgcggguacaagagcaucaaguccgacuucagcggcgacaagaagaucaccgacuacgucaagaccgugaagacccgguacgacgagcugaaggagaugcgccugacgaucggggagcuguucuuccggcgccucaccgagaacgccuucuuccggugcaaggagcaggucuacccccgccaggccuacguggaggaguucgacugcaucaugaacugccagcggaaguucuaccccgacauccugaccgacgagaccauccgcugcauccgggacgagaucaucuacuaccagcgcccccucaaguccugcaaguaccuggugagccgcugcgaguucgagaagcgguucuaccugaacgcggccggcaagaagacggaggccggcccgaagguguccccgcgcaccagcccccucuuccaggucugccggcugugggaguccaucaacaacaucguggugaaggaccgccggaacgagaucgucuucaucagcgccgagcagcgcgcggcccuguucgacuuccucaacacccacgagaagcugaaggggagcgaccugcucaagcugcugggccucuccaagaccuacggguaccggcugggcgagcaguucaagacgggcauccaggggaacaagacccgcguggagaucgagcgggcccugggcaacuaccccgacaagaagcgccuccugcaguucaaccugcaggaggagagcuccagcauggugaacaccgagaccggggagaucauccccaugaucucccucagcuucgagcaggagccccuguaccggcuguggcacguccucuacuccaucgacgaccgcgagcagcugcagagcgugcugcggcagaaguucggcaucgacgacgacgaggugcuggagcgccucuccgccaucgaccuggucaaggccggguucggcaacaagagcuccaaggcgauccggcgcauccugcccuuccuccagcugggcaugaacuacgccgaggccugcgaggccgccggguacaaccacagcaacaacuacacgaaggcggagaacgaggcccgggcccugcucgaccgccugcccgccaucaagaagaacgagcugcggcagccggugguggagaagauccucaaccagauggucaacguggucaacgcccugauggagaaguacggccgcuucgacgagauccgcguggagcuggcgcgggagcucaagcaguccaaggaggagcgcagcaacaccuacaaguccaucaacaagaaccagcgggagaacgagcagaucgccaagcgcaucguggaguacgggguccccacccggagccgcauccagaaguacaagaugugggaggaguccaagcacugcugcaucuacugcggccagcccguggacgugggggacuuccugcggggcuucgacgucgagguggagcacaucauccccaagagccuguacuucgacgacuccuucgccaacaaggugugcagcugccgcagcugcaacaaggagaagaacaaccggaccgccuacgacuacaugaaguccaagggcgagaaggcccucagcgacuacgucgagcgcgugaacacgauguacaccaacaaccagaucuccaagaccaaguggcagaaccugcugaccccgguggacaagaucagcaucgacuucaucgaccggcagcuccgcgagucccaguacaucgcgcggaaggccaaggagauccugacgagcaucugcuacaacgucaccgccaccuccgggagcgugaccuccuuccugcgccacguguggggcugggacacgguccuccacgaccugaacuucgaccgguacaagaagguggggcugaccgaggugaucgaggucaaccaccgcggcagcgugauccggcgcgagcagaucaaggacugguccaagcgguucgaccaccgccaccacgccaucgacgcgcucaccaucgccugcaccaagcaggccuacauccagcggcugaacaaccugcgcgccgaggaggggcccgacuucaacaagaugagccucgagcgcuacauccagucccagccccacuucagcguggcccagguccgggaggcgguggaccgcauccugguguccuuccgggccggcaagcgcgccgucacgcccggcaagcgguacauccgcaagaaccggaagcgcaucagcgugcaguccgugcugaucccgcgcggggcccucagcgaggagagcgucuacggcgugauccacgugugggagaaggacgagcaggggcacgucauccagaagcagcgggccgugaugaaguaccccaucaccuccaucaaccgggagaugcuggacaaggagaagguggucgacaagcgcauccaccggauccugagcggccgccucgcgcaguacaacgacaaccccaaggaggccuucgccaagcccguguacaucgacaaggagugccggaucccgauccgcaccgugcggugcuucgccaagcccgccaucaacacccuggucccccugaagaaggacgacaagggcaaccccguggcgugggugaacccggggaacaaccaccacgucgccaucuaccgcgacgaggacggcaaguacaaggagcggaccgugacguucugggaggccguggaccgcugccgcgucgggauccccgccaucgugacccagcccgacaccaucugggacaacauccuccagcggaacgacaucuccgagaacgugcuggagagccugccggacgucaaguggcaguucgugcucucccugcagcagaacgagauguucauccugggcaugaacgaggaggacuaccgcuacgcgauggaccagcaggacuacgcccuccugaacaaguaccuguaccgggugcagaagcucagcaaguccgacuacagcuuccgcuaccacaccgagacguccgucgaggacaaguacgacgggaagcccaaccugaagcugagcaugcagaugggcaagcucaagcggguguccaucaagagccugcugggccucaacccccacaaggugcacaucuccguccugggggagaucaaggagaucagcuga

SEQ ID NO: 1700 - RNA, 3474 nt, Artificial Sequence
  Cas9 variant
augaacuacuacaacggcuucaucaucaccgagaacgccaugaccagcaagcaggagaagcacggggcccugacguucggccucgacaucgggaucgcguccgugggcugggccguccugggggagagccgcaucguggaccugggcgugcggugcuucgacaaggccgagaccgccaaggagggcgagucccucaaccugacccgccggauggcccgccugcuccggcgccggcugcgccggcgcgcguggcggcugaccaagcucgcccgccugcugaagcgggaggggcucaucgccgacgccaaccuguucaagcacaagaucgagaagaacacgcccguccccaagagcuccuggcagcugcgcguggacggccucgaccggcagcugaacgcggaggagugggcccgcgugaucuaccaccugugcaagcaccggggguuccacuggaucagccgcgccgaggagaaggccgccgagggcgacuccaagggggagggcggcaaggucaagcaggggcucgcgggcaccaagaagcugaugcaggagaaguccuaccggaccgccgccgagauggugcuggccgaguuccccgacgcccagcgcaacaagcagggggacuacagcaaggcgcucagccggauccugcugggcgacgagcucaaggcccuguucgagcaccagcgcaagcugggcaaccccguggccaccgagaagcucgaggccgccauccuggggaacggcgacaagaagugcgggcuguucugggcgcagaaccccgcccucgccggcaacaagcugcuggagaugcucgggcgcugcacguucgagaagaccggcggcgacgacgggaagggcgaguaccgggccccgaaggccuccuucagcgcggagcgccacgucuggcugacccaccugaacaaccuccggaucgugguggacgggaccacgcgcccccugaacgaggccgagcggcgcgucgcccugcccaugcccuaccagcaggccggcgaccucuccuacaagcagcucgggggcgcgcugaucaaggagggcuuccuccagaaggacggguucaaguucgccggccugccguaccccaccaagcaggccagcgaggagaaggccaaggaccccgagaccuccgugcugugcaagcuccccgccuggcacacccugcggaagacgcuggagaagcacgggcucgagagcgaguggcagaagcuguccaccgacgcgcuggacggcaagccgcagcugcucgacaacaucgccugggugcugagcgucuacaaggacgacgacgaggugaagaccgagcuggggaagcucaaccugcccaacaccgagaagaugaucgacgcccugcucgacauccgcuucgacaaguucuccaaccugagccugaaggcccucagcaagaucgugcccuucauggagcagggccagcgguacgacgaggccgucgcgaacauccccgaguacggccaccacucccagcugcacaaggugggggccggcgagcacaaguaccugccgcccuucuacaaggagcgcgacaagacggggcggaugguguucaacgacgacauggacaucccccgcaaccccgucgugcuccgggcccugaaccaggcccgcaagguggucaacgcccugaucaaggaguacggcagcccgcacgaggugcacaucgagauggcgcgggaccucucccgcccccuggacgagcggcgcgacaucgagaagcugcagaaggaguucggcgagcggaacaagaaggacaaggagcuguucgcccaggacuucaacaucgucgggaccgugaagggcaagcaguucgagaaguaccagcuguaccgcgagcagcaggggaagugcaucuaccccagcauggacgagaagcagggcaucugcugcuacucccugaagccccucgaccugcaccgcgugcuguacgaggagggguacgccgagaucgaccacgcccucccguacagccgguccuucgacgacagcaagaacaaccgcguccuggugcuggcgaaggagaaccgggacaagggcaaccgcacccccuucgaguaccucggcgacaaggacaacuccgagcccuggcggcaguucguggccuucgucgaggggaacaaggccuaccgccuggccaagcggagccgccugcuccggaaggacuucggcgacaaggaggccaaggaguuccgcgagcggaaccugaacgacacccgcuacaucugcaaguucuucaagaacuacguggagcaguaccugcagcuccacgaggacuccgaggcgaagcggugcgugguccugagcgggcagaugacguccuuccugcgcgcccgguggggccucgugaaggugcgcggggacagcgaccggcaccacgcccuggacgccgccgucguggcggccugcucccacggcauggugaagcgccugagcgacuacucccggcgcaaggagcucgagcagguccgggagggcuucguggacguggacaccggggagaucgucaaccccgccauguuccagcagguccaggagcacuucccgaaccccuggccccacuuccgcgacgaggugaagcugcgccugagcaucgacgacccgacccuccugcgguccgagauggagaaguucggcaccuacacgcccgagagccuggaggcccuccgcccccuguucgugagccgggccccgcagcgccggaacuccggggcggcccacaaggacaccaucuacgcccagccgaagcgccugguggcccagggcggggugacccagaaggucgcgcucagcucccugacccugaaggaccucgacaagcugaucgacccccaccggaacgagcgccuguacgccgccauccgggcccgccucgagcagcacggcggcaagggggacaaggccuuccccgcgagcaacccccugcggaagccggacuccgagggcaaccccacggggcccaucgugcgcggcgugaccauggucaucgacaagcugagcgggauccccauccggggcggcaucgccaagaacgacuccauggugcgcguggacgucuucaccaaggccaacaaguuccaccucgugccgguguacguccaccacagcgugcuggggcugcccaaccaggccaucgugggcgggaaggaggaguccgaguggacccagaucgacgacagcuucgacuggcacuucuccaucuaccccaacgaccucauccgggucacgcugaagcaggagggccgcuucggcuacuacgccgggugcgaccggagcaccgcggccauccaccugugggcccacgaccgcaaccagcaggucggcaaggacgggcucauccgguccaucggcgugaagaccgcccugagcaucgagaaguucaacguggacgugcuggggaaccgcuaccccgccccgcccgagaagcgccgggaccucgcguga

SEQ ID NO: 1701 - RNA, 3486 nt, Artificial Sequence
  Cas9 variant
augaagaagauccugggccucgaccuggggagcgccuccaucggcugggcccugguggaggagaccgagcagaugcaguacaacaucgucagccucgggucccgcaucauccccuacaacggcaccgaggggcaggaguucgagaagggcacgggcgagagccggaacucccugcgcaccaaggcgcggaccgcccgcaagggguacgaccgguaccagcugcgccggaagaaccucgagaagauccugcugcagaacggcauguacccgaacgagcagguccgcgcccuccagaagcuggagcuguggaagcuccgggccgacgcccccaacgugcagaucagccugcccgagcuggggcgccuccuguucuggcugaaccagaagcggggcuacaaguccagccgcuccgacgcgaaccucgacaagaaggacaccgaguacguggccacggucaagagccggcaccagaagaucaaggacgccgggcagaccgugggccaguacuucuacggccagauccuggagaacgaguaccaccgcaucaaggagcaggucuucccccgggaggccuacaucgaggaguucgacgcgaucguggcccgccagaaggaguacuacccgaccauccugaagcaggagcucaucgacaagauccggaacgaggugaucuacuuccagcgcgggcugaagucccagaagggccuggugagcgugugcgaguucgaggggcgggaguucaacggccacuucggcgggcccaagguggcccccaaguccagccccaucuuccagcucggcaagaucugggagaacaucaacaacaucaagaucgccgacaucgagcugaccgccgagcagaagcuggucuucuucaacuaccucaacugccacgagcgcaucacggaggcgaagauccgggagcugcugaagcucuccaaggacagccgccugaacgggcagcugaagaacggccucaccgggaacaagaccuacucccagaucgccagcugcuucggcaacaagaucggcgaguacgagcgccuguucaaguucgagcuggaggugaucgaguccgagaagcucgaguacaccuaccaccccaagagccacaucccggugggggagaagcggcgcaaguacaucagcgagaacgucgagaaggagcccuacuaccggcuguggcacacgaucuacuccaucaaggacaaggacgagugccgcgccgcccugaucaagaacuucggcaucgaggaggagaucgccgagaagcucgcgagccuggacuucuccgccgggggcuucgggaacaagugcgccaaggugauccggaagauccugcccuaccucauggagggcgacaaguacaacguggccauggacuacgccggcuacaaccacagcuucucccagaccaaggacgagaaccugcagcgcguccugcucgacagcaucaaccaccucccgaagaacucccugcggcagcccaucguggagaagauccucaaccagaugaucaaccuggugaacgaggucaucaagcagugggggcgccccgacgagauccggguggagcuggcgcgcaagcugaagcagagcaagaccgagcggaacgacgacgacaacuucaugcgcaagcgggagcgcgagaacgagaucaucaaggccgaccucgccaaguacggccugaaggccacccggaacaacgugaucaaguggcgccuguaccacgagaucgacgacaaggacaagaagcucaacgcccggugcaucuacugcgggcagcccaucucccugacggaggcgauccugggcaacaacgucgacguggagcacaucaucccgaaggacaagcuguucgacgacagccaguccaacaagacccuggcccaccgcagcugcaacuccgggaagggcaacaagaccgccuacgacuucaugaaggacaagccccaguucgaggaguacgucgcccggguggaggagcuguacaagaagcaccucaucagccugaccaagaagcgcaaguuccugauguccgaggacaagauccccagcgacuucaucgaccgccagcuccgggagucccaguacaucgcgcgcaagagccgggagauccugcagacggugugccgcaacgucugguccaccgacggcggggugaccgcccaccuccggaagcuguggggcugggacgacgugaccaugaaccugcagaugcccaaguacaaggggaucggcaugacggagaucgucgagugggagagcaaccacggcaagaaccagcacacccaggaggugaucaaggacuggagcaagcgcgacgaccaccggcaccacgccaucgacgcccugguggucgccugcacccgccagggguacauccagcggaucaacacccucaacuccagcgagacgaaggacgagaugcaccgcaagguggcgggcucccugguggaguucaaccagaagcacacccugcucaacaaguaccugaucaccgagaagccguucaccacgagcgaggucgaggacgugguguccaagauccuggucagcuucaaggccgggaagaaggccgccacccccggcaagcggaagguggggaagcgcggcaacaagcaggucgugcaggacggcaucaucaucccccgcggggcccuccacgcggacuccgugagcggcuccaucaagcaguacgaccccaccgggaacuucgagaaccacaacgugaucaaguacaaggucggcguggggaagggcuaccuguucgacggcaaggacgacaagaagaagaucgacaagaccaucgacugcaucguggacaagaagauccgggaccugaucaagcagcgggccgaggagagcaacuacucccucaagaagauguucgagacgccgauccuguucaaccagcgcgccgucuucagcgugcggugcaagaccgggaacaaggccgugguccccauccgcaacggcuacguggugcccgacaacaaccaccacaccgccaucuacaaguacgacgggggccugaaggagcagugcgucucccucaugcaggcgaucgagcggaagcgcuacaaccugcccaucaucaucaagaacccgaaggagaucuacgacaagaucaccgagaucgccaacaucaaccagcuccuguucgacagccugcccaagcuggacugggaguucgugaccacgcuccagaagaacgacauguucauccuggggauggacuacuccgccaccgaggaggcccuggcggacggcaacuaccggcuccugagcgaguaccuguacaaggugcagaacaucuccgacggcaucuaccgccucugccaccacaccaucaccaaguucgaccugagcaaggccaacaagcccgacaagcgcuucuacaacauccagagccugaaggccuggaacacgcucaacccgcagaaggucaagaucaacauccuggggcagaucgagcggcaguga

SEQ ID NO: 1702 - RNA, 3501 nt, Artificial Sequence
  Cas9 variant
augcacguggagaucgacuucccccacuucagccgcggcgacucccaccuggccaugaacaagaacgagauccuccgggggagcuccguccuguaccgccugggccucgaccuggggagcaacucccugggcugguucgugacccaccucgagaagcgcggggaccggcacgagccgguggcccugggccccggcgggguccggaucuuccccgacggccgcgacccccagagcgggaccuccaacgcgguggaccggcgcauggcccggggcgcccgcaagcggcgcgaccgguucguggagcgccggaaggagcugaucgccgcccucaucaaguacaaccugcugccggacgacgcgcgcgagcggcgcgcccucgagguccuggaccccuacgcccugcggaagacggcccucaccgacacccugcccgcgcaccacguggggcgcgcccuguuccaccucaaccagcggcgcggcuuccagagcaaccgcaagaccgacuccaagcagagcgaggacggcgccaucaagcaggccgccucccggcuggcgacggacaaggggaacgagacccugggcguguucuucgccgacaugcaccuccgcaagagcuacgaggaccggcagaccgccauccgcgccgagcugguccggcuggggaaggaccaccucaccggcaacgcccgcaagaagaucugggcgaaggugcggaagcgccuguucggcgacgaggugcugccccgggccgacgccccgcacgggguccgcgcccgggccacgaucaccggcaccaaggcguccuacgacuacuaccccacccgcgacaugcuccgggacgaguucaacgccaucugggccgggcagagcgcccaccacgccacgaucaccgacgaggcgcgcaccgagaucgagcacaucaucuucuaccagcggccccugaagcccgccaucgugggcaagugcacccuggacccggccacgcgccccuucaaggaggaccccgagggguaccgggcccccuggucccacccgcucgcgcagcgcuuccggauccugagcgaggcccgcaaccuggagauccgcgacaccggcaagggcucccggcgccucaccaaggagcagagcgaccugguggucgccgcccugcucgccaaccgggaggugaaguucgacaagcugcgcacccugcucaagcugcccgcggaggcccgguucaaccuggaguccgaccgccgggccgcccucgacggggaccagacggccgcgcgccugagcgacaagaagggcuucaacaaggccuggcggggguucccgcccgagcgccagaucgccaucguggcccggcuggaggagaccgaggacgagaacgagcucaucgccuggcuggagaaggagugcgcgcuggacggcgccgccgccgcgcgcgucgccaacaccacccuccccgacgggcacugccggcugggccugcgcgccaucaagaagaucgugcccaucaugcaggacggccuggacgaggacgggguggccggcgccggguaccacaucgcggccaagcgggccggcuacgaccacgccaagcuccccacgggggagcagcugggccgccugcccuacuacggccaguggcuccaggacgccgucguggggagcggcgacgcgcgggaccagaaggagaagcaguacgggcaguucccgaaccccaccgugcacaucggccugggccagcugcgccgggucgugaacgaccucaucgacaaguacgggccgcccaccgagaucuccaucgaguucacccgcgcccugaagcugagcgagcagcagaaggccgagcggcagcgcgagcagcgccggaaccaggacaagaacaaggcccgcgccgaggagcucgcgaaguucggccggcccgccaacccccgcaaccugcugaagaugcggcucugggaggagcuggcccacgacccccuggaccgcaagugcgucuacacgggggagcagaucuccaucgagcggcuccugagcgacgagguggacaucgaccacauccugccgguggccaugacccucgacgacucccccgcgaacaagaucaucugcaugcgcuacgccaaccggcacaagcgcaagcagacccccagcgaggccuucggcuccagccccacccugcaggggcaccgguacaacugggacgacaucgccgcccgcgcgacgggccugccgcggaacaagcgcuggcgguucgacgccaacgcccgcgaggaguucgacaagcggggcggguuccucgcccgccagcugaacgagaccggcuggcuggcccggcucgcgaagcaguaccugggggccgucaccgaccccaaccagaucuggguggugcccggccgccugaccuccaugcuccgcgggaaguggggccugaacggccugcuccccagcgacaacuacgccgggguccaggacaaggccgaggaguuccuggccuccacggacgacauggaguucagcggcgugaagaaccgggcggaccaccgccaccacgccaucgacgggcuggugaccgcccucaccgaccggucccugcuguggaagauggccaacgccuacgacgaggagcacgagaaguucgucaucgagccgcccuggcccaccaugcgcgacgaccucaaggcggcccuggagaagaugguggugagccacaagcccgaccacggcaucgaggggaagcugcacgaggacuccgccuacggcuucgucaagccgcucgacgccaccggccugaaggaggaggaggcggggaaccugguguaccggaaggccaucgagagccucaacgagaacgagguggaccgcauccgggacauccagcugcgcacgaucguccgggaccacgugaacguggagaagaccaagggcgucgcccuggccgacgcccuccgccagcugcaggcgcccuccgacgacuacccccaguucaagcacgggcugcggcacgugcgcauccucaagaaggagaagggcgacuaccuggugcccaucgccaaccgggccagcggggucgccuacaaggccuacuccgcgggcgagaacuucugcguggagguguucgagaccgccggcgggaagugggacggcgaggccguccgccgguucgacgccaacaagaagaacgccgggccgaagaucgcgcacgcgccccaguggcgcgacgccaacgagggcgccaagcuggugaugcggauccacaagggcgaccucauccgccuggaccacgaggggcgggcccgcaucauggugguccaccggcuggacgccgccgccggccgcuucaagcucgccgaccacaacgagaccgggaaccuggacaagcgccacgcgacgaacaacgacaucgaccccuuccgguggcugauggccagcuacaacacccucaagaagcuggccgccgugcccgugcgcgucgacgagcugggccggguguggcgcgugaugccgaacuga

SEQ ID NO: 1703 - RNA, 3507 nt, Artificial Sequence
  Cas9 variant
auggcccgccccgccuuccgggcgccgcgccgggagcacgugaacggcuggacccccgacccccaccgcaucagcaagcccuucuucauccuggucuccuggcaccuccugagccggguggugaucgacuccagcuccgggugcuucccgggcaccagccgcgaccacacggacaaguucgccgagugggagugcgccguccagcccuaccggcuguccuucgaccucgggaccaacagcaucggcugggggcugcugaaccucgaccgccagggcaagccccgggagauccgcgcccugggcucccggaucuucagcgacgggcgcgacccccaggacaaggccucccuggcgguggcccggcgccucgcccggcagaugcgccggcgccgggaccgcuaccugacccggcgcacccgccugaugggcgcccucgugcgguucgggcugaugccggcggaccccgccgcccgcaagcggcuggaggucgccguggaccccuaccucgcccgcgagcgggcgacgcgcgagcggcuggagcccuucgagaucggccgcgcccuguuccaccucaaccagcggcgcggguacaagccggugcggaccgccaccaagcccgacgaggaggccggcaaggucaaggaggccguggagcgccuggaggcggccaucgccgccgccggcgcgcccacccugggggccugguucgccuggcggaagacgcgcggcgagacccuccgggcccgccuggccgggaagggcaaggaggcggccuaccccuucuacccggcccggcgcaugcuggaggccgaguucgacacccucugggcggagcaggcccggcaccaccccgaccugcugaccgccgaggcccgcgagauccuccgccaccggaucuuccaccagcgcccccugaagcccccgcccgugggccggugcacgcuguaccccgacgacgggcgcgcgccccgggcccucccgagcgcccagcgccugcggcuguuccaggagcucgccucccugcgcgucauccaccuggaccucagcgagcggccccugacccccgccgagcgcgaccggaucguggccuucgugcagggccggcccccgaaggcggggcggaagcccggcaagguccagaaguccgugcccuucgagaagcugcgcgggcuccuggagcugccgcccggcaccggcuucagccucgaguccgacaagcggcccgagcugcugggggacgagaccggcgcccgcaucgcccccgccuucgggccgggcuggacggcccucccccuggaggagcaggacgcgcugguggagcuccugcugaccgaggccgagcccgagcgggccaucgccgcgcugaccgcccgcugggcccucgacgaggccaccgccgcgaagcuggccggggccacgcugcccgacuuccacggccgguacggccgccgggccgucgccgagcuccugccggugcuggagcgcgagacccgcggggaccccgacggccgggugcgccccauccggcucgacgaggcggucaagcugcugcgcgggggcaaggaccacagcgacuucucccgggagggggcccuccuggacgcccugcccuacuacggcgccgugcucgagcgccacguggccuucggcaccgggaacccggcggaccccgaggagaagcgggucggccgcguggccaaccccaccguccacaucgcccugaaccagcugcggcaccucgugaacgccauccuggcgcgccacgggcggcccgaggagaucgugaucgagcuggcccgcgaccucaagcggagcgccgaggaccgccggcgcgaggacaagcggcaggccgacaaccagaagcgcaacgaggagcggaagcgccugauccugagccucggcgagcgcccgacgccccggaaccugcugaagcuccgccugugggaggagcagggccccgucgagaaccggcgcugccccuacuccggggagaccaucagcaugcggaugcugcucuccgagcaggucgacaucgaccacauccugccguucagcgugucccuggacgacagcgccgcgaacaagguggugugccuccgcgaggccaaccggaucaagcgcaaccggucccccugggaggccuucggccacgacagcgagcgcugggccgggauccuggcccgggcggaggcccugcccaagaacaagcgcuggcgguucgcccccgacgcccucgagaagcuggagggcgagggcggccugcgcgcccggcaccucaacgacacccgccaccugucccggcuggcgguggaguaccuccgcugcgucugcccgaaggugcgggugagccccggccgccugaccgcccugcuccggcgccgcugggggaucgacgccauccuggccgaggccgacgggcccccgcccgagguccccgcggagacgcuggaccccuccccggccgagaagaaccgggccgaccaccgccaccacgcccucgacgcgguggugaucgggugcaucgaccggagcaugguccagcgcgugcagcuggccgccgccuccgccgagcgggaggcggccgcccgcgaggacaacauccggcgcgugcuggagggcuucaaggaggagcccugggacggguuccgggccgagcucgagcgccgggcccgcaccaucgucgugagccaccggcccgagcacggcaucggcggggcgcugcacaaggagaccgccuacggccccguggacccgcccgaggagggguucaaccuggucgugcgcaagcccaucgacggccucuccaaggacgagaucaacagcgugcgggacccccgccugcggcgcgcccugaucgaccggcucgccauccgccgccgggacgccaacgacccggcgaccgcccuggccaaggccgcggaggaccuggccgcccagcccgccucccgcgggauccggcgcguccgggugcucaagaaggagagcaaccccauccgcguggagcacggcggcaaccccuccgggccgcggagcggcgggcccuuccacaagcugcugcucgccggcgagguccaccacguggacguggcgcugcgcgccgacgggcggcgcugggucggccacugggugacgcuguucgaggcccacggcgggcggggcgccgacggggccgcggccccgccccgccucggcgacggcgagcgguuccugaugcgccugcacaagggggacugccucaagcuggagcacaagggccgggugcgcgucaugcaggucgugaagcuggagcccagcuccaacagcguggugguggucgagccccaccaggugaagaccgaccgguccaagcacgugaagaucagcugcgaccagcuccgcgcccgcggggcccgccgggucaccguggacccccugggccgcgugcgcguccacgcccccggggcgcgggugggcaucggcggggacgccggccgcaccgccauggagccggccgaggacaucuccuga

SEQ ID NO: 1704 - RNA, 3513 nt, Artificial Sequence
  Cas9 variant
augagcaaguacaacgugggccuggacaucgggaucgccuccgucggcuggagcaucguggacgccgacaagaagaagaucaucgaccucgggucccgcaucuucagcuccggcaacgcggccgccaaccaggagcggcgcggguuccggggcacccgccggcugauccgccggcgcaagaaccggcugaccgacgugaucaacuucuucggcgagaagaaguucaucgacacgaaggucguggacaagaacgggcacgugcacuacaaguucagcgucaacaacaccgagucccccuacgagcuccgcgugaagggccugagcgagauccugaccaagcaggagcucgugaucgcccuguaccacaucgucaagcaccgggggaucuccuacgaccugggcgaccucgaggacgacgggaccagcggcgugacggacuacaagaccuccaucaacaucaaccgccagcugcugaacgagaagaccgugggccagauccagcucgagcggcugaacgaguucgggaagguccgcggccagguggaggagaacgagaacgugacccugcucaacgucuucccgagcgccgcguacgugaaggaggccacgcagauccugaccaagcagcgggaguucuaccccgagaucaccgacgacuucaucgccaaguucaugcuguucaucacccgcaagcgggacuacuucguggggcccggcaacgagaagucccgcacggacuacggcaucuacaagaaggacgggcggacccucgacaaccuguucgacgagcugaucggcaucgacaagaucaacggggagaagcgcgccagcgcguccagccucaccgcccagaucuacaacaugcugaacgaccugaacaaccucaccguccccaacacggaggacggccggcugaccauccagaccaagaaggagauccuggaggccgccaagaccacgaacgggcuguucggcaucgcccagaucugcaagaucaucggcugcaagaaggacgacaucaagggguuccgcaucgacaaguccgagaagaagaucaugcacacccugagcggcuaccgcaaguuccggaaggagcuggcggacgugaacaucgaggccaacgaccucaacaucaaccuggugaacaagaucgccgacauccugacccucaacaccgagaaggccgagauccgcaagcagcuggacaaguccaacauggacaucagcaacgagaugaaggagaucgucaucaacaagaacaaggaguuccugguggacgggcgggccacguggcacagcuucuccuacaagacccucaaccugcugaucccggagcuccugaacacccccgaggagcagaugaccauccugacgcgccucggccuggugaagcccaacaacaagaaguacgaggggcugaagaacauccccgcgcggcgcaucaccgaggagaucuacaacccggucguggcccgggccacccgcgaggccgucaacguguucaacgccaucaccaagaaggugggccgggacaacaucaaggacgucaucaucgagcucccccgcgaggacaacgagguggacaucaagaagggcaucgugaagcggcagaagcagaacgaggucgagaaggagacggcggacgcccuggugaagcagcacaugaccaucagcgacuccgcccugaucgcccaguaccgcaagauccgggggcucagccagaaggugcgcuacugguaccagcaggacaccaucugccccuacugcggcaagaagaucgaggccguccagcugaucaacaacaacgacuccuucgagguggaccacaucgugcccaucagcgucuccuucgacgacagccagaacaacaaggugcuggugcacucccagugcaaccaggcgaaggagaagcagaccccgcugggguggcucaacaacggcgggggcuucggccagagcaaggccgacuacaucgcccgggucaaguccaacaagaacuacgccaagaacaagaucgacaaccugcugaacgagacggaccucaacgacaucgcgacccagcgcggguucauccagcggaaccugaacgacacccgcuacgccagccggaucgugcugaacgaguucuacuccuucuuccgcagcaacaaccucuccaccaaggugaaggucgugcgcggcaaguggaccagccagaugcggaagaaguggaacggggugggcggccuguccaagacgcgcgacaccuaccaccaccacgccaucgacgccugcaucaucgccugcuucccccugcucaaggcguucgacaaggccaucaagcugaucgacgucgacggggagaccggcgagauccugcaggacaagaaggccaucaagcucgcccaggaggccgagaucguggagaagaucagcgugaucaagaacaagaaguucgagaacauggucaacgagaucuacaacuucccccuguucaagcaggucgagcuggcgaacgacaucaccaaccucgagaaccccgugaaguucucccaccacguggacaagaaggccaaccgggccguggccaaccagacgaucuacgggacccgcaucaaggagaaggaggugaccaagcggggcaagaaggagaagauccaggagcgcuacacccuggggacgaucaagaacaucuacgacaucgacggcuucaugaacuucaagaagcuguacgacaagaucagcaagaacgacgacgucaaguuccucaugcagaagaacgacccgaagaccugggagaagcugaucgacaucuucaacagcuaccccgacuccgaggaggugacccagguggacggcaaggucaagcggguggccgugagccccuucaagcuguacuaccgcgagaacggguucaucaccaaguacuccaagcacaacgacggccccaaggucgugagcaucaaguacuacgacuccaagguggggagccacaucgacaucacgccgaaggacgcgcggaacaaggucauccuccagucccugaagcccuggcgcaccgacguguacuucaacagcaucacccagcaguacgagcugcucggccugaaguacuccgaccugaaguucaccaacgggguguacggcaucacgcgggacgccuacgagaagcucaagcacggcgucagcgaggacggggugaccgccuggaagcccaucuccaagaacagcgaguuccgcuucucccuguaccggaacgaccgcgugcgggucaucgacgagaagggcgacagcaucgagcuccucuucgccucccgcaccaccagcaacgagggguacguggagcugaagcccaucuacaaggcgaaguucgacuccaaggaggaggugggcuucuacgggcuggucagcaacggccggcucaucaagaagaugagcaagggcggguacaagcuguacaaggugaacacggacauccugggcaagccguacuacgugacccgcgaguccgacgagcccaagcucagccuguga

SEQ ID NO: 1705 - RNA, 3516 nt, Artificial Sequence
  Cas9 variant
auggccaaguacagcgugggccuggacaucgggaucuccagcgucggcugggccaucaucgacaucgagaccaagcagaucgugaaccucgggucccgcaucuuccccagcggcaacgcggccgggaaccaggagcggcgcggcuuccggggcauccgccggcugauccgccggcgcaagaaccggcugaccgaccucaagaagcugcugggggagacguucuucuccgaccucaagaagaucgacagcaacggcuacgaguacuacgacaucgacuuccagaucaacgccaacccguacgagcugcgcgugaaggggaucaccgagaagcuguccaagaaggagcucgccgucgugcugcaccacaucaucaagcaccggggcaucagcuacgaccugggggaccucgaggacgacggcaccuccggcgugagcgacuacaagaacuccaucaacaucaaccgccagcugcugcgggagaagaccgucgggcagauccagcucgagcgccugaucgaguucaaccaggugcacggccaggugaagaaggccgaggacgucagccugcucaacguguuccccuccagcgcguaccgggacgaggccaacaagaucaugaucaagcagcaggaguucuacuccgagaucacgaacagcuucauggagcaggucgaccagcuggugucccgcaagcgggacuacuucaucgggcccggcaacgagaagucccgcaccgacuacggcaucuacaagagcgacgggcggacccuggacaaccucuucgccgagcugaucggcaccgacaagaucaacggggagaagcgcgccagcgcgagcucccugacggcccagguguacaaccuccugaacgaccugaacaaccuccacgugagcaacaccgaggacggcaagcugaccaccuccacgaagaaggagaucaucaaggccgccaagaccaccgacggggucuucggcaucagccagaucugcaagaucaucggcugcaagaaggaggagaucaccggguuccggcaggacaaguccgagaagaaggugauccacacgcuggccggcuaccgcaagauccgcaaggcgcucgccaccaucaacaucgaggccaacgagcugaaccccaccguguucgaccagaucgccgacauccugacccucaacacggagaaggccgagauccggaagcagcuggacaagguccagcuggacaucaccgacgagaugaaggagcucgugaucgacaagaacaaggacuuccugguggacgggcgcgcgaccuggcacagcuucuccuaccagacccugaacaugcucaucccggagcugcugaacacgagcgaggagcagaugaccauccucacccggaugggccugaugaaguccgacaacgagaaguaccgcgggcugaagaagauccccgccgagaagaucgccagcgagaucuucaaccccgucguggccaaguccacccgggaggccaucaagguguucaacgcgaucagcaaggagaucggcaagaacaacaucgagcacgucgugaucgagcucccccgcgacgacaacgaggaggacgagaagcggaagauccagaagcugcagaaggccaacgagacggagaaggaggccgccgacaaccuggucaagcacaagcucggcaucuccgacagcgcccugaucgcgcacuaccgcaaguucaaggggcugucccagaaggugcgguacugguaccagcaggagaccuacugcccguacugcggcaagaucaucgaggccacccagcugaucaacaacaacgacaacuucgagguggaccacaucauccccaucagcgucuccuacgacgacagccagaacaacaaggugcucgugcacucccagugcaaccaggccaaggagaagcagacgccccugggguggaucaacaacggcgggggcuucggccagagcaagaacgaguacaccaaccgcgucaagaacaacaagaaguacagcaagaacaagguggacaaccugcucaacgagaccgaccugaccgacaucaucacccagcgguccuucauccagcgcaaccugaacgacacgcgguacgccgcgcgcaccgugcucgacgaguucuacagcuucuucaaguccaacgaccugcccaccaaggucaagguggugcgggggaaguggaccagccagaugcgccggaaguggaacaacgucggcgggcugcgcaagacccgggacacgcaccaccaccacgccaucgacgccuccaucaucgccagcuucccgcuccugcgcgccuucgaccgcgcgaucaagcugaucgacguggacaaggagaccggcgagaucgugcaguacggcaaggccucccucaacggggacgucaucgaggagaaguccgugauccaggcccccaucaucaagaacgagaaguucgagaagcugguggacgagaucuacaacuucccccuguucaagcaggucgagcucgccaacaacaucgagaaccccgagaacccggugaaguucagccaccacguggacaagaaggccaaccggaccgucgcgaaccagaccaucuacagcacgcgcaucaagaagaccgagaagaucgugcggaagaaggugaccgccaaggaggaggaguacgucaucggcaccaucaaggacaucuacgacgugacgaacuucgagaaguucaagaagcuguacgacgaguccagcaagaaggacgacaucaaguuccugaugcagaagaacgaccccaagaccugggagaagcucguggagaucaugaacaccuaccccgacuacgaggagaucucccagcuggacgggaaggucaagcgcgugaaggugagccccuucaagcuguacuuccgggagaacggcuucaucaccaaguacgccaagcacaacaacgggccgaaggucguguccaucaaguacuacgacagcaagcucggcaaccacaucgacaucacgcccgugaacgccaacaacaaggucauccugcagucccugaagcccuggcgcaccgacguguacuacaacaacgagacccagcaguacgagcuccugggccugaaguacagcgaccucaaguucaccaaggggguguacggcaucacgcgggaggccuacgagaagcugaaguacggguacaccgacggcguccccgcguggaagccgaucagcaaggaguccgaguucaaguucagccuguaccgcaacgaccgggugcgcaucaucaacgaggccggggagaagaucgaccuccuguucggcucccggaacgagaccagcgagggcuacguggagaugaagcccaucuucaagaccaacuucgacgacgccgaggaggccuccuucuacgggaagacgagcaacaagcgccugaucaagaagauggcgcggaagggcuaccagaucuacaaggucaacaccgacauccucgggaaccuguacuacaccgccaaggaguccaacgagcccaagcuggaccucuga

SEQ ID NO: 1706 - RNA, 3519 nt, Artificial Sequence
  Cas9 variant
augcgcaagcccuacagcaucggccuggacaucgggaccaacuccgugggcugggccgucaucaccgacgacuacaaggugccgagcaagaagaugcggauccaggggacgaccgaccgcaccuccaucaagaagaaccucaucggcgcccugcuguucgacaacggggagaccgcggaggccacgcggcucaagcgcaccacccggcgccgguacacccgccggaaguaccgcaucaaggagcugcagaagaucuucagcuccgagaugaacgagcuggacaucgccuucuucccccggcucagcgaguccuuccuggugagcgacgacaaggaguucgagaaccaccccaucuucggcaaccugaaggacgagaucacguaccacaacgacuaccccaccaucuaccaccuccgccagacccuggccgacuccgaccagaaggccgaccugcggcucaucuaccuggcgcuggcccacaucaucaaguuccgcggccacuuccucaucgaggggaaccuggacagcgagaacaccgacguccacgugcuguuccucaaccuggugaacaucuacaacaaccuguucgaggaggacaucgucgagacggccuccaucgacgccgagaagauccucaccagcaagaccuccaagagccggcgccuggagaaccugaucgcggagaucccgaaccagaagcggaacaugcuguucggcaaccuggugucccuggcccucgggcugacccccaacuucaagacgaacuucgagcugcucgaggacgccaagcugcagaucagcaaggacuccuacgaggaggaccuggacaaccuccuggcccagaucggcgaccaguacgccgaccuguucaucgcggccaagaagcucagcgacgccauccugcuguccgacaucaucaccgugaagggggccagcaccaaggcgccccucagcgccuccaugguccagcgcuacgaggagcaccagcaggaccuggcccugcucaagaaccuggugaagaagcagauccccgagaaguacaaggagaucuucgacaacaaggagaagaacggcuacgccggcuacaucgacgggaagaccagccaggaggaguucuacaaguacaucaagccgauccugcucaagcuggacggcacggagaagcugaucuccaagcucgagcgggaggacuuccugcgcaagcagcggaccuucgacaacgggagcaucccccaccagauccaccugaacgagcugaaggccaucauccgccgccaggagaaguucuaccccuuccucaaggagaaccagaagaagaucgagaagcuguucaccuucaagauccccuacuacgugggcccgcuggccaacggccaguccagcuucgcguggcucaagcggcaguccaacgagagcaucacccccuggaacuucgaggaggucguggaccaggaggccuccgcccgcgccuucaucgagcggaugacgaacuucgacaccuaccugcccgaggagaaggugcugcccaagcacagcccgcucuacgagauguucauggucuacaacgagcugaccaaggugaaguaccagaccgaggggaugaagcgccccguguuccuguccagcgaggacaaggaggagaucgucaaccuccuguucaagaaggagcggaaggugacggugaagcagcugaaggaggaguacuucuccaagaugaagugcuuccacaccgucaccauccucggcguggaggaccgcuucaacgccagccuggggaccuaccacgaccugcucaagaucuucaaggacaaggcguuccuggacgacgaggccaaccaggacauccuggaggagaucguguggacgcucacccuguucgaggaccaggccaugaucgagcggcgccuggucaaguacgccgacguguucgagaaguccguccucaagaagcugaagaagcggcacuacaccggcugggggcgccugagccagaagcucaucaacggcaucaaggacaagcagaccggcaagacgauccugggguuccugaaggacgacggcguggcgaaccggaacuucaugcagcucaucaacgacuccagccuggacuucgccaagaucaucaagaacgagcaggagaagaccaucaagaacgagucccuggaggagaccaucgccaaccucgccgggagccccgccaucaagaagggcauccugcagagcaucaagaucguggacgagaucgucaagaucauggggcagaaccccgacaacaucgugaucgagauggcgcgcgagaaccaguccaccaugcagggcaucaagaacagccggcagcgccugcggaagcucgaggaggugcacaagaacaccggcuccaagauccugaaggaguacaacgucagcaacacgcagcugcaguccgaccgccucuaccuguaccugcuccaggacgggaaggacauguacaccggcaaggagcuggacuacgacaaccugagccaguacgacaucgaccacaucaucccgcaguccuucaucaaggacaacagcaucgacaacaccgugcucaccacgcaggccuccaaccggggcaagagcgacaacgugcccaacaucgagaccgucaacaagaugaaguccuucugguacaagcagcucaagagcggggccaucucccagcgcaaguucgaccaccugaccaaggccgagcgcggggcccucagcgacuucgacaaggcgggcuucaucaagcgccagcugguggagacccgccagaucacgaagcacguggcccagauccuggacucccgguucaacagcaaccucaccgaggacuccaagagcaaccgcaacgucaagaucaucacccucaagagcaagaugguguccgacuuccggaaggacuucggcuucuacaagcugcgcgaggugaacgacuaccaccacgcccaggacgccuaccugaacgccgucguggggaccgcgcugcugaagaaguaccccaagcucgaggccgaguucguguacggcgacuacaagcacuacgaccuggccaagcugaugauccagcccgacagcucccucgggaaggccacgacccggauguucuucuacagcaaccugaugaacuucuucaagaaggagaucaagcuggcggacgacaccaucuucacccgcccgcagaucgaggucaacacggagaccggcgagaucgugugggacaaggugaaggacaugcagaccauccggaaggucauguccuacccccaggugaacaucgugaugaagaccgagguccagacgggcggguucagcaaggaguccaucuggcccaagggcgacagcgacaagcucaucgcccgcaagaaguccugggaccccaagaaguacgggggcuucgacagcccgaucaucgccuacuccgugcugguggucgccaagaacugcaagcggaagaacagcaagaccaagaacuaccagcggaccugcgggaacaagaacaacggcacccgguga

SEQ ID NO: 1707 - RNA, 3522 nt, Artificial Sequence
  Cas9 variant
augcgccccaucgagccguggauccugggccucgacaucgggaccgacagccugggcugggccguguucuccugcgaggagaaggggccgcccaccgccaaggagcugcucggcgggggcguccggcuguucgacagcggccgcgacgcgaaggaccacacgucccggcaggccgagcgcggggccuuccggcgcgcccggcgccagacccggaccuggcccuggcgccgggaccgccugaucgcccucuuccaggcggccggccugaccccgcccgccgccgagacgcggcagaucgcgcuggcccuccgccgggaggccgugagccgcccccuggcccccgacgcccugugggcggcccuccugcaccuggcccaccaccggggguuccgcuccaaccggaucgacaagcgcgagcgggccgccgcgaaggcccucgccaaggccaagccggccaaggcgaccgccaaggccaccgcccccgccaaggaggcggacgacgaggccggcuucugggagggggccgaggccgcgcugcgccagcgcauggccgccagcggcgcccccaccgugggcgcccugcucgcggacgaccuggaccgggggcagcccguccgcaugcgguacaaccaguccgaccgcgacggcgugguggccccgacgcgggcccugaucgccgaggagcucgccgagaucgucgcgcgccagagcuccgccuaccccgggcuggacuggcccgccgugacccggcuggugcucgaccagcgcccccugcggagcaagggcgccggcccgugcgccuuccugcccggggaggaccgcgcgcuccgggcccugcccaccguccaggacuucaucauccgccagacccuggccaaccuccggcugcccuccacgagcgccgacgagccgcgcccccugaccgacgaggagcacgcgaaggcccucgcccugcuguccaccgcccgguucguggaguggcccgcccuccgccgggcgcugggccugaagcgcggggugaaguucaccgccgagacggagcggaacggcgccaagcaggccgcccgcgggaccgcgggcaaccucaccgaggccauccuggcgccccugaucccgggcuggagcgggugggaccucgaccgcaaggaccgggucuucuccgaccugugggccgcccgccaggaccggagcgcccugcucgcccugaucggcgacccccgcgggcccacccgggugacggaggacgagaccgccgaggccguggcggacgccauccagaucguccugcccaccggccgcgccucccucagcgccaaggccgcgcgggccaucgcccaggccauggccccggggaucggcuacgacgaggcggugacccuggcccugggccugcaccacucccaccgcccccggcaggagcgccucgcccggcugcccuacuacgccgccgcgcugccggacguggggcucgacggcgaccccgucgggcccccgcccgccgaggacgacggcgccgccgccgaggcguacuacgggcgcaucggcaacaucagcgugcacaucgcccugaacgagacgcggaagaucgugaacgcccugcuccaccgccacggccccauccugcggcuggucaugguggagaccacccgcgagcucaaggccggggcggacgagcggaagcgcaugaucgccgagcaggccgagcgggagcgcgagaacgccgagaucgacguggagcugcgcaagagcgaccgguggauggccaacgcgcgcgagcggcgccagcggguccgccuggcccggcgccagaacaaccucugccccuacaccuccacgcccaucggccacgccgaccugcugggggacgccuacgacaucgaccacgugaucccccucgcccggggcggccgcgacagccuggacaacaugguccugugccaguccgacgcgaacaagaccaagggggacaagacccccugggaggccuuccacgacaagcccggcuggaucgcccagcgggacgacuuccucgcccgccuggacccccagaccgccaaggcgcuggccuggcgguucgccgacgacgccggggagcgcguggcgcgcaagagcgccgaggacgaggaccagggcuuccucccgcggcagcugacggacaccggguacaucgcccggguggcccugcgcuaccucucccuggucaccaacgagcccaacgccgugguggcgaccaacggccggcugacgggccuccugcgccuggccugggacaucacccccgggcccgccccgcgggaccuccugcccacgccccgcgacgcccugcgcgacgacaccgccgcgcggcgcuuccucgacggccugacgcccccgccccuggccaaggccgucgagggggccgugcaggcccggcucgcggcccugggccgcagccggguggccgacgccgggcuggcggacgcccucggccugacccuggccucccucggcgggggcgggaagaaccgcgccgaccaccggcaccacuucaucgacgccgcgaugaucgccgucaccacccgcggccugaucaaccagaucaaccaggccagcggggccggccggauccuggaccuccgcaaguggccccggaccaacuucgagcccccguaccccaccuuccgcgccgaggugaugaagcagugggaccacauccaccccuccauccggccggcgcaccgcgacggcgggagccugcacgccgccaccguguucggcguccggaaccgccccgacgcccgggugcuggugcagcgcaagcccgucgagaagcuguuccucgacgccaacgcgaagccccugccggccgacaagaucgccgagaucaucgacggguucgccagcccccggauggccaagcgcuucaaggcgcuccuggcccgguaccaggccgcccaccccgaggugcccccggcgcuggccgcccucgccguggcccgcgaccccgcguucggcccccgcgggaugaccgccaacaccgucaucgccggccgguccgacggcgacggggaggacgccggccugaucacgcccuuccgcgccaacccgaaggcggccgugcggaccauggggaacgccguguacgaggucugggagauccaggugaagggccgcccccgguggacccaccgcgugcugacccgguucgaccgcacgcagcccgcgcccccgcccccgcccgagaacgcccggcucgucaugcgccugcggcgcggcgaccugguguacuggccccucgaguccggggaccggcuguuccuggugaagaagauggccgucgacggccgccucgcccuguggcccgcccggcuggccaccgggaaggcgaccgcccucuacgcccagcugagcugccccaacaucaaccugaacggcgaccagggguacugcgugcaguccgccgagggcauccgcaaggagaagauccggaccacgagcugcaccgcccucggccgccugcggcuguccaagaaggcgaccuga

SEQ ID NO: 1708 - RNA, 3525 nt, Artificial Sequence
  Cas9 variant
augggcaaguacagcaucgggcuggacaucggcaucuccagcguggggugguccaucaucgacaucgagaagaagaagaucgucgaccucggcagccgcaucuuccccuccgggaacgccgccgcgaaccaggaccggcgcggcuaccggggcacccgccggcugauccgccggcgcaagaaccggcuggccgacgugaucaacuuccucggggaggagaacuucaucgacaccaagguggucgaccagaacggcaacauccacuacaagcugcuggugaacagcacggaguccccguacaagcuccgcgugaaggggcugagcaagaugcugaccaagcaggagcucgucaucgcccuguaccacaucgugaagcaccggggcaucuccuacgaccugggggaccucgaggacgacggcaccagcggcgugaccgacuacaagacguccaucaacaucaaccgccagcugcugaucaagaagaccgucgggcagauccagcucgagcggcugaaggaguucggcaaggugcgcgggcacgugaagaaggacgagaacaucacccugcucaacgucuuccccagcuccgccuacgugaaggaggccacccagauccugacgaagcagcgggaguucuaccccgagaucaccgacgacuucaucaccaaguucauccccuucaucagccgcaagcgggacuacuucgugggcccgggcaacgagaagucccgcaccgacuacgggaucuacaagaaggacggccggacgcuggacaaccucuucgacgagcugaucgggaucgacaagaucagcggcgagaagcgcgcguccgccagcuccgucaccgcccagaucuacaacaugcugaacgaccucaacaaccugaccgugaccaacacggaggacgggaagcugaccacccagaccaagcgggagaucaucgaggccgacaagacgaccaacggccucuucggcaucacccagaucugcaagaucaucgggugcaagaaggacgacaucaagggcuuccgcaucgacaagguggagaagcccaucaugcacacccugagcggguaccgccgguuccgcaaggagcuggcgaagaucaacaucgaggccaacgaccucgacaucaaccuggucaacaagaucgccgacauccugacgcucaacaccgagaaggccgagauccggaagcagcugaacaagagcaacaucgacguguccaacgagaucaaggagcugaucaucaacaagaacaaggacuuccucguggacggccgcgccaccuggcacagcuucuccuacaagacccugaaccugcucauccccgagcugaugaacacgagcgaggagcagaucaccauccugacccggcucgggcuggucaaguccaacagcgagaaguacaagggccugaagaacauccccgcgcgccggaucaccgagggcaucuacaacccggugguggccaaggccacgcgcgaggccgucaacguguucaacgccaucgcgaagaagaucgggcgggacaacaucuccgacgucgugaucgagcucccccgcgaggacaacgaggccgacaucaagaagggcaucgugaagcggcagaagcagaacgagcuggagaaggaggccgccgacgcccuggucaagcagcagaugaccaucagcgacuccgcgcucguggcccacuaccgcaaggugcgggggcugagccagaagguccgcuacugguaccagcaggggaccugcugccccuacugcggcaagaacaucgaggccgugcagcugaucaacaacaacgacuccuucgagguggaccacaucauccccaucagcgucuccuucgacgacagccagaacaacaaggugcuggugcacucccagugcaaccaggccaagggcaagcagaccccgcucggcuggcugaacaacgggggcggguucggccagaacaagacggaguacgucgccaaggugaagaccaacaagaacuacagcaagaacaagauggacaaccugcucaacgacauggaccuguccgacaucgugacccagcggggcuucauccagcgcaaccugaacgacacccgguacgcgagccgcaucguccucgacgaguucuacuccuucuucaagagcaacaaccugagcaccaaggugaagaucgugcgggggaaguggacgucccagaugcgcaagaaguggaacggcgucgggggccugaagaagacccgcgacaccuaccaccaccacgccaucgacgccagcaucaucgccuccuucccccuccugaagguguucgacaaggcgaucaagcugaucgacaucgaccgggagaccggggagauccuccaggacaaggaggccaucaagaugagccaggaggccaagcugcuggagaagauccccgugauccagaacgagaaguucgaggagcucaucaacgagcuguacgacuucccccuguucaagcaggucgagcucgccaacgacaucacgaacccggagaaccccgugaaguucucccaccacguggacaagaaggccaaccgcagcgucgcgaaccagaccaucuacggcacccggaucaaggagaaggagaucaacaagcgcggcaagguggagaaggugcaggagcgguacauccuggggaccaucaagaacaucuacgacaucgacuccuucacgagcuucaagaagaucuacgacaagauguccaagaccggcgacgucaaguuccugaugcagaagaaggaccccaagaccugggggaagcucguggagauccugaacagcuaccccgacuccgaggagaucacccagguggacggcaaggucaagcgcgugaaggugagcccguucgagcuguaccggcgcgagaacgacuucaucacgaaguacgccaagcacaacgacgggcccaagaucgucuccaucaaguacuacgacagcaagaucggcucccacaucgacaucacccccaucaacgccaagaacaagguggugcuccagagccugaagcccuggcggaccgacgucuacuucaacuccgagacccgccaguacgagcugcucggccugaaguacagcgaccugaaguucacgaacgggguguacggcaucaccagcgaggccuacgagaagcucaagcacgggaucuccgaggacggcaccaagaccuggaagccgaucgggaagaacagcggcuuccgguucucccuguaccgcaacaaccgggugaagaucgucgacgagaagggcgagagccuggagcuccuguucgccucccgcacgaccagcaacgagggguacguggagcugaagcccaucuacaaguccaaguucgacagcaaggaggacgugggcuucuacgggcagaugacccccuccggccaguucgucaagaagauggcgcgggugggguacaagcucuacaaggugaacaccgacguccugggcaaccccuacuacaucacgaaggagagcgacgacccggagcugucccucuacaagaaguga

SEQ ID NO: 1709 - RNA, 3528 nt, Artificial Sequence
  Cas9 variant
auggaggagaugaagcagaccggccgcaagaacgaggcccccaagcugaccgaccucaacuaccggaucgggcuggacaucggcaucgccagcguggggugggcgguccuggagaacaacucccacgacgagccguuccgcaucaucgaccucggcgugcggaucuucgacacggccgagcagcccaagaccggggccagccuggcccugccccgccgggaggcccgcuccgcgcggcgccggauccgccggcgccgggaccgcaucgagcggaucaagaagcuguuccaggccgagggccugaucaacaucgacgaguucgaggcccgcuacaagaucgccggccugagcgacguguacaagcuccgguacgaggggcuggaccgcaagcugaccgacgacgagcucgcgcagguccugcugcacaucgccaagcaccggggcuucaaguccaccagcaaggccgaggaggccgagaacgagaacgacgccgcgaagaagaaggaggccggggcccucaagaagggcaucuccaacaacaagaagcugauggaggagaagggguaccgcacggugggcgagaugauguaccuggacgagaacuuccggaccgacugccccuggaacgagaacggcuacauccucaccccgcgcaacaagagcggggacuacaagcacaccgugcugcgcgacaugcuggucgacgaggugcgggagaucuucaagucccagcgcagccucggcaacauccacgccuccgaggagcuggagaacgccuaccuggacaucaugcucagccagcgguccuucgacauggggcccggcgcgcccagcaaguacgccauggagggcuucgaggaccgcguggggcugugcacguucgagggcaagaacggggagaagcgggccgccaaggccgcguacaccuccgagcuguucgucgcccucgagaagaucaaccacaccaagaucgugagcgacgacggcgccacccgcuuccugacgaccuacgagcggaaguccaucaucgagcugaugcacaagcagcagaccgugaaguacgccgccguccgcaaggcgaucgggcucgccgaggaggacaaguucuacaaccugaacuacagccccaaggccggcuccaagaaguccccggaggacaccgacuucgugaagcuggagaacuaccacaagauccggaaggcccucggcgaggacaucgugagcgagcaccuccccgcggagaagaucaagcuguacgacagcaucgccacgauccucacccuguucaagaacgacgacagccgcaucaagcgguucaucgagcuggggaucggcgaggagugcuucgacgggcuccugucccugagccccuccaaguuccacaaccucagccuggucgccaugggcaagaucauccccuuccugcucgacgggaacaccuacgacaaggccugcgagcuggccggcuacgacuucaaggcggacaacaagggcgagaaguccgugcugcucaaggggaagaacaucaccgacauggugaacgacaucacgaacccggucgugcgccggagcgugucccagaccaucaaggucaucaacgccaucauccuggaguacggcagcccccaggccgugaacaucgagcuggcccgcgagauguccaagaacuucgacgagcggcgcaagcucaagagcgacauggagucccgggagaaggagaacaacaacgugaucaagcgcgucaaggaguacaagcugaaccccaccgggcaggacaucgugaaguuccggcugugggaggagcaggaccgccgcugccuguacagcggcgagaagaucgacaucaacgaccucuucucccgggacgggggcuacgacgucgaccacauccugcccuacagcaucaccuucgacgacacguaccgcaacaaggugcuggugaaggccuccgagaaccggcagaagggcaaccgcaccccguacgaguacuucauggcggagaaggacgacgacgaguggaacgucuacgagacccucgugcggaacaccgugaaggacuacaagaagguccugaagcugcucaagaagcacaucacggaggacgagaaguccgaguuccgcgagcggaaccugaccgacaccaaguacaucacccgcaucaucuacaacaugauccggcagaaccuggugcucaagcccuaccugagccuggagaaggagcgcaagaagcaggucauggccgugaacgggagcaucacgcacuaccucagcaagcgguggggccuggaguccaaggaccgccggaccgacacccaccacgcccaggacgccguggugaucgccugcaccacggacgggaugaucaacaagaucagccgcuacuccaagggccgggagcugcucuacagccgcggcuucaaguucgucgacgaggagaccggggagauccugucccgggacaacuucacccgcgaggagugggacgagaaguacggcgugaagauccccauccccugggagcacuuccgggacgagcuggacauccgcaugagccgguacaacgggaccggcgacgacuccaucgacaagaccacgccgcgcgacuucauccucagccaccgcgacgcgcacaaguggaucaacuaccccgaguggauguucguggaggggcggcccggccgccggggcguccuggacgggaucuucgugucccgcaugcccaagcacaaggugagcggccaggcccacgaggagaccguccgguccgccaaguacuacaacgacgggggcagcguguucgaguccgggggcuacguggucaccaagaaguccauccaggacaucaagcugaaggacggcgagaucaaggaguucuucaacccggacagcgaccgccuccuguacaacgcccugguggaccggcucaacaaguucgagaacgaccccaagaaggcguucgccgagcccuucuacaagcccaaggccgacgggacccagggcccgaucgugaagaagaucaaggucuucgagaagcagagcuccgggguguucgugcgcgacggcaaggggaucgccgccaacggcgcgaugguccggaucgacguguucugcgaggaggacaagggcaagaagaaguacuacuucgugcccaucuacacggccgacgucgugaagaagaagcugcccgaccgcgccgccaccgccaacaagcugaucagcgaguggcgggugaugaaggaggagaacuucaucuucagccucuacucccgcgaccugaucuacaucgagagcgacaaggggguccaggugaaggacaucgacggcaagaucuccaagccggugaaccuguucgcguacuaccucggggccgacaccagcaccgccuccaucagcggcaagcugcacgacuccagcgccaacuuccgguccaucgggauccagggccugcgccgguucgacaagugccaggucgacgugcucggcaacaucagcuucgugaacaaggagaagcgcaugcccuucaacuga

SEQ ID NO: 1710 - RNA, 3531 nt, Artificial Sequence
  Cas9 variant
augaacaaggugcaggaggacugcuacaagaagaucaaggagaagcuggccgaccgcgaguaccggaucggccucgaccugggggucggcagcaucggguacgccguggugucccugaagggcgacaugcccgaggacgucauccucgcggggagccgcaucuucaaguccagcaucggcgccgccgagcggcgccacuuccgggcccagcgcaacacccaccggcaccaccgcgagcggaugcgcuaccuguggaagcugcucgccgagaagaaccuggcgcugcagcucccggagaaccuguccaagaaggagaacuucaccgacuucgacacgagccggaagcgcuuccccaucgaggugcugcggaacgaccccuacauccuccgcuacaaggcccuggacgagaagcugucccucuuccagcugggcuacgcccuguaccacaucgccaaccaccgggggaccgcgagcgugcgcuccuuccucgaggacgacgaggccaaggucaaggagaacaaggagaccgccaagcuggccaagaacaccaagaagaucauguacgagaagaaguaccggacguucggcgaguaccuguaccgcgagcggaucgagaaguuccgccagaacgagcggaugaaggugaccaacaagaacgagaacaaggaguucgccgugacccgcgacaucaucgagaaggaggucgagaugauccucggggcgcagaagcgcuacaacaccgccgugcuggccgacgacuacaucgagcggaucaagaaggccaucuucuacgagacggagaagcugauccccgagccggaguacugccccuacuucaaggacgacaagcgccucccccggagccacaagcugaacgaguaccgccggaucuacgaggcccugaacaacacccgcuacuacauccccgagaucgaggagaagaccggcgagauccucucccggaaggagaaggagcagcugagcaaggaggagaaggagaagcuguucaacuuccuccugaagaacaaggagcugaccgaggcgaaggugaagaagcuccugaaccuguccgagauggccaagguccagcuccaggggcgcgacaagaagaaccagaagaucaagggcuacgcccugaucacgcuggagagccucccguucugguccaagcugcccgagcagcagcaggacgaguuccuguacgacuggaacaagcuccccgacgagaagcugaaggaccggcugcgcaacuacuacaagcucaccgacgacgagaucgacgagaccuuccagaacaucgugcugcccagcaacuacgccccgcugggcaagaaggccauggagauccuccuggaguacaucaagaacgggcuguccuacaucgaggcgcuggacaaggccgccgacgagaacaagaucaagguggagaagcacgagaucaacgaccuccugcccuacuacggcaagauccugcaggagagcacccagaugcccaucgggaaggccuucuccaagcaguucgccgcgaagaacuacaagaagcccgacaucaacaagaacgagcaggaguucggccggaucgccaacccggucgugcaccagacgcucaacgagcugcgcaagcugaucaacgagaucaucaccguguucggcaagaagccccucgagaucagccuggagaccagccgggagcugaagaagucccagaaggagcgcgagcucaucgccaagcagcaggacaucgacgaggagaagcggaagaagaucuggaagaccuacaucgagccccaccuccagcagaucaagagccgcuccgacaagcugaagaagcuguucgucuucgagcugugggaggaccagaagcacaacugccccuucugccuggagaagaucaacguggacgacaucuacagccgcgggguggacaaggagcaccucuucccgcugaagaaguccgaggacgacagcgagaacaaccuggucaucgcccacaacaagugcaacgcgcgcaaggccgagcgggcccccuucgacgccuucggccacgaguccaucuggaacgacaucuucagcaacgccgagaagaaccucccccgcaagcuguggcgcuuccggcagggguccuucgagaaguuccuggagaagcccccgaugcucaagcgcuucgagacggacaacagcuacaucuccaagaucagcgcgcgguaccuggccugccuguucgacaagcccuccaagaucuucugcgugaagcccuuccucaccgcccagcugcgcaucgccuggcagcuggacgagaucaugauccggcucgccgagaacaucauccuggacagcgagaaggacuccuucaacaagggcgggcugcagaagaagaagcgcaucgacaaccggcaccacgcgcucgacgccguggucaucgccuacgccagccgcggcuaccacaacuuccugaaccgggugcacgccaagggcuacaagaucaacuacgacgagaagaccuggcuguccgagacccuccggcccccggggaacaagaaccuggaggacuucaagagcggcaucaucaacgucaugaucaacgcgaacaucuccaucaagcacgaccacaacaacaaggggcagcuggucaagagcaaggccuacaagcucuacuacagcgagaucggcaaguacaucaucacgacccugaaguccgugagcgagauccuguucaagcagaaggagaagccccaggacacccuccggcgcgcccugugcaaguucgaggaccggcuguccgacaucaaggacaagaagcuccgcaagaagcuggaggacaacaucaccaucuacaagagcaucgagaacgaguccgcccugagcaaggcgaagcaggagcucgaggaguucgaccugaaggccaagaaggaggggaagaagggcuacgagaagaucacggacauccugaucuacaagaaggccugcuccaugcacggcgggaaguacauccacgugaagaaccggaucgagaacaaguucuucgcccucaaggagcccaccgagaucgagaccggcuucggguacgacaccgccgacaaccugagccuggaccucuaccacgacaacaacggcaagcugugcggggaggugauccgcaagaucgacuucaaccggaaccgcgugccgaacuacaagaaggagggcuacauccugcucgagcggaucuaccagggcgacacgcuggaggucgacaucuccgacgacaagaucagccugaagaacaaggugggguccgcgcccgacaagcgcaccuucgugaagguccucaccuucaccgagagcgaccgguaccugaagaacaagcgcgaccagauccagaucuucuucugcaaccugcucaaguccacgcugaagcacgacgacagcuccaagcacgacgacagcuucuacguguccagcaugcagaaguacaacgugcgcaaggucauccugaccagccucggcaucaucaaguaccgguccaagauccugaagaacaaggagaucuga

SEQ ID NO: 1711 - RNA, 3531 nt, Artificial Sequence
  Cas9 variant
augcuguuccccaagaagcucagcaaggaggagguggccuacguccugguggagaucaacuccaaccugaacaacagcuccaacuaccucggcaacaucagcgaccgcuccaaggagcuguacuucaacaagcagaccaucgggcaguuccuguacaccaagcucaaggaggaccggcacuacagccugaagaacaagguguucuaccgccaggacuaccuggacgaguucgagcggaucugggagacgcaggccaucuuccacaaggagcucaccgaggaccugaagaagcagauccgcgacaccaucaucuucuaccagcggcgccugaagucccagaagggccucaucagccugugcgaguucgagaacaaggagaucaccaucgagaaggaggggaagacggucaccaagcagaucggcgugcgggugaucccgaaguccagcccccuguuccaggaguucaagaucuggcagauccucaacaacgucaucugcaagaagaaggggacccgcaagaagaaggcggugacccccgcgccccugcuguucgagcuguucggcacgccguccgagaccuucuucagccuggacauggagugcaagcagcuccucuucgaggagcugaaccugaagggcaaccucaaggccgacaaggugauccggcugcugggguacaucccccaggagugggagaucaacuacaaccagcucgagggcaaccgcacccagaagucccuguacgaggccuaccugaagaucaucgagaucgagggguacgacaucaagaccuuccuccggaucaagagcgacaaggaggacugggaccuggaggagagcccccuguccgccaaggagauccgcgagaacauccagcacaucuucgagacgcucggcaucuccaccgccauccuguacuucgacgccacccugcccaucaaggacuucgagaagcaggccagcuaccagcucuggcaccuccuguacuccuacgagagcgacaacagcccguccgggaacgagacccuguacaagcugcugcaggacaaguucggcuucaagcgggagcacgccgucuuccucagcaacaucuccuuccaggacgacuacggcagccuguccgcgaaggccauccgcaagaucuaccccuacaucaaggagaaccaguacagcacggccugcgagcuggccggguaccggcacuccaagcucagccugaccaaggaggagcugaacaaccgcccccucaaggaccugaucagcccccugaagaagaacucccugcggaacccggugguggagaagggccucaaccagaugaucaacgucgugaacgcccugaucgagaagaacuccgagaaggacgcggaggggaacaucaucaaguacuuccacuucgacgagauccgcaucgagcuggcccgggagcucaagaagaacgcccaggagcgcgccgagaugacccugaacaucaagaacgccaccaucgagcaggagaagaucaagagcauccugaucuccgacuucggcaucaagaaccccacgaagaacgacaucacccgguaccgccucuaccaggagcuggcgcacaacgacuacaaggaccuguacaccaacaccgacauccccaaggagcuccuguucagcaagaacaucgacaucgagcacaucgugcccaaggcccgcgucuucgacgacuccuucagcaacaagacgcuggccuaccgggacuucaaccucaagaagggcgagaacaccgccuucgacuucaucgacuccagccugggggaggaggagcugaaccaguacaucgcccgcguggagaacgcguucaagaccaagaacaucuccgccaccaaguaccggaaccuccugaagaaggccacggagaucaacgacggcuucaucaaccgcgaccugcgggagacccaguacaucgccaagaaggccaaggaccuccuguuccagaucacccgcagcguggucagcaccuccgggagcaucacggaccggcugcgcgaggacuggggccucaucgacaucaugaaggagcugaacaugccgaaguaccgggaccuggggcucaccgagaucaucgagcgccgggacggccgcaagguggaggugaucaaggacuggaccaagcggaacgaccaccgccaccacgcgauggacgcccugaccgucgccuucacgaagcccuccuacauccaguaccugaaccaccucaacgcccggaaggacgagaacaacaagcuguacgcggacauccugggcaucgagcgcaaggagaccaccaagauccacgacgagaacgggaacgagaagcggguguucaucgagcccauccccggcuuccgccagaucgccaagaaguaccucgaggagauccugaucagccacaagaccaagaacaagguggucaccaaguccaucaacaagaucgccgggacgaacaagaagcaggagacccugaccccgcggggccagcuccacaaggagaccaucuacgggaaguaccacuacuacagcaacaaggaggagaagaucggcacgaaguucgacaaggagaccaucuccaaggugagcaaccccaucuaccgcuacgcccugcagaagcgccuggaggccaacgagaacaaccccaagaaggcguucaccggcaagaacgcccucuccaagaaccccaucuaccuggacgacgccaagaccaagauccugccggagaaggucaaccucaucuaccuggaggaggacuucagcauccggaagaagaucguguccgagaaccccacgagcaaggaguucgugcccaacuccaucagcaucgagaagaucgucgacgaggggaucaagcgcauccugaaggagcggcucgagaccuacaacaacgaccccaagaaggccuucgccgaccuggacaagaacccgaucuggcugaacaaggagaagggcaucuccaucaagcgcgugaccaucagcggggugaagaacacccaggcgcuccacuccaagaaggaccaccugggcaagcccauccuggacaaggaggggcaggagauccccgucgacuucgugagcacgggcaacaaccaccacguggccaucuaccgggaccagaagggcaaccuccaggagcagaucgucagcuucuucgaggccguggugcgcgcccagcaggggcugccgaucaucgacaagaccuacaagcaggaggagggcuggcaguuccuguucaccaugaagcagaacgagauguucgucuuccccaacgagaucaccggguucaaccccuccgagaucgaccuccuggaccccaagaacaagaagcugaucagcccgaaccucuuccgggugcagaagaucuccaucaaggacuacuucuuccgccaccaccuggagacgaacguggagaccaacaacauccugaaggacaucaccuggaagcggggcggccucagccugcugaaggggaucaucaagguccgcaucaaccaccucggcaacaucguguccaucggggaguacuga

SEQ ID NO: 1712 - RNA, 3534 nt, Artificial Sequence
  Cas9 variant
augaacaaggugcaggagaucgaguacaagaagaucaaggagaagcuggccgaccgcgaguaccggaucggccucgaccugggggucggcagcaucggguacgccguggugucccugaagaaguacgacgaccucagcuaccugcccgaggacaucauccuggcgggcucccgcaucuucgccagcuccaucggggccgucgagcggcgcgaguuccggcuccagcgcaacagccaccggcaccgccgggagcgcaugcgguuccuguggaagcugcucgccgagaagcagcuggcccugcagccguccaaggaccucgagaagaaggagaacagcgcggacugcgagaccucccagaagcgcuuccccaucaacauccugaagaacgaccccuacauccugcgguacaaggcccucgacgagaagcugagccuguuccagcucggcuacgugcuguaccacguggccaaccaccgcggcaccgacuccauccggagcuuccuggaggacacggacgacaagaucaaggagaacaccaagaccgccaagcucgcgaccgagacgaagaagaucaucgacuccaagaaguaccgcaccuucggggaguaccuguacaaggagcggauccagcagaacgagcgcaagaaggucagcaaccggaagaccgccggcaacaagaacaaggaguucgccgugacccgcgacaugaucuucaaggagacggagaagauccuggccucccagaagcaguacuacaccaacgugcucaccgacgaguacaucaaggagaucgagggggccaucuucuaccagaccgagaagcugauccccgagagcggcuacugcccguacuucaaggacgagaagcggcugcccugcucccacaagcucaacgaguaccgccgcaucuacgaggcgcugaacaacgcccgguacagcgcccccguccuggacgagaagacgggggagauccucuccuaccaggagggcgaggaguucagcagcgaggagaagaagauccuguucgacgaggugcugcucaagggcaagaagcugaccgaguccgagaucaagaagcugcuccaccuccccgacgggugcgagauccagcugcagggccgcgacaagcggacccagaagaucaagggguacgcccugaccgcccuggaggcgcugccguucuggagcaagcucucccagcagcagcaggacgaguuccuguacgacuggaacggccugcccgaggagaagcucaagcccaagcugaucgacugcuacagccugacggagaacgagguggacgagaccuuccagaagauccgccuccccuccaacuacgccccggucggcaagaaggccauggagauccugcugaccuacaucaaggacggguacagcuacaccgaggcccuggacaaggccguguccgagggcaaguucaagguggacaagcagacgaccaucuacgacagccuccccuacuacgggaagauccugcaggaguccacccagaagcugaucggcaaggcguucagcaagcaguucgccaagcggaacuacaagaagcccaacaccaaccgcaacgagcgggaguucgggaagaucgccaaccccgucgugcaccagucccucaacgagcugcgcaagcugaucaacgagaucaucacgguguucggcaagaagccgcucgagaucggccuggagaccgcccgggagcugaagaaguccagcaaggaccgcgagagccucgucaagcagcagaacgagaacgaguacaaccggaacaagaucuacaaggacuacguggagccccaccugucccagaucaagagccgccaggagaaccccucccgguacaucuucaaguucgagcuguucgaggagcagaaguccaucugccccuucugccucaaggagaucaccccggacgacaucaucaacagcaagguggacaucgagcacaucuuccccaucgaggagagcgaggacgacgccaagaacaaccuggucaucgcgcacaacgagugcaacgccgacaaggggaagaagucccccuucgacgccuucggcgacaagaccagcgggaaguacguguggaacgacauccugcacaacgccaagaagaaccucccccacaagaucuggcgcuucuaccagggcagccuggagaaguuccuggagaacaagccgaugcucaagcgguucgggacggacaacuccuacaucagcaagaucgcggccaaguaccuggccugccuguucaacaacuccagcaagaucuucugcaucaaguccagccucaccgcccagcugcgcaucgccugggagcugaacuccaucaugaucccccucgcgaagaacauccugagcgagaaggagcuggaggaguucaagacccucaagaacaagaagauccggauggacaaccgccaccacgcccuggacgccaucaccaucgccuacgccaaccggggcuaccacaacuuccugaacaagauccacgcgaagggcuacaagaucgacuaccgcgagaagaacuggcucuccaagauccugcugccgccccucaaccgcgaccuggaggacuucaagaucagcgugaagaacuccaucgagaaggccaacgucagcaucaagcacgaccacaagacgaacgggucccuggugaagggcaccgccuacaaggucuacuacagcgggaccggcaaguacaucaucaccacgcucaagaacguggaggagaucuccuucaaggagaaggaggaccccgaggacacccugcggcgcgcccugugcggguucgaggacagcaacaucaaggacgagaagcucaucaagaagcugaaguacaacagcgaccuguacaagaagauccucaacaccaagcccaaggccaagcaggagcuggagcaggcgaaccaggagaccaaggaggagggcaagaagacccagaagaucacggacgugcugaucuacaagaaggccugcucccucgucggcgagcaguacauccagugcgccagccggcuggagaacaaguucuucgccgugaaggagcccaccgagauccgcaccgggaucggcuacgacaccggggacaaccuguuccucgaccuguacuacgacaagacgcggaagcugugcggcgagaucauccgcaagaucgacuucaaccagaacaagaucccgaacuaccagaaggagggcuacauccucuucgagcggaucuaccagggggacacccuggaggcggacaccuccgaggacaagaucagccugaagaacaagaccggcuccgcccucgacaaccgcacguucgugaagguccugaccuucaccgagagcgacaaguacuucgacgggaagaaggacaagauccagaucuucuucggcaaccugcucaaguccaacuacaagcaggacgacagcuucuacaucuccagcaugcagaaguacaacgugcggaaggugauccugaccucccuggggaucaucaaguaccgcagccagauccucaagaacaaggaggucuga

SEQ ID NO: 1713 - RNA, 3540 nt, Artificial Sequence
  Cas9 variant
augagcaagaaggugucccgccgguacgaggagcaggcccaggagaucugccagcgccugggcagccggcccuacuccaucgggcucgaccugggcgucgggagcaucggcguggccguggcggccuacgacccgaucaagaagcagcccuccgaccuggucuucgugagcucccgcaucuucauccccagcaccggggccgccgagcggcgccagaagcggggccagcgcaacucccuccggcaccgcgccaaccggcugaaguuccuguggaagcuccuggcggagcgcaaccugaugcucagcuacuccgagcaggacgugcccgacccggcccggcugcgcuucgaggacgccgucgugcgggccaaccccuacgagcugcgccucaagggccugaacgagcagcugacccucagcgagcugggguacgcgcuguaccacaucgccaaccaccggggcuccagcuccgugcgcacguuccucgacgaggagaaguccagcgacgacaagaagcuggaggagcagcaggccaugaccgagcagcuggccaaggagaaggggaucagcaccuucaucgagguccucaccgccuucaacacgaacggccugaucggguaccggaacuccgagagcgucaagagcaagggcgugcccgugcccacccgcgacaucaucuccaacgagaucgacgugcugcuccagacccagaagcaguucuaccaggagauccugagcgacgaguacugcgaccggaucguguccgcgauccuguucgagaacgagaagaucgucccggaggccggcugcugccccuacuuccccgacgagaagaagcucccccgcugccacuuccugaacgaggagcgccggcugugggaggccaucaacaacgcccgcaucaagaugccgaugcaggagggggccgcgaagcgguaccagagcgccuccuucagcgacgagcagcgccacauccucuuccacaucgcccgguccggcaccgacaucacgcccaagcuggugcagaaggaguuccccgcccugaagaccagcaucaucgugcuccaggggaaggagaaggccauccagaagaucgcgggcuuccgcuuccggcgccuggaggagaaguccuucuggaagcggcugagcgaggagcagaaggacgacuucuucuccgccuggaccaacacccccgacgacaagcgccucagcaaguaccugaugaagcaccuccugcugacggagaacgaggucguggacgcccugaagaccgugucccucaucggcgacuacgggccgaucggcaagaccgccacccagcugcugaugaagcaccucgaggacgggcugacguacaccgaggcccuggagcggggcauggagaccggggaguuccaggagcucagcgucugggagcagcagucccugcugcccuacuacggccagauccugaccggcagcacgcaggcgcucauggggaaguacuggcacuccgccuucaaggagaagcgcgacagcgagggcuucuucaagcccaacaccaacuccgacgaggagaaguacgggcggaucgccaaccccguggugcaccagacccugaacgagcugcgcaagcucaugaacgagcugaucaccauccugggcgccaagccgcaggagaucacggucgagcucgcgcgggagcugaaggugggggccgagaagcgcgaggacaucaucaagcagcagaccaagcaggagaaggaggccguccuggccuacagcaaguacugcgagcccaacaaccucgacaagcgguacaucgagcgcuuccggcugcuggaggaccaggccuucgugugccccuacugccucgagcacaucagcguggcggacaucgccgccggccgcgccgacgucgaccacaucuucccccgcgacgacaccgccgacaacuccuacggcaacaaggugguggcgcaccggcagugcaacgacaucaaggggaagcgcaccccguacgccgccuucagcaacacguccgccuggggccccaucaugcacuaccuggacgagacccccgggauguggcggaagcgccggaaguucgagaccaacgaggaggaguacgccaaguaccugcagagcaagggcuucgucucccgcuucgagagcgacaacuccuacaucgcgaaggccgccaaggaguaccuccggugccuguucaaccccaacaacgugaccgccguggggagccugaagggcauggagacguccauccuccgcaaggcguggaaccugcagggcaucgacgaccugcucgggagccggcacugguccaaggacgccgacaccagcccgaccaugcgcaagaaccgggacgacaaccgccaccacggccuggacgccaucgucgcccuguacugcucccggagccucgugcagaugaucaacaccauguccgagcaggggaagcgcgccguggagaucgaggcgaugauccccauccccggcuacgccagcgagccgaaccuguccuucgaggcccagcgggagcuguuccgcaagaagauccucgaguucauggaccugcacgccuucgucagcaugaagacggacaacgacgccaacggcgcgcugcucaaggacaccguguacagcauccugggggccgacacccagggcgaggaccugguguucgucgugaagaagaagaucaaggacaucggggugaagaucggcgacuacgaggaggucgccuccgccauccgggggcgcaucaccgacaagcagcccaagugguaccccauggagaugaaggacaagaucgagcagcuccagagcaagaacgaggccgcgcugcagaaguacaaggagucccuggugcaggccgccgccgugcucgaggagagcaaccggaagcugaucgaguccggcaagaagcccauccagcugagcgagaagaccaucuccaagaaggcgcucgagcuggucggcggguacuacuaccugaucagcaacaacaagcgcacgaagaccuucguggugaaggagccguccaacgaggucaagggcuucgccuucgacaccgggagcaaccucugccuggacuucuaccacgacgcccagggcaagcugugcggggagaucauccggaagauccaggccaugaaccccuccuacaagcccgccuacaugaagcagggcuacagccucuacgugcgccuguaccagggcgacgugugcgagcugcgcgcguccgaccucaccgaggccgagagcaaccuggccaagacgacccacguccggcugcccaacgccaagccggggcgcaccuucgugaucaucaucaccuucacggagaugggcuccggguaccagaucuacuucagcaaccucgccaaguccaagaagggccaggacaccagcuucacccugaccacgaucaagaacuacgacgugcggaagguccagcuguccagcgcggggcucgugcgcuacgugagcccccugcuggucgacaagaucgagaaggacgagguggcccucugcggcgaguga

SEQ ID NO: 1714 - RNA, 3567 nt, Artificial Sequence
  Cas9 variant
augaaguacauccugggccucgacaucggggugagcuccgucggcaucgccgugaucagcgaggagaaccagaagaagaccaucgagaaccuggccgugcgcaucguccccgaggacccggacuuccacgggaaguucuacuccggcaacaccgcgagcaagaaccuggagcggacggccaagcgcgggaaccggaagaacaaccagcgcuucaaggcccggcgcgacaagcucuaccagucccugaaggagaacaacauguuccccaccagcaaccuguucgaccucuccgccguggagcuguacggccugcgggccaaggcggugagcgagcaggucucccuccaggagcugggccgcauccugauccuccugaaccagcggcgcggguuccugagcaaccggaaguccgugagcgaggagaacuccaccgaguacaaggagcgcaucgccggccucgagaaggcccuggggaacaagaccaucggccagaagcuguacagcgagcuccaggagaacaacaacguguucgagguccugcugcgggagcgcacguaccagcgguccagcuacaccgaggaguucgaccgcaucugggacgagcagaagaaguacuaccucauccugaccggguccagcaacgaggacgacaacaagggcacccuguacgaccucauccggaaccgcaucaucuacuaccagcggccccugaagucccagaagggccugaucagcgagugccucuucgagaagcaccacaaggccguggccaagagcucccccuacuucgagcuguuccgcaucuggcagaagaucaacgaccugagcuggaagacgccgaacggggagcuguucaagcccaccgacgagcagaagcagaagcucaagaacgcgcuguggaacggcgacaaccucaaccccaagcacaagcugaccguguccaagaucaaggagauccugggguacaccagccgggagaagaucuaccucaacuucacggagcuggacggcucccgcaccuacagcauccugcgcaacgcccucaucgaggccggcaucgagaagcccgagcaguaccuguucuucaacauggagaccaacgacgagaagggcgggcuguucgagcucuggcacaucaccuacucccugccgaucgagaaggaggucaucaacgcccugaagaaccgguucggguucgacaagaagcaggcggagaucaucgcccgccgggugggcuacagcuccgacuacgggagccucuccacgcgcgccauccggaagcugcuggugcaccucgagaagggccugggcuacaccgacgccugcgacaacaucggguacgaccacagcggcuacaagaccaagaucgaccugcagcccaagcugaagcagcucaagcgcaacgagcugcggaaccccgucguggagcagauccugaaccagguggucaacgccgugaaccucaucaucgagaaguacgggaagaucgacgagauccgcguggagcuggcgcgggagcugcgcaacaacgccaagacccggaagaacaucucccuccugaacagcaagaacaagaagaacaacgacaucauccgcaagaagcugcaggaggaguacggcuucaaguucgucaacgggcgggacgugacgcgcuacauccucugggaggagaacuccaaggagugccuguacugcaacaagaccaucaacggcagcgacaugcugaccggcaacgccgacaucgagcacauccuccccaagucccggagcuucaacaacgccaugaacaacuacaucaucacccaccgcaagugcaacuccgacaaggggcagaagacggccuacgacuucaugagcagcaagggcgaggugauccugcagcaguacaucgagaaggucaacgaccuguacaaggacgggaagggcuccaucagcaagaccaaguucgagaaccuccugugcaagggggaggacaucccguccgacuucguggagcggaugaagaaggacagccaguacaucgcgaaggaggccgucaagaugcugaagaccgugugccccaacguguacaccacgaccggccaggucaccgacuuccuccgcgaggaguggaagcugaagaaccugcuccaggagcugaccuucgagaaguacaaggccaucggccaggugaaggagaagaucaucaagacgaacaacgggcagaccaagaccuucaaggugaucgccgacugguccaagcgggacgaccaccgccaccacgccaucgacgcgcugaucugcgcccucaccgaccagaagaucaucuucaagcugaacaaccugaacaagaucuaccaguacgagcgcaacgcccucagccagaaggagaucgaggagaucgaggaguuccuggagggcaaguucuccaucaaggaguucagcgcccagcaggggaacaucaucgagugcuccauccccaacauccggaaggacgcgcagaagcaccuggagaacauccucaucagcuucaagaaggagaacuccaagguccugacgaugaaccgcaaccagcccaagaacugcaaggagcagaucaccugggugccgcgggcccgccugcacgaggacaccaucaugggccgggugaagcgcauccccgagaagaagaugaagcucaacgacaaggucagcuucgagcagaucaagaugaucgugaaccccgagaucaaggagauccugcuguaccggcucgccaaguucggcgacaaccccaagguggccuucgccaccaaggcgcugaagaaggagccgaucuucuaccgcgagaacgagcugaaggaggucuccaucuacgagugggugaacaccaagcggguggcccucaacgagaacaucacggacagccagaucgagaagaucaucgaccaggccuccaagcgcgccgucaaggagcggcugaacgggggcaagaucaaggagguguucaagaaccugaccgagaaccccauccagcucaagaacgggaugauccugaagaacgugaccgucaccgacgagagcaagguggagaagauccgcaacggcuucgccaucacggggaagaaccaccacgcgcugguguacaaggacgagaacggcaaguacaacgacaaggucguguccuucugggaggccguggccaucggccuccggaacgucaccgaguacgggaaccccuaccccaucaucaaccgcaaccacaacgacgagcugggcgaguucuacuucagcaugcagaucaacgaccuguucguguucgaccucaagcacagcgagaacccgcaggaggagaacgagaucaacuucuucgacguggagaaccggaagcagaucuccgacaagcuguuccgcguccagaagaugagcaagaaguccaacgggcaguucgugagcgacuuccggcaccaccuggagaccuccgugauccgcaacgacaugauccucaagaacaucaccuggaucagcaucuccaagaacagcgaccuggagcggcugacgaagauccgcgucaaccaccucggcgagaucaucaaggugggggaguga

SEQ ID NO: 1715 - RNA, 3585 nt, Artificial Sequence
  Cas9 variant
auggacuucaccgccgacgugagcgagcugaacgaguccuucaugcagauccacaccgagagcaaguucgagaucgacacggccaagguccaggagaucucccagcuccugcuggacaacaagaucacccgcauggaccggcagaagcaggucgcgaacgugcucgccaagaacagcggcgacaaggaggccgacaagaucaacaagaagaucgccaccgaguucugcaaggccgugcuggggaacaaggcgaaguucaacgugauccugggcgaggacgccguggacuccgacuggagcuucaagauggacgacgagaacuccgacgaggagaucgagauccucauggggcagaccaacggccagcagcagaacguccugcgcaucauccaccagugguacagccagaucacgcugaacgggaucgugcccgacggccagaugaucuccgagagcaugaucgacaaguacgagcuccaccggaagcaccuccugcugcugaagcagcagaucaaggugaccaaggacaagaagaaggcccagcagcugcacgaggccuacgagcaguacguccacggcaccggggcgaagaagaagcucacccaggacgacuucuacuccaaggugacgaagaaccuggagaccagcgacuucuccgacgagaucaagaagcagaucaacgccgagaccuucaugccgaagcagcgcaccagcgccaacggcgugaucccccaccagcugcaccagcaggagcucgacaagaucaucgagaagcaggccaaguacuaccccuuccuggccgagcugaaccccgacacgaagcggcagaacaucgcgaaguacaagcucgacgagcugaucgccuucaagaucccguacuacgucgggccccugaucaccaccgaggaccagaagaagaccuccggcaagagcuucgccuggauggugcgcaaggagcccgggaagaucacgcccuggaacuucgaccagaagguggacaagauggccuccgccgaccaguucauccggcgcaugaccaccaaggacagcuaccucaucaccgaggacguccugccggcggagucccugaucuaccagaaguacaaggugcucaacgagcugaacaugauccgggugaacggcaacaagcugacgaagcacgacaagcagaacaucuaccagcaggucuucgagaaguacaagaccgugaacgugaagaagguccagaacuacuuccucaccgacggccgcuaccagcacgcccccaagaucaccgggcugagcgacgacaacaaguucaacagcaaccuguccacguacaucgacuucaagaagaucuuccaggacgugguggacgacccccagaagcagaaggacuucgagcggaucaucgaguggagcaccaucuucgaggaccgccacaucuacgaggucaagcucaaggagaucuccuggcugaacgacgagcagcggaaggagcugaagaagaagcgccaccagggcugggggcggcucagcgccaagcugcugaccggcaucuucgacgagaacggcuacuccaucauggaccagcucuggaacacccagaagaacuucaugcagauccaggccgaggagggguucaacaagaagauccaggccgagaacagcaagcaccuggagaagaacgacuucgaggacauccuggaggacgcguacacgagcccccagaacaagaaggccauccgccaggugaucaaggucguggaggacauccagaagaccaugggcaccgccccgcagaagaucagcaucgaguucacccgguccgccgacaagaacccccgccggagcaucgagcgccagcggcagcucgaggagaucuacuacaacgacgccaaggagaucguguccgaggggaugcaggacaaccugcagaacuucacggacaacaagcagacccugaccgacaaguacuuccucuacuucacccagcugggcaucgacauguacacggggaagaagaucaacaucgacgagaucggcaacuaccagaucgaccacauccugccccaggcguucaucaaggacgacagcaucgacaacaagguccucguguccagcgccaucaacaacggcaaguccgacaacgugccccugagcauguacgccuccguccgcaucaagagcgaggugcagaacaaguggaagaacuucgccgagcacgggcugaucucccagcgcaagcugaacaaccucaugaccgacccggagagcaucgacaaguacaaggcgcggggcuucaucaagcgccagcugguggagaccagccaggucauccggcugguggccgagauccucaacgagaaguaccagggggagaccgagaucaucgaggugcgcgccaagaugaacucccagcugcggaaggacuucgaccugcucaagaaccgcaacgucaacgacuaccaccacgcccuggacgccuaccugaccacguucaucggcaacuaccucuaccggcgcuaccccaagcugcggagcuacuucaccuacgggcacuucaagaagaucgacgacgcgaagcugaagcaguucaacuuccuccacgacaucgagaacgacaaggaccccaaguacgugaacgacaacggcgagcugcugugggaccgcgagaaggacaucgccuacuucaagaagaucuacaacuucaaguacaugcucgugucccacgaggucagcacccggcagggcgccauguucaagcagaccaucuuccccgccgccgcggacgccaaguccaagcugaucccgaucaagaacgacaagcccacggccaucuacgggggcuacaccaacaacaacgacgccuaccuggccaucaucaagcucgcgaagaccgggcaguucaagguggugggcgucccccagcgcgccaucgugaagcugaagcaggccuacgacaaggagaccggggacuacagcaacgugcuguacaagguccucgagcccaaguucgugaagaagaaggugaaccggaagacgggcgagaucaccuaccaggucgagaaguucaagaucguggugccgaagguccccuaccgccagcuggugaucgacggcgaccagaaguucaugcugggguccagcaccuacaaguacaacgccaagcagcucgugcuguccgagaacgcgaucaagauccuggacaagaaguccuucgaccaguccggcuacaagagcuccgaccucgacaccgucuacgacgagauccugagccagguggaccgguacuucuccauguacgacaagaacaaguuccgcgaggggcugcacaacggcaagaaguacuuccagcggcuccccaugaucgacaacguggagaagggcaagaucaaggagaacgggaaguucaagcugcugaacgagauccucaucggccugcacgccaaccccagcuucgggaaccugaagucccucggcaucagcacgccguucgggaugaugcaguucgccagcggcaucucccugagcgagaacgccauccugugcuaccagucccccaccggcaucuucgagcgccgggucgcccucaaggaccuguga

SEQ ID NO: 1716 - RNA, 3588 nt, Artificial Sequence
  Cas9 variant
augcagaagaacaucaacaccaagcagaaccacaucuacaucaagcaggcccagaagaucaaggagaagcugggcgacaagcccuaccgcaucgggcucgaccugggcguggggagcaucggcuucgccaucgucuccauggaggagaacgacgggaacgugcugcucccgaaggagaucaucauggugggcagccggaucuucaaggcguccgccggcgccgccgaccgcaagcugagccgggggcagcgcaacaaccaccggcacacccgcgagcggaugcgcuaccuguggaagguccucgccgagcagaagcuggcgcugcccgugcccgccgaccucgaccggaaggagaacuccagcgagggcgagacguccgccaagcgcuuccugggggacgugcugcagaaggacaucuacgagcuccgggucaagagccuggacgagcgccugucccuccaggagcugggcuacgugcuguaccacaucgccgggcaccggggcagcuccgcgauccgcaccuucgagaacgacagcgaggaggcccagaaggagaacaccgagaacaagaagaucgccggcaacaucaagcggcucauggccaagaagaacuaccgcaccuacggggaguaccuguacaaggaguucuucgagaacaaggagaagcacaagcgggagaagaucuccaacgccgcgaacaaccacaaguucagccccacgcgcgaccuggugaucaaggaggccgaggccauccucaagaagcaggccggcaaggacggguuccacaaggagcugaccgaggaguacaucgagaagcugaccaaggccaucggcuacgaguccgagaagcucaucccggagagcggcuucugccccuaccugaaggacgagaagcggcugcccgcgucccacaagcucaacgaggagcgccggcugugggagacccugaacaacgcccgcuacagcgaccccaucgucgacaucgugacgggggagaucaccggcuacuacgagaagcaguucaccaaggagcagaagcagaagcuguucgacuaccuccugaccggguccgagcucacgccggcccagaccaagaagcugcugggccucaagaacaccaacuucgaggacaucauccugcaggggcgcgacaagaaggcccagaagaucaagggcuacaagcugaucaagcucgagagcaugcccuucugggcccggcugagcgaggcgcagcaggacuccuuccuguacgacuggaacagcugccccgacgagaagcuccugaccgagaagcuguccaacgaguaccaccucacggaggaggagaucgacaacgccuucaacgagaucgugcugagcuccagcuacgcgccccugggcaaguccgccaugcucaucauccuggagaagaucaagaacgaccugagcuacaccgaggccgucgaggaggcccugaaggaggggaagcucaccaaggagaagcaggccaucaaggaccgccugccguacuacggcgccgugcugcaggaguccacccagaagaucaucgccaagggguucagcccccaguucaaggacaagggcuacaagacgccccacaccaacaaguacgagcucgaguacgggcggaucgcgaaccccgugguccaccagacccugaacgagcugcgcaagcucgugaacgagaucaucgacauccugggcaagaagccgugcgagaucggccuggagaccgcccgggagcucaagaaguccgccgaggaccgcagcaagcugucccgggagcagaacgacaacgagagcaaccgcaaccggaucuacgagaucuacauccgcccccagcagcaggucaucaucacgcggcgcgagaacccccggaacuacauccugaaguucgagcuccuggaggagcagaagucccagugccccuucugcgggggccagaucagcccgaacgacaucaucaacaaccaggccgacaucgagcaccuguuccccaucgccgaguccgaggacaacgggcgcaacaaccucgugaucagccacuccgcgugcaacgccgacaaggccaagcggagccccugggccgccuucgcgagcgccgccaaggacuccaaguacgacuacaaccgcauccugagcaacgugaaggagaacaucccccacaaggccuggcgguucaaccagggcgccuucgagaaguucaucgagaacaagccgauggcggcccgcuucaagaccgacaacuccuacaucagcaagguggcccacaaguaccuggccugccucuucgagaagcccaacaucaucugcgucaaggggucccugaccgcgcagcugcggauggccuggggccuccagggccugaugauccccuucgccaagcagcugaucaccgagaaggagagcgaguccuucaacaaggacgugaacagcaacaagaagauccgccucgacaaccgccaccacgcccuggacgccaucgugaucgcguacgccucccggggguacggcaaccugcucaacaagauggccgggaaggacuacaagaucaacuacagcgagcgcaacuggcuguccaagauccugcugcccccgaacaacaucgucugggagaacaucgacgccgaccucgagagcuucgaguccagcgugaagacggcccugaagaacgcguucaucuccgucaagcacgaccacagcgacaacggcgagcucgugaagggcaccauguacaagaucuucuacuccgagcggggguacacccugaccacguacaagaagcugagcgcccucaagcugaccgacccccagaagaagaagacccccaaggacuuccuggagaccgcccuccugaaguucaagggccgcgagagcgagaugaagaacgagaagaucaaguccgccaucgagaacaacaagcggcuguucgacgugauccaggacaaccucgagaaggccaagaagcugcuggaggaggagaacgagaaguccaaggcggaggggaagaaggagaagaacaucaacgacgccagcaucuaccagaaggccaucagccucuccggcgacaaguacguccagcugagcaagaaggagccggggaaguucuucgccaucuccaagcccacgcccaccaccaccggcuacggcuacgacaccggggacagccugugcguggaccucuacuacgacaacaagggcaagcugugcggggagaucauccgcaagaucgacgcgcagcagaagaacccccugaaguacaaggagcagggcuucacccucuucgagcggaucuacgggggcgacauccuggagguggacuucgacauccacuccgacaagaacagcuuccgcaacaacacgggcuccgccccggagaaccgggucuucaucaagguggggaccuucaccgagaucacgaacaacaacauccagaucugguucggcaacaucaucaagagcaccgggggccaggacgacuccuucaccaucaacagcaugcagcaguacaacccccgcaagcugauccucuccagcugcggguucaucaaguaccggucccccauccugaagaacaaggagggcuga

SEQ ID NO: 1717 - RNA, 3594 nt, Artificial Sequence
  Cas9 variant
augagcaagcacgugcugggccucgaccugggggucggcuccaucggguggugccugaucgcccucgacgagcaggaccagcccgccgagauccugggcauggggagccgcaucgugccgcugaccaccgacgaccucaacgaguucucccagggcaaggcgaucagcaagaaccagaagcggacgacccagcgcaccauccggaagggccuggaccgcuaccagcugcggcgcaaggugcucuccgagaagcuggccgggcacggcaugcugcccgacaaggaccucaugcagcugcccguccuggaccucugggagcugcgggcccgcgccgccagccccggggagaagcugucccucccggagaucggccgggugcuguaccacaucaaccagaagcgcggguacaagcacgccaagagcgacgaggcggaggaggugaccaagcggggcaaggagcagggcuacgucgccacggugaaggggcgcuacgccgagcugcagcgggagggcgcgaccguggggcagcacuucgccugcaagcucaaggagcaccgccaggagucccccagcggcggcuucuucuacaacuaccggaucaaggaccaggucuacccccgcgaggccuacaucgaggaguucgaccggaucauggaggugcaguccguguucuaccccgagguccugaccccggccuucauccaggagcugcgcgacaaggugaucuucuuccagcggccccucaagagcugcaaggggcugguguccuucugcgaguucgagaagcaggagcgcgucgugcagcugaagcgggugaaccgcgagggcaaggaggagcuccaggagcgcaagaucaccaucgggcccaaggucgcccccaagagcuccccgaucgcgcagcugugcaagcugugggagagcauccacaacauccggaucuacuaccccgacggcaaggagcgccccaucacgcucgaggagaagcggaagcugcuggccuaccuccagacccacgacaagcugaccuucaccgcccugaagaaggagcucaagaucuccgacaaggagcgccuguggugcgacaagcugcucaagggcgggaucaagggcgacacgacccgggugcugcugcgcaaggcccucgccggguacaagcgguacgagccccugcugcgcauggaccucgagcugcgggacuuccaggagaucgugagcggcaagcgccugauccggccgaucgucgacgaguccuaccucagccagccccuguaccgccuguggcacauccuguacagcaucgaggagcgggaggcgaugcgccgggcccucaucgaccagcugggguuccuggaggaggaccucgacggcgggcugcuggacaagcucuaccagaucgacuucgccaagcagggcuacuccaacaagagcgccaaguucaucugcaagcugcugccccaccuccagggcgggcacggcuacucccaggccugcgagcuggcggggaagcgccacagcgccggcucccugaccaaggaggagcucgaggagcggccccugcuggagcacaucccgcuccugcagugcaacgagcugcgccagcccaucguggagaagauccucaaccagaugaucaaccuggugaacgcccugcggcagaaguacgggagcaucgacgagguccgcguggagcucgcccgcgagcugaagaugucccgggaggagcgcgaggagaccagcaagcggauccgcucccgggagaaggagaacaaggagaucgccgagcgcaucaaggaguacgagcuguaccccaccaagagccggauccagaaguaccgccucuggcaggaggcgggcgagcagugccuguacugcggccgguccaucgacgucgugcaguuccugcgcggggacggcguggagaucgagcacaucauccccaagagcauccucuacgacgacuccagcgccaacaagacgugcgccugcucccggugcaacaaggacaaggggaaccgcaccgccuacgaguacauccuggcggagggccgggaggccgaguaccuggaccgccucgagacccuguuccacgacggcaagcugagcuacuccaagcggcgccggcuccaguggaagaaggccgacaucccggucgacuucaucgagcgccagcugcggcugacgcaguacaucgcccgccaggcccaggagauccuccggcaggggauccgccgcgugggcgcgagcgagggguccgugaccgccaagcugcggcaccuguggggcuacgacgacauccuccgcgagcugaacuucgagcgguaccagagcaugggggagaccgagaucgucagccaggaggagaaggacggcuccaucaccaagagcgagcgcaucaaggacugguccaagcggaaggaccaccgccaccacgccaucgacgcccuggugguggccugcacgcggcagggcuacauccagcgccucaacagccugaacuccgaggaggacagccugcagaugcaggaggacuccaagcagaugcgggagaagaugggcgggcagaagcgccccaccgcggacaagcacagcauccucgagaacuggcugauccugcagccccacuucucccaccaggaggucaagagcaagguggccgagauccucguguccuuccggcccgggaagcgcaccgucagcaccggccggaacacguaccugcgcuccgggaagaaggugacccagagcggcgugcugaucccgcggggcccccucuccgaggagagccuguacgggcagauccugcgcaacggcgagcccaccuacgucaagaagguggcccucgagucccugagcgaggcccagaucgagcagaucguggacccgaagcugcggcgcgagauggucgcccggacccagcccagcgagggggcgaagcucaaccccaagcugcugcucgccacgcccuucuacuccgacgccgccggcacccagcgcgugcgcagcgugcgggucgcgaucgagaacgggaagaacuccaucgugccgcugcgcuacaacgagagcggcaaggccaucaccuucgugaaccccggcaacaaccaccacgucgggaucuaccggaccuccgagggcaagcugguggagagcugcgugacguucuggcaggccgucgaccgcgugcgguacgggauccccaccaucauccgcaagccccgggaggugcucgaccagcugcugcuccgcgacgacaucccggaggcccugcuggcccaccuccccgcguccgacugggaguucgucgaguaccugcaggccaacgagauguuccugaucggccucaccgacgaggagauccagaccgcccuggccgagagcgaccugcucacccuguccaaccaccuguaccgggugcagaagaugagcuccgaguacuacguguuccgcuaccaccucgagacggaggucgccgacaacaagaacaacaccgggaucauccccaaguucuaccggcugcgcggccccaacgacaccuaccugaaggcgaacccgcggaaggugaaggugaaccuccugggcgagaucagccugcccuga

SEQ ID NO: 1718 - RNA, 3615 nt, Artificial Sequence
  Cas9 variant
auggagcgcauccugggcaucgacaccgggaccaacagccucggcugggccaucguggacaaggacgagaaccaguaccaccuggucgccaaggggacgaacaucuucuccgagggcgugaagaucgagaaggggaucgagagcuccaaggcggccgagcggaccgagcaccgcagcgugcggaagcacuacuggcgccggaagauccgcaagauccggcugcucaccauccuguccgacaacgaccugugcccccgccucaagcacgagcagcugcggcaguggcgccugaagaaggucuacccgaccgacgacacguucauggaguggcagcggaccgaggacaaggcccaggugaaccccuacaaguuccgcuacaucugccucacccagaagcuggaccugagcgacaucacccagcgguucauccucggccgcgcccuguaccaccugaaccagcggcgcggcuuccucuccaaccggaaggaggccacgaaggagagcgaggggaccgugaaggagggcaucuccagccuguccaaggacaugaaggacagcgggugcgaguaccugggcgaguacuucuaccagcucuaccagcaggggaagaagauccgcaaccacuacaccgcgcggaaggagcacuaccugaaggaguucaaggccaucugcuccaagcaggagcuggacgacgcccucaucgagaagcuggagaaggccaucuucgaccagcgcccccucaagagccagaagggccaggucgggaccugcacguucgagaagggcaagucccggugccccagcucccacccgcuguacgaggacuuccgcauguacagcuucaucaacaacaucaagguccagguggacacccuguacgacaagggcgagcgcucccugaccgacgaggagaagcagcucaucaucccccuguucaagcgcaagagcaagcggaccuuccccuucgaggacaucgcgaagaagaucgccgggaagaacaacuacugcuacaucaagagcaacgaggagaaggccuacaaguucaacuaccagauggacacccagguguccggcagccccgugaacgcccagcuggaggagaucuucggcgaggacuggcucuccagcgugugcgaggucuacacgcuggccaacaacaagucccgguuccagaucaugaacgacguguggcacgugcuguucuucuacgacgacgaggacaagcucaaggaguucgcgaaggaccgccugcagcuggacgacgagcucgccgagaaguucagcaagaucuccaucccgaacgacuacgccgcccugagccugaaggccauccggaagaucaugcccuaccuccgcgacuacgggcugaucuacuccgaggcggucuuccuggccaaccucguggacgugcugccccagcacgucuggggcaucaaggagaugcgggaggccgccaucgagaacgugaucgacgugaugcacagcuacgacaagaacaacaucgacgggaucacccuggagggcugcgucaagaccuuccucaaggagcgcuaccagguguccgacgacaaccugaagaagcuguaccaccccagcaugcucgacccguacccccggcagcgccccaacgacgaggggguguuccagcugggcagcccccggaucagcuccgucaagaacccgauggccaugcacagccuguuccgccugcggaagguggucaaccucaugcugaagaagggcuacaucacgcccgacaccaaggugcacaucgaguucucccgcgaccugaacgacgcgaacaagcggugggccauccagaccuggcagcgcgagaacgagaaggagcgggagcgcugccggaaggagaucgagaaguacaucgccagccccuccgacaccgacauccucaaguaccagcugugggaggagcagaaccacaagugccuguacacgggggacgagauccgcaucaccgacuuccucggcgacaaccccaaguacgacaucgagcacaccaucccgcgcagcgccgggggcgacagcaccaagaugaaccugacgcugugcuccagccgguucaaccgcgacgagaagaagaccaagcuccccgccgagcuggugaaccacgacgagauccuggagcggaucuccaacuggaaggagaaguacgaggacaucgacaagcagauccgcaagaucagcaccaagggggcgaccuccaaggaggacaaggacagcaagauccggcgccggcacuaccucauccugcagcgcgacuacuggcggggcaaguaccagcgcuucacgaugaccgagguccccgagggcuucucccggcgccaggggaccgacaucagcgugaucucccgguacgcccgcauguaccucaagagcguguucaagcaggucuacaucgugaagggcaucgccaccuccgacuuccggaagaugugggggauccaggacgaguacgccaagaaggagcgcgugaaccacguccaccacugcaucgacgcgaucacgaucgccugcaucggcaaggccgaguacgacaagcuggccgacuaccggcaccaguacgacgacuaccuguuccaggggaagaccaagcccaccuucgacaagccguggcccagcuucgugaucgacaucaagcacauccaggacgagcugcucaucgcccacuacgcgaaggacaaccuggagaaguucaccaagaagaaccugcgcggcaaggacggccggaucauccgcgacaaguucgggaacaagcuccagaugaagggcgacaccucccggaacagccugcacaacgacaaguucuacggggccaucaaccacgagggcgagaucaaguacguguaccgcacgaacaucgaggcccuggacgccaaguccaucggcaacaucgucgaccccaccgugcgcagcaucaucgaguccgccaucgcgauccacgggagccucaaggccgccaucaacaagggcaucuggaugaacgaggagaagcacauccccaucaagaaggugcgggucuuccgcaacgacgugaagaagccgaucgagcugaaggaccagcgggaccugagcgacaaggacuacaagcagcacuacuacgugaccaacgacgggaacuacaugaugcucaucuucuccaagcugaacaacaagggccgcgagauccggcagcacgucgugaucaacagccuggaggccaccgaggugaucaagucccacaagcgcagccaggucgggaagguggugugggaguccuacuacagcaaggagggcuucgaccucaucuacaagcugaaguccggcacgaugauccugcucuacgagaacaaccgggacgaggucugggaccuggacauccgcaaccugcagaagcggcucuacaucaucaccaagaugaaguacgacgggcgcaucuacaugaugcaccaccaggaggcccgggagaagaaggaccuggaggagaaguccggcuccuucaagaucaacgaggacuaccgcccccugaucgugaacagcuacaaccaguucaacgcgcucgugcaggaccuggacuucgagaucaacgaccugggggagauccggcgccucaucuga

SEQ ID NO: 1719 - RNA, 3630 nt, Artificial Sequence
  Cas9 variant
augaagaaggacuacauccugggccucgacaucgggaucagcuccgugggcugggggcugcuggagcucgacgacaacaacaaccccuacaagaucaucgacgucggcagccgcaucuucaccccgggggagguggagaagaccggcgacucccgggccaaggagcgccgggagaagcgcggcgcccggcgcaucgcgcggcgccgggaguuccgccuggaccgggugaagaaccugcucuacgagaacggguaccugaagggcaacaucaacagcaacaucgucuccgagaagaacgaggagcugagcaucaucuucaacaacaugaucaacaacuacuacaacgggaagaacacgaaccccuacauccucaagguggaggcccuggaccgcaagcugaccgacgaggagcucuccaucauccuggugcacuacgccaagaagcggggcuacaagagcaaccgcgaggaggccuccgacaaggagagcgggaagguccugaccgccaucaaggagaacgagaagaucaugaaggacaacaacuaccggaccaucuccgagauguacaucaaggacgacaaguucaagaacaagaucaagaacagccccaacgacuacaagaucuccgugacgaacgagauguaccucgaggagaucaacaaggugcuggacagccagaucaaguucggccugaucaccgacgacuucaagaaccaguaccucgagaucuacaacucccgccggagcuacgcgaagggccccgggggcaacuccccguacgggggcgaccugaucgagcgcaugaccggcaagugcaacuucgacgggaacccccgggcccccaagcgcgccuucagcuccgagaucuacgucgcccugaccaagcucgugaaccugaaguacaaggugaacgacggcgaguacaucaagcugagcgagaaggagaucaagaacaucaucgagaaggcgaaggagaagaaguccaucagcuacaaggaccucacgaagaugaucgggaacaacaucgacuucaaggaccugacccugagcaagaaggaguacaucaagcucaucgaggagcugaagaagaagcugaacaucaagaaggacaccaagaucaacaucaacgagcucuccagcgaggacaaggagcuguacaacaagcugugcaacgacaagcuccuguccaagacccugaucgagcucaagggcuaccacauccugaaggacagcgucaucaaggccuacuccaaggacaucugggacgaggugaaggacaacauguaccugcucgacgaccuggcccuguacugcacgaacuacaaggugaacgaggacauccucaacaagaucaaggagagcgagaacaucgacaacaucuucaacgacauccacuucgucgagcugcugcccaacuucaaggaccaccucaugcuguccaccgagcugauccggaagcucaucccgaucauguacgggggcaacaccuacgacaaggccaugaacauccugggcuacaaccacagcgacaucaacggggacaaggagaagaaggaccugcuggugcccaucugcguggacgacaacaucaccaaccagcgcgucauccgcucccucacgcagacccggaaggugaucaacagcaucaucaagaaguacggcaugcccaagaucaucaacaucgagaccgcccgcgagcuggcgaagucccggcaggagcgcaacgagaucgccaagaacaacguggagaagcaggccgagaacgagaagaucaagaaccagcuggucgagcucgggcuguucgugagcaccgacaagaucuccagcacggaccugcucaaguacaagcuguggaaggagcagaacgaguucugcggcuacuccaugaagaagaucagcaucgaggaccuguucgggaacaacaucgugcagaucgaccacauccuccccuacucccggaccuacaacgacaacuaccugaacaagacccuggucuacaccaaggagaaccaggagaagggcaaccgcacgccguacgagugguucggcaagaccgacaagugggacgaguacgagaccuacaucaacaaccucaccaucagccagaagaagaaggacaacuaccugcugaagaagcucgacuucgacacggagcgggagaugcgcagccagaaccugaacgacaccaaguacaucuccaaggagcugagcucccucaucaaggccuaccugaacguggagaaggucaacauguaccccggggccaucaccgcgaagcugcgggcccgcuggggcuucaaccggcucacccacagcuaccuguccaagaacuacauccugcccaagaacaucaaggaggacaucaacaaggaccgcgacaaccaccuccaccacgccauggacgcccuggugaucgccagcaucacgcccucccugcagcagaagaucacccucuacgagaaguucagccgguacaucgacgggcugaccgagcugcagaucaagaacaucuccuacaucaagaucgaggacagcgagggccaguacuacaacgacgacaccgacgagguggagacgaucgacauccgcgaguacaucaagcagcagcucgcggagaacaacaucuacuacaaccggcacaacaucuccaagcuggaguucccgcugcccuacgagaacuucgacaaggaggccaagcuccgcgucuacgagcaggaccuggacacccugaaguggaaccucaagagcuacaacaccuacacccagaaggacaucgacaacgugcacacccugauccccuccaucgccaagacgaaggugagcgggaagaugcacgaggagaccuacuacggcaucaaggagaucggcaaggacgaggacaagaagaucuacaagacccugcggacccccaucgagaaggucaagcgcaaggaccucgacaacaucccggaccggcucgggggcuccaaggacguguacgagagccugguggagugguucggggacuacgaggucggcgaggaggugcugaaggccaacggcaacaaguaccccguguccaagagcgacaaggagcacaaggagaucaagaagcugaagcuguacagcgaguacaagaacacggggcacaugaucaacaaguccaacgucgagaagggcgggaucuaccgcaucgacguguucaagagcaaggacaaggaggacgacaagcucuacuucgccgcguacgacauccuggagaucaagaagaucaacacccugaaggagaagaaccgcguggacgacaacuucaacaucaagcucgacuacggccaggggaagaacuccaagaucaugagcuacaccgacaucaucaacaacuacgaccuguacaucucccugaacaagaacgaccucaucaagaucaccacgaacgacggcaaggagagcgucgccuacguggugggcugcuccagcgggaugcuggaggucaaguccaagcugggcgacggguacgacaucaucaagaccgaccucaacgagaacaacaucuucagcaagcagcgggcccaguaccagaucaccguguccaccaucaaggagaucaagaagcugagcaucuccgugcugggcgagaucagcgggcucuga

SEQ ID NO: 1720 - RNA, 3633 nt, Artificial Sequence
  Cas9 variant
augcgcaccauccugggccucgaccuggggaccaacagcaucggcugggccgugaucaacuccgucaucaaggagcagacggagcggaucuggaucgagauggccgggagccgcaucauccccauggacgcggccauccugggcgacuucgacaaggggaacuccaucagccagaccgccgagcggacccgcuuccggggcgugcgccggcuccgcgagcggcagcugcugcgccgggagcgccuccacaaggugcugaagauccugggcuuccucccggagcacuaccugaaggggaucgacuucgagaagcacaccggcaaguuccuguccgggagcgagcccaagcuccccugggucaaggaccgguggggcaaguacuccuuccuguuccagacggccuucaacgagaugcuggccgacuucgcgaagcaccagcccagccucguguucgacgggaagaagaucccguacgacuggaccguguacuaccugcgcaagaaggcccugaccgagaugaucuccaaggaggagcucgccuggauccugcugaacuucaaccagaagcggggcuacuaccagcuccgcggcgaggaggaggaggacaacgccggcaagagcgucgaguucuacgcgcugaaggugcuguccguggaggccaccgacgagaagaaggggcgggacaucugguacaacguccaccucgagaacggguggguguaccgccggagcuccaacgugccccuggacugggagggccgcgucaaggaguucaucgugacgaccgaccugaaccccgacggcacccccaagcucgacaaguacggggaggugaagcggagcuuccgcgccccgaaggaggacgacuggaugcugaucaagaagcgcaccgaggccgacaucacgggcacccacaagaccaucggguccuacaucuacgacgcccugcuccaggagccccagcagaagaucaucggcaagcuggucaagaccguggagcggaaguucuacaaggaggagcugaacuucauccuccagaagcagugcgcguuccacgccgagcugcaggaccgcgaccuguacaugcggugcaucgaggcccucuaccccgggaacgaggugcagcgccggaacaucgccaaccgcgacuucaucuaccugcugaucgacgacguccucuucuaccagcggccccugaagacgaagaagucccugaucgccaacugcccguacgaggagaacgaguacgugaaccgcaagaccggcgagaucaagaccgcgccccucaagugcaucgccaagagccacccccuguuccaggaguuccggcugugguacuuccucagcaacauccgcguguaccagaaggagcgggaggucaacggcacccugcaccuggacguggacgugacgaccgaguuccucaagaccgaggacgacuacgucgcccuguucgacuggcugaacucccgcaaggagaucgaccagaaggccuuccugcgguaccccgccuucgggcucaagaaggagaucaacaacuaccgcuggaacuacguggaggacaaguucuacccgugcaacgagacccggcacgcgauccugagccgccuggagaaggccggcaucgggaucgacuuccucagcgacgagaaggagacggcccuguggcacauccuguacuccgucagcgacaagcaggagaucgagaaggcccucgccaccuucgcggugaagaacggccugaacgaguccuucguggaggucuucaagaaguucccgcccuucaagagcgaguacggggccuacuccgccaaggccaucaagaagcugcucccccugaugcggugcggcaaguacugggacaugagccugaucgacggcaccaccaaggagcgcaucgagcggaucaucgcgggggagugcgacgaguccaucggcgccaaggugcgcgagaaggccaugaaccucagcgacaucuccugcuucaagcgccugccccuguggcucgccugcuacguggucuacaaccggcacagcgaggacaaggagaucacgaagugggagacccccgccgacaucgacgcguaccuggccgccuucaagcagcacucccugcgcaaccccaucguggagcaggucaucaccgagacccuccggguggugcgcgacaucuggaagcaggucgggaagaucgacgagauccggaucgagcugggccgcgagaugaagaaccccgccgacaagcggaagcgcaugacgacccagauccuggagaacgagaacgccaaccuccggaucaaggcgcugcuggccgaguucgugaacccggaguacgggguggagaacgugcgccccuacagccccucccagcaggagauccuccggaucuacgaggacgccguccugaagggcgaggagcagauccccgaggacaucgacgugauccugaagaaguucaacaccagcaagcucccgaccaaguccgaguuccugcgcuacaagcuguggcucgagcagaaguaccggagccccuacacgggcgagcugaucccccuggccaagcuguucaccgccgcguacgagaucgagcacgugaucccgcagucccgcuacuucgacgacagcuucuccaacaaggucaucugcgagagcgccgugaacaagcucaaggacaaccagcugggguacgaguucaucaagaaccaccacggccagaagguggaggucggguucggcaagaccguggagaucuucagcguggacuccuacgagcgguucgucaaggagcaguacgccaagagcggcaucaagaugaagaagcuccugauggacgacauccccgagcaguucaucgagcgccagcugaacgacucccgguacaucagcaagguggugaaggggcuccuguccaacaucguccgcgagaagaacgacagcggcgaguacgagcccgaggccguguccaagaacauccuggugugcaccgggagcgucaccgaccggcucaagaaggacuggggcaugaacgacguguggaacuccaucgugagcccccgcuucgagcggcugaacgcgcugacggagacccagugcuucgggcacugggagaacaaggacggcaagaaggucuuccagaccgccgugccgcucgaguaccagaagggcuucuccaagaagcgcaucgaccaccgccaccacgccauggacgccaucgugaucgccugcgcgacccggaaccacgucaacuaccugaacaacgagagcgccucccgcaacgccaagaucagccgguacgaccugcagcgccuccugugcgacaagucccgcggggacggcaacgggaacuaccgguggaucaucaagaagcccuggacgaccuucacccaggacgcccgggaggcccugagcggcaucaucgugucccucaagcagaaccugcgcaucaucaacaagaccacgaacaucuaccagcacuucgacgcgaacgggacccggguguacgagaagcagaagaucggcgacagcugggccauccgcaagcccaugcacaaggacaccgucuucggcgccgugaaccugcggaaggcccucaucccccagcacuacaaccugacccuguucaucagcuccuga

SEQ ID NO: 1721 - RNA, 3642 nt, Artificial Sequence
  Cas9 variant
auggagaagcgccugggcaucgacguggggaccaacagccucggcugggccaucgucgagguggacgacgaggggugcacccugcuggaccggggcguggacaucuuccaggagggggucgcccgcgagaagaaccaggagaagcccgcggugcaggaccggacggacgcccgcgcccuccggcgccacuacuuccggcgccggcugcgcaagaucgcccugcuccgggugcugguccgccacgaccugugcccggcccucuccgaggagcagcugaacgcguggcagggcaagggcaucuacccccuggacgacgccuucauccgguggcagcgcaccgacgacaacgccgaccggaaccccuaccgcgaccgguuccgcugccucaccgaggagcuggaccuggccugccgggaggagcgcuacgugcucgggcgggcgcuguaccaccugugccagcgccgcggcuuccucagcaaccggaaggacgccgggaacgaggccgaggagggcaaggugaagcaggagaucaagacccuguccgccgacauggccgcggccgggugcgaguaccugggcgaguacuucuaccgccucuaccagcggaaggagaagauccgcaagcacuacacggcccggaacgagcacuaccuggccgaguuccgcgccaucugccggaagcagcgccuggacgaggagcuccggcaggcgcuggagaaggccaucuucuaccagcgcccccucaagagccagaagggccuggucgggaagugcaccuucgagaaggacaagucccggugcccggugagccacccccgcuucgaggaguuccggaugcugcaguucaucaacaacgugcgcgucaccggccccggggacgccgagccccggccgcugucccccgaggagguggagaucgugcgcccccucuuccugcggaaguccaagccccacuucgacuucgaggacaucgccaagaagaucgccggcaagggcaacuacgcgugccgcggggagcugcuccaggccccguaccgguucaacugcgccggcaagagcaccgucacggggagccccguguccgcccuguucgccagcguguucggcgacgacuggcagcgcgagaucugcucccuguacacccucggggcgggcaagaacgaggagcagauccugaacgacgucuggcacgugcuguucgccuucgaggacgaggagcgccuccaggccuggcugcaggagaagcugcagcucagcgccgacgacgcgaagacccuggccgccuuccggcugccccagggcuacgccucccucagccugaacgugaucaacaagauccugcccuaccuccgccggggguaccgcuacgacgaggccgucuucuucgcgaaccugggcaaggugcugccggccgagguguacgccgaccccgcccggcgccgggaggucgagcaggggaucuccgcccagauggacgaccugggcgacggggagaagacccgcaaggaggagcggauccgcgacuaccuccggcgcuacuggggcguggaggagaagcggcuggagcgccuguaccaccccagcaugaucgaggcguaccccuccgccagcccgaacggccaggggcuccugcagcugggcagcccccggauccccgccguccgcaaccccauggccaugcgggcccucuuccgccugcgggugcugcucaacgagcugcugcgcgaggggaagaucgaccggggcacgaagaucaacaucgagcucgcgcgcgagcugaacgacgccaacaagcgcaaggccaucgagcgguaccagcgcgagcgggaggccgagaaccgcaaguacgcggaggagauccggcagcaguacguggaggccaccgggcacuccaucgagccgagcgaggaggacauccugaaguaccgccucugggucgagcagggccacugcucccuguacaccggcaagaccaucgggaucagcgaguuccugggcgacgggcggcgcuacgacaucgagcacacggugccccggucccgcggcggcgaggacgcccaguacaacaagacccucugcgaggaggaguucaaccgggacaucaagcgcgacaagcugcccagcgagcuggccaaccacaccgccauccucgcgugcguggaguccugcgggugguucgagcggaucgagggccuggagcaccgcgucuggggcgccgaccggcgcgccaagagcgccaccacgaaguccgccaaggacuucgcgauccaggaccggcacuacuggcgcaugcaccuggacuacuggcggcgcaagugcgaggccuucaccaugaccgaggugcccgagggguucagcaaccgccaggggguggacgucggcaucaucggccgguacgcccgccucuaccugcagaccguguucgaccggguguacacggucaagggggccaccaccgccgcguuccgccggauguggggccugcaggaggaguacgccgccaaggagcgcgugaaccacgugcaccacugcaucgacgccaucaccaucgcgugcaucgggucccgggaguacgcccucugggcccaguacguccgccaggacgagcuguaccgguggggcgaggccgacaagccgcgcugcgggaagcccuggcccacguucaccgaggacgugcgggccaccgcggacgagcugcucaucagccaccacaccccggacaacaugcccaagcagucccgcaagcggcugcgcgugcggggcaagguccagcgcaacgaccggggcgaggugaaguacaugcagggggacacggcccgcggcgcccugcaccagcagaccuucuacggggccaucgagcgggacggcgagauccgcuacgugguccgcaagagccucgaccagcugcugcccgccgacguggagaagaucguggacgaggcgguccggcagaaggugcgcgaggccguggaggccuacggguucaaggaggccaccgaccccaccaagcacacggucuggaugaacgaggagaagcagaucccgauccggaaggugcgcauccucaccggcgugaagaaccccauccugcugaagccccaccgggacgucuccgugaaggaguacaagcgcuacuaccacguggucaacgacggcaacuacugcauggccaucuacgaggggcgggaccgccagggccggcucaagcgcaccuucgagaucgugaacaagcuggaggcggcccgguacuucaagcgcagcgccgaccgggagucccgccccgaccuggugccgcucagcgacgucaacggguacucccugaaguaccugcucaagaccggcaccauggugcuguucuacgagaacagccccgacgagcuguacgagugcagcgugggggagcucgccaagcggcuguacaaggucgugggcauggcccaggacggccgcgugcaguuccuguuccaccaggaggcgcgggaccagaaggccgucacggccgagugcgggaugggcaucuccguguucgacgcccgccaccccgcgcccaagcuccggauccgcgugagcaacuucaagauguucgucgagggguacgacuucgagcugaccgugaccggcgaggugaaguucaagcgguga

SEQ ID NO: 1722 - RNA, 3642 nt, Artificial Sequence
  Cas9 variant
auggagaagcgccugggcaucgacguggggaccaacagccucggcugggccaucgucgagguggacgacgaggggugcacccugcuggaccggggcguggacaucuuccaggagggggucgcccgcgagaagaaccaggagaagcccgcggugcaggaccggacggacgcccgcgcccuccggcgccacuacuuccggcgccggcugcgcaagaucgcccugcuccgggugcugguccgccacgaccugugcccggcccucuccgaggagcagcugaacgcguggcagggcaagggcaucuacccccuggacgacgccuucauccgguggcagcgcaccgacgacaacgccgaccggaaccccuaccgcgaccgguuccgcugccucaccgaggagcuggaccuggccugccgggaggagcgcuacgugcucgggcgggcgcuguaccaccugugccagcgccgcggcuuccucagcaaccggaaggacgccgggaacgaggccgaggagggcaaggugaagcaggagaucaagacccuguccgccgacauggccgcggccgggugcgaguaccugggcgaguacuucuaccgccucuaccagcggaaggagaagauccgcaagcacuacacggcccggaacgagcacuaccuggccgaguuccgcgccaucugccggaagcagcgccuggacgaggagcuccggcaggcgcuggagaaggccaucuucuaccagcgcccccucaagagccagaagggccucgucgggaagugcaccuucgagaaggacaagucccggugcccggugagccacccccgcuucgaggaguuccggaugcugcaguucaucaacaacgugcgcgucaccggccccggggacgccgagccccggccgcugucccccgaggagguggagaucgugcgcccccucuuccugcggaaguccaagcugcacuucgacuucgaggacaucgccaagaagaucgccggcaagggcaacuacgcgugccgcggggagcuccugcaggcccccuaccgguucaacugcgccggcaagagcaccgucacggggagcccgguguccgcccuguucgccagcguguucggcgacgacuggcagcgcgagaucugcucccucuacacccugggggcgggcaagaacgaggagcagauccugaacgacgucuggcacgugcuguucgccuucgaggacgaggagcgccugcagaccuggcugcaggagaagcuccagcugagcgccgacgacgccaagacccuggcggccuuccggcucccccagggcuacgccucccugagccugaacgugaucaacaagauccuccccuaccugcgccggggguaccgcuacgacgaggccgucuucuucgccaaccugggcaaggugcugcccgcggagguguacgccgacccggcccggcgccgggaggucgagcaggggaucuccgcccagauggacgaccucggcgacggggagcagacgcgcaaggaggagcggauccgcgacuaccugcggcgcuacuggggcguggaggagaagcggcuggagcgccucuaccaccccagcaugaucgaggccuaccccuccgcgagccccaacggccaggggcugcugcagcucggcagcccgcggauccccgccguccgcaaccccauggccaugcgggcccuguuccgccugcgggugcuccugaacgagcugcuccgcgaggggaagaucgaccggggcaccaagaucaacaucgagcuggcccgcgagcugaacgacgcgaacaagcgcaaggccaucgagcgguaccagcgcgagcgggaggccgagaaccgcaaguacgccgaggagauccggcagcaguacguggaggcgaccgggcacuccaucgagcccagcgaggaggacauccucaaguaccgccugugggucgagcagggccacugcucccuguacaccggcaagacgaucgggaucagcgaguuccucggcgacgggcggcgcuacgacaucgagcacaccgugccgcggucccgcggcggcgaggacgcccaguacaacaagacccugugcgaggaggaguucaaccgggacaucaagcgcgacaagcugcccagcgagcucgccaaccacaccgccauccuggccugcguggaguccugcgggugguucgagcggaucgagggccuggagcaccgcgucuggggcgcggaccggcgcgccaagagcgccacgaccaaguccgccaaggacuucgccauccaggaccggcacuacuggcgcaugcaccucgacuacuggcggcgcaagugcgaggcguucaccaugaccgaggugcccgagggguucagcaaccgccaggggguggacgucggcaucaucggccgguacgcccgccuguaccugcagacgguguucgaccggguguacaccgucaagggggccaccaccgccgccuuccgccggauguggggccuccaggaggaguacgcggccaaggagcgcgugaaccacgugcaccacugcaucgacgccaucacgaucgccugcaucgggucccgggaguacgcgcugugggcccaguacguccgccaggacgagcuguaccggcgcggcgaggccgacaagccccggugcgggaagccguggcccaccuucaccgaggacgugcgcgccaccgccgacgagcuccugaucagccaccacacgcccgacaacaugccgaagcagucccggaagcgccugcgggugcgcggcaagguccagcggaacgaccgcggcgaggugaaguacaugcagggggacaccgcgcggggcgcccuccaccagcagaccuucuacggggccaucgagcgcgacggcgagauccgguacgugguccgcaagagccuggaccagcugcuccccgccgacguggagaagaucguggacgaggccguccgccagaaggugcgggaggcgguggaggccuacggguucaaggaggccaccgaccccacgaagcacaccgucuggaugaacgaggagaagcagauccccauccgcaaggugcggauccugaccggcgugaagaacccgauccugcucaagccccaccgcgacgucuccgugaaggaguacaagcgguacuaccacguggucaacgacggcaacuacugcauggccaucuacgaggggcgcgaccggcagggccgccugaagcggaccuucgagaucgugaacaagcuggaggccgcgcgcuacuucaagcggagcgccgaccgcgagucccggcccgaccucgugccccugagcgacgucaacggguacucccugaaguaccuccugaagaccggcacgauggugcuguucuacgagaacagcccggacgagcucuacgagugcagcgugggggagcuggccaagcgccuguacaaggucgugggcauggcccaggacggccgggugcaguuccucuuccaccaggaggcccgcgaccagaaggcggucaccgccgagugcgggaugggcaucuccguguucgacgcccggcaccccgcccccaagcugcgcauccgggugagcaacuucaagauguucgucgagggguacgacuucgagcugaccgugaccggcgaggugaaguucaagcgcuga

SEQ ID NO: 1723 - RNA, 3651 nt, Artificial Sequence
  Cas9 variant
augaccaagauccugggcaucgacaccgggacgaacagccucggcugggccaucguggacaagaccgccgacaacuacaaccugcuggacaagggggucaacaucuuccaggagggcgugaagaucgagaaggggaucgaguccagcaaggcggccgagcgcaccgagcaccgggccacccgcgugcgguacuaccgcaucaagcuccggaagauccgccugcugcggauccucuccgacaaccaccugugcccgccccugagccaggaggagcucuccacguggcgccugaagaaggucuaccccaagaacgagcuguucaugcaguggcagcggaccgacgacgacaccgagaagacccccuacgccuaccgccacaagugcauccacgagaagcucgaccugagcgacgugacggaccgguacauccugggccgcgccuucuaccacaucauccagcggcgcggcuuccucuccaaccggaaggagcagggcggggaggacagcgggaaggugaaggagggcaucuccacccugacccacgagaugaacgaggcgggguacgaguaccugggcgacuacuucuacgcccucuacaacaagggcgagaagauccgcaagcacuacaccgcccggaacgagcacuuccugagcgaguucaaggccaucugcgagaagcaggaccuggagaaggagcucggguccgaggucgugcgcaacaucgagaaggcgaucuucgaccagcggccccugaagucccagaagggccagguggggaagugcgucuucgagaagaacaagacgaagugcccguccagccaccccauguacgaggaguuccgcaugcugaccuucaucaacaacaucaagaucaagacccccaacgacgacgugcuccggccccugaacaccggcgagcgcgagaagaucaugccgcuguucuuccgcaaguccaagaagcaguucgacuucgaggacaucacgaagaagcucgcccccaagaagauguacggcuucuacaagaaggaggaggacgccgagaugcccuuccuguucaacuaccccauggacaccagcguguccgggugcccggucaccgccgcccugaaggacguguucggcgacgacuggaucaccgcgaucugcgagacguacacccucggggagggcaagagccgguucgacaucgugaacgacaucuggcacgcccuguacuucuacuccgacaaggacaagcuggccgaguucgccaucaaccgccuccagcugagcgaggacgaggccaagaucuucagcgagaucucccugcccgcggacuacgccagccucucccugaaggccaucugcaagauccugcccuaccuccggcgcgggcugaucuacagccacgccgucuuccugggcaaccucugcgaggugaugcccaaguacgagugguccaucaaggagaugcgggagaccaucaucgacaacaucaucauggagauggacaagugcgacaccaaggacaagcgcacguucgaggugugcaucaaggacuaccugaagggccaguacaacgucagcgacaacucccugaagaagcucuaccacccgagcaugaucgagaccuacccccgggugcaguacaccaacgagcacgggguguaccagcugggcagcccccgcaucgacagcguccggaaccccauggccaugcgcuccauguuccggcugcgcaagcucgugaaccggcugcugguggaggggaagaucgaccagaacaccgagguccacaucgaguucgcgcgcgagcugaacgacgccaacaagcggaacgccaucgcccucuucgugaaggagaaccagagcgccaacgacgaggcgcgcaagcagaucaucacgcuguucaagaaggagaccggcaccgacaucgagccgaccgacaaggacauccugaaguacguccucugggaggagcagaaccacaucugccuguacacggggaagcagauccggaucuccgacuucaucggcgccaaccccaaguucgacaucgagcacaccaucccccgcagcgugggcggggacuccaccaagaugaaccugacccucugcgacagccgguucaaccgcgaggugaagaagacgaagcugcccgucgagcugccgaaccacgacgagaucauggagcgcaucaaggaguggaagaagaacuacgagcuccuggacauccagauccggaagaacaagaagcuguccaagggcgccaccaccaaggagcagaaggacaccaucauccgcaagcggcaccuccuggagcugcgccgggacuacuggcgcgggaaguacgagcgguucaccauggagagcgugcccgagggcuucucccgccggcaggggacggacaucagcgugaucagcaaguacgcccgccucuaccugaagucccuguucaaccgggucuacaccgugaagggcaucgcgaccagcgacuuccgcaagaucuggggcauccaggacaucuacuccaagaaggagcggaucaaccacgugcaccacugcaucgacgccaucgucaucgccugcaucgggcucgacgaguacaacaagcugggcgccuacuaccacgacgaggagaacaacaagugguacgggaugagcaaggccuccuucaagaagcccugggcgaccuucguggaggacaucaagaagauccaggacgagauccugguguaccacuacacgcccgacaacaugccgaagcagggccgccggcgcaucaagaucgacggcaagaagauccucugcaagggggacgccgcccggggcagccugcacaacgacaccuacuacggggccaucgagaacgacggcgccgucaaguacgugaagcgcaucgaccuggcgucccucgaggagaaggacgugaagaacaucgucgacgacaccgugcggagcaucaucgaggccgccaucaaggagaagggguucaaggacgccauggccuccaccaucuggaugaacgaggagaagcgcgugcccaucaagaagguccggugcuucacgcccagcaucaccaagccgcugaacauccgcaagcagcgcgacguguccaucaaggaguacaagcagcaguaccacguggcgaacgacagcaacuaccugcucgcccuguacaucggcaccgacaacaagggcaaggagaagcgggaguucgagaucgucaacauccugcaggccgcccaguacuaccgcaccuccaacgacaaggaggugguggaccggcacaucguccccaucaagagcgagcacgacuaccccuucgcguacacgcucaagaucgggaccauggugcugcuguacgagaagucccccaacgaggugugggacgccaccaucaaggagcgcaaccggcgccucuacaaggucaccggccugagcacgaugcggaugaaggggcgcaacggcgaguacgccuacgccaccgugaagcugauccacaacgaggaggcccggccguccaaggacaucaaggcgaagaacggggaguacgagcagggcgaggaguuccgccccgccaucaucaugcuccacacccagcugaacgcccuggugcagggcuacgacuucgagaucaacgagcucggggagauccggcgccugcgguga

SEQ ID NO: 1724 - RNA, 3654 nt, Artificial Sequence
  Cas9 variant
auggagaagcagcgcauccugggccucgaccccgggaccaacagccugggcugggccgugcuggacuucgacaacuccaagcaggaguacaaccucguccggaagggggaggugaucuucgaggagggcgugggcaagagcgagcgcggggaguucuccaaggccgcguaccggaccuucuacaagagcacgcgcaagcacuacuuccggcgccggcugcgcaagaucgagguccugaaggugcucgugaaguacgacuucugcccguaccuguccgacgaccugcucaagcaguggcacgagaagaagaucuaccccgccgucaaggaguucauggacuggcagcggaccagcgacgccgagggcaagaaccccuacuacgaccgccacugcugccugaacgagaagcuggaccucucccucaagagcgaccgguacauccuggggcgcgcccuguaccaccugacccagcggcgcggcuucaaguccaaccggcugauccagaacaacgacgagaacgaggaggggaaggugaagaagggcaucagcgagcucuccaccgagaugcaggaggccaacugcaacuaccugggggacuacuucuacaagcuguacacggagaagggcaacaccgugcagauccgcaagcgguacaccgaccgcgagaagcacuacaagaacgaguucaacgcgaucugcgagaagcaggagcucaacgagaccaucgucaaggagcuggacaaggccaucuucuuccagcggaagcugaagccccagcgccacggcguggggaagugcacguucgagccgaacaaccggcgcugcgccaucagccaccccgacuucgagcgcuuccggaugcucugcuucaucaacaacaucaagaucaagacccccuucgaggagaaccugcgcccccugaacaacgaggagaaggcccucaucgagccgcuguucuaccggaaguccaucaagaacuucgacuucgaggagaucgcgaagaagcuggccggcaagaacaacuacugcuacaucaaggacgacagcuccaagcaguacaaguucaacuaccgcaugagccagggggccuccacgugccagaccaucgccaagcucaagagcaucuucggcgaggaguggaagaacggcaucgccgagacguacaccaaccggcgcaagaaggaggggcugaagaagcaggcggagaugguggacgacaucuggaacguccuguacuccgugagcgagugcgacgugcucaaggacuucgccaucaacaagcugcagcuggacgagaagaccgccgacaacuucagcaagaccaagcucgcccagggcuucgccacgcugucccugaaggcgauccggaagauccuccccuuccuggagcagggguucggcuacaccgaggccgucuuccuggccaacauccccaccgugguggggaaggaguacuggaacaacgaggacauccgcaacgacaucauggaggagaucaagaccaucuucuaccacaacacgcucaagaccaacgacagccacaacaccauccuguucugcaucaaggacauccuguccaacaacuucgaccucgcccccggcgccaucgacaagcuguaccacccgagcaugaucaacgucuacaaggacgugauccccaacgaggacggcauccugcagcucgggucccccaagaucgacgcggugaagaaccccauggccaugcggagccugcacaucauccgcaaggucgugaacgagcugcugcgggagggcaucaucaacuccgacaccgaggugcgcaucgaguacgcccgggagcucaacgacgccaacaagcgccacgccaucgcggacuggcagaagaagcaguacgggaagcaccagaaguaccggaaggagaucaaggagcuguucaaggccgagacgggcuucgagaucgagccgaacgagaccgacauccugaaguucgagcucugggaggagcagaaccacaucugccuguacaccgggcaggagaucggcaucagcgaguucgucggcgagaaccccaaguacgacaucgagcacaccuucccccgcucccucgggggcgacagcacgaagaugaacaugacccugugcgagaacaaguucaaccgggagaacaagcagaagaagcugcccuccgagcuggccaaccacagcgagauccucgagcgcaucgacgacuggaagaagaagaucuacauccugcagaagaaguacgacuccauccggacccacaacgggauggacaaggagaacaaggacaagaagaucgugagccgccacaagaucaagcuggagcucgacuacuggaagggcaaguacaaccgcuucaccaugacggagaucccggagggguucucccggcgccagggcaugggcaucgggcugaucagccgguacgccggccuguaccucaagaccaucuuccacaagaaggacaacccccagaaguccaacgucuacaucgugaaggggagcaucaccgcggaguuccgccggaucuggaacauccaggacgacuacgagaagaagugccgcgacaaccacauccaccacugcaucgacgccaucguggucggcugcaucggcaagcgggaguacgaccugauggcccaguucuaccgcgacgaggagaaguaccggugggagaagaagaagaagcccuucuucaagaagcccugggagaccuucacgcaggacaugcugucccucaaggacgaggugcugaccgugcacuucaacccgagcaacuucaccaagaaggcccacaagaaggucuucacccccaaggggaucuucguggcccagggcgacugcgcgcgcgugaagcugcacaaggggagcuacuucggcgccaucgagcagaagggggagaucaaguacgucaugcggaaggagcucuccgcccugaagaucgaggacaucaagaacaucguggacgccguggucaaggagaaggugcuggccguggucaagaagaagggcuucaagcaggcgauggccgagcccaucuacaugaacgaggacaagcgcauccucaucaagaaggugcggcuguucgugagccaggccaacccccugaucgucaagaagcaccgcgaccucuccagcaaggaguacaagcagaacuacuacguggacaacgagggcaaccugaugaucgccauguacgagggggugaagaagaacggcaagaucgaccgggagaucaccgucgugaacaaccuggaggccgcgaaguucuuccgccagucccagaagaacaacgccgagaagcagcucaucagccaccuguccccgaagaacggguacccccugaagacggugcucacccagaagcagcugguccugauguacgaggacagccccaaggagaucaagcuccgggacaccaagaacauggugaagcgccuguaccagguguucggcaucgagaaggacgggcgggucaagcugaaguuccaccaggaggcccgcuccgagggccucaacaucaacagcgccgcguucaagauccaggacaccccggagucccuguaccggcacaccaagagcaaccugaaggugcucgugaacggcgucgacuucaagaucaacauccugggggagaucucccugaucuga

SEQ ID NO: 1725 - RNA, 3654 nt, Artificial Sequence
  Cas9 variant
auggagaagcagcgcauccugggccucgaccccgggaccaacagccugggcugggccgugcuggacuucgacaacuccaagcaggaguacaaccucguccggaagggggaggugaucuucgaggagggcgugggcaagagcgagcgcggggaguucuccaaggccgcguaccggaccuucuacaagagcacgcgcaagcacuacuuccggcgccggcugcgcaagaucgagguccugaaggugcucgugaaguacgacuucugcccguaccuguccgacgaccugcucaagcaguggcacgagaagaagaucuaccccgccgucaaggaguucauggacuggcagcggaccagcgacgccgagggcaagaaccccuacuacgaccgccacugcugccugaacgagaagcuggaccucucccucaagagcgaccgguacgugcuggggcgcgcccuguaccaccugacccagcggcgcggcuucaaguccaaccggcugauccagaacaacgacgagaacgaggaggggaaggugaagaagggcaucagcgagcucuccaccgagaugcaggaggccaacugcaacuaccugggggacuacuucuacaagcuguacacggagaagggcaacaccguccagauccgcaagcgguacaccgaccgcgagaagcacuacaagaacgaguucaacgcgaucugcgagaagcaggagcucaacgagaccaucgugaaggagcuggacaaggccaucuucuuccagcggaagcugaagccccagcgccacggcguggggaagugcacguucgagccgaacaaccggcgcugcgccaucagccaccccgacuucgagcgcuuccggaugcucugcuucaucaacaacaucaagaucaagacccccuucgaggagaaccugcgcccccugaacaacgaggagaaggcccucaucgagccgcuguucuaccggaaguccaucaagaacuucgacuucgaggagaucgcgaagaagcuggccggcaagaacaacuacugcuacaucaaggacgacagcuccaagcaguacaaguucaacuaccgcaugagccagggggccuccacgugccagaccaucgccaagcucaagagcaucuucggcgaggaguggaagaacggcaucgccgagaccuacaccaaccggcgcaagaaggaggggcugaagaaccaggcggagauggucgacgacaucuggaacgugcuguacuccgugagcgagugcgacguccucaaggacuucgccaucaacaagcugcagcuggacgagaagaccgccgacaacuucagcaagaccaagcucgcccagggcuucgccacgcugucccugaaggcgauccggaagauccuccccuuccuggagcagggguucggcuacaccgaggccguguuccuggccaacauccccaccguggucgggaaggaguacuggaacaacgaggacauccgcaacgacaucauggaggagaucaagaccaucuucuaccacaacacgcucaagaccaacgacagccacaacaccauccuguucugcaucaaggacauccuguccaacaacuucgaccucgcccccggcgccaucgacaagcuguaccacccgagcaugaucaacguguacaaggacgugauccccaacgaggacggcauccugcagcucgggucccccaagaucgacgcggucaagaaccccauggccaugcggagccugcacaucauccgcaagguggugaacgagcugcugcgggagggcaucaucaacuccgacaccgagguccgcaucgaguacgcccgggagcucaacgacgccaacaagcgccacgccaucgcggacuggcagaagaagcaguacgggaagcaccagaaguaccggaaggagaucaaggagcuguucaaggccgagacgggcuucgagaucgagccgaacgagaccgacauccugaaguucgagcucugggaggagcagaaccacaucugccuguacaccgggcaggagaucggcaucagcgaguucgugggcgagaaccccaaguacgacaucgagcacaccaucccccgcucccucgggggcgacagcacgaagaugaacaugacccugugcgagaacaaguucaaccgggagaacaagcagaagaagcugcccuccgagcuggccaaccacagcgagauccucgagcgcaucgacgacuggaagaagaagaucuacauccugcagaagaaguacgacuccauccggacccacaacgggauggacaaggagaacaaggacaagaagaucgucagccgccacaagaucaagcuggagcucgacuacuggaagggcaaguacaaccgcuucaccaugacggagaucccggagggguucucccggcgccagggcaugggcaucgggcugaucagccgguacgccggccuguaccucaagaccaucuuccacaagaaggacaacccccagaaguccaacguguacaucgugaaggggagcaucaccgcggaguuccgccggaucuggaacauccaggacgacuacgagaagaagugccgcgacaaccacauccaccacugcaucgacgccaucgucgugggcugcaucggcaagcgggaguacgaccugauggcccaguucuaccgcgacgaggagaaguaccggugggagaagaagaagaagcccuucuucaagaagcccugggagaccuucacgcaggacaugcugucccucaaggacgaggugcugaccguccacuucaacccgagcaacuucaccaagaaggcccacaagaagguguucacccccaaggggaucuucguggcccagggcgacugcgcgcgcgucaagcugcacaaggggagcuacuucggcgccaucgagcagaagggggagaucaaguacgugaugcggaagaagcucuccgcccugaagaucgaggacaucgagcacaucguggacgccgucgugaaggagaaggugcuggccgucgugaagaagaagggcuucaagcaggcgauggccgagcccaucuacaugaacgaggacaagcgcauccucaucaagaaggugcggcuguucgucagccagaccaacccccugaucgugaagaagcaccgcgaccucuccagcaaggaguacaagcagaacuacuacguggacaacgagggcaaccugaugaucgccauguacgagggggucaagaagaacggcaagaucgaccgggagaucacgguggugaacaaccuggaggccgccaaguucuuccgccagucccagaagaacaacgcggagaagcagcucaucagccaccuguccccgaagaacggguacccccugaagaccguccucacccagaagcagcuggugcugauguacgaggacagccccaaggagaucaagcuccgggacaccaagaacauggugaagcgccuguaccaggucuucggcaucgagaaggacgggcggguggagcugaaguuccaccaggaggcccgcuccgagggccucaacaagaacagcgccgccuucaagauccaggacacgccggagucccuguaccggcacaccaagagcaaccugaaggugcucgucaacggcguggacuucaagaucaacauccugggggagaucucccugaucuga

SEQ ID NO: 1726 - RNA, 3654 nt, Artificial Sequence
  Cas9 variant
augaaguacaacuacgugcugggccucgacaucgggaucagcuccgucggcugggggcugcuggcccucgacgagaacaacaaccccuacaagaucaucgacgugggcagccgcaucuucuccccgggggagguggagaagaccggcgacagcaaggccaaggagcggcgcgagaagcggggcacccgccgggucauccgccggcgcgaguuccggcuggaccgcgugcggaaccugcucuacgagaagggguaccugaagggcaacaucacguccaacaucgugagcgucaagaacgaggagcugaccaucaucuucaacgacauggugaacaacuacuacaaguccaaggacaccaaccccuacaagcucaagguggaggcgcuggaccgcaagcugaccaacgacgagcucagcaucauccugguccacuacgccaagaagcggggguacaaguccaaccgcgaggagagcuccgacaacgacaacggcaaggugaaggaggccaucaaggagaacacgaaccugauggaggagaagaaguaccggaccaucagcgagauguacaucaagaacgagaaguucaagaacaagaucaagaacgggcccgacgacuacaagcucuccgugaccaacgagauguaccuggaggagaucaacaagguccuggacagccagaucggcuucggccucaucgacgacaacuucaagaacgaguaccuggagaucuacaacucccgccggcacuacagcgaggggcccggcuacuacuacgccaaggacgccaacgggaacaaggugaaggugcgcuccccguacggcggcgaccugaucaagaagaugaccggggucugcagcuucgacaagaaggcgcgggcccccaaguacgccuucuccagcgagcuguucgugagcaucuccaagcuggugaaccugcgcuacaagaucgacgacgacagcuacaagcagcucacgaaggagcagaucaacgagcugaucgacgaggccaagaacaagaacaaggucaccuacaagucccugaucaagauccucggcaucaagaacaucaaggugaaggaccugaaccugagcaaguccgaguacaucaaggugaucgacgagcucaagaagaagcugaacaucagcaaggaggagaagaucgacaucuacucccuggacgaggagaacaagaagaucuacgacgacaucuacaacgagaagcuguucagcaagacccucaucgaguucaagggguacaaccugcucaagaaggcgaucacccuguccuacaacagcggcacguggaacgacgucaaggacaacaucgaguuccuggacgagcucgcccuguacugcaccgacuacaaggugaacaacgagauccaggagcacauccacaacucccugaucaucgacagccgguucgacgacuccaacuucguggagaaccuccccaacuucaaggaccaccugaugcugagcaccgacaucauccgcaagcucauccccaucaugcuggaggggaucaccuacgacaaggccauggacaagaucggcuacaaccacuccaaccuguacaaggacacgaucaaggaggaccuccuggucccgguguacgucagcaagaacaucaccaaccagcgcgugauccggucccugacccaggcccgcaaggugaucaacgccaucaucaagaaguacggcagccccaagaucaucaacaucgagaccgcgcgggagcuggccaagacgcagaaggagcgccggaucaucgagaagaaccagcaggacaagcaguacgagaacgagcgcaucaagaagcaccucgucgagcuggagcuguucuccgacgagagcaagaucaccgggaacgaccuccugaaguacaagcuguggcaggagcagaaggaguucugcggcuacagcaugaagaagaucaagcucgaggaccuguucuccaacaacaucgugcagaucgaccacauccugcccuacagccggaccuacaacgacaacuaccucaacaagacccugguguacacgaaguacaaccaggacaaggggaacaagacccccuacgagugguucggcaagaccgacaaguggcaggaguacgaggccuucaucaacucccugagcaucucccagaacaagaaggacaacuaccuccugaagaaccuggaccaggacgccgagcgcgagaugcgggagcagaaccucaacgacaccaaguacaucagccgcgagcugcugucccucaucaaggccuaccugaacgucgacgaggugaacgcguucccgggggccaucacggccaagcugcgggcccgcuggggcuucaaccggcucacccacagcuacaucuccaagaccuacaucaugcccgaggacaugaagaagggcaucaacaaggaccgcgacaaccaccuccaccacgccauggacgcgcuggugaucgccagcaucaccaagucccuccagcagaagaucacgcuguacgagaaguucagccgguacgucgacgggaucaccaagaacgagcugggcaagaucuccaccgggaacaucaacgacgaccucuacaacuacuacgacgaggagaccggcgagaucaaggagcuggagcugcgccaguacaucaagaaccagguggcccagaacaacaucuacuucagcaagcacaacguguccaagcucaucuuccccacgcccuacaacaacuucgucgaggaggccaagcugcggguguacgagcgcgaccuggaggugcucaaguggaaccugaagaaccuggggaccuacaccagcuccgagcucaaccggauccacguccugaucccgagcguggccaagaacaagaucagcggccgccugcacgaggagaccuacuacggccucaaggagguggggaucggcgaggacaaggucaccuacaagacgcugaagacccccaucuccaaggugaagaagaaggaccuggacaacauccccgacugcaagggcgggagcaaggacaucuacaacgcgcucgugaagugguucggcaacugcgagaccggggaggaggcccugaagaugcacgacggcaaguaccccgucaacccgaacgacaaggagcagaaggagauccgcaagaucaagguguacaccaaguacaacgccacggggcacguggucaacaacggcaacguggagaagggcgggaucuaccggaucgacguguucaaguccaagaacaaggaggacaacaagcuguacuucaccagcuacgacaucuucgagaucgagcagaucaaggccuacgagaagggcaagaacaucaacuucuccaucaagcucgaguacgggcagggcaagaacaacaagauccugcuguacaaggacgucaagaacgaguacgaccucaucaugagcaucuacaagaacgaccugauccgcaucaagaccaagaccgggaacaaguccacggcguacguggugggcuucagcgggggcaagcuggagaucaaguccaccaucggcgacggguacgacaucaucggcaacaacaacaucuucgacaagagcauggagcgguaccgcgucaccuccagcaccaucgugaagaucgacaagcucuccaucagcauccugggggagguguccggccuguga

SEQ ID NO: 1727 - RNA, 3657 nt, Artificial Sequence
  Cas9 variant
augaacaagcgcauccugggccucgacaccgggaccaacagccugggcugggccguggucgacugggacgagcacgcccaguccuacgagcugaucaaguacggggacgugaucuuccaggagggcgugaagaucgagaaggggaucgagagcuccaaggcggccgagcggagcggcuacaaggccauccgcaagcaguacuuccggcgccggcuccgcaagauccagguccugaaggugcuggugaaguaccaccucugccccuaccuguccgacgacgaccugcggcaguggcaccuccagaagcaguaccccaagagcgacgagcugaugcuguggcagcgcacguccgacgaggagggcaagaacccguacuacgaccggcaccgcugccuccacgagaagcuggaccugaccgucgaggccgaccgguacacccucgggcgcgcccuguaccaccugacccagcggcgcggcuuccucagcaaccggcuggacacguccgcggacaacaaggaggacgggguggucaagagcggcaucucccagcugagcaccgagauggaggaggccgggugcgaguaccucggcgacuacuucuacaagcuguaccacgagcagggcaacaaggugcgcauccggcagcgcuacaccgaccggaagaagcacuaccagcacgaguucgacgccaucugcgagaagcaggagcuguccagcgagcucaucgaggaccugcagcgcgccaucuucuuccagcugccccucaagucccagcggcacggggugggccgcugcaccuucgagcgcgggaagccccggugcgcggacagccacccggacuacgaggaguuccgcaugcugugcuucgugaacaacauccaggucaagggcccccacgaccuggagcuccggccccugacguacgaggagcgcgagaagaucgagcaccuguucuuccggaaguccaagcccaacuucgacuucgaggacaucgccaaggagcucgccggcaagaagaacuacgccuggauccacgacaaggaggagcgcgccuacaaguucaacuaccggaugacccagggggugccgggcugccccaccaccgcgcagcucaagagcaucuucggggacgacuggaagacgggcaucgccgagaccuacacccugauccagaagaagaacggguccaagagccugcaggagaugguggacgacgucuggaacgugcuguacagcuucuccagcguggagaagcugaaggaguucgcccaccacaagcuccagcuggacgaggagaacgccgagaaguucgccaagaucaagcugucccacagcuucgcggcccucucccugaaggccauccgcaaguuccugcccuuccuccggaagggcauguacuacacccacgccagcuucuucgccaacauccccacgaucgucggcaaggagaucuggaacaacgagcagucccgcaaguacaucauggagaacgugggggagcugguguucaacuaccagccgaagcaccgggacguccagggcaccaucgagaugcugaucaaggacuuccucgcgaacaacuucgagcugcccgccggggccaccgacaagcuguaccaccccagcaugaucgagaccuacccccacgcccugcgcaacgaguucggcauccuccagcugggguccccgcggacgaacgccauccgcaaccccauggcgaugcggagccugcacgugcuccgccggguggucaaccagcugcugaaggaguccaucaucgacgagaacaccgaggugcacgucgaguacgcccgcgagcucaacgacgccaacaagcggcgcgccaucgcggaccgccagaaggagcaggacaagcagcacaagaaguacggcgacgagauccggaagcuguacaaggaggagaccggcaaggacaucgagcccacccagacggacgugcugaaguuccagcucugggaggagcagaaccacuacugccuguacaccggggagcagaucggcaucaccgacuucaucgggagcaaccccaaguucgacaucgagcacaccaucccgcaguccgugggcggggacagcacgcagaugaaccugacccucugcgacaaccgcuucaaccgggaggucaagaaggccaagcugcccaccgagcuggccaaccacgaggagauccucacccgcaucgagcccuggaagaacaaguacgagcagcuggugaaggagcgggacaagcagcgcacguucgccggcauggacaaggccgugaaggacauccggauccagaagcgccacaagcugcagauggagaucgacuacuggcggggcaaguacgagcgcuucaccaugaccgagguccccgagggguucucccggcgccagggcaccgggaucggccucaucagccgguacgcgggccuguaccugaagucccucuuccaccaggccgacagccgcaacaaguccaacguguacguggucaaggggguggccacggccgaguuccggaagauguggggccugcagagcgaguacgagaagaagugccgcgacaaccacagccaccacugcauggacgccaucaccaucgcgugcaucgggaagcgggaguacgaccugauggccgaguacuaccacauggaggagaccuuccgccagggccggggguccaagccgaaguucagcaagcccugggccaccuucaccgaggacgugcucaacaucuacaagaaccugcuggucgugcacgacacgcccaacaacaugcccaagcacaccaagaaguacgugcagaccuccaagggcaagguccucgcccagggcgacaccgcccgcgggagccugcaccuggacacguacuacggcgcgaucgagcgggacggggagauccgcuacguggugcgccggccgcucuccagcuucaccaaccccaaggagcuggagaacaucgucgacgagaccgugaagcgcaccaucaaggaggccaucgccgacaagaacuucaagcaggccaucgcggagcccaucuacaugaacgaggacaagggcauccugaucaagaaggugcggugcuucgccaacuccgucaagcagccgaucaacauccgccagcaccgggaccucagcaagaaggaguacaagcagcaguaccacgugaugaacgagaacaacuaccugcuggccaucuacgaggggcucgugaagaacaaggucgugcgcgaguucgagaucguguccuacaucgaggccgccaaguacuacaagcggagccaggaccgcaacaucuucuccagcaucguccccacgcacuccaccaaguacggccugccccugaagaccaagcuccugaugggccagcagguccugauguucgaggagaaccccgacgagauccagguggacaacaccaaggaccucgugaagcggcuguacaaggugguggggaucgagaaggacggccgcaucaaguucaagcaccaccaggaggcgcggaaggaggggcugacgaucuacagcaccccguacaagaacaacgacgacuacguccccaucuuccgccaguccaucaagaacaucaacauccucguggacggcaucgacuucaacaucgacauccuggggaaggugacccugaaggaguga

SEQ ID NO: 1728 - RNA, 3657 nt, Artificial Sequence
  Cas9 variant
augaacaagcgcauccugggccucgacaccgggaccaacagccugggcugggccguggucgacugggacgagcacgcccaguccuacgagcugaucaaguacggggacgugaucuuccaggagggcgugaagaucgagaaggggaucgagagcuccaaggcggccgagcggagcggcuacaaggccauccgcaagcaguacuuccggcgccggcuccgcaagauccagguccugaaggugcuggugaaguaccaccucugccccuaccuguccgacgacgaccugcggcaguggcaccuccagaagcaguaccccaagagcgacgagcugaugcuguggcagcgcacguccgacgaggagggcaagaaccccuacuacgaccggcaccgcugccuccacgagaagcuggaccugaccgucgaggccgaccgguacacccucgggcgcgcccuguaccaccugacccagcggcgcggcuuccucagcaaccggcuggacacguccgcggacaacaaggaggacgggguggucaagagcggcaucucccagcugagcaccgagauggaggaggccgggugcgaguaccucggcgacuacuucuacaagcuguacgacgcccagggcaacaaggugcgcauccggcagcgcuacaccgaccggaacaagcacuaccagcacgaguucgacgccaucugcgagaagcaggagcuguccagcgagcucaucgaggaccugcagcgcgcgaucuucuuccagcugccccucaagucccagcggcacggggugggccgcugcaccuucgagcgcgggaagccccggugcgccgacagccacccggacuacgaggaguuccgcaugcugugcuucgugaacaacauccaggucaagggcccccacgaccuggagcuccggccccugacguacgaggagcgcgagaagaucgagccccuguucuuccggaaguccaagccgaacuucgacuucgaggacaucgccaaggcccucgccggcaagaagaacuacgcguggauccacgacaaggaggagcgcgccuacaaguucaacuaccggaugacccagggggugcccggcugccccaccaucgcccagcucaagagcaucuucggggacgacuggaagaccggcaucgccgagacguacacccugauccagaagaagaacggguccaagagccugcaggagaugguggacgacgucuggaacgugcuguacagcuucuccagcguggagaagcugaaggaguucgcccaccacaagcuccagcuggacgaggaguccgcggagaaguucgccaagaucaagcugagccacuccuucgccgcccucagccugaaggccauccgcaaguuccugcccuuccuccggaagggcauguacuacacccacgcguccuucuucgccaacaucccgaccaucgucggcaaggagaucuggaacaaggagcagaaccgcaaguacaucauggagaacgugggggagcugguguucaacuaccagcccaagcaccgggagguccagggcacgaucgagaugcugaucaaggacuuccucgccaacaacuucgagcugcccgccggggccaccgacaagcuguaccaccccagcaugaucgagaccuacccgaacgcgcagcgcaacgaguucggcauccugcagcucggguccccgcggaccaacgccauccgcaaccccauggccaugcggagccugcacauccugcgccggguggugaaccagcuccugaaggaguccaucaucgacgagaacacggagguccacguggaguacgcccgcgagcugaacgacgcgaacaagcggcgcgccaucgccgaccgccagaaggagcaggacaagcagcacaagaaguacggcgacgagauccggaagcucuacaaggaggagaccggcaaggacaucgagcccacccagaccgacguccugaaguuccagcugugggaggagcagaaccaccacugccucuacacgggggagcagaucggcaucaccgacuucaucgggagcaacccgaaguucgacaucgagcacaccaucccccaguccgugggcggggacagcacccagaugaaccugacgcugugcgacaaccgcuucaaccgggaggugaagaaggccaagcuccccaccgagcuggccaaccacgaggagauccugacccgcaucgagcccuggaagaacaaguacgagcagcucgucaaggagcgggacaagcagcgcaccuucgcgggcauggacaaggccgugaaggacauccggauccagaagcgccacaagcugcagauggagaucgacuacuggcggggcaaguacgagcgcuucacgaugaccgaggugccggagggguucucccggcgccagggcaccgggaucggccugaucagccgguacgccggccucuaccugaagucccuguuccaccaggccgacagccgcaacaaguccaacgucuacguggugaagggggucgccaccgcggaguuccggaagauguggggccuccagagcgaguacgagaagaagugccgcgacaaccacagccaccacugcauggacgccaucacgaucgccugcaucgggaagcgggaguacgaccugauggccgaguacuaccgcauggaggagaccuucaagcagggccggggguccaagcccaaguucagcaagcccugggccaccuucaccgaggacgugcugaacaucuacaagaaccuccuggugguccacgacacccccaacaacaugccgaagcacacgaagaaguacgugcagaccuccaucggcaaggugcuggcgcagggcgacaccgcccgcgggagccuccaccuggacaccuacuacggcgccaucgagcgggacggggagauccgcuacgucgugcgccggccccuguccagcuucacgaagcccgaggagcucgagaacaucguggacgagaccgucaagcgcaccaucaaggaggccaucgcggacaagaacuucaagcaggccaucgccgagccgaucuacaugaacgaggagaagggcauccugaucaagaaggugcggugcuucgccaaguccgugaagcagcccaucaacauccgccagcaccgggaccugagcaagaaggaguacaagcagcaguaccacgucaugaacgagaacaacuaccuccuggccaucuacgaggggcuggugaagaacaaggugguccgcgaguucgagaucguguccuacaucgaggcggccaaguacuacaagcggagccaggaccgcaacaucuucuccagcaucgugcccacccacuccacgaaguacggccucccccugaagaccaagcugcucaugggccagcugguccugauguucgaggagaacccggacgagauccagguggacaacaccaaggaccucgugaagcggcuguacaaggucguggggaucgagaaggacggccgcaucaaguucaaguaccaccaggaggcccggaaggaggggcugcccaucuucagcacccccuacaagaacaacgacgacuacgcccccaucuuccgccaguccaucaacaacaucaacauccucguggacggcaucgacuucacgaucgacauccuggggaaggucacccugaaggaguga

SEQ ID NO: 1729 - RNA, 3657 nt, Artificial Sequence
  Cas9 variant
augaacaagcgcauccugggccucgacaccgggaccaacagccugggcugggccguggucgacugggacgagcacgcccaguccuacgaguucaucaaguacggggacgugaucuuccaggagggcgugaagaucgagaaggggaucgagagcuccaaggcggccgagcggagcggcuacaaggccauccgcaagcaguacuuccggcgccggcugcgcaagauccagguccucaaggugcuggugaaguaccaccugugccccuaccucuccgacgacgaccugcggcaguggcaccuccagaagcaguaccccaagagcgacgagcugaugcuguggcagcgcacguccgacaagaagggcaagaaccccuacuacgaccggcaccgcugccugcacgagaagcucgaccugaccgucgaggccgaccgguacacccuggggcgcgcccucuaccaccugacccagcggcgcggcuuccugagcaaccggcucgacacguccgcggacaacaaggaggacgggguggucaagagcggcaucucccagcugagcaccgagauggaggaggccgggugcgaguaccugggcgacuacuucuacaagcucuacgacgagcagggcaacaaggugcgcauccggcagcgcuacaccgaccggaacaagcacuaccagcacgaguucgacgccaucugcgagaagcaggagcuguccagcgagcugaucgaggaccuccagcgcgccaucuucuuccagcugccccugaagucccagcggcacggggugggccgcugcaccuucgagcgcgggaagccccggugcgcggacagccacccggacuacgaggaguuccgcaugcucugcuucgugaacaacauccaggucaagggcccccacgaccuggagcugcggccccucacguacgaggagcgcgagaagaucgagccccuguucuuccggaaguccaagccgaacuucgacuucgaggacaucgccaaggcccuggccggcaagaagaacuacgccuggauccacgacaaggaggagcgcgcguacaaguucaacuaccggaugacccagggggugcccggcugccccaccaccgcccagcucaagagcaucuucggggacgacuggaagacgggcaucgccgagaccuacacccugauccagaagaagaacggguccaagagccugcaggagauggaggacgacguguggaacguccucuacagcuucuccagcguggagaagcugaaggaguucgcccaccacaagcugcagcucgacgaggaguccgccgagaaguucgcgaagaucaagcugagccacuccuucgccgcccugagccucaaggccauccgcaaguuccugcccuuccugcggaagggcauguacuacacccacgccuccuucuucgcgaacaucccgacgaucgugggcaaggagaucuggaacaacgagcagaaccgcaaguacaucauggagaacgucggggagcucguguucaacuaccagcccaagcaccgggaggugcagggcaccaucgagaugcugaucaaggacuuccuggccaacaacuucgagcuccccgccggggccaccgacaagcuguaccaccccagcaugaucgagaccuacccgcacgcccagcgcaacgaguucggcauccugcagcugggguccccgcggacgaacgcgauccgcaaccccauggccaugcggagccuccacauccugcgccgggucgugaaccagcugcucaaggaguccaucaucgacgagaacaccgaggugcacgucgaguacgcccgcgagcugaacgacgccaacaagcggcgcgcgaucgccggcuggcagaaggagcaggacaagcagcacaagaaguacguggacgagauccgcaagcuguacaaggaggagaccggcaaggacaucgagcccacccagacggacguccucaaguuccagcugugggaggagcaggaccaccacugccuguacaccggggagcagaucggcaucaccgacuucaucgggagcaacccgaaguucgacaucgagcacaccaucccccaguccgugggcggggacagcacgcagaugaaccucacccugugcgacaaccgguucaaccgcgagaucaagaaggccaagcugcccgcccagcucuccaaccacgaggagauccuggcccggaucgagcccuggaagaacaaguacgagcagaagaucaaggagcgcgacaagcagcggaccuucgcgggcauggacaaggccgugaaggaccugcgcauccagaagcggcacaagcuccagauggacaucgacuacuggcgcggcaaguacgagcgguucaccaugacggaggucccggagggguucagccgccggcagggcaccgggaucggccugaucucccgcuacgccggccuguaccucaagagccuguuccaccaggccgacucccggaacaagagcaacguguacguggucaaggggguggccaccgcggaguuccgcaagauguggggccugcagagcgaguacgagaagaagugccgggacaaccacucccaccacugcauggacgccaucaccaucgccugcaucgggaagcgcgaguacgaccucauggccgaguacuaccggauggaggagacguuccgccagggccgggggagcaagcccaaguucuccaagcccugggccaccuucaccgaggacgugcugaacaucuacaagaaccugcucgucgugcacgacacccccaacaacaugccgaagcacaccaagaaguacgugcagacgagcaagggcaagguccuggcgcagggcgacaccgcccgcgggucccugcaccucgacaccuacuacggcgccaucgagcgggacggggagauccgcuacguggugcgccggccccugagcuccuucaccaagcccaaggagcuggagaacaucgucgacgagacggugaagcgcaccaucaaggaggccaucgcggacaagaacuucaagcaggccaucgccgagccgaucuacaugaacgaggacaagggcauccucaucaagaaggugcggugcuucgccaagagcgucaagcagcccaucaacauccgccagcaccgggaccuguccaagaaggaguacaagcagcaguaccacguggugaacgagaacaacuacaugcuggucaucuacgaggggcucgugaagaacaaggugguccgcgaguucgagaucgugagcuacaucgaggccgcgaaguacuacaagcggucccaggaccgcaacaucuucagcuccaucgugcccacccacagcgccaaguacggccugccccugaagaccaagcuccugaugggccagcugguccucauguucgaggagaacccggacgagauccagguggacaacacgaaggaccuggugaagcggcuguacaaggucguggggaucaagaaggacggccgcgugaaguucaaguuccaccaggaggcccggaaggacgggcuccugaucuucuccacccccuacaagaacaacaacggcuacguccccaucuuccgccacagcaagaagaacaucaacauccugguggacgggaaggacuucaccaucgacauccucggcaaggugacccugaaggaguga

SEQ ID NO: 1730 - RNA, 3660 nt, Artificial Sequence
  Cas9 variant
augaaggaggaggugcgcggcaagaaccggagccagaccugggccauccuggccaaguucuucgucugguccgagaaggagagcguguggaacgagaaggaggcgcgcaccgaggagcgggugaaggaguacaagcucgucgggcugaagcgcgacacgaagggcaacgagcugaagcucgagaacuaccgguggcgcgugcaggcccuguccgagcagcugaaccccgagaucguggccaucguccuccaggagaucaacgggcagaucagcgccuccagcggcuaccugggggccaucuccgaccggagcaagcagcuguacuucaaccgccagaccgugggccaguaccucauguccgagcuggagaaggacccgaacgugagccugcggaaccgcgucuucuaccggcaggacuaccucgacgaguucgaccgcaucugggagaagcaggcggaguuccacgaggagcugaccguggagcugaagaaggagauccgggacaucaucaucuucuaccagcgccggcucaagucccagaagggccugaucagcuucugcgaguucgagaagcgcgagguggucguggaggaggacgggcggaagaagaacaagaccgugggcugccgcgucaucccccggucccacccccuguuccaggaguucaagaucuggcagacgcucaacgacaucgagguguucgccugggacaagcagagcaagcgcaagaaggccgacaaguccagcauccuguucgacaacuccgaggacgcccugcucguggaggggaagcgguuccuguaccaggaggagaaggagcugcucgcgaaggagcuguucgucaaggagagcaugaagaaggccgaggugcugaagcuccuguucgagaacuaccaggagcuggaccucaacuucaagcagaucgacggcaaccacaccggguucgcccuguucuccgccuacagcaagaugaucgagaaguacggcuacgagcccguggacuucaagcgcagcgccgacgagaucaucgagaagcuggagaccaucuucaccaaccucggcuggaacacggagcugcuguccaucgaccucagcaaggaggacaaggagcuggagcgccaguccuacuuccggcuguggcaccuccuguacagcuucgagggggacaacaccccgaccggcaacgggaagcugcucgagaagaucaugcagcugugcgacgucgagaaggaguacgcgguggagcuggccaacguguccuuccaggaggacuacggcagccucuccgccaaggccaucaagaagauccugcccuaccugaaggagggcaaccaguacgacgucgccugcgacuacgcgggguaccgccacagccgguccagccucaccaaggacgagaucgagaacaagauccugaaggacaagcuggagauccugcccaagaacucccuccgcaaccccguggucgagaagauccugaaccagauggugaaccugaucaacacgcucaucgacaccuacggcaagccggacgagauccggguggagcuggcccgcgagcugaagaagaacgccaaggagcgggaggagcucaccaagagcaucgcccgcaacacccgggagcacgacgagauccgccagcugcugcggacggaguucgggaugaugaacgucucccgcaacgacaucauccgguacaagcucuacgaggagcugaaggacaacggcuacaagacccuguacagcaacgaguacaucccccgcgagaagaucuucuccaaggagaucgacaucgagcacgugaucccccaggcccgccucuucgacgacagccuguccaacaagacccuggaguaccgggcgaucaacaucgagaaggggaacaagaccgccuacgacuucgugaaggagaaguacggcaacgacggccucgagaaguuccugaaccggugcgagacgcuguucaaggacaagcgcaccaagcuccggaagcugaagauggaggagaaggacauccccgagggguucaucgaccgcgaccugcgcaacacccaguacaucagcaagaaggccuucgccaugcucaacgagaucucccggcgcgucguggccaccacgggcagcaucaccgacaagcugcgggaggacuggcagcugguggaccucaugaaggagcugaaccugccgaaguacgagaagcucgggauggucgagauguucgaggacaaggacggccgcaagaucaagaagaucaccgacuggaccaagcggaacgaccaccgccaccacgcgguggacgcccugacgguggccuucaccaaggacgucuucauccaguucuacaacaacaagaacgccgcguggaugcccgccagcaaggagcacgccaacaucaccgggaucaaggcccgguacuucgagaacggcaaggcccuggcgcccaugccccucgcccaguuccgcgccgaggccaagcggcaccuggagaaccugcucguguccaucaaggccaagaacaaggugaucaccagcaacgucaaccgcacgaagaacaagaacggcgagaaccggaagcugcagcagaccccgcgcgggcagcugcaccucgagaccguguacggcucccaccggcaguacgcgaccaagaucgagaaggugaacgccgccuucgacgucacgaagaucgccaccgugagcaagcuggccuaccgcaacgcgcugcucaagcggcuggaggccuucgggaacgaccccaagaaggccuucaccggcaagaacacccuggagaagaacccccucuaccuggacgagaaccagaccgagauggugcccgagaagguccagacgguggaguucgagaccguguacaccauccgcaagccgaucgaccccaaccuguccaucgacaaggucguggacgugaagauccggagcguccucgagaagcgccugaaggaguacgggggcgacgccaagaaggcguucgugaaccuggacgagaaccccaucuggcucaacgaggccaagggcaucuccaucaagcgggugagcauccgcgggaucuccaacgcccagagccugcacgagaagaaggacaaggacggcaaccugauccucgggaaggagggccggaagauccccgucgacuucgugaacaccggcaacaaccaccacguggccaucuacaagaagccgguccuggacaaggugggccaggugguccuggacgaggaggggaaccccaaguacgagcucgacgaggugguggucuccuucuucgacgccgugacgcgcgcgaaccuggggcagcccaucaucgacaaggacuaccgccggagcgagggcuggcaguuccuguucuccaugaagcagaacgaguacuucguguuccccaacgacaagaccggguucaacccgaaggaggucgaccuccugaaccccgagaacuacgcccugaucagccccaaccucuuccgcgugcagaaguucgccuacaagaacuacguguuccggcaccaccuggagaccaccaucaaggacacguccagcacccugaagggcaucaccuggaccgacuuccgcuccagcaagggccucgacaagaucgucaaggugcggguggaccacaucgggcagaucgucagcaucggcgaguacuga

SEQ ID NO: 1731 - RNA, 3663 nt, Artificial Sequence
  Cas9 variant
augaagcgcauccugggccucgaccuggggagcgccuccaucggcugggcccugaucgaggaggacgagaaggggauccggaucaucgcgcucggcagccgcaucauccccuacaacgggaccgagggccaggacuucgccaagggcgccggggagucccggaacagccugcgcacccaggcccggacgacccgcaagggcuacgaccgguaccagcugcgccggaaguaccucaucaacgugcuggagaagaaccugaugaugccguccgaggaccuccgcaagaugcccaagaugaaccuguggcagcugcggagcaaggccgucaccgaguacaucucccgccaggagcucgggcggcugcugcucuggcugaaccagaagcgcggcuacaagagcucccggagcgacgcgaaccuggacaagaaggacaccgacuacgugaaggaggugaagucccgcuucgacaagaucaaggagaagaaccagacgaucgggcaguacuucuacgagagccuccagugcgacgaguacuuccgggucaaggagaacguguucccccgcgaggccuacaucgccgaguucgacgccaucugcucccggcagaaggaccaccugggccugagcgaggagcucaucgcggagauccgcaacgagaucaucuacuaccagcggccccugaagucccagaagggccuggugagcgucuacgacuucgaggggaaguggaugaaccagaacggcaaggagcuguucaucgggccgaagguggcccacaaguccagcccccucuuccagcuggccaagaucugggaguccgugaacaacaucaagcucagcaccaaguacggcgacaccaucgagcugacccuggaggagaagaagcagcucgucgaguuccuggacaacaacgagaagcugacgaccgccgcccucuucaagauccugcgcaaggacaagaaggaguacauccugcccaagcagcucgagaagggccugcaggggaacaucaccaagugcaagaucgcggacauccugggcagcaaguacaaccagcuccugcagcugaaccucgagaagcaggagguggggacccccugcuaccuguacacgaaguccaccggcgaggugcugggggagaagccgcuccaguacaucgacaagagcgucgagaaggagcuguucuaccagcuguggcacaccaucuacuccaucagcgacgaggacgagugcugcaaggcccuccagaagcgcuucgacaucgacgccgagaccgccggccggcuggccaagaucgacuucuccaaguacggcuucgggaacaagagcgcgaaggccauccgcaagauccugcccuaccugauggagggcgacaaguacuccgacgccaugugcuacgccggguacaaccacagcaacucccucacgaaggaggagaaccacgagcggaagcugaacgacaagcugaagcuccugaccaagaacagccugcgccagcccaucguggagaagaucaugaaccagaugauccagcucgugaacaccaucaucgacaaguacggcaagcccgacgagauccggcuggagcuggcccgcgagcucaagcaguccaaggaggagcggaacgacgcggacaaggccaugagcaagcgccagcgggagaacaaggaggccgagaagaagcuggaggagcacgggauccgcgccacccacaacaacauccugaaguaccgccucuucgaggagaugggcgagaagaagcacgaggccaucugcaucuacugcggcaacccgaucuccuucagcgcggccaugaacggggacgaggucgacguggagcacaucaucccccgguccaagcuguucgacgacagccaguccaacaagacgcuggcccaccggaagugcaacgccaacaagaacgacaugaccgcguacgacuucaugaagaccaagagcaagcaggacuucgacaaguacguggagcgcgucaaccagcucuacgccgaccggaucaucucccgcagcaaguacaacaagcugcugaugagcgaggacgacauccccuccaacuucaucgaccggcagcuccgcgagagccaguacaucgccaccaaggcccgggagauccugcagacgaucugcuacaacgugugguccaccagcggcaccgugaccgccgagcugcgccaccucugggggugggacgacaucacgaugaaccugcagaugcccaaguacaaggagcugggccucaccgagauggucgaguggaccuccgaccacgggaagaacgugcacagcaaggaggugaucaagggcuggaccaagcgcgacgaccaccggcaccacgcgaucgacgcccugacgaucgccugcaccaagcagggcuucauccagcgcuucaacacccuguccagcuccaagacccgggacgacaugcagaaggagcucgagaagugcagcauccaguuccgcgagaagcggucccugcuggagaaguacaucaucagccagcgcccgaucuccgucagcgacguggccgaggccgucucccggauccucaucagcuucaaggcggggaagaagguggccacgaucggcaagcgcaaggugaaggggaaggucgugcagcagggcaucguggucccccggggcgcccuguccgaggggagcguguacggcaagauccgcaccaucgugcggaagaugcccgucaaguaccuguucgagaaccccgaccucaucuucaagccguacaucaaggcccuggugaaggagcgccuggccgaguucgacaacgacaacaagcaggcgcucgccagccugaagaagaaccccguguaccuggacaaggagaagaccaagcuccuggaguacgggaccugcuucaaggacgaguacgucaagaaguacgacgugaaccccaacuucaccaagaucgccgacgugaucgacggcaaggucaagcagauccuggaggaccggcucuccaaguucgggggcaagcccaaggaggccuucaaggacguggugaaggacggcaagacgcugaagugguacgaggacgaggggcuggagcgcccgauccggagcguccgcugccucaccggccuguccgcgguggugcccgucaagaaggacgagaacgggauggacaucggcuucgugaagcccgggaacaaccaccacguggccaucuacgucggcgccgacggcaaggggcaggagcacgugugcaccuucuggaacgccguggagcggaagaaguacggccugcccaucaucaucaaggacgccaacgaggucugggacaagaucaccauggcgggggacgacguguacccgcagagcuuccucucccugcugcccaagcccgacuggacgcucaagcugagcaugcagcagaacgagauguucauccugggcauggaggaggacgaggugaaguucgccaucgaguccaaggacuacaagcuccugagcgaccaccuguaccgcguccagaagcucuccagcuccgacuacaacuucauccaccaccuggagaccgacgugcagaagaagaccaugaccuaccgggugcgcagccuguccggccucuucgcccugcggccguucaagguccgcaucgacugccuggggaacaucauccccagcuga

SEQ ID NO: 1732 - RNA, 3669 nt, Artificial Sequence
  Cas9 variant
augaagaagcgcauccugggccucgacagcgggaccaacucccugggcugggccguggucgaccgggacgagaacaaccaguacagccugaucaaguacggggaccucaucuucgaggagggcgugaagaucgagaaggggguggaguccagcaaggccgcggagcgcaccucccaccgggcccugcgcaagcuguacuuccggcgccggcuccgcaagaucgagguccugaaggugcuggugaaguacaaccucugcccccaggucagcgaggaggagcugcaccuguggcacacgcggaagcucuacccgcagaacaaggaccugcugcaguggcagcgcaccgacgagaaggccggcaagaaccccuacaucuaccgguaccgcugccuccacgaggagcuggacauguccgugagcgccaaccggaugaccgugggccgcgccauguaccaccuggcgcagcggcgcggguuccucuccaaccggcuggacaacgaggaggacgagaaccagaucggcgccgucaagugcgggaucagcaaccugaccgaggagauccaguccagcggcugcaaguaccucggggaguacuucuacaagcuguacaacgagcacggcaacacggugcgccugcggacccgcuacaccucccgggaguuccacuacaagaaggaguucuacgccaucugcgagaagcagaagcucgacaagaagcugaucgaggagcuggccagcgcgcucuacuuccagcgcccccugaagucccagcgccacaccgugggccggugcacguucgagcccaacaagccgcgcugcgccgacagccaccccgccuacgaggaguuccggaugcuguccuucaucaacaccaucaagguccaggggcccuacgacaccgagcuccgcgugcugaacaccgaggagcgggacagcaucacgaagcuguucugccgcaaguccaagcccaacuucgacuucgaggacaucgccaaggagcucgccggccggaacaacuacugcuacaucggggacguggucgacaaggcguacaaguucaacuaccgcaugagccagggcgugagcggcugcccgaccaccaccuaccugaucaacguguucgggcaggacuggcagacgggcaucgccgaguccuaccaggccaucgacaccaagcuggggcagaaguccgucgacgccaugaucgacgacguguggaacgugcucuacuccuucagcuccaaggacaagcugcgggacuucggccgcaagaagcugcagcucggggacaaggaggccgacaccuucgcgaacaucaagcugacccacaaguucgccagccugucccucaaggccauccggaagaucaacaucuuccugcgcaugggccuggucuacagccacgccgugacgcucgccaacauccccaccaucgugggcaccgacaucuggcagcggaagcgcaacuucauccuggcggagcugcucccccugaucgagaacuucaaccccaaggagaccaagcugcaggagacgcuggacuucugcgucaaggacuuccuccagaacaacuucgagcugaagaacggggccguggacaagcuguaccacccguccaugaucgaggccuaccccgacgccggccucaacagcaacgggauccugcagcugggcagcccccggaccaacgccauccgcaaccccauggcgaugcggagccuccacgagauccgcaaggucaucaaccagcugcugaaggacaagaucaucaaccaggacaccgagauccacguggaguacgcccgggagcucaacgacgccaacaagcgcaaggccaucuccaucuggcagaagucccaggagaagcugcacaagaaguacguggaggagaucaccaaccuguacaaggaggagacggggaaggcgaucgucccgaccgacaccgacauccucaaguucaagcugugggaggagcagaaccacaucugccuguacaccggccagcagaucggcaucgccgaguuccucggggccacgcccaaguacgacaucgagcacaccaucccccagagcgugggcggggacagcaccgacaugaaccugacccugugcgacucccgcuucaaccgggagaucaagaaggcccagcuccccacgcagcugggcaaccacgccgacauccuggugcgcaucgcgggguggaagaacagcuacgagaagcucuccaaggacaucgaccggauccgcacccacagcggcauggccaaggacaucaaggaccggcugauccagaagcgccaccuccugaagcuggagcgggacuacuggcgcggcaaguacgagcgguucaccaugaacgagaucccggagggguucagccgccggcagggcgucgggaucggccugaucuccaaguacgccggccucuaccucaagagccuguuccacgacaagaacgagcgcaacaaggggcacguguucguggucaagggcaccaccacggccgaguuccggaagaugugggggcugcagaacgaguacgagaagaagucccgcaacaaccacgugcaccacugcaucgacgccaucaccaucgcgugcaucggcaagcacgaguacgcccagauggcccaguacuaccacgacgaggccgaguaccuguaccaccacgggaucaagcccaucuuccccaagcccuggaagaccuucaccgaggaccugcucgaccuggagcacagccuguucgugguccaccacuccccgaacaacauggccaagcaggcgcggaagcgcaucaucacgagcaccggccagcacugggcccagggcgacuccgcccacgggagccuccacaacgacaccuacuacggcgccaucgagcgggacggggagaucaaguacguggugcgccgggcggucuccagcuucgagcagauguccgacguggacagcaucguggacgacgucgugaaggagaccgugcgcaaggcccuggagggcaagaacuucaaggaggccgucaacgcccccaucuacaugaacaaggagaagggggugcugaucaagaaggugcggugcuacgccaaguccaucaagaagcccaucgacauccgcacgcaccgcgacagcuccagcaaggaguacaagcggaaguuccacgucuccaacgacaucaacuaccucaucgcgaucuacgagggcaccgugaagggcaaggugaagcgcgacuucgaggucgugaagaacaucgaggccgccaacuucuucaagcggagccaggaccgccgggacuaccccaccaucgugccggagaaguccaucaagcacggguucccccugaagaccacgcugaccaacggcaccauggucauccucuacgaggagaacaaggaggagaucgacuucaccaagaaggaggacaucugccgccggcuguacaagcugguggggaugagcagcaugaucguguccggcugcgaguacgggguccucagccugcgccaccaccaggaggcccggcccuccaaggacaucaagagcaagaacggcgccuucaagaacggcgaggcgcugcgcccggccaucacgaugcuccacacccaguucaacgcccugguggagaacaucgacuucaacaucgacgugaccgggaacaucgagcugaucuga

SEQ ID NO: 1733 - RNA, 3669 nt, Artificial Sequence
  Cas9 variant
augaagaagcgcauccugggccucgacagcgggaccaacucccugggcugggccguggucgaccgggacgagaacaaccaguacagccugaucaaguacggggaccucaucuucgaggagggcgugaagaucgagaaggggguggaguccagcaaggccgcggagcgcaccucccaccgggcccugcgcaagcuguacuuccggcgccggcuccgcaagaucgagguccugaaggugcuggugaaguacaaccucugcccccaggucagcgaggaggagcugcaccuguggcacacgcggaagcucuacccgcagaacaaggaccugcugcaguggcagcgcaccgacgagaaggagggcaagaaccccuacaucuaccgguaccgcugccuccacgaggagcuggacauguccgugagcgccaaccggaugaccgugggccgcgccauguaccaccuggcccagcggcgcggguuccucuccaaccggcuggacaacgaggaggacgagaaccagaucggcgcggucaagugcgggaucagcaaccugaccgaggagauccaguccagcggcugcaaguaccucggggaguacuucuacaagcuguacaacgagcacggcaacacggugcgccugcggacccgcuacaccucccgggaguuccacuacaagaaggaguucuacgccaucugcgagaagcagaagcucgacaagaagcugaucgaggagcuggccagcgcccucuacuuccagcgcccccugaagucccagcgccacaccgugggccggugcacguucgagcccaacaagccgcgcugcgcggacagccaccccgccuacgaggaguuccggaugcuguccuucaucaacaccaucaagguccaggggcccuacgacaccgagcuccgcgugcugaacaccgaggagcgggacagcaucacgaagcuguucugccgcaaguccaagcccaacuucgacuucgaggacaucgccaaggagcucgccggccggaacaacuacugcuacaucggggacguggucgacaaggccuacaaguucaacuaccgcaugagccagggcgugagcggcugcccgaccaccaccuaccugaucaacguguucgggcaggacuggcagacgggcaucgcggaguccuaccaggccaucgacaccaagcuggggcagaaguccgucgacgccaugaucgacgacguguggaacgugcucuacuccuucagcuccaaggacaagcugcgggacuucggccgcaagaagcugcagcucggggacaaggaggccgacaccuucgccaacaucaagcugacccacaaguucgcgagccugucccucaaggccauccggaagaucaacaucuuccugcgcaugggccuggucuacagccacgccgugacgcucgccaacauccccaccaucgugggcaccgacaucuggcagcggaagcgcaacuucauccuggccgagcugcucccccugaucgagaacuucaaccccaaggagaccaagcugcaggagacgcuggacuucugcgucaaggacuuccuccagaacaacuucgagcugaagaacggggcgguggacaagcuguaccacccguccaugaucgaggccuaccccgacgccggccucaacagcaacgggauccugcagcugggcagcccccggaccaacgccauccgcaaccccauggccaugcggagccuccacgagauccgcaaggucaucaaccagcugcugaaggacaagaucaucaaccaggacaccgagauccacguggaguacgcgcgggagcucaacgacgccaacaagcgcaaggccaucuccaucuggcagaagucccaggagaagcugcacaagaaguacguggaggagaucaccaaccuguacaaggaggagacggggaaggccaucgucccgaccgacaccgacauccucaaguucaagcugugggaggagcagaaccacaucugccuguacaccggccagcagaucggcaucgcggaguuccucggggccacgcccaaguacgacaucgagcacaccaucccccagagcgugggcggggacagcaccgacaugaaccugacccugugcgacucccgcuucaaccgggagaucaagaaggcccagcuccccacgcagcugggcaaccacgccgacauccuggugcgcaucgccggguggaagaacagcuacgagaagcucuccaaggacaucgaccggauccgcacccacagcggcauggcgaaggacaucaaggaccggcugauccagaagcgccaccuccugaagcuggagcgggacuacuggcgcggcaaguacgagcgguucaccaugaacgagaucccggagggguucagccgccggcagggcgucgggaucggccugaucuccaaguacgccggccucuaccucaagagccuguuccacgacaagaacgagcgcaacaaggggcacguguucguggucaagggcaccaccacggccgaguuccggaagaugugggggcugcagaacgaguacgagaagaagucccgcaacaaccacgugcaccacugcaucgacgccaucaccaucgccugcaucggcaagcacgaguacgcgcagauggcccaguacuaccacgacgaggccgaguaccuguaccaccacgggaucaagcccaucuuccccaagcccuggaagaccuucaccgaggaccugcucgaccuggagcacagccuguucgugguccaccacuccccgaacaacauggccaagcaggcccggaagcgcaucaucacgagcaccggccagcacugggcgcagggcgacuccgcccacgggagccuccacaacgacaccuacuacggcgccaucgagcgggacggggagaucaaguacguggugcgccgggccgucuccagcuucgagcagauguccgacguggacagcaucguggacgacgucgugaaggagaccgugcgcaaggcgcuggagggcaagaacuucaaggaggccgucaacgcccccaucuacaugaacaaggagaagggggugcugaucaagaaggugcggugcuacgccaaguccaucaagaagcccaucgacauccgcacgcaccgcgacagcuccagcaaggaguacaagcggaaguuccacgucuccaacgacaucaacuaccucaucgccaucuacgagggcaccgugaagggcaaggugaagcgcgacuucgaggucgugaagaacaucgaggcggccaacuucuucaagcggagccaggaccgccgggacuaccccaccaucgugccggagaaguccaucaagcacggguucccccugaagaccacgcugaccaacggcaccauggucauccucuacgaggagaacaaggaggagaucgacuucaccaagaaggaggacaucugccgccggcuguacaagcugguggggaugagcagcaugaucguguccggcugcgaguacgggguccucagccugcgccaccaccaggaggcccggcccuccaaggacaucaagagcaagaacggcgccuucaagaacggcgaggcccugcgcccggcgaucacgaugcuccacacccaguucaacgcccugguggagaacaucgacuucaacaucgacgugaccgggaacaucgagcugaucuga

SEQ ID NO: 1734 - RNA, 3678 nt, Artificial Sequence
  Cas9 variant
augagcaagcgcauccugggcaucgacguggggaccaacucccucggcugggccgucguggaccggaccgacugcgacaacuacacgcuggugaagcgcggggacgucaucuuccaggagggcgugaacaucgagaaggggaacaucgagaagucccgggccagcgagcgcaccggccaccggagcacccgcaagcacuacuuccggcgccggaugcugaagaucaaggugcucgagauccuggucgagcaccagcugugccccuaccucucccacgaggagcugcaccaguggaugacccgcaagguguacccgacgaacgaggacuuccggcuguggcuccgcaccaacgacgcgaacgaccagaaccccuaccacgaccggcacgugugccugcacgagcgccuggaccuccggcugcaggagaaccgcuaccggcugggccgcgcccucuaccaccuggcccagcggcgcggguuccugagcaaccggcucgagcagaacuccaagaccgacgagaccggcgccgucaagagcgacaucucccagcugaacgaggagaugaagaaggccgggagccaguaccugggcgacuacuucuacuggcucuaccaggaguacgggaaccaggugacgcugcgcauccgcuacaccgaccggaagcagcacuaccagaaggaguucgaggcgaucugccagcgccagcagcuguccgacgaccucguggacaagcugcggcgcgccaucuacuuccagcggagccugaagucccagcgcgccggcgucggcaagugcaccuucgagcccgacaagccccggugcgcccucagccacccgcgcuacgaggaguuccggaugcuguccuuccugaacaacgugaaggugaaggggcccagcgacgacucccuccgcccccugagccccuccgagaaggagaagaucaagccgcuguuccuccgcaagagcaaggcgaacuucgacuucgaggacaucgccaaggccaucgccggcaaggggaaguacgccugcauccgggacaaggagggcgcgcagaagcccuaccaguucaacuacgcccugagccagggcgucuccgggugccccgugaccgccaagcugaucgccguguucggcgagagcugggagcggaaccucgucaacgccuaccgcucccggaacgacaugcgcaagagcgacgaggagaucgugaacgagguguggaacguccuguacuccuucagcuccaaggagaagcugcgggcgugggggauggagaagcucggccuggacgaggccugcgccggggaguucgccgacaucacgcugcccaccgccuucgcggcccucagccugaaggccgugaacaagauccugccguuccuccgccagggcuucaucuacucccacgccgugaugcuggccaacauccccuacaucaucggcauggaccgguggaacgagccccgccagcgccaguucaucauggacaaccugcaggagcuccuggacaacuucaccgcgagcgacaaggcccugcagcagacccuggacuucugcaucaaggacuuccuccugaacaacuacgagcuggcccccgggaaggccgaccggcucuaccacccguccaugaucgagacguaccccgacgcgaaggccgacggccaggggaucuaccagcugggcagccccgccaccaacgccauccgcaaccccauggccaugcggucccugcacauccuccgccgggucgugaaccagcugcugaaggagaagaccaucgacagcgagaccgagguccacaucgaguacgcgcgcgagcucaacgacgccaaccggcgcugggccaucaaccaguggcagcggaagcaggagacgcagcgcaaggacuacgccgagaagauccggaagguguacgccgacgaguucgagaaggugaucgagccgacccaggaggagcugcugaaguaccagcucugggaggagcagcagcaccugugccuguacaccggggagcagaucggccucaccgacuucaucggccccaacccccgcuacgacaucgagcacacgaucccccaguccaugggcggggacagcacccggaugaaccugacccugugcgagcgcaccuacaaccggacggucaaggggaaccgcaugccgucccagcucgcggagcacgagagcauccugacccggaucaagcccuggaaggacaaguacgaggagcugaccgugaagaucaacaagcuccgcacccaccccggcauggacaaggccuccaaggacaacaucauccggaagcgccaccuccuggagcucgagcgggacuacugguuccagaaguaccagcgcuucacgaugaccgaggugcccgagggguucagccugcgccagggcaccggcaucgggcugaucggcaaguacgccgggcuguuccucaagagccuguuccaccacgucaaggagcggaaccgcaagcaggucuacgugaucaagggcccgaucaccgccgaguuccggcgccuguggggccugcagaaccuguacgagcagaagucccgggacaaccacgcccaccacugcaucgacgcgaucgugaucgccugcaucaaccccgccgaguacgcccgcauggcgagcuacuaccggcaggaggaggacuuccgccucaacaaggggaacaagcccguguucccgaagcccuggacgaccuucacccaggaccugcaggcccuggaggccgagcuccuggugguccacgagacccggaacaaccugaccaagaaggcccgcaagcgggugcgcacgaagggcgggaacgugcucuccgagagcgacuccgcccggggcagccugcacaacgacaccuacuacggggcgauccagaaggacggcgucauccgcuacguggugcggaaggcccuguccagccucuccgagaaggacgucaaggacaucguggacaagaccgugcgcgagaagguccaggccgccauccaggagaagggcgccaaggaggcgcuggccgggaccaucuacaugaacgaggagaagggcaucacgaucaagaaggugcggugcuucaccaagaucgccagcccccuggccauccgccggcaccgcgacgccuccgcgaaggaguacaagcgccccuacuacgugaccaacgagagcaacuacgucauggggaucuacgagggcugcaucaaggagaagaccaagcgggaguucauccucgugaacaaccuggaggccgugcgccagcugaaggccgcccggaagcagggggucguguccagcauccucccgcccguguccgccaagagccaguucccccugaaguaccgccuguacacgggcacccucguccugcuguacgagaacucccccgaggagaucgacuucaccaaccagguggacaucugcaagcggcucuacaaggugaccggccugagcagcaugacggucaccgggaaccaguacggcaccauccagcugcgcuaccaccaggaggcgcggcaggccaaggaccucaaggcccagaacggggccuacaaggagggcgaggagcaccgcccggcgaucaugaugcugcacacccaguucaaggcccugguggaggggacggacuuccggaugaacauccucggcgagaucgagccccugcgcaaguga

SEQ ID NO: 1735 - RNA, 3690 nt, Artificial Sequence
  Cas9 variant
augggcgaccgcaaguacaaccuggggcucgacaucggcaccagcuccaucggguucgccgccguggacgagaacaaccagcccauccgggucaagggcaagaccgcgaucggggugcgccuguucgaggagggcaagacggccgccgaccggcgcggcuuccggaccacccgccggcgccugagccggcgccgguggcgcaucaaccuccugaacgagaucuucgacgcccaccuggccgagguggacccgaccuuccucgcgcggcugaaggaguccaaccgcagcaaccuggaccccaagaaguccuuccaggggagccuccuguuccccgagcggaaggacuaccaguucuacgaggaguaccccacgaucuaccaccuccgcaaggcccugauggagaaggaccggaaguucgacauccgcgagaucuaccuggccguccaccacaucaucaaguaccggggcaacuuccugaacgggaccccgaugcgcuccuucaagguggagaacaucgagcucaacacccuguucgaccagcugaaccagcucuacgccgagaucgugcccgacaacgagcuggcguucgaccuggcccaggucgccgacgugaaggacgugcucagcuccaccacgaucuacaagauggacaagaagaagcagcuggucaagaugaugcugcuccccgccagcaacaaggcccugcaguccgagaacaagaagaucgugacccaguucgugaacgcgauccugaacuacaaguucaagcucgacguccugcuccagguggagaccgacgccgacuggagccugaagcugaacgacgagggcgccgacgacaagcuggaggaguucaccggggaccucgacgagaaccggcuggagaucaucgaccugcuccagcgccugcacaacugguucucccugaacgagaucacgaaggacggcaacagccucuccgccgccaugguggagaaguacgagaaccaccaccaccaccugggccugcucaagaaggucaucgagaaccaccccgacgcgaagaaggccaaggcccugaaggagaccuacaccgccuacguggggaagaccgacgacaagacgcagaaccaggacgacuucuacaaggccguggagaagaaccuggacgacagcccggacgcgaagggcaucaagcgccucauccagcuggaccaguucaugcccaagcagcggaccgggcagaacggcgccaucccccaccagcugcaccagcaggagcucgaccagaucaucgagaagcaguccaaguacuaccccuuccuggccgagccgaaccccaacgucaagcgccggaaggacgcccccuacaagcuggacgagcugaucgccuucaagauccccuacuacgugggcccgcucgugacccccgaggagcaggcgcagaacaaggagaacgucuucgccuggaugaagcgcaaggccgccgggcccaucacccccuggaacuucgacgagaagguggaccggauggagagcgcgaaccgcuucauccggcgcaugacgaccaaggacaccuaccuguucggcgaggacgugcugccggccgaguccaugaucuaccagaaguucgucgugcucaacgagcugaacaaccugaagaucaacgggcggcaccucagccugaaggacaagcaggacgucuacaacgaccuguucaagcagcagaagaccgugagcaucaaggcccuccagaacuacuacgugacgaagaagaaggccgccaccgcgcccaccgucggcgggcuggccgaccccaagaaguuccuguccagccucuccaccuacaucgacuucaagaacauguucggcgagcgcgugaacgacccccaguuccaggaggaccuggagcagaucguggaguggagcacgaucuucgaggaccggggcaucuucaaggccaagcugcaggcccucggguggcuguccgagaagcagauccagcagcuggucgccaagcgcuacaagggcugggggcggcucagcaagaagcugcugaccggccucaagaacgcggagggguacuccauccuggacgagauguggcgcagcaccgagaacuucaugcagauccagucccggccggaguucgccgcccugauccagcaggccaacgagaagcaguucgagggcaacgaccccgacaacgugugggagaacaucgagaacauccucggcgacgccuacaccagcccccagaacaagaaggcgauccgccagguggucaagguggugcaggacaucgagaaggccgucgggaacccgcccgagaagaucgccaucgaguucacgcgggaggccgcggccaacccccagcgcacccagucccggcugcgcacccuggagaagcucuacgagagcgccgaggaggugguggacgccggccugaccgccgagcuggcggaguucaaggagaacaagcacguccucuccgacaaguacuaccuguacuucacgcagcuggggcgcgacguguacaccggcgacaccaucagccucgacaagcugaacgacuacgacguggaccacauccugccccaguccuucaucaaggacgacagccucgacaaccggguccugaccauccgcgccgugaacaacgggaaguccgacaacgugccggccaagauguucggcaagaagaugggcagcuucuggcggcaccuccuggacaacgggaugaucuccaagcgcaaguacaacaaccugaucaccgaccccgacaacaucagcaaguacgcccagaagggcuucaucaaccggcagcuggucgagacgagccaggugaucaagcucaccgccaacauccugaacgggaucuacgacaaggacaccgagaucaucgaggugcccgcgaagaugaacucccagaugcgcaagauguucgaccuggucaaggugcgggaggugaacgacuaccaccacgccuucgacgccuaccucaccaucuucaucggcaacuaccuguacaagugcuaccccaagcugcgcccguacuucgucuacgacaacuucaagaaguucggcaacaaggaggacaucgggcacaagcgguucaacuuccucggcaagaucgagcgcgagaagaaggugguggcccccgagacgggggagauccuguggagcaacgucgcccccaacgagaccaucaagcagaucaagaagguguacaacuacaaguucaugaucgugucccgggagaucaccacccgccgggcggagcuguucaaccagacggucuaccccaagaacuaccgcggcaagcucaucccgaucaaggaggaccggcccaccgaccuguacgggggcuacagcggcaacaccgacgccuaccuggccaucguggcccucgaggacaagaagaaggggaaguacuucaagguggucggcauccccacccgcgcggccgccaagcuggagaagcugaagcagcaggacucccagcaguaccuccaggcccugcacgaggugaucgcgccccaguucaccaagagcacgaagaaggggaucaagaagaccgaguucgagaucgugcuggacaagguccacuaccggcagcucgugcaggacggcccggugaagaugaugcugggguccagcaccuacaaguacaacgccaagcagcugguccucuccgagaaggcccuguga

SEQ ID NO: 1736 - RNA, 3696 nt, Artificial Sequence
  Cas9 variant
augaucacccgcauccugggccucgacaccgggacgaacagccuggccugggccguggucgaccgggacgcgaacggcaacuacacccuggugaagcgcggggacgugaucuucaccgagggcgucaagaucgagaaggggaucgaguccagcaaggccgccgagcggaccgcccacaaggcccuccgcgugcacuacucccggcgccggcugcacaagaucgacacgcugaaggugcucgucgagcuggaccugugccccuaccucagcaacgagcagcugaaccuguggaaggcgaagaagaccuacccgcucaccgacgacuucaugcuguggcagcgcuccggcagcgccgaggagaacaaccccuacuacugccggcaccgcugccugacccagaagcucgaccugacggaccagucccagcgguuccugcucggccgcgccuucuaccaccuggcccagcggcgcggguuccugagcaaccggcucgacaccuccgcggacagcgacgaguccggcaaggucaagagcgggaucgccgagcuguccguggagauggagaaggccggcugcgaguuccugggggaguacuucuaccagcucuacaagcagcacggcaacaccaucaagcugcgcagccgguacaccgaccgcgaggagcacuacaagaaggaguuccuggccaucugcgagaagcaggagcucgaccccaaguggguggaggcccugcagcgggcgaucuacuuccagcgcccccugaagucccagcggaagggcguggggaagugcacguucgagccgaagaagccccgcugcgccgagagccaccccgacuacgaggccuuccgcaugcucugcuuccugaacaacgugaagauccagacccccaacgacaccucccugcggccgcucaacgaggacgagcgcgagaagaucuggccccuguucuuccgcaagagcaagcccaacuucgacuucgaggacaucgccaaggcccuggcgggcaagaacaacuacgccugguacaaggacgccggggagaagcccuucaaguucaacuaccggaugcagcagggcgucuccggcugcccggugaccgcccagcucaucgacaucuucgggagcgacuggcagacggccaucgcggagaccuacaccgccguggagaagaagaacggcaccaagacgaucgacgagauggccgacgacgucuggaacgugcuguacagcuucuccagcaaggacaagcugaaggccuucgccaccgagaagcuccagcuggacgaggcguccgccaccaaguucgccaacgccaagcugccccacggguucgcgagccucucccugaaggccauccggaacauccugcccuuccuccgccagggcuucaucuacgcccacgccgugcaccuggccaagauccccgacaucgucaccaaggcgguguggaacgacgccgacaagcgggagaugauccugagcgggcucauggagaucaucgagaacuacaacccgaaggaccgcggcguggagggcacgaucgacuucugcaucaagucccaccuccaggacgucaucgaccugcggcccggggccgccgacgcccuguaccaccccagcaugaucgagaccuaccccgacgcgaagcugaacaagaugggcguguuccagcugggguccccgcgcaccaacgccauccggaaccccauggccaugcgcagccugcacauccuccgguccguggucaaccagcugcugcgcgacggcaucaucgaccggaacaccgaggugcacgucgaguacgcccgcgagcucaacgacgccaacaagcggaaggcgaucgccgacuaccagcgcgagcaggagaagaagcggaagcaguaccgcgacgacaucaucgcccuguacaagagcgagugccacaaggagaucgagcccacggacaccgacauccugaaguuccagcucugggaggagcaggaccaccugugccuguacaccgggacccagaucggcaucugcgacuuccucggcgacaaccccaaguucgacaucgagcacacggugccgcgcuccgugggcggggacagcacccagaugaaccugacccugugcgacgccaccuucaaccggcaggucaagggggcgcagcuccccucccagcugagcaaccacgccgacauccuggugcgcaucgaccacuggaaguccaagugcgaggaccuccggaagcagcuggacaagauccgcacguacggcgggauggagaaggccaugaaggaccggcugauccagaagcgccaccggcucaagauggaccuggacuacuggcagggcaaguacagccgcuucaccaugaccgaggugcccgagggcuucucccggcgccagggggccggcaucgggcuggucagcaaguacgccggccucuuccucaagagccuguuccacaacgagcagaaccccaacaaguccaacguguacguggucaagggcgugaccaccgcggaguuccggcgcaugugggggcugcagggcgaguacgagaagaagucccggcugaaccacugccaccacugcaucgacgccaucacgaucgccugcaucgggaaggccgaguacgacaagauggcccaguacuaccacgacgaggagcuguuccaguggcgcggcaccaccaccaagccgcacuucaacaagcccuggcccacguucaccgaggacgugcucgcgaucgagcagagccugcuggucaagcaccucaccaaggacaacaugccgaagcaggccaagaagcgggugcgcaccgccacggggaaguaccuggcccagggcgacaccgcccggggcagccugcacaaggacaccuacuacggggcgaucgagcaggacggcgagauccgcuacgugcuccggaagccccugaacaaguucgagaacgaggccgagcuggagaagaucgucgaccaggccgugaaggagaagaucaaggaggccaucgcggggaagaacuucaagaccgccaucacggagcccaucuucaugaacaaggagaagggcauccgcaucaacaaggugcgguacuacgucaaggcccaggagcgccucaagauccgccagcagcgggaccuguccagcaaggaguacaagcaguucuucugcguggagaacgaguccaacuaccugcucgccaucuacgagggggagcugaagggcaagaaggagcgcgacuucugcguggucaacaaccuggagagcgccgcgugccucaagcgguccaacaagggcaaggccgcgccccuggugccggagcgcagcgaggagcggaaccugccccuccuggccgugcugaagcgcgggacccagguccucuucuacgagaacucccccgaggagauccuguucgacaacccccaggaccuggugcggcgccucuacaaggugaccggcaucaacaccaagaaggacgucaagaacgggaagacguaccuguacggcaacaucgagcugcgguuccaccagaacgcccagaagaaggacgacgugaagaugcagagcgggguguacaagaacaacgagguccuccgccagggcaucgugcugucccacaagcaguucaaggcccugguggagggcgucgacuucgaguucaacgugcucggggagaucaagaagaaggagcggcacgccuga

SEQ ID NO: 1737 - RNA, 3699 nt, Artificial Sequence
  Cas9 variant
augaccaagacccggauccugggccucgacacggggaccaacagccugggcugggccaucguggaccgggacgaggucuccgggcaguacgagcugguggaccgcggcgaccucaucuucaccgagggggugaagaucgagaagggcaucgagagcuccaaggccagcgagcggacccagcaccgcgcgcugcggaagcaguacuuccgccggcgccugcggaagaucgagguccuccgcgugcugacguucuaccaccugugcccgcccguguccgaggaggagcuccaccuguggcacgucaagaagaucuaccccguggagaaccacgaguucaugaucuggcagcggaccaacgacaacgagggcaagaaccccuacuacuaccgccacaucugccugcacaccaagcucaaccugacccugaugaaggaccgguacauccucgggcgcgcccuguaccaccugagccagcggcgcggcuuccucuccaaccggcuggaccagagccaggacgaggacgacaaggggacggugaagaccggcaucuccagccuguccaaggacaugaacgacgccgggugcaccuaccucggcgacuacuucuacaagcuguacagcgagaacggcaaccgcguccggauccgcaaccacuacaccgcccggaacgagcacuaccuggccgaguucgaggcgaucugccaggugcagaagcucgagcccgagcugguggaggcccugcgccgcgccaucuucuuccagcggccgcucaagucccagcgcaagggggucggcaagugcacguucgagccccggaagccccgcugcgccgacagccaccccgacuacgaggaguuccggaagcugugcuucaucaacaacaucaagauccagaccuccgacgacgacaccaugcgcccgcugaacaaggaggagcggcagcgcaucaacagccucuucuaccggguguccaaggcgaacuucuacuucgaggagaucgccaagcugcucgggggccgcaacaacuacugcuacuucaaggacgaggugcagaaggacuucaaguucaacuaccggaugagccaguccgucagcggcugccccaccacggcccagcugcgcaacaucuucggggaggacuggaagaccggcaucgccgagaccuaccagcacagcgccaagaaggacgggucccugaagaccguggacgagauggcggacgacaucuggaacgugcuguacagcuucuccagcaaggacugccucuacaacuucgccgucaacaagcugcagcuggaggaggacaaggccaagaaguucuccaagaucaagcucagccacggcuucgccuccaucagccugaacgccauccacaagauccugcccuuccuccggauggggaugaucuacucccacgcggugcuguucgccaacauccccacgaucgugggcauggacgucuggaacgacgagagcaagcgccagcacaucaugaccgagcuguccgaccucguguucaacuacgacccgaagaaccgggagguggagggcaccaucgagaugugcaucaaggacuuccugcugaacaacuacgaccuccccgccggggccgucugccgccuguaccaccccagcaugaucgacaccuaccccgacgccaaggcgaacaaguacggcgugcugcagcugggguccccggccacgaacgccauccggaaccccauggccaugcgcagccuccacgagcugcggcacgucgugaaccugcuccugcgcaagggcaagaucgaccagaacaccgaggugcacgucgaguacgcccgcgagcugaacgacgcgaacaagcggaaggccaucgccgaccgccagcgggagcucgacaagcugcacaagaaguaccacgacgacaucaucacccuguacaaggaggagaccgggaaggacaucaaccccacgcaggccgacauccucaaguuccagcugugggaggagcaggagcacgugugccuguacaccggccgccagaucggcaucuccaaguuccucgggcccgacccggaguucgacaucgagcacaccgugccccggagcgucggcggggacuccacccagaugaacaugacgcugugcgaccgccgguucaaccgcgacgugaagaaggcgaugcugcccagccagcuccccaacuaccaggagauccugccgcggaucgagaaguggaagaagaaguacgagaagcugaccaaggacaucgaccacugcaucacccacuccggcaugaccaaggaggccaaggacagcaucauccagaagcgccaccggcucacgcuggagcacgacuacuggcgcaacaaguacagccgguucaccaugaccgaggugcccgagggguucucccgccggcagggcgccggcaucgggcuggucagcaaguacgccggccucuuccugaagucccuguuccacgaccccaccgaccgccggcgcagccacguguacguggucaaggggaccacgaccgccgaguuccggaagauguggggccuccaguccgaguacgagaagaagucccgcgacaaccacgugcaccacugcguggacgcgaucaccaucgccugcaucggcaagaacgaguacaacaagauggccagcuucuaccacgacgaggaggccuucgagcgcggggagugcgagaagccccacuucgacaagccguggcccaccuucacgcaggacguccugggccuggagaagcggcucaucguggugcacagcacccaggacaacaugcccaagcacgccaagaaguacguccgcaccccgcgggggaaguucaucgcgaagggcgacugcgcccgcgggucccugcaccuggacaccuacuacggcgccaucaagcacaaggacgacacggagccccgguacgugcuccgccgggagcugagcuccuucgacagcgugaacgaccuggacaucaucgucgacgacgccgugcgcgagaagaucaaggaggccgugaagggcaaguccgggaaggcguucaaggaggcccucgccaacgucuacaugaacaaggagaaggacauccggaucaagaaggugcgcugcuacgugcccagcgucaagcggcccaucgacauccgccaccagcgggacaugucccgcuucgacuacaagcggcaguuccacguggccaacgacggcaacuacaugauggcgaucuacgaggggguggucaagggcaagcugaagcgcgacuucgagcuggugaagaacaucgaggccgccagcuacuucaaggugucccaggacaacgagagcuucagcuccaucgucccggagaaguccagcaacggguucccccucaaggccgugcugaagaucggcacccacgugcugcucuacgagaacaccgccagcgagaucgacuucuccgaccccgucgaccugacccggcgccuguacaagguggugggccucagcuccgcgaucaucaacaacugcagcuacggguucaucacgcugcgguuccaccaggaggcccgccaggccaagaaccugaagcucaccaagggcgucuucaagaacguggacaacuaccgcggggccaucauccuguaccacacccagcugaaggcccucguggagggcuacgacuucgacaucaacauccugggggagaucaccuccaagcaguga

SEQ ID NO: 1738 - RNA, 3705 nt, Artificial Sequence
  Cas9 variant
augcccaacuucuggagcaucuucaccgagaaccugcagaccuaccucaugaagacgcgcauccugggccuggacaccgggaccaacucccucggcugggccguggucgaccgggacgagaacaaccaguacaccccgaucugccgcggggaccugaucuucacggagggcgugaagcaggagaaggggaucgaguucagccuggccgcggagcggaccuccuaccgcgccagccggcgccacuacuuccggcgccggcuccgcaagguggagguccugaaggugcuggugaagcacaagcucugcccgccccuguccgacgaggcccugaaccgguggcacaccaagaaggaguacccccucgacgaggacuucauccuguggcagcgcaccaacgaggccgacaacaagaaccccuaccacgaccggcacaucugccugcaccgcaagcucaaccugaaggacagccagacggaccgguacacccugggccgcgcccucuaccaccugacccagcggcgcggcuuccuguccaaccggcucgaccagaacgaggaggcggaggagaccgggaaggucaagagcgccaucuccgagcugagcaaggagaugaaggaggccggcugcgaguuccugggggacuacuucuaccuccuguaccgcacggagggcaaccgggugcgcauccgcucccgguacaccgaccgcgagaagcacuaccugcaggaguucaaggagaucugccgggugcaggagcucgacgaggaccuggccaaggcgcuggagaagaccaucuucuuccagcgcccccucaagagccagcggcagggggucggcaagugcaccauggagaagggccacucccgcugcgccgugagccacccccuguacgaggaguaccggcugcucugcuaccugaacaacauccgcaucaagacgcccuccgacgaccggcugcgcccgcucaacgccgaggagcgggagaagaucacgccccuguucuacaaggagaagaacuucgacuucgagaagaucgccaagaagcuggccgggaagacccccuucggcuggauccgcgacgcggaggacuggcccuaccaguucaacuaccggaugacccaggaggccccggccugccccaccaccgcccagcucaucaagguguucggggaggacuggaaggccgcgcuggccgagaccuacaccaugagcgccaagcaggacggcacgcugaagaccgaggacgagaucugcaccgacaucuggaacguccucuacuccuucagcuccaaggagaagcugaaggaguucggccugaagaagcuccagcuggacgaggugcaggccaaggccuucagcgagauccgccugacccgggacuucgcgagccucucccugaaggccauccgcaagauccuguucuuccugcggacgggggaggacuacagcaaggccaucuuccucgccaacauccccaccaucgugggcgaggagaucuggaacgacaucgagcgccggucccgccugcuguacaaggucgaccucgcccugcgcccccaggaggagcgggacgcggaggagcaccgcaccaucgccgagcggaucaaggccgccguggcggccgaggugccggacgcccccaucgaccugcucuaccaccccagcaugaucgaggccuaccccgacgccaagcgcaacgagcgguucgacugcuaccagcugggguccccgaagaccaacgcgguccgcaaccccauggccaugcggagccugcacauggugcgcaaggugaucaaccaccuccugcggaagcacaucaucgacgagaagacggagauccacaucgaguacgcccgcgagcugaacgacgccaacaagcggcaggccaucgcggacuggcagcgcgagcucuccaagcggcacaccgccuacgcccagaacauccgccagcuguacaaggccgagaccggccuggucaucgagcccaccaaggccgacauccucaaguaccagcugugggaggagcagcagcacgugugccuguacacggggaagaagaucggcaucgcggacuuccucggcgccaaccccaaguucgacaucgagcacaccaucccgcggagccgcgggggcgacuccacccaggagaaccugacccugugcgagagcaaguucaaccgggacaucaagcgcgacaagcuccccaccgagcuggccaacuacgaggagauccuggcccggaucgagcacuggaagaagcagugcuacgcgcucaagcugaagcgcgacgggauccggacgcacuccggccuggagaaguccaucaaggacagccgcauccgccggcgccaccucguggggcuggaguacggcuaccugaagggcaaguacgaccgguucaccaugaaggagguccccgagggguucagccgccggcagggcgccgggaucggccucaucuccaaguacgccgggcuguuccucaagagccuguucaaggaccccaagaacccgaaccgcuccaacguguacgucgugaagggcgccaucaccgccgaguuccggaagcuguggggccugcagcaggcggacgaggccaagagccgcgagaaccacacccaccacugcaucgacgccuacacgaucgccugcaucgggcccugcgaguacgccgcgcucgccgccuacuaccgguccgacgaggaguucaaguacggccgccggcgcgagaagccccaguucgagaagccguggcccaccuucaccgaggaccugcugaagcuccaggaggagcugcugaucgugcaccagaccacggacaagcucgggaagcgggaccgccggaaggucaagacgccccgcggcaaguuccugaccggcggggacagcgcccggggccgccugcaccaggagaccuacuacggggccaucaacuacgacggcaacaucaaguacguggugcggaagccccucgacagccugaccgagaaggaccuggacaagaucgucgacgagaccgugauggggaucgugaagggcgcggucgaggccaagggcucccucaaggaggcccuggccgacgggaucuacaugaacaaggagaagggcauccugaucaagcgcgugcgcaucuucagcgacguguccgagccgaucaaccucaagcagcugcgggacgucagcaccaaggaguacaagcgccacauccaccuccggaaggacgagaacuaccuguucgcgaucuacgaggggaucgacaagaagaagaacaagaagcagaccgagacggccaccguggacuaccuggacgccgccaaguucuacaaggacuccaagcgccgggacaaggccaacagccuggugggcgacuacuccaagaagaacaagcucccccugaagugcauccugaagaagcgccagaugguccucuucuacgagcacagccccgaggagauccgguucaaggacaagaaggaccugucccgccggcuguacaucgugaccagcaucgcgaaggacgggcgcgugaaguuccuccaccaccaggccgccaccgccacgggcauccaguccagccccuccccguucaccaacgacggcgagcaccagcccuacuaccggcugagcgccuccaacaucaagguccugguggcggggaucgacuucgacaucaacauccucggcgagaucacccccaagcuguga

SEQ ID NO: 1739 - RNA, 3711 nt, Artificial Sequence
  Cas9 variant
auguacuucuacaagaacaaggagaacaagcugaacaagaaggugguccucggccuggaccuggggaucgccagcgugggcuggugccucaccgacaucucccagaaggaggacaacaaguuccccaucauccugcacggggugcgccuguucgagaccgucgacgacagcgacgacaagcuccugaacgagacgcggcgcaagaagcggggccagcgccggcgcaaccggcgccuguucacccggaagcgcgacuucaucaaguaccucaucgacaacaacaucaucgagcuggaguucgacaagaacccgaagauccuggugcggaacuucaucgagaaguacaucaaccccuucuccaagaaccucgagcugaaguacaagagcgugaccaaccugcccaucggguuccacaaccuccgcaaggccgcgaucaacgagaaguacaagcuggacaaguccgagcugaucguccuccuguacuucuaccugagccuccggggcgccuucuucgacaaccccgaggacaccaaguccaaggagaugaacaagaacgagaucgagaucuucgacaagaacgagagcaucaagaacgccgaguucccgaucgacaagaucaucgaguucuacaagaucuccggcaagauccgcagcacgaucaaccugaaguucgggcaccaggacuaccugaaggagaucaagcaggucuucgagaagcagaacaucgacuucaugaacuacgagaaguucgccauggaggagaaguccuucuucagccggauccgcaacuacuccgagggccccgggaacgagaaguccuucagcaaguacggccucuacgccaacgagaacgggaaccccgagcugaucaucaacgagaagggccagaagaucuacaccaagaucuucaagacccugugggagagcaagaucggcaagugcuccuacgacaagaagcucuaccgggcgcccaagaacagcuucuccgccaagguguucgacaucaccaacaagcugacggacuggaagcacaagaacgaguacaucagcgagcgccugaagcggaagauccuccugagccgcuuccugaacaaggacuccaagagcgccguggagaagauccucaaggaggagaacaucaaguucgagaaccuguccgagaucgccuacaacaaggacgacaacaagaucaaccugccgaucaucaacgcguaccacagccucaccaccaucuucaagaagcaccugaucaacuucgagaacuaccugaucuccaacgagaacgaccucagcaagcugauguccuucuacaagcagcagagcgagaagcuguucgugcccaacgagaagggguccuacgagaucaaccagaacaacaacgugcuccacaucuucgacgccaucagcaacauccugaacaaguucuccaccauccaggaccggauccgcauccuggagggcuacuucgaguucagcaaccucaagaaggacgucaaguccagcgagaucuacuccgagaucgccaagcugcgcgaguucagcgggacguccagccuguccuucggcgccuacuacaaguucauccccaaccucaucagcgagggcagcaagaacuacuccaccaucagcuacgaggagaaggcccugcagaaccagaagaacaacuucucccacagcaaccuguucgagaagaccuggguggaggaccugaucgcgucccccaccgugaagcggagccuccgccagacgaugaaccugcugaaggagaucuucaaguacuccgagaagaacaaccucgagaucgagaagaucgucguggaggugacccggagcuccaacaacaagcacgagcgcaagaagaucgaggggaucaacaaguaccggaaggagaaguacgaggagcugaagaaggucuacgaccugccgaacgagaacaccacccuccugaagaagcuguggcuccugcgccagcagcagggcuacgacgccuacagccugcggaagaucgaggccaacgacgugaucaacaagcccuggaacuacgacaucgaccacaucgugccccgcuccaucagcuucgacgacuccuucagcaaccucgucaucgugaacaagcuggacaacgccaagaaguccaacgaccugagcgccaagcaguucaucgagaagaucuacgggaucgagaagcucaaggaggcgaaggagaacuggggcaacugguaccugcggaacgccaacgggaaggccuucaacgacaagggcaaguucaucaagcuguacacgaucgacaaccucgacgaguucgacaacuccgacuucaucaaccgcaaccugagcgacaccagcuacaucaccaacgcccuggugaaccaccucaccuucuccaacagcaaguacaaguacuccgucgugagcgucaacggcaagcagacguccaaccugcggaaccagaucgccuucguggggaucaagaacaacaaggagaccgagcgcgaguggaagcggcccgagggcuucaagagcaucaacuccaacgacuuccugauccgcgaggaggggaagaacgacgugaaggacgacguccucaucaaggaccggagcuucaacggccaccacgcggaggacgccuacuucaucaccaucaucucccaguacuuccgcagcuucaagcggaucgagcgccugaacgugaacuaccggaaggagacccgcgagcuggacgaccucgagaagaacaacaucaaguucaaggagaaggccuccuucgacaacuuccugcugaucaacgcccucgacgagcugaacgagaagcugaaccagaugcgcuucagccggauggugaucacgaagaagaacacccagcuguucaacgagacccucuacuccgggaaguacgacaagggcaagaacaccaucaagaaggucgagaagcugaaccuccuggacaaccgcacggacaagaucaagaagaucgaggaguucuucgacgaggacaagcugaaggagaacgagcucaccaagcugcacaucuucaaccacgacaagaaccuguacgagacccucaagaucaucuggaacgaggugaagaucgagaucaagaacaagaaccugaacgagaagaacuacuucaaguacuucgugaacaagaagcugcaggagggcaagaucagcuucaacgagugggucccgauccucgacaacgacuucaagaucauccggaagauccgcuacaucaaguucuccagcgaggagaaggagaccgacgagaucaucuucucccagagcaacuuccugaagaucgaccagcggcagaacuucuccuuccacaacacgcuguacugggugcagaucuggguguacaagaaccagaaggaccaguacugcuucaucagcaucgacgcccgcaacagcaaguucgagaaggacgagaucaagaucaacuacgagaagcucaagacccagaaggagaagcugcagaucaucaacgaggagcccauccugaagaucaacaagggggaccucuucgagaacgaggagaaggagcuguucuacaucgucggccgggacgagaagccccagaagcuggagaucaaguacauccucgggaagaagaucaaggaccagaagcagauccagaagcccgugaagaaguacuucccgaacuggaagaaggugaaccugaccuacaugggcgagaucuucaagaaguga

SEQ ID NO: 1740 - RNA, 3717 nt, Artificial Sequence
  Cas9 variant
augaccaaggugcugggccucgaccugggggccgccagcgucggcugggcgaugaucgaggaggaggagaagucccacaagauccuggggcucggcagccgcaucauccccuacgaggggaccgagggcaacgacuucgccaagggcacgggggagucccggaacgcccugcgcaccaaggcccggaccgcccgcaagggcuacgaccgguaccagcugcgccggaaguaccucguggacacccuggugaagaacgagaugaugccggacgaguaccugcgcaagcuccccaagaugcagcugugggagcugcggagcaaggcggucacgaccgagaucaccaagcaggagcucgggcgccuguuccuguggcucaaccagaagcggggcuacaaguccagccgcuccgacgccaaccuggacaagaaggacaccgaguacgugguggaggucaagagccggcacgagaagaucaaggaguccggguucacgaucggccaguacuucuacagcgagcugaaguccaacgaguacuuccgcgugaaggagaacaucuucccccgggaggccuacaucgaggaguucgacgccaucugcaagcagcagaagcgccaccucaccgacaagcugaucagccggauccgcaacgagaucaucuacuaccagcggccccugaagucccagaagggccucgugagcgucugccgcuucgagggguucuucaagaagggcaucaacgggaaggaguacuucgugggcccgaagguggcgcccaaguccagcccccuguuccagaccgucaagaucugggagaacaucaacuccauccggcugagcgaccgcaacggcaaggagaucaugcucucccuggagcagaagaagugcaucuucaaccaccuggacaacaacgagaagcucacccccaaggaccuguucaucaucaucggggugaagaaggagaacugcuucgugaacaagcagcuggagaagggcauccaggggaacgucaccaagagcacgauccucaagugcuucggcgagaacaacgacuacgacaaguggcugaagcuggaccucaacaucaucgugaagaaggacaccuucggguaccuguacgacaagaagaccggcgagaucaucggcgagaagcugaucaagcacguggacagcgccgucgagcgcgagccgcucuaccagcuguggcacacgaucuacuccaucaacaacaccgacgagugcagcgccgcccugcagaacaaguucggguucgacuccgagaccgccgacaagcucagcaacaucgacuucggcaaggcgggguucggcaacaaguccgccaaggugauccggaagauccugcccuaccugauggagggggacgacuacagccaguccaugagcuacgccggcuucaaccacuccgacagccucaccaaggacgagaaccugaagcgcaagcugcucgacaagcugcggcccaucgagaagaacucccugcgccagcccaucguggagaagauccucaaccagauggucaacguggugaacgccaucaucgacaaguacggcaagccggacgagauccggaucgagcuggcccgcgagcugaagcagaacaaggaggagcggaacaagacggacaaggacaugagcaagcgccagcgggagaacggggagaucuccaagcgccuggcggaguacggccuccgggccacccgcaacaacaucaucaaguggcggcuguacgaggagaucgacaaccaggacaagaagcugaacgccaucugcgucuacugcgggcagcccaucagccucaccgaggccaucaagggcaacgagguggacgucgagcacaucauccccaaguccaagcuguucgacgacagccaguccaacaagacccuggcccaccgccggugcaacagcacgaagggggacaugaccgcguacgacuucauggagaacaagcccgcccagguguucaacgccuacaucgagcgcgugaacaugcucuacgacaacaagaucauccggaaggucaagcgcgacaagcugcugaugccggaguccaagauccccgacaacuucaucgaccggcagcuccgcgagagccaguacaucgccagcaaggcccgcgagauccugcagaccaucugcuacaacgugugguccaccagcggcacggugaccgcgcggcugcgccaccucuggggcugggacgacgccaccaugucccugcagcugcccaaguaccgggagcucgggcugaccgagauggucgagugggagagcgagcacggcaagcagaagcacuccaaggaggugaucagcgacugguccaagcgcgacgaccaccggcaccacgccguggacgcccugacgaucgcgugcaccaagcagggguucauccagcgcuucaacacccucaacagcuccaagaccaaggaggacauggaguucgagaucgccaagugcagcaucgaguaccgggagaaccuguccaagcuggagaaguacaucaucgcccuccgccccaucccggucagcgagguggaggacgccguggccaacauccugaucuccuucaagagcggcaagaaggucgcggugaagggcaagcggaagaucgggaagcgcggcaacaagaagaucauccagacggacaucaucaucccccacgggucccugagcgaggaguccguguacggcaagaucaagaccaucgagcgggagaagccccucaaguaccuguuccagaacagccagcugaucuucaacaacaagaucaagauccucgucgaggagcgccuggccaccuucgagaacgacaccaagaaggcccuggccagccucaagaaggugcccguguaccuggacgaggagaagaccaucguccuggaguacgccacgugcuucaaggaggaguacgugaagaaguacgacguggacaccaacuucuccaagaccgacaaggucaucgacgacaagaucaaggagauccuccagcaccggcuggggaaguucggcggcaaggcgaaggagaaggaggccuucaaggacgugcagcagggggacaagaccaucaagugguacgaggacgagggccuggagcgcccgauccacagcgugcggugcuucacggggcucuccgccaucguccccgugaagaaggacgagaacggcaucgacaucggguucgugaagcccggcaacaaccaccacaucgccaucuacagcgacaaggacggcaaccgcuacgagcacaucugcaccuucuggcacgccgucgagcggaagaaguacgacauccccguggugaucaaggacuccaacgagaucuggaacaagaucuggagcaagccggagggguccuacccccagagcuuccuggacaagcugccccaggagaaccucacccuggaccuguccaugcagcagaacgagaugcucauccugggcaugagcuacgaggacaucaagaccgcgaucgacaacuccgacuacaagcagcugagcuccaaccucuaccgccugcagaagcuggccaacgccaacuacauguuccggcaccaccucgagacgcagaucaucgacgacaacaacagcaaggccucccgccgguucaucaacauccacagccugaaggcgcuguucgccuggaacccguacaaggucaacaucaacugccucggggacauccagaccaacucccgcuga

SEQ ID NO: 1741 - RNA, 3720 nt, Artificial Sequence
  Cas9 variant
augaccgagaagcgcaaguucgacauccgggagguguaccuggccauccaccacaucgucaaguaccgcggcaacuuccucaacagcgccaccguggacuccuucaagacgagcaacaucgacuucaccucccaguucgaccggcugaacgagcuguaccgccaggugauccucgaggagcccuuccagaucaacaugaaccaggucgacaagaugaccaacaagcugcuggacaacgacgcgcucaagcuggacacccagaagcaggucgccaagcugcucccggugaucuacaacgacaagcccguggacaagcaguacacgcggcuggccaccgaguucagcaaggccauccugggguacaagaccaagcucgacgugauccugaaccuggacacccagaacgccaaggacugggcgauccgccucgacgacgaggacaucgacgacaagcugcccgcccugguggagaaccucgacgagucccggcaggagaucgucacgaucauccgcgaccuguacgcccagaucacccugaacgccaucgugcccaagggcaagagccucuccgagagcaugguggacaaguacaacgaccacaaggaccaccuggaccugcucauggggcugauccacgagcugggcgacgacuccgcgaaggggaucaagcuccgggaggccuacacccaguacgucggcaagagcggcgacaagacccugaaccaggacgacuucuacgccgccaucaagaagaaccuggacgaggacuccaagcgcagcccgaagauccagcggcucaucgagcaggccuccuucaugcccaagcagcgcacgagcgcgaacggggugaucccccaccagcugcaccagcuggagcucgaccggaucaucgagaaccagggccgcuacuaccccuuccugaaggagccgaacuccaacacccacaagcccaacgggggcaaguacaagcuggacgagcucguggccuuccggauccccuacuacgucgggccccugaucaccaagcaggaccaggagaagaccagcggcgccgacuucgccuggaugauccgcaagccgggccagggcggggagaucacgcccuggaacuucgaccaggagguggaccggauggccuccgcgaacaccuucauccgccggaugaccaccaaggacagcuaccugguggccgaggacguccuccccgacuccagccugaucuacgagaaguucaaggugcugaacgagcucaacaugcugaaggugaacgaccgccggcugagcaucucccagaagcaggaccucuucaacaaccuguucaagaagcagaagacgauccgcaccaagaagcugcagaccuacauccgcaccaagugggagcuccccagcgucaugaucuccgggcugagcgacccggacaaguucaacuccagccuggccacguacaucgacuuccgggacguguucggcgagaagguggacgaccccaaccgccaggccgacuacgagaagaucaucgagugguccaccgucuucgaggaccggaagaucuaccaggccaagcugaaccagcucgacuggcugaccgagagccaguccaaggcgcugcucaccaagcacuacacgggcugggggcgccugagcaagaagcugcucaccggccugaaggaccagaacggggacuccauccuggaccagcucuggaagaccaacgacaacuucaugcagauccagagccgggacgaguucgccaagcagauccacgacgagaacgccaagcaguuccacgaggccaacaacguggacgacauccuggacgacgccuucaccagcccccagaacaagaaggcgauccgccaggucgacaagguggugcaggacgucgugaaggccgugggcuacgcccccgacaagaucgccaucgaguucacgcgguccccgcaggaccgcccccagcggaccuucucccgccagcggcagcugcagagcaccuaccucaacgucgcgaaggcccugaugaaguccaaccugaaccaggagcucaagagcgugaucgacucccagcagacccugacggacaagcuguaccucuacuucacccagcuggggcaggacauguacaccggcaaggagaucaacuucgacgagcuggugaacuaccagaucgaccacauccucccccaggccuucaucaaggacgacagccuggacaaccgcguccuggugagcgcccccaucaacaacgccaaguccgacaacgugccggucaagaaguucggcgcgaagaugggguacuucuggaagcagcucgccgagaaccaccugaucagcaagcggaagcugaacaaccucaccaccgaccccgacaagaucggcaaguucacggcccagggguucauccaccgccagcugguggagaccucccaggugauccggcuggucgccaacauccucggcaacgaguacgggcacgacggcaccaccaucaucgaggugacggccaagaugaaccaccagaugcgcaaggacuucgaccugaucaagauccgggacgugaacgacuaccaccacgcgauggacgccuaccugaccgccuacgucggcgacuaccucuaccugcgcuaccccaagcugcggagcuacuucguguacggggacuucaagaagcucaaggaccagucccugaagauccgcaacuucaacuuccugcacgaccucaccaacgacgaggccggcgacaagaucguggaccaggagaccggggagaucaucugggacaagcacgagagcgucaagcagcugaagaagguguaccacuacaaguucaugcuggugucccaggaggucuacacgcgccaggacgcccucuucaaccagaccaucuaccccgcgagcgacgccgacaagcggaagcugaucccgaucaagaacaacaagcccguggacguguacggcggguacuccggcaacgucgacgccuacauggccaucgugcgcauccacggcaagaaggaggacaaguacaagguggucggggugcccaugcgggcgguggccgaccugaagaaggccgagagcaagggccgcgacaacuaccucaacgccguccacgaggugcugaagccgcaguucaccaagaagaagaaggaccggaagaccggggagaucacggagaugauggacgacuucgacgugcugcucggcaaggucuacuaccgccagcugaucguggacggcaacaagaaguucaugcugggguccagcaccuaccaguacaacgccaagcagcucgugcuguccgacaaggcgaugcagguccugagcaaggacgacaagcucaagaaccaggacgagaaccagaaccugaucgacguguacgacgagauccuggagaagguggaccaguacuucgagcucuacgacaucaacaaguuccggcagaagcugcacgacggccgcaagaaguucaucgagcugcccgucgacaacgacuucaacgggaagaagcucaucuccuacggcaagcgggccaccaucaucagcauccugaacgggcugcacgccaacgccaccauguccaaccucaaguaccugggcaucagcagccccuucggcaugcuccaggugcccaacgggaucauccuguccccggccagccgcaucugcuaccagucccccacgggccuguucgagcggaaggugaagcugagcgaccucuga

SEQ ID NO: 1742 - RNA, 3738 nt, Artificial Sequence
  Cas9 variant
augaucaucuacuucaucuucgagaagaucgugaacaccauccuggucaugaagaagaucgugggccucgaccuggggaccaacagcaucggcugggcccugaucaacgccuacaucgacgaguacaacaaggagcaccucuacgggaucgaggcgugcggcucccgcaucauccccauggacgccgccauccuggggaacuucgacaagggcaacagcaucucccagacggccgaccggaccagcuaccgcggcauccggcgccugcgggagcgccaccuccugcggcgcgagcggcugcaccgcauccucgaccugcugggguuccucccgaagcacuacuccgacagccugaaccgguacggcaaguuccugaacgacaucgagugcaagcuccccugggugaaggacgagaccggguccuacaaguucaucuuccaggagagcuucaaggagaugcuggccgacuucaccgagcaccaccccaagcugaucgcgaacaacaagaagguccccuacgacuggacgaucuacuaccuccgcaagaaggcccugacccagaagaucuccaaggaggagcuggccuggauccuccugaacuucaaccagaagcggggcuacuaccagcugcgcggggaggaggaggagaccccgaacaagcucguggaguacuacagccugaagguggagaaggucgaggacuccggcgagcggaagggcaaggacaccugguacaacgugcaccuggagaacgggaugaucuaccgccggacgagcaacaucccccucgacugggagggcaagaccaaggaguucaucgugaccaccgaccuggaggccgacgggucccccaagaaggacaaggagggcaacaucaagcgcagcuuccgggcgcccaaggacgacgacuggacgcugaucaagaagaagaccgaggccgacaucgacaagaucaagaugaccgucggcgccuacaucuacgacacccuccugcagaagccggaccagaagauccgcgggaagcuggugcggacgaucgagcgcaaguacuacaagaacgagcucuaccagauccugaagacccaguccgaguuccacgaggagcugcgcgacaagcagcucuacaucgccugccugaacgagcuguaccccaacaacgagccccggcgcaacagcaucuccacccgggacuucugccaccucuucaucgaggacaucaucuucuaccagcgcccccucaagagcaagaagucccugaucgacaacugcccguacgaggagaaccgguacaucgacaaggagagcggcgagaucaagcacgccagcaucaagugcaucgcgaagucccacccccuguaccaggaguuccgccuguggcaguucaucgugaaccugcggaucuaccgcaaggagaccgacgucgacgugacgcaggagcuccugcccaccgaggccgacuacgugacccuguucgaguggcucaacgagaagaaggagaucgaccagaaggccuucuucaaguacccgcccuucggguucaagaagaccacgagcaacuaccgguggaacuacgucgaggacaagcccuaccccugcaacgagacccacgcccagaucaucacccgccugggcaaggcccacauccccaaggcguuccuguccaaggagaaggaggagacccuguggcacauccucuacagcaucgaggacaagcaggagaucgagaaggcccugcacuccuucgccaacaagaacaaccugagcgaggaguucaucgagcaguucaagaacuucccgcccuucaagaaggaguacggguccuacagcgccaaggccaucaagaagcuccugccccugaugcggaugggcaaguacugguccaucgagaacaucgacaacggcacgcgcauccggaucaacaagaucaucgacggggaguacgacgagaacauccgcgagcgggugcgccagaaggcgaucaaccucaccgacaucacccacuuccgggcccugccccuguggcucgccugcuaccugguguacgaccgccacagcgaggucaaggacaucgugaaguggaagaccccgaaggacaucgaccuguaccucaaguccuucaagcagcacagccugcggaaccccaucguggagcaggucaucacggagacccugcgcaccgugcgcgacaucuggcagcaggucggccacaucgacgagauccacaucgagcucgggcgggagaugaagaaccccgccgacaagcgcgcccggaugucccagcagaugaucaagaacgagaacaccaaccugcgcaucaaggcgcugcucacggaguuccugaaccccgaguucggcaucgagaacgugcggccguacagccccucccagcaggaccugcuccgcaucuacgaggagggggugcugaacagcauccuggagcuccccgaggacaucggcaucauccugggcaaguucaaccagaccgacacccugaagcggccgacccgcuccgagauccuccgguacaagcuguggcuggagcagaaguaccgcagccccuacaccggggagaugaucccccucuccaagcuguucacgcccgccuacgagaucgagcacaucaucccgcagagccgguacuucgacgacagccuguccaacaaggucaucugcgagagcgagaucaacaagcucaaggaccgcucccugggcuacgaguucaucaagaaccaccacggggagaagguggagcuggccuucgacaagcccguggagguccucagcguggaggccuacgagaagcuggugcacgaguccuacagccacaaccgguccaagaugaagaagcugcucauggaggacauccccgaccaguucaucgagcgccagcugaacgacagccgguacaucuccaaggucgucaagagccugcucuccaacaucgugcgcgaggagaacgagcaggaggcgaucagcaagaacgugauccccugcaccggcgggaucaccgaccggcugaagaaggacuggggcaucaacgacguguggaacaagaucgugcugccgcgcuucauccggcucaacgagcugaccgaguccacgcgcuucaccagcaucaacaccaacaacaccaugauccccuccaugccccuggagcuccagaagggcuucaacaagaagcggaucgaccaccgccaccacgccauggacgccaucaucaucgccugcgccaaccgcaacaucgucaacuaccugaacaacgugagcgcguccaagaacacgaagaucacccggcgcgaccugcagacccuccugugccacaaggacaagaccgacaacaacgggaacuacaagugggugaucgacaagcccugggagacguucacccaggacacccugaccgcccuccagaagaucacggucagcuucaagcagaaccugcgggugaucaacaagaccaccaaccacuaccagcacuacgagaacggcaagaagaucgugagcaaccaguccaagggggacagcugggccauccgcaaguccaugcacaaggagaccguccacggcgaggugaaccugcggaugaucaagacggugagccucaacgaggcccugaagaagccgcaggccaucgucgagauggaccugaagaagaagauccucgcgaugcuggagcugggcuacgacaccaagcgcaucaagaacuacuucgaggagaacaaggacaccuggcaguga

SEQ ID NO: 1743 - RNA, 3741 nt, Artificial Sequence
  Cas9 variant
augcgccugguguaccucgcccuggcccacaugaucaaguuccggggccacuuccuguacgagggggaccucaaggcggagaacaccgacguccaggcccuguucaaggacuucguggaggaguacgacaagaccaucgaggagagccaccuguccgagaucacgguggacgcccucagcauccugaccgagaaggucuccaagagcucccgccuggagaaccucaucgcccacuaccccaccgagaagaagaacacccuguucggcaaccugaucgcccucagccuggggcugcaggcgaacuucaagacgaacuuccagcucuccgaggacgccaagcugcaguucagcaaggacaccuacgaggaggaccuggagggccuccugggggaggugggcgacgaguacgccgaccuguucguguccgccaagaaccucuacgacgcgauccugcugagcggcauccucaccgucgacgacaacuccaccaaggccccgcugagcgccuccauggugaagcgguacaaggagcacaaggaggagcuggccgccuucaagcgcuucaucaaggagaagcuccccaagaaguacgaggagaucuucaaggacgacacgaagaacggguacgcgggcuacgugggggccgacaagaagcugcggaagcgcagcggcaagcuggccaccgaggaggaguucuacaaguacgucaaggggauccucaacaagguggagggcgccgacuacuuccuggacaagaucgaccgggaggacuuccugcgcaagcagcggaccuucgacaacggcuccaucccccaccagauccaccuccaggagaugcacgccauccugcgccggcagggggagcacuaccccuuccugaaggagaaccaggacaagaucgagaagauccucaccuuccgcaucccguacuacgugggcccccuggcgcggaaggggagccgcuucgccugggccgaguacaaggccgacgagaagaucacgcccuggaacuucgacgacauccuggacaaggagaaguccgccgagaaguucaucacccggaugacccucaacgaccuguaccugcccgaggagaagguccucccgaagcacagcccccuguacgagaccuucacgguguacaacgagcugaccaaggugaaguacgucaacgagcagggcgaggcgaaguucuucgacaccaacaugaagcaggagaucuucgaccacguguucaaggagaaccgcaaggugaccaaggacaagcuccugaacuaccugaacaaggaguucgaggaguuccggaucgucaaccucacgggccuggacaaggagaacaaggccuucaacgccucccuggggaccuaccacgaccugcgcaagauccucgacaagagcuuccuggacgacaaggugaacgagaagaucaucgaggacaucauccagacccugacccucuucgaggaccgggagaugauccgccagcggcugcagaaguacagcgacaucuucacgacccagcagcugaaggagcucgagcgccgccacuacaccggcugggggcggcuguccuacaagcugaucaacggcauccgcaacaaggagaacaagaagaccauccucgacuaccugaucgacgacggguacgccaaccggaacuucaugcagcugaucaacgacgacgcccucagcuucaaggaggagaucgcgcgcgcccagaucaucggcgacguggacgacaucgccaacgucgugcacgaccugcccggcucccccgccaucaagaaggggauccugcagagcgugaagaucgucgacgagcucgugaaggucaugggccacaacccgacgaacaucaucaucgagauggcgcgggagaaccagaccaccgacaaggggcgccggaacucccagcagcgccugaagcugcuccaggacagccugaagaaccuggacaaccccgugaacaucaagaacguggagaaccagcagcuccagaacgaccggcuguuccuguacuacauccagaacggcaaggacauguacaccggggagacgcucgacaucaacaaccugucccaguacgacaucgaccacaucaucccccaggccuucaucaaggacaacagccuggacaaccgcguccucacccgguccgacaagaaccgcggcaagagcgacgacgugcccuccaucgaggugguccacgagaugaaguccuucuggagcaagcugcugagcgugaagcucaucacccagcggaaguucgacaaccugaccaaggccgagcgcggcgggcugacggagaacgacaaggccggcuucaucaagcggcagcucguggagacccgccagaucaccaagcacgucgcccaggugcuggacgcgcgguucaacgccaagcacgacgagaacaagaaggugauccgcgacgucaagaucaucacccugaaguccaaccucgugagccaguuccggaaggacuucaaguucuacaaggugcgcgagaucaacgacuaccaccacgcccacgacgccuaccugaacgccgucaucgggaccgcgcugcucaagaaguacccgaagcuggccuccgaguucguguacggcgaguucaagaaguacgacgugcgcaaguucaucgccaagagcgacaaggagaucgggaaggccacggccaaguacuucuucuacuccaaccugaugaacuucuucaagaaggaggucaaguucgcggacggcaccgugguggagcggcccgacaucgagaccagcgaggacggcgagaucgccuggaacaagcagaccgacuucaagaucguccgcaaggugcucagcuacccccaggugaacaucgucaagaagacggaggugcagacccacgggcuggaccggggcaagccccgcgggcuguucaacgccaacccgucccccaagcccaagcccgacagcuccgagaaccucgugggcaucaagcggaaccuggacccgaagaaguacggcggguacgccggcaucagcaacuccuacgcgguccuggugaaggccaucaucgagaagggggugaagaagaaggagaccaugguccucgaguuccagggcaucagcauccuggaccgcaucaccuucgagaaggacaagcgggccuuccugcucgggaagggcuacaaggacaucaagaagaucaucgagcugcccaaguacucccuguucgagcucaaggacggcagccgccggaugcuggccuccauccugagcacgaacaacaagcgcggggagauccacaagggcaacgagcuguucgugccccagaaguucaccacccuccuguaccacgccaagcggaucaacaaccccaucaacaaggaccacaucgaguacgugaagaagcaccgcgacgacuucaaggagcuccugaacuacguccuggaguucaacgagaaguacgugggggcgaccaagaacggcgagcggcucaaggaggccguggccgacuucgacuccaagagcaacgaggagaucugcacguccuuccugggggccgucaacagcaagaacgccggccuguucgagcucaccucccugggcagcgcguccgacuucgaguuccugggggugaagaucccgcgcuaccgggacuacacccccagcagccuccugaaggacuccauccugauccaccagagcaucaccggccucuacgagacgcgcaucgaccuguccaagcugggggaggacuga

SEQ ID NO: 1744 - RNA, 3747 nt, Artificial Sequence
  Cas9 variant
augaagaagauccugggccucgaccuggggagcgccuccaucggcugggccgugaucaccgagaacgucgagaacgggaucaccaagugcgacauccugggcauggggagccgcaucauccccuacgagggcacggagggcaaggacuucaccaaggggaccggcgagucccggaacagccuccgcaccaaggcgaagacggcccggaagggguacgaccgcuaccagcugcggcgcaaguaccugguggacacccucaucaagaaccagauguacccggacgaggccacccggaaccugcccaagaugaagcugugggagcuccgcgacaaggccgugcacucccccgucagccugauggagcugggccggcuccugcuguggcucaaccagaagcgcggguacaaguccagccgguccgacgccaaccugggcaagaaggacaccgaguacguggcgacggucaagagccgccacgagaagaugaaggagcuggacgugaccaucggccaguacuucuaccgggagcucuccgccaacgaguucuucaaggugaaggagaacaucuucccccgcgaggccuacaucgaggaguucgacgccaucugcaagacccagcagaucgcgcacccgaugauccugcggagcgagcugaucgacaagauccgcaacgaggugaucuacuaccagcggccccucaagucccagaaggggcuggucagcgugugcgaguucgagggcuucuggcgcaucgggaaggacggcaaggaguacuucgugggccccaaggucgcccccaaguccagcccgcuguuccagcucgccaagaugugggagaacaucaacaacaucaagaucgggucccggaccggcgaggaccugaagcugacgaccgagcagaagugggccaucuuccagcaccucgacaacaacgagaagcugacccccaccgaccugcucaagauccugaaccugaagaaggagaacugcuacgugaacaagcagauggggaagggccucaacgggaacaucacgaagcacgccauccugcagugccugggcggcagcgacaaguacgagaaccuccugaagcuggagcucaagaugguggacggggacaaggagggcuaccuguacgaccgcaagaccggggagguccugaacuccaagaugaucaaguucaucgaccccaugguggagcaggagcccuucuaccagcucuggcacaucaucuacagcauccacgaccaggaggagugcagccgggugcugcaggcgaaguucgacaucgagcagccgaucgccgacaagcuggccgccaucgacuucuccaagcacgccuucggcagcaaguccgcgaaggucauccgcaagauccuccccuaccugauggacggggacggcuacagcgaggccauguccuacgccggcuacgaccacagcaacucccagaccaaggaggagaaccugcagcgcaagcuccuggaccugcugaagcccauccccaagaacagccuccggcagccgaucguggagaagauccugaaccagauggugaacgucgugaacgccaucaucgagaaguacgggaaccccgacgagauccgcguggagcuggcccgggagcucaagcaguccaaggaggagcgcaacgacgcggacaaggccaugagcaagcggcagcgcgagaacgacgccaucaccaagcggcuggaggaguucggccugcgcgccacgcggaacaacaucaucaaguggcgccucuacgaggagaucgacaaccaggagaagaagcugaacgccaugugcgucuacugcgggcagcccaucucccugaccgaggcgcuccggggcaacgacguggacaucgagcacaucauccccaagagcaagcuguucgacgacucccagagcaacaagacccuggcccaccgccacugcaacaagaacaagaacgaccucaccgccuacgacuucaugaaggggaagccggaggccgucuucaacgaguacguggagcgggugaaccugcuguacgacaaccacaucauccgcaaggcgaagcgggacaagcuccugaugacggaguccaagauccccgacaacuucaucgaccgccagcugcgggagagccaguacaucgccaagaaggcccgcgagauccuccagaccaucugccacgacgucugguccaccagcggcaccgugacggccgagcugcggcaccuguggggcugggacgacgugaccaugaaccuccagauggccaaguaccgcgagcuggggcugacccaccaggucgagugggaguccgagcacggcaagaacaagcacgagaaggaggugaucaccgacuggacgaagcgcgacgaccaccggcaccacgcgguggacgcccucaccaucgccugcaccaagcagggguucauccagcgcuucaacacccugagcgccgccaagacgcgggaggacaugauguucgacaucgagcagcgcagccacgaguucaaggagaagcggucccugcucgagaaguacaucaucagcgagcagccccugaaggucgacgagguggagaaggcgguguccaacauccugaucagcuucaaguccggcaagaaggucgccguguggggcacccgcaagaucgggaagcggggcagcaagaaggugauccagaagaagaucaucgucccccgcgggucccucagcgaggaguccguguacggcaagaucaagaagcaggaggagaaggacuacaaguaccuguucgagaacccgcagcugaucuucaaccccaccaucaaggccaagguggaggagcggcuccugauguucgacggggacgucaagaaggccaucaccagccugaagaagauccccaucuaccucgacaacaacaagaccguggugcuggagaaggccaucugccugaaggacgaguucgucaucaaguacuccguggacaucaacuucaacaagguggacaaggucguggaccccaagaucaaggagauccuccagaaccgccugaagaaguucggcggcaaggagaaggaggcguucaaggacgugcagcuggaggacaagaugaucaucaagugguacgaggacgaggggcucgagcggccgaucaagagcguccgcugcuucacgggccuguccgccguggugcccgucaagaaggacgagaacgggaacgacaucggcuucgugaagcccgggaacaaccaccacaucgccaucuacaccgacaccgaggagaacaagcagcagcacgugugcaccuucuggcacgccgucgagcggaagaaguacgacaucccggugaucaucaagaacacgaacgaggugugggacaagauccagagccagcccgacggcaccuaccccgacuccuuccuggagaugcugcccccgcccaaccucaaccugcucgucaacaugcagcagaacgagauguucauccugggcaccaccacggaggacaucaagcuggcgaucgacaagcgcgacuacaagaucaucggggacaagcucuaccggcugcagaagaugagcaucaagcccuccagcggccagaucgacaucguguuccgccaccaccuggagacccagcucaucgacgacgagaacagcaagaaguccaagcgguucuacaacgugcagagccugggggcccuguucgcccucaaccccuucaagguccgcaucgacaaccugggcaaccuggugaaggagaaguga

SEQ ID NO: 1745 - RNA, 3762 nt, Artificial Sequence
  Cas9 variant
augaaggcccgcggcaacuuccugcaccaggacacccccgggcucaccgccgcgaacgccaacaugggcgacgccguggagaagcugugcgucgcccuggaggacuggugcacgcuccggaaccuggagugcaacauccgcaagaaccagaagaacauccagaaccugcucgaggggaagaccguggaggugagcgccgagaacgcgcugaaggaguccuucgacagcucccgggccagccgcaaggacaaggccaccauccuguccaccuggaucgccauccagccgggcgaguaccucgacgcgaagcaggccaaggacgccagcaaggagaucgccaacguccuguucgggcugcagggcaacaugaagaagaucuucaucgaguucgaggaggaccagaagauccggcucgacaacgacgagcaggucgaggccuucuacucccugugccccgacgacggcguggcgcuguucgagagcuuccaguccaucuacagcgccuacauccucauggggauccugaagaacgccaacggcggguccaucagcuccugcaagguggccgccuacgaccaguacaaggaggaccugaagcuccugaaggaccuggugcgcgaguucgcgagcgagaaguacgacgaguucuuccggggcgacaucuucgacuccagcaagggguuccgcgcccggaacuacaaccccgccacggccaagggcuacaccaaguacaacuccgugcgcggcgccagcuacgacgacuucaagaaggaggucgagaagaucuucaaggggaccguggcggaggaggacauccgguacguggacaugaugcagcgcuucgccgagggcaccuuccuccggcgccugaagacguccgacaacgggagcauccccuaccagcugcaccucgaggagauggacgccaucgucgagaaccagaagcaguucuacccguuccuggagagcgagaaggagaagcuggagucccucgugaccuuccggaucagcuacuacgugggcccccugacccagaagaacgcccgccuggacaaccacaacaacgcccgguucgcguggucccagcgcaaggagggcaaggagcacgcccgggucuaccccuggaacugggaggaggugaucgaccgcaagcagagcgccgccaaguucauggagcggcucaccgggacgugcaccuacauccuggacgagcccgugcugccgcgcugcucccuccuguacgaggaguacugccugcucaacgagcugaacggcagcaaguggcgcgacaugggcggggacuggcaccgguucgacuacgagacccgcauggagaucaucgagaaccuguucaagaagaagaagggguccgucaaguacgcggccguggaggacuggcucaagugcgagaagcacaagagcugcgccgaggugaagggcggccagggggagaccggcuucgaguccaagcugagcuccuacgucuucuucaaggaggugcugcacguggacgagaucgacgaggccgacauccccaugaucgaggagcucaucugguggaacacgcuguucgaggaccggagcauccugaaggaguccaucgaggacaaguacggggaccgccucaccgacgaccagaucaaggccaucugcaagaagcgguucaccggcugggggcgccugagcaaggagcugcucugcggcaucaagacccacacggacaacggccccuacuccaucauggacguccugcgggaggggaaccccaacaacaacgcgcgcagcgagaccaugguguucauggagauccugcgggacgacaaguucggcuucgacaagcugaucgaggaggagaacaugcgccgggucuccgagguggacaacuucgacgugaacgaccucccggggagccccgccguccgccggaccgugaaccaggccaagcgcaucguggacgagaucgucggcaucgccgggugcgagccccagaacaucuucaucgaggugacccgggacgaggacggccgcaacaagggccggcgcacgaagcggcgcuacgacaacaucaagaacgccaucgcggcccugaagaaggagcagaaggaguacuucaacaaggacguguccgacagccugaacaagaccaaccccagcgaccucgacaacgagcgccuggcccuguacuucaugcagaacgggaagugcauguacugcggcaaggaccucgacaucaagcagcuggacaaguaccaggucgaccacauccugccgcaguccuacgugaaggacgacagcuucgagaacaaggcccucgugcacauggaggacaaccagcggaaguccgccagcaugcugcuggacgacuccaucauccgcaagaugaagcccuacugggaggcgcuccgggccgccgggcugaucggcgagaagaaguucaagaaccugacccgcguccgggugagcgacaaggagcucggcggguucaucgcccgccagaugguggagaccucccagagcaugaagcugacgucccugguccucgagaagaccuaccccaacaccaacgugcggcccgugaaggcgggcuucagcuccgaccugcgcaagcggcuggaccucaucaagugccgcgagaucaacgacuaccaccacgcccacgacgccuaccuggccugcgagaucgggcaguucaucaccaugcggcacaacaagcuguacgagaacccgaucagcuacucccacgccgucaaggacuucaucgcgaagcgcgccaaguacgccaacgaccacggcacgcccaugagcaccuacgggaugcccggcuccagcuccuucgugaucagcagcuuccucaccuccggcuucgacgaggagaccggggagaucuucaaggacgccuggagcgccgagguggcggccguccggauccgcgagucccugaaccggaaggacugcuacaucagccgcaugcccgaggagacguccggcgccuucuggaaggagacccugaucagcccgcgggaccccucccucgggaagaaccugagccugcccaucaagaagggccucgacccccgcaaguacgggggcuacaacgagcagaaguucgccuacuucuucguguacgaggccgugaagaucaagaagaagggcgaggucaaggaguacguguucgcggccgugccgguccagguggccgccaucguggcgcgggaccccaacgcccugaccggguucgccaagaaggacgccgaggcccgcaagaucaaguuccugcggaucauccgcgagaaggucuacaaguaccagcucaucgaggugaacggcgagcgccuguacaucaccgggcugaaguccgugcggaacgcgcgccagaucgcccucagccaggacaugaccacggucuuccugaaggccaucaacgacaaggacguggccgaggacgagcugaagucccucuucgaggagaucgugcagcgguaccgccugugcgccaaccggcugggcaaccagcucaagaucuucagccuguccgacagcuucaacuccgcgaacagcgaguccaagaagcgcgcccuggucagccucguggccaucaucgacgccaagaccaacaagaucgaccuguccgggaucggcagcggcaaggccguggggaacaugcggcugagcuucuccaaggagaugagcaacuccaagaaccacuucgcguucaucgaccagagcgucaccggcauguucgagcgcaagaccuaccucuga

SEQ ID NO: 1746 - RNA, 3777 nt, Artificial Sequence
  Cas9 variant
augaccgaggagaaccccgacauccgcaagguguuccuggccauccaccacauccucaagaaccggggccacuuccugcugcaggggcagagcuucaaggagggcaaccucaacaaccugaucaaggagcugcucaaccuggacauccugcacaucuccaucgagaucaccgaggagaacaucaacaagaucacggagaucgcccucgagaagaagacccugaccgacaaggucaacgaccugaagaagaucuacccgaaggagaagcagcuccuggaggcguuccgccugaucuucgggggcaagaccagccucgacaagcuguucgccaucgacgaguacaaggagcuggacgccuccgucaagagcguguccuucaaggagaagaucuacgaggaggugcggcacgacuacgagcagguccucagcaacuacaucgagcugcuggaccucgccaagcugguguacgacuccaucauccugagcgacaucaagaaggaggggaagacgcucuccgagagcaagguggagcuguaccacaagcaccgcgaggaccugaccaagcucaagacccuggugaagaacgacuccaagcugagcgaggacaagaagguggagcucuacuccgccaucuucaaggaggacaaggacaagggcaccaacuacgucaacuacauccgcaagagcgaggagggcaaggggugcaacuacgaggacuucaagaaguuccuggugaaggagcuggcgaagcucgaggaguccagcgccaaggaggagauccugcgggaccuggagcucgagcuguuccugccccuccagcggacgaaggacaacuccgugguccccuaccagauccacaaggaggagcuggugaagauccuggacaacgccgccaaguaccacaaguuccucaacgagaaggacgacagcggcuacuccaucaucgagaaggugauccagcugcuggaguuccgcauccccuacuacgucgggccgcucaacagcagcaagaaggcgaagguggacggcuucgccugguccgugcggaacaagggguacgagaacacccccgucacccccuggaacuacgagaaggugaucgacgagagcgccuccgccgagaaguucaucaccaaccugacgaacaagugcaccuaccugaagggcgaggacgugcuccccaagagcucccugcuguacagcgaguucgcccugcucaacgagcugaacgcgcugaaguacgacggcaaccgcaucucccucgaggcccggaacgucaucaucgagaagcuguucaaggagcaggggaagaaggugaccaagaccagcaucaagaaccugcucaaggccgagggcuacaucgacgggaagggcgagaucacgggcaucgacaucaccgugaagaacgaccugaaguccuaccgcgacuucaagaagauccugggggacaaguucaacaccgagcacgucgagaacaucauccucuggaucacccuguacggcgagagccggaagcugaucaaggccaagaucgaggccguguacggggacaucuacuccaaggaggagaucgcgaagaugagccgccucgucuacaaggacuggggccgguucucccgcaagcugcugacggagcucgugagcaagaagcuguacaacgaggagaccggggagugccugaacaucaucggcgccaugcggcagaacaacauccucuucauggagcugcuggccgaccgcuucgacuacucccagcagaucaucgacuacaacaaggagcuccagaaggaggugaccgagaucaccccggagauccuggacgaccuguacgucagccccuccgugaagcggagcaucuggcagacggugcgcaucgucgaggagcucaagaagaucaucggcugcgcccccgccaagaucuucguggagaccacccgguccaaccaggacaagaagaagcccaccgacagccgcaagaagcagcuggagcuguucuacaaggcggugaagaaggacgucaaggaccucgagaaggagaucgggagccugaacuucgacaagcugaacgagcgccucuccagcguggagccguccaagcugaaggccaagaagcuguaccucuacuacacgcagcugggccggugcauguacagcggggagaccaucgacaucacccagcugaacaccacggccuacgacaucgaccacaucuacccccaguccaaggugaaggacgacagcuucaccaacaccguccucgugaagcgcgaguacaacgccgccaagaccgaccgguacccccugggcuccgacauccagacgcccagcaaccgccgguucuggaaguuccugaaggagaaggggcucaucaccgacgagaaguacaaccgccuggugcggaccgaggaguucuccgacgaggagcugaccggcuucaucgcgcgccagcucgucgagaccagccaguccgugaaggccguggccggcauccugggggagcugaacccgaagacgagcaucugcuacuccaaggccgagaacgucagcuccuuccggcagaacuucggcaagaucaaggaggggaaccgcaagagcgacaacaccgagcagcucaucaaggugcgggagaucaacgacuaccaccacgcgaaggacgccuaccugaacguggucgugggcaacguguacgacaccaaguucacccgcaacgucuucaacuucaucaaggacaagaaggacgggcggaaguacucccugaacaacguguucuacgagaacgugagcaacagcaacaacgucgccugggagcucaacaagacggugcaccagguggagaaggucaugaacaacaacaacauccuggugacccgccggaccuccgagcagaagggcggccuguucgacgccaccguguacaaggccaaggucgcggccaaggccaaggaggggguguacuacccccucaagacgagcgaccccguggucaacgacgugaccaaguacggcggguucaccaaggugaagaucgccuacuacuccaucuucgaguacacccuggucaacaagaagggcgaggagaagaucacgcgcaucauccccaucccgaucuacgugagccagaacaucaaggacgacuccacccugcucgaguucggcaagacccagaucaacaucaagagcggggaggaggugaaggacuucaagcugaaguaccggaagcugugcaucggcgaccucgucaagaucaacaacuucuucaacuucaucgggggcaagaccaacgacuccuucguguacgacggggccgugcaggucacgcuggacaccgagagcgagcgcuacaucaagacccuguccaaguaccagaacuggaagaaggagaacaaggacggcgagcucugggagagcaucaccaaggagaagaacacggagcuguacaaccugcucguggagaagaugaacuccggcaucuucaucaagaagaagcccaacaaguucaacgagcugaacagcgaggagauccggaacaacuucuccagcaucucccuggaggagcaggcgaaggugcuccuggagguccugaaccuccugaccaacaagaaguccaucuucgaccucaagagcaucaacaucaccgccgcccgcgggaagaucagcuucaaccuguccaaccugagccaguucagcaucaucgagcaguccguggccggcuucuacgagaaggagaucaccaucaucggggacaaggagaacgacauggagaacaacaacugcuga

SEQ ID NO: 1747 - RNA, 3780 nt, Artificial Sequence
  Cas9 variant
augaaguacauccugggccucgaccuggggguggccagcaucggcugggccgucaccgagaucaacgagaagggggagcccgugggccugaucgacgcgaacuccgugaucuucaagccgcucgacaacgacaaggggaagcuguacaacgucgagcgccgggacaagcgcggcagccggcgcauccugcggcgcaagaagcaccggguggagcgcaccaagaugcuccuggugaacuccagcuuccugacgaacgaggagaucgacaaccucuacgucggcaagcuggacaacaucuacgaggugcggcugaaggggcucaaggagcagcuguccaagaacgagaucgcccgccugaugaucuacuacugcaagaaccggggcuucaagagcaaccgcaagaccgaggaccucgagauccugaagucccugggggagaagaucagcgagaaggacuccgacgagaagaagcucaagcccaucaucgccaagaacaccgagcugaucgagagcaagggccugacccccaucgaggugaucuacaugauccgggagaacgacaacuccauccucggguucaagaacaaggagggcaacuacaaguucggcuucaagcgcaaccaggucaucgacgaggugcggaagauccuggggacgcagcagauccugagcaaggagaucguggacgaguacaucgacauccucuccagccagcgcgacuucuccgacggccccgggggcgacagcaaguacaagaucgacuacaccaagcuggccggcaagugcaaguacaccggggagguccgggccgugaaguccgcgccgagcuacgagaucuucaccaugcugcagaagcucaacgacauccgcuacgugaaguucacguccgaggacaagaucgagaagaagaagcugagcaaggaggucauccacaagcuguacgaccucgugguggagaagaacaagacccugaccuacgaccugaucgagaaguccaucgacgaggagaacaucaagcuccugaacauccccaagcugagcaagagcaaguacgucgagcuccggaaguccuacuucaaggagcgcaacgacaacgagaaccugaccgaggaggagaucaacgccuucaacgagaagcugaacaacgagcggaugaagcaggagcucauccgcaacaaccugaaggccuacaaggagcucaagagcaaguucaagaagaacaacaucgacgagaaccgcaucaaggagcugggcgggaucuacuuccuggaccugguggccgagcuccugacguacuccaagaccgacgagaagcuggaguacuucguggagaacgucgagcgguacagccucuucaaggagcagcgcgacaucguggagaucaucaagaccuuccccaacuacaccaagaacggcaaccugucccugagccuggugcgggagcucaacaagcugcugauggaggggcacgacuacgaguccagccucuccagccugaacuacuacaucgacacggacgucgacugggagaaguuccccaccaucuccgagaucgaggacagccuguccaccaagaucaccaacccgaacgugaagcacauccucgucauccugcgcaagcuguacaacacgcuccuguucaaguacggccggcccgagaaggugcaccuggagcucagccgcgacuucuccaacgacuucagcacccggaacaagauccagaaggagcagcuggagaacaaggugcgccgggaggucgcggccuucgagauguacggcgccaacaaggacaucguggccgggaaggaccgccuguccaacgacgacuucgugcggaucaagcucugggaggagcagaacaaggucugcauguacagcggccgcaccaucgagaaguaccagcugaccagcgccgaggugcagaucgaccacauccugcccuacuccaagagcuucgacaacuccuacagcaacaaggugcucgucuucuccaacgagaaccaggacaagaaggagcggacgcccuaccaguggcugaaggggaccgagaaguggaacgaguucaagcagcgcgugcggcugaaccucaacaucagcaacaagaagaaggagaaccugcuguucgaggacgagguggucaacaacgaguuccucgagcgcgagcugcacgcgaccuccuacagcucccggcuggcccucaacaucuuccagcgccugaucccggugagcgacgaggacaaguacgacgagcacggcaacgagaaggugaaguaccuguacaaccggaacgucaucgccuuccaggggaagaugaccuccaugcuccgcaaccuguacagccugaacaaguacacgcacuccuucgagagcgacacccucgacaucgacaacaaggccuucauccugaaggaguucgagaucaacaaggacaaccugaagaugaccgccuacaacgugaacaccggccucgagaucacguccgagaccaagguggagaagaacaagagcggcgaguucaagaccaucaaggacgagcugcugaagaaggagcucgacaagaaggagaaccugaucgagaucuccgacuacuucaaggacaagguccuguucgaccucaagaucguggacuucgaggagaucgacaccguggagcccgagaucaucagcauccuguacaagaugaucacggcgcugaaggaggaggucuacagcaagaaccgcgagaaccaccuccaccacucccuggacgccuuccugcucaccaucaugaaccggagcaugcagaugaagcugaucaaguacaaccagcugaucuccgugcucaagaacaaggagaucgagaucuucaacgaggagaagggggaguacaucgacagcaaggaguucgccgaggagcugcagaagcagaagaucaucgacaucgacggcaacgagcgcgggaucaaguucaacgugaacggcaagacccaccggcugaaccucgucaagcccuacgagaacuuccuggacgacaucaagaacaagaucuucgacaagcgcgagaacaacaagcugcccuaccacguggugaaguccaaggucagcggggcccuccacgccgagaccauccugggcgaguccaagggcgagaucaccaagcggaucagcguguucgacaucaacuacaagaaccuggggaagaucuucgacaaggacggcucccagaaggagaucuacgagacgcucgugaaguggcuggaggccaagagcaaggacuacccgaagcugaagaacgggaacaucaucaagaaggucaagaucguggacggcaacaaggacaagcucaucaagcugggcaacaagcgcuacguggagauggggcggaccaccgucaagauccuggugcucaagaaggaggcggaggagggccugaaguucgccuccaucgggcgcuacaaguacaaccugcucaagagcgagaaggacgugaacaucuccaucuggaaggacgccauccacuucugcaagguccgguacaacaagcugaaggagaacggcuaccgccugauccacgagcucauccccggggagaccaucgagcuggagcugaacaagggcaacaucagcaagugccucguggugggcuucuccgggggcaagaucgagaucagcuccgucaucggggacgcccuggaccugaucaacgacaagaucagcacgcggaucaaggagcgcuacuacaucaccguguccaccaucaagagcaucaagaagaucaacaagaacauccucggcgacuga

SEQ ID NO: 1748 - RNA, 3792 nt, Artificial Sequence
  Cas9 variant
augcacaagaacaaccccgacauccgcgagcuguuccucgccauccaccacauccugaaguaccggggccacuuccuguucgccgggcagcaguucaagggcagcgagaucaaggacaacauccgcgagcuccugcaguacaacucccugaacaucaagaucgacaucaccgacgagcucaucaacaacaucgcggagauccugcugaagaagaagaacagcaccgacaagaucaucgaguucaagaagcuguucgccgacgagaagcagcugaucgaggcccugcggcucgcccuggggaacaagacgcagcuggccaagcuguucgacaucgaggcguacaaggagcuggacaucuccaucaagaccaucagcuucaaggagaagaucuacgaggacgugcgcuccaacuacgaggagauccugggcgaguacaucaucguccucgacaccgccaagcugaucuacgacgccaucauccugagcgagaucaagaucaagaacaugaccaucuccgagagcaaggugaucuccuacgagaagcacgggaaggaccucaagcagcugaagcagcugaucaaggaggacagcaagcucuccaagaaggagaagcggcagcuguucgagaacaucuucgugaaggaggacgagaaggaggccaacuacgucaacuacaucggcaagaacaacgugggcagcuccaagagcuccugcagcuacgaggacuucaagaagucccugaucaaggagcucaaguacugcgaggagagcaagcugaagcaggacauccuggcggagcucgagcuggagacguuccugccgcgccagcggaccaaggacaacuccgugauccccuaccagauccacaaggaggagcucgagaagauccugaacaacgccguccaguaccaccccuuccugaacaacaccgacgaguacgggaucagcaucaaggagaagaucauccagcuccuggaguuccgcauccccuacuacgugggcagccugaacaccucccacaagguggggaacggcggguucagcugguccguccggaacaagggcuacgagcgcacggccgugaccccguggaacuucaacaaggugaucaacaaggaggagagcgccaagaacuucaucgagaaccucaccaaccagugcaccuaccugcuguacgaggacguccuccccaagcacucccugcuguacagcgaguucacgcuccugaacgagcugaacuccaucaacuacggcgggaagcggcucaccguggagcaccgcaaccugaucaucgagcgguucuucaagcagagcgcccccaaggcgaccggcaaggagcugaagaaguuccugauguccgagggggugaucgacggcaaggacgagcucagcggcuucgacaucuccaucaagaacgaccucaagagcuaccgcgacuucaagaagauccugggggagaaguucgacuccgagaaggucgagaagaugauccgguggaucacccucuucggcgagagcaagcagcugcugguggacaagaucacgaaggaguacggggacaucuacuccagcgaggagaucaagaagaucuccggccucaccuacaaggacugggggcgccugagcgagaagcugcucaccgagaucguguccagccagcuguacgacgagagcaccggcgagugcuucaacaucaucaacgccaugcggaacaacacgcuccucuucaucgagcugcugggcaccaacuacgacuacuucgagaagaucaacaccuacaacgggaagcuccgcaaggagaucaccgagaucacgccccacauccuggacgaccuguacgucuccccggccgugaagcggagcaucuggcaggucgugcgcaucguggaggagcucaagaaggugaucggcuccgagcccaagcggaucuucgucgagaccacccgcagcaacaaggagaagaagggggacgacggccgcaaggacucccggaagaaggcccugcuggagcucuacaagaagaucaagaccagcgacaucgccgagcuggagaaggcgcuggggcacacgguggacuucgacaagaagaagcaggaccucaccgacaucgacaacaacaagcugaaggcccgcaagcuguaccucuacuacacccagcugggccggugccuguacaccggcaaggccaucgaccucaacaaccuguucggguccaacagcgaguacgacaucgaccacaucuacccccaguccaagacgaaggacggcagcuggaacaaccugguccucgugaacaagaccgagaacuccaagaaguccaacgggcugaucagcgagagcauccagcgcaagaacaagcacuucuggcgguuccugaaggccaagaaccucaucuccgaggagaaguacaagcgccugacccggaccgaggacuucacggacggcgagcugagcggguucaucgcccgccagcucaucgagaccucccagagcgugaaggucgugagcaagauccugcagaaccugaaccccaccaccgagcucugcuucuccaaggcggagaacgugagcgacuuccggcaggaguucggcaagaucaaggucggcaagcgcaagaaccugaccgaggaggagcagaagaaggccaaggaggggcagcugaucaaggugcgggaccucaacgaccugcaccacgccaaggacgccuaccugaacaucguggucggcaacguguaccacaucaaguucacgcgcaacccgaagaacuucauccggaagaacuucaagaaccgcgaguacacccucaacacccuguucuacuccgacaagguggagcggaacggggaggucgccugggagaagggcaagaccgaggagaucgugagcuccgugaugugcaacaaccugaucaacgucacgcgccggaccagcgagcagaagggcgcgcucuacgaggccaccaucuacaaggccaacgccgcgaaggagggguccuacuaccccgugaagaccaacaacaagaaccugaagaacgugacgcgcuacggcggguucaccagcaucaagaucgccuacuacuccaucuucaaguacgacauccggaacaaggacaaggucaaggagaacaucaagaucauccccauccccaucuacaucagccagaacaucaagaccgaccuggaccucaucaacuucgccgagaagcagaucaagcugaagaagggcgagaacaucgagaaccugcagcucaucuacaagaagcugaacaucggggcccuggugaagaucgaccacuacccguacuacaucggcggcaagaccgacgacaacuucuacguggacggggccguccaggugcuccuguccagcgacaucgagcgcuaccugaaggagguggucaaguucgugaacuuccagcgcgagaacaaggaggcgaagguguccaaggagcacaucagccucgaggagaacaucaagcuguacaacacgcuggucugcaagauggccaccaagaucuucacccacaagaagaacaacaaguacaacgaccucacccaggacaaggccaagaacacguucaacaagcugucccuggaggagcagugcaaggugcuccuggagauccugaaccuccugaccaacaagaagaccaccuucgaccugagccucaucaacgagaagacgucccgggugaagugcggcuucaaccugcugaaccagaagcaguucagcaucaucgagcaguccgucaccgggcucuacgagaaggagaucaagaucaucgaggacuga

SEQ ID NO: 1749 - RNA, 3795 nt, Artificial Sequence
  Cas9 variant
augaagaacgugcugggccucgaccuggggaccaacagcaucggcugggcccugaucgaggucgacgagaacaaccuccccauccgcaucaucgccauggggucccggaucaucccgcugagcaccuccgacaaggaggaguuccagcgcggccugagcaucacgaagaaccagucccggaccgugagccgcacccagcggaagggguacgaccgcaagcagcucaagaaguccgaccugaagaagauccugaacaaguacaacaucuuccccagcgaggagcuccugcggcugcccaugcucgaccuguggaagcugcgcuccgacagcgcgaaccccgacgagaacaucuccgccgagcagcucggccggauccuguacaugcugaaccagaagcgcggcuacaagagcgcccgguccgaggccaacgccgacaagaaggacagcgacuacgugcaggcggucaaggggcgcuacgaccagcucaaggaccggaagcagaccaucggccaguacuucuacgacgagcuguacaacgccaacgccaacaacuccuacuuccgcaucaaggaggagguguacccgcgggaggccuacaucgaggaguucgacacgaucaucagcgcgcagcgcgagaagcacgacuuccugaccgacgaggugguccaccagcuccggaacgagaucaucuacuuccagcgcaagcugaagucccagaaggggcuggugagcaucugcgaguucgagggcuucgagaagaccguguucgacaaggagaagaacaagaacaaggucguguucguggggcccaaggucgcccccaagaccagcccccucuuccagcugugccggaucugggagguggugaacacgaucacccugaagaucaagaacccggagggcuccaaguacaaguggggcgagaagauccccgacaucaaggagaaggagauccucgccgacuaccuguucaagaacgagagccuguccuucagcaagcuccuggagauccuggagcucaagaaggagaacgucuacgugaacaagcagauccugaaggggaucaagggcaacgagaccuacuccgcccugcacagcauccucggggacaacgagcugcugaacuucgacguguccaucaugaccagcaaccagacggcccuccuggucgaccgcaagaccggcgagauccuggaggagcgggcgggccucgagcuggacgccucccuggagaaggagccccucuaccagcuguggcacaccaucuacagccugaaggaccucgacgagugcaagaacgcccugaucaagcgcuucgacuucgacgacgagaccgccgagaagcugucccgcaucgacuucaacaagcaggccuucgggaacaagagcaacaaguccaugcggaagauccugcccuuccucauggagggcuacgacuacagccaguccagcucccuggcgggguacaaccacagcaacucccugacgaagaacgagcgcgagcagcagaucacccucgaccggcuggagcugcucccgaagaacagccugcgccagcccaucguggagaagauccugaaccagaugaucaacguggucaacgccauccucgacgaguacggcaagcccuccgagauccggguggagcuggcccgcgagcugaagcagagcaaggacgagcggaacgagaccgaccuccagaacagcaagaacaagaagcugaacgacgagaucgggaagcgccuggaggagcucggccugcccgugaccaagcgguacauccagaaguacaaguucaucuucccgucccugagcaagaaccucaaggaggccaaggucaacaaccagugcaucuacugcggcgagacguucaaccugaccgaggcccuguccggggacgcguacgacguggaccacaucguccccaaggcccuccuguucgacgacagccagaccaacaaggugcuggugcaccgcaagugcaacuccaccaagacgaaccagaccgccuacgacuacaucgccaccaagggcgacgagcaccucaagcuguacagcgagcggcuggacgacugguucgagcgcgggaucaucuccuacagcaagaugcagcggcucaaggucucccacaaggaguaccuggagcgcaagaagcugggcaaggagaccgagacggacaagaagcucugggagaacuucaucgaccggcagcugcgcgacacccaguacaucagccggaagucccgcgagauccugcagaagaucugcaacgacgugaagaccaccgagggcggggugacggccaagcuccggaaccuguggggcugggacgacguccugaugaaccuccagaugcccaaguacaaggagcuggggcagaccaucaccaaggaguggaccagcgagcacggcaagcgcaagcaccagaaggaggagaucgacaacuggacgaagcgcgacgaccaccggcaccacgcgaucgacgcccuggugaucgccugcaccaagcagggguucauccagcgcaucaacacccucaacuccagcgacaccaaggaccugaugaucaaggagguggaggaggccaagaucgaguucaacgagaagaccacgcugcucgagaaguaccugaagacccagaagcccuucuccacccaggaggucaugaaggaggcggacaagauccuggugagcuucaaggccggcaagaagguggccaccaucacgaaguucaaggccaccgggaagaacaaggagaccggcgucaucgugccgcggggcgcccuccacgagcaguccguguacgggaagaucaaggucaucgagaaggacaagccccugaaguaccugcucgagaacagcgacaagaucgugaacccccgcaucaagaaccugaucgagaucaagcugagcgagaacaagaacgaccccaagaaggcgcuccuggcccugaagaagaucccgaucuuccucgacgaggagcaguccaucacccuggagaaggccagcugcuacaacgacgccacggugcugaaguacaagcuccagaaccugaaggccgcgcaggucgacgacaucguggacgagaaggugaagaagaucguccgggagcgccugucccaguucggcaacaaggagaaggaggccuucaaggacacccucugguucaacgaggagaagaagauccccaucaucaccgugcggcuguucgcccgccccgacgccaacaaccugcagaccaucaagaaggacgagaacgggaacggcaucggcuucguggucacggggaacaaccaccacaucgccaucuacgaggacaaggacaacaagcccgugcagcacagcugcaccuucuggcacgcgguggagcggaagaaguacaacaucccggccgucauccgcgacuccagcgagguguggaacgaccuccugcggaaggagcugcccgaguccuuccucaacaagcugcccgccgacaaccugaaccucaaguucagcaugcagcagaacgagauguucauccugggccugucccaggacgaguucgugaaggccaucgcgaacaacgacaagagccuccuguccaagcaccuguaccucgucuggagcaucuccgagaacaacuacugguuccgccaccaccuggagaccaagaacagcgaccugaagaagaccgacggggugaaggaguccaagcggcucuacaacauccgcagccugggcucccuguucagccucaacccgaucaaggugcggcugaacuaccugggggagaucacgaagaucggcgaguga

SEQ ID NO: 1750 - RNA, 3801 nt, Artificial Sequence
  Cas9 variant
auggccaaguacauccugggccucgaccuggggaccaacagcaucggcugggcccugaucgagguggacgagaacaacauccccauccgcaucaucgucauggggucccggaucaucccgcucagcuccaacgaccgcgaggaguuccagcggggccugagcaucaccaagaaccagaaccgcacgaucucccggacccagcgcaagggguacgaccggaagcagcugaagcgcaacgaccucaacaaggugcugaacaaguacaacaucuuccccagcaagaugcugcucaaccugcccaugcuggaccucuggaagcugcgguccgacagcgcgaacuccaacaaggacaucagcgccgagcagcugggccgcauccucuacaugcugaaccagaagcggggcuacaaguccgugcgcagcgaggccaacuccgacaagaaggacaccgacuacguccaggccgugaaggggcgguacgcccagcugaaggaccgcaaccagaccaucggccaguacuucuacgaggagcucuacaacgcgaacgugaacaacagcuacuucaagaucaaggaggaggucuacccccgggaggccuacaucgaggaguucgacacgaucaucaacucccagaagaccaagcacgaguuccugaccgaccaguucgugcaccagcugcgcaacgagaucaucuacuuccagcggaagcucaagagccagaaggggcugaucuccaucugcgaguucgagggcuucgagaagaccguguucgacaaggagaagaacaagcacaagaucgucuucguggggccgaagguggcgccccgcagcgcgccccuguuccagcucugccgggucugggaggugaucaacacgaucuccaucaaggugaagaaccccgagggcagcaaguacaaguggggcgagcgcaucccgagcaucaaggagaaggagauccuggccgacuaccuguucaagaacgagguccucuccuucaccaagcugcuggagauccucgggcugaacaagaacgacguguacgugaacaagcagauccugaagggcaucaaggggaacgagaccuacgccacccucuacaacauccugggcgagaacgaguuccugaacuucgacgucagcaucauccccuccaaccacacgagcaugcucguggacaagaagaccggcgagauccuggaggagcgggccgggcuggagcucgacgugucccuggagaagcagcccuucuaccagcuguggcacaccaucuacagccucaaggaccuggacgagugcaagaacgcccugaucaagcgcuucgacuucgacgacgagaccgccgagaaccucucccgcaucgacuucaacaagcaggccuucggcaacaagagcaacaaguccaugcggaagauccugcccuuccugauggagggguacgacuacagccaguccugcagccucgccggcuacaaccacuccaacagccugacgaaggacgagcgcgagcagcaggucacccuggaccggcuggagcuccugccgaagaacucccugcgccagcccaucguggagaagauccucaaccagaugaucaaccuggugaacgccauccuggaccaguacggggagcucagcgagauccgggucgagcuggcccgcgagcugaagcaguccaaggacgagcggaacgacgccgaccuccagaacaccaagaacaagaagcugaacgacgagaucggcaagcgccuggcggagcucggccugcccaucaccaagcgguacauccagaaguacaaguucaucuuccccagccuguccaagaaccucaaggacgcccacgugaacaaccagugcaucuacugcggggagacguucaaccugagcgaggcccugagcggcgacgccuacgacgucgaccacaucgugccgaaggcccuccuguucgacgacucccagaccaacaaggugcugguccaccgcaagugcaacagcaccaagaccaaccagacggcguacgacuacaucuccaccaagggggacgagcagguccggaucuacuucgagcgcguggacgacugguucaagagcggcaucaucuccuacagcaagaugcagcggcucaaggugucccacaaggaguaccuggagcgcaagaagaucgggaaggagaccgagaccgacaagaagcugugggagaacuucaucgaccggcagcuccgcgacacgcaguacaucagccggaagucccgcgagauccugcagaaggugugcaacaacgugaccaccaccgagggcggcgucacggccaagcugcggaaccucugggggugggacgacgugcugaugaaccugcagaugcccaaguaccgcgagcucggccagaccgugaucaaggaguggaccagcgagcacgggaagcgcaagcaccagaaggaggaggucgagaacuggaccaagcgggacgaccaccgccaccacgccaucgacgcccuggugaucgccugcacgaagcagggcuucauccagcggaucaacacccugaacuccagcgacaccaaggaccucaugcugaaggagguggaggaggcgaaggucaaguucuccgagaagaccacccugcucgagaaguaccugcgcacgcaggagcccuucagcacccaggaggugaugcgggaggccgacaaggugcuggucuccuucaaggccgggaagaagguggccaccaucaccaaguucaaggcgaucggcaagaacaaggacagcggcgugaucgucccccgcggggcccuccacgagcaguccguguacggcaagaucaaggugaucgagaaggacaagccgcugaaguaccuguucgagaacagcgaccggaucgucgaccccaaggugaagaagcucguggagguccgccugagcgagaacgagaacaacuccaagacggccaucagcacccugaagaaggcccccaucuuccucaacgaggagaagaccgaggugcuggagaaggccuccugcuacaacgacgcgaccgugcugaaguacaagcuccagagcaucaaggccucccaggccgacgacaucgucgacgagcgggugaaguuccuggugaaggagcgccuggcccaguucgggaacaaggagaaggaggccuucaaggacauccucugguucaacgaggagaagcagauccccaucaucagcguccggcuguucgcgcgcccggacgccaacaaccuccaggugaucaagaaggacgagaacggcaaguccaucggcuucgugcugacggggaacaaccaccacaucgccaucuacgaggacaaggacaacaagcugauccagcacagcugcaccuucuggcacgccgucgagcggaagaaguacaacauccccguggugaucaagaacuccagcgacgucuggucccagcugcucgacaagcagcugcccgagagccugcucaacaagcugcccaccgacaagcugaaccucaaguucuccaugcagcagaacgagauguucauccugggccugagccagaaggaguucgacgaggccaucaagaacaaccacaaguccuuccucagcaaguaccuguaccuggugugguccaucagcaacaacgacuacuacuuccgccaccaccucgagaccaagaacacggagcugaagaacaucuccaccgcgaaggagagcaagcgguacuuccgcuucaagagcgugggggcccuggucggcaccaacccgaucaagauccggcucaaccaccugggggagaucaacaaggugggcgaguacuga

SEQ ID NO: 1751 - RNA, 3807 nt, Artificial Sequence
  Cas9 variant
augaccaagaacauccugggccucgaccuggggaccaacagcaucggcugggcccugaucgagguggacgagaacaacacgcccauccgcaucaucgccauggggucccggaucaucccgcucagcaccuccgacaaggaggaguuccagcgcggccugagcaucaccaagaaccagucccggaccgucagccgcacgcagcggaagggguacgaccgcaagcagcugaagaaguccgaccucaagaagauccugaacaaguacaacaucuuccccagcgaggagcugcucaagcugcccaugcuggaccucuggaagcugcgguccgacagcgcgaaccccaacgagaacaucuccgccgagcagcugggccgcauccucuacaugcugaaccagaagcggggcuacaagagcgcccgcuccgaggccaacgccgacaagaaggacaccgacuacgugcaggcggugaaggggcgguacgcccagcugaaggagcgcaaccagaccaucggccaguacuucuacgaggagcucuacaacgccaacaccaacaacagcuacuuccggaucaaggaggaggucuacccgcgcgaggccuacacggaggaguucgacaccaucaucaacgcgcagaagaacaagcacgacuuccugaccgacgagguggugcaccagcugcggaacgagaucaucuacuuccagcgcaagcucaagucccagaaggggcuggucagcaucugcgaguucgagggcuucgagaagaccguguucgacaaggagaagaacaaggacaagguggucuucguggggcccaagguggcccccaagacgagcccccuguuccagcucugccggaucugggaggucgugaacaccaucucccugaagaucaagaacccggagggcuccaaguacaaguggggcgagaagauccccaaccugaaggagaagcagauccucgccgacuaccuguucaagaacgacagccugagcuucaccaagcuccuggagauccuggaccucaacaagaacgacguguacgucaacaagcagauccugaaggggaucaagggcaacgagaccuucuccacgcugcacaccgugcucggggacaacgagcugcugaacuucgacgugagcaucauccccuccaaccacaccagcaugcucgucgacaagaagaccggcgagauccuggaggagcgcgccggccuggagcucgacgccucccuggagaaggagccccuguaccagcucuggcacacgaucuacagccugaaggaccuggacgagugcaagaacgcgcucaucaagcgguucggguucgacgacgagaccgccgagaagcugucccacaucgacuucaacaagcaggccuucggcaacaagagcaacaaguccaugcgcaagauccugccguuccugauggagggguacgacuacagccaguccugcagccucgccggcuacaaccacuccaacagccugaccaaggacgagcgggagcagcagaucacccuggaccgccucgagcugcuguccaagaacagccuccgccagcccaucguggagaagauccugaaccagaugaucaacguggucaacgccauccuggagcaguacgggaagcucuccgagauccggguggagcuggcgcgcgagcugaagcagagcaaggacgagcggaacgacgccgaccuccagaacuccaagaacaagaagcugaacgaggagaucggcaagcgccuggccgagcucggccugcccgugacgaagcgguacauccagaaguacaaguucaucuuccccagccugagcaagaaccucaaggacgcccacgucaacaaccagugcaucuacugcggggagaccuucaaccugaccgaggcccuguccggcgacgcguucgacguggaccacaucgucccgaaggcccuccuguucgacgacagccagaccaacaaggugcuggugcaccgcaagugcaacuccacgaagaccaaccagaccgccuacgacuacaucgggaccaagggcgaggagcagguccggguguacagcgagcgcaucgacgacugguucaagcgggggaucaucuccuacagcaagaugcagcgccucaaggugucccacaaggaguaccuggagcggaagaagcugggcaaggagacggagaccgacaagaagcucugggagaacuucaucgaccgccagcugcgggacacccaguacaucagccgcaaggcccgggagauccugcagaaggucugcaacaacgugaccacgaccgagggcggggugaccgccaagcuccgcaaccuguggggcugggacgacguccugaugaaccuccagaugcccaaguacaaggagcuggggcagaccgugaucaaggaguggaccuccgagcacggcaagcggaagcaccagaaggaggagaucgagaacuggacgaagcgcgacgaccaccggcaccacgcgaucgacgcccugguggucgccugcaccaagcagggguucauccagcgcaucaacacccucaacagcuccgacaccaaggaccugaugcagcgcgagaucaaggaggccaagaagcugcucggcgagaacuacaacgagaaggaguucgagaacgacaacgaguucgugaagaaccacaaggagcggcugagccagcuggacgacuaccuccgccugcagaagcccgugaaguucgacacgaaguacgucgagcaggaggcggacaaggugcugguguccuucaaggccggcaagaaggucgccaccaucaccaaguucaaggccaccgggaagaacaaggacacgggcgugaucgugccccgcggggcccuccacgaggcgggccuguacggcauccggaccaucuacagcaagggcgggaucgccgagaagcacaucaucaagaaguacaaggucgggguguccgcccaggaccacaucuucaccggcaaggagaccuacagcgugaagaaggacaagaacgggaacgagaaggucgacgacaagaucaagaucgugcuggacuccaucguggacaacaaggucaaggagguggugcucaaccggcugaaccgcggcuucaacaacgaggaggacuaccggaucgacgucaagaaggcccugaacaacuucaagaaccucgacgaggacccgcugugguacaacgagagcaagggcaucaagauccugagcaucaagcucaagacggggcugaaggacuccguggugccccugcgccucaacgagaagaacgaggucaucacccuggugaagaccggcaacaaccaccacaucgccaucuacgaggacaacgacgggaagcugauccaguacagcugcaccuucuggcacgcgguggagcggaagaaguacaacauccccacggucaucaagaacuccagcgagguguggaaccaggugcucgacaagaagcugcccgaguccuuccugaaccgccucccggccgacaagcugaaccugaaguucagcaugcagcagaacgagauguucauccucggccugcuggaggaggaguucgacaaggccaucaaggacaacgacaagucccuccugagcaaguaccuguaccucgucugguccaucgccgagggggacuacugguuccggcaccaccuggagaccaagaacaccgagcugaagaagaccaacggcgccaaggagagcaagcgcuacuuccggcucuccacgaagggccugaucgaccugaaccccgugaaggugcgccucaaccaccugggggagaucaccaagaucggcgaguacuga

SEQ ID NO: 1752 - RNA, 3810 nt, Artificial Sequence
  Cas9 variant
augaacaacagcaucaaguccaagcccgaggugaccaucggccuggaccucggggucggcagcguggggugggccaucguggacaacgagaccaacaucauccaccaccugggcucccgccuguucagccaggccaagacggcggaggaccggcgcuccuuccgcggggcccggcggcucauccgccggcgcaaguacaagcugaagcgguucaucaaccugaucuggaaguacaacagcuacuucggcuucaagaacaaggaggacauccucaacaacuaccaggagcagcagaagcugcacaacaccguccugaaccucaagcuggaggcccugaacgccaagaucgacccgaaggcccucuccuggauccugcacgacuaccugaagaaccgcggccacuucuacgaggacaaccgggacuucaacguguaccccaccgaggagcucgcgaacuacuucggggaguacggcuacuacaaggggaucaucgacagcaaggaggacaacgacgacaagcuggaggagggccugaccaaguacaaguucuccaaccagcacuggcucgaggagaucaagaaggugcugagcaaccagacggggcugcccgagaaguucaaggaggaguacgagucccucuucagcuacguccgcaacuacuccgagggccccggcagcaucaacuccgugagcccguacgggaucuaccaccuggacgagaaggagggcaaggugguccagaaguacaacaacaucugggacaagaccaucgggaagugcuccaucuuccccgacgaguaccgggcccccaagaacagccccaucgccaugaucuucaacgagaucaacgagcuguccaccauccgcagcuacagcaucuaccucaccggcugguucaucaaccaggaguucaagaaggccuaccugaacaagcugcucgaccugcugaucaagacgaacuccgagaagccgaucgacgcgcggcaguucaagaagcuccgcgaggagaccaucgccgagagcaucggcaaggagacccugaaggacguggagcgggaggagaagcuggagaaggaggaccacaaguggaagcucaaggggcugaagcugaacaccaacggcaagauccaguacaacgaccucuccagccuggccaaguucgugcacaagcugaagcagcaccucaagcuggacuuccugcucgaggaccaguacacgacccuggacaagaucaacuuccugcagucccucuucgucuaccuggggaagcaccuccgcuacagcaaccggguggacuccgccaaccucaaggaguucagcgacuccaacaagcuguucgagcgcgugcugcaggagcagaaggacgaccuguucaagcuguucgagcagaccgacaaggacgacgagaagauccuggcccagacccacagccuguccacgaaggcgaugcuccuggccaucacccggaugaccaaccuggacaacgacgaggacaaccagaagaacaacgacaagggcuggaacuucgaggccaucaagaacuucgaccagaaguucaucgacaucaccaagaagaacaacaaccucagccugaagcaggacaagcgcuaccuggacgaccgcuucaucaacgacgccauccucucccccggggucaagcggauccugcgcgaggccacgaagguguucaacgcgauccugaagcaguucagcgaggaguacgacgugaccaaggucgugaucgagcucgcccgggagcuguccgaggagaaggagcuggagaacaccaagaacuacgagaagcucaucaagaagaacagcgacaagaucuccgagcgccuggaggcccuggacaucgccgaggacaagaucgaggacauccucaagagccccaccaaguccuacaaggugcugcuguggcuccagcaggaccacaucgaccccuacagccagaaggagaucgccuucgaggacauccugacgaagaccgagaagaccgagaucgaccacaucaucccguacagcaucuccuucgacgacagcuccagcaacaagcugcucguccuggcggaguccaaccaggccaagagcaaccagacccccuacgaguucaucacguccggcaacgccggcaucaagugggaggacuacgaggccuacugccggaaguucaaggacggggacaccagccugcucgacuccacccagcgcagcaagaaguucgccaagaugaugaagaccgacacguccagcaaguacgacaucggcuuccuggcgcggaaccugaacgacacccgcuacgccaccaucguguuccgggacgcccucaaggacuacgccaacaaccaccugguggaggacaagcccauguucaaggucgugugcaucaacgggggcgucaccuccuuccugcgcaagaacuucgacaagagcugguacgcgaagaaggaccgggacaagaacauccaccacgccguggacgccuccaucaucagcaucuucuccaacgagacgaagacccucuucaaccagcugacccaguucgccgacuacaagcuguucaagaacaccgacgggagcuggaagaagaucgaccccaagaccggcguggucacggaggugaccgacgagaacuggaagcagauccgcgugcggaaccaggucagcgagaucgccaaggugaucaacaagugcauccaggacuccaacaucgagcgcaaggcgcgguacagccgcaagaucgagaacaagaccaacaucucccucuucaacgacaccguguacagcgccaagaaggucggcuacgaggaccagaucaagcggaagaaccugaagacgcuggacauccacgaguccgccgaggagaacaagaacagcaaggugaagaagcaguucguguaccgcaagcucgucaacgugucccugcugaacaacgacaagcucgccgaccuguucgccgagaaggaggacauccugauguaccgggcgaacccgugggugaucaaccucgccgagcagaucuucaacgaguacaccgagaacaagaagaucaagagccagaacgucuucgagaaguacaugcuggaccugaccaaggaguuccccgagaaguucuccgaggccuucgucaagagcaugcuccgcaacaagaccgccaucaucuacaacguggagaagaagguggugcaccgcaucaagcggcugaagauccuguccagcgagcucaaggagaacaagcuguccaacgugaucauccgcagcaagaacgaguccgggacgaagcugagcuaccaggacaccaucaacuccaucgcccucaugaucaugcggagcaucgaccccaccgcgaagaagcaguacauccgcgucccccugaacacccugaaccuccaccugggcgaccaggacuucgaccugcacaacaucgacgccuaccucaagaagccgaaguucgugaaguaccugaaggccaacgagaucggggacgaguacaagcccuggcgggugcugacguccggcacccuccugauccacaagaaggacaagaagcugauguacaucagcagcuuccagaaccucaaggacgucaucgagaucaagaaccugaucgagaccgaguacaaggagaacgacgacuccgaccccaagaagaagaagaaggccaaccgcuuccugaugacccucagcacgauccugaacgacuacauccugcucgacgcgaaggacaacuucgacauccuggggcuguccaagaaccggaucgacgagauccucaacagcaagcugggccuggacaagaucaccaaguga

SEQ ID NO: 1753 - RNA, 3810 nt, Artificial Sequence
  Cas9 variant
augaacaacagcaucaaguccaagcccgaggugaccaucggccuggaccucggggucggcagcguggggugggccaucguggacaacgagaccaacaucauccaccaccugggcucccgccuguucagccaggccaagacggcggaggaccggcgcuccuuccgcgggguccggcggcucauccgccggcgcaaguacaagcugaagcgguucgugaaccugaucuggaaguacaacagcuacuucggcuucaagaacaaggaggacauccucaacaacuaccaggagcagcagaagcugcacaacaccgugcugaaccucaaguccgaggcccugaacgccaagaucgacccgaaggcccugagcuggauccuccacgacuaccugaagaaccgcggccacuucuacgaggacaaccgggacuucaacgucuaccccaccaaggagcuggccaaguacuucgacaaguacggguacuacaagggcaucaucgacuccaaggaggacaacgacaacaagcucgaggaggagcugaccaaguacaaguucagcaacaagcacuggcuggaggaggugaagaaggugcucuccaaccagacggggcugcccgagaaguucaaggaggaguacgagagccuguucuccuacguccgcaacuacagcgagggccccggguccaucaacagcguguccccguacggcaucuaccaccucgacgagaaggagggcaaggugguccagaaguacaacaacaucugggacaagaccaucgggaagugcaacaucuuccccgacgaguaccgggcgcccaagaacagccccaucgccaugaucuucaacgagaucaacgagcuguccaccauccgcagcuacagcaucuaccugaccggcugguucaucaaccaggaguucaagaaggccuaccucaacaagcugcuggaccuccugaucaagacgaacggggagaagccgaucgacgcccggcaguucaagaagcugcgcgaggagaccaucgcggaguccaucggcaaggagacccucaaggacguggagaacgaggagaagcuggagaaggaggaccacaaguggaagcugaagggccucaagcugaacaccaacgggaagauccaguacaacgaccugagcucccucgccaaguucgugcacaagcugaagcagcaccugaagcucgacuuccugcuggaggaccaguacgccacgcucgacaagaucaacuuccugcagagccuguucgucuaccucggcaagcaccuccgguacaacaaccgcguggacuccgccaaccugaaggaguucagcgacuccaaccggcuguucgagcgcgugcugcaggagcagaaggacgggcuguucaagcuguucgagcagaccgacaaggacgacgagaagauccucgcccagacccacagccuguccaccaaggcgaugcugcucgccaucacgcggaugaccaaccuggacaacgacgaggacaaccagaagaacaacgacaagggcuggaacuucgaggccaucaagaacuucgaccagaaguucaucgacaucaccaagaccaacaacaaccugagccucaagcaggacaagcgcuaccuggacgaccgcuucaucaacgacgccauccugucccccggggucaagcggauccuccgcgaggccacgaagguguucaacgcgauccugaagcaguucagccaggaguacgacgugaccaaggucgugaucgagcuggcccgggagcucuccgaggagaaggagcuggagaacaacaagaacuacaagaagcugaucaagaagaacagcgacaagaucuccgagggccucaaggcccuggacaucgccgaggacaagaucgaggacauccucaagagccccaccaaguccuacaaggugcugcuguggcugcagcaggaccacaucgaccccuacagccagaaggagaucgccuucgaggacauccucaccaagacggagaagaccgagaucgaccacaucaucccguacuccaucagcuucgacgacagcuccagcaacaagcugcugguccucgcggaguccaaccaggccaagagcaaccagacccccuacgaguucaucaccuccggcaacgccgggaucaagugggaggacuacgaggccuacugccgcaaguucaaggacggcgacacgagccugcuggacuccacccagcggagcaagaaguucgccaagaugaugaagaccgacaccuccagcaaguacgacaucggguuccucgcgcgcaaccugaacgacacgcgguacgccaccaucguguuccgcgacgcccugaaggacuacgccaacaaccaccucgucgaggacaagcccauguucaagguggugugcaucaacggcggggucaccuccuuccugcggaagaacuucgacaagagcugguacgcgaagaaggaccgcgacaagaacauccaccacgccguggacgccuccaucaucagcaucuucuccaacaagaccaagacgcuguucgaccagcucacccaguucgccgacuacaagcuguucaagaacaccgacggcagcuggaagaagaucgaccccaagaccggcguggucaccgaggugacggacgagaacuggaagcagauccgggugcgcaaccaggucuccaagaucgccgaggagaucgacaagugcauccaggacagcaacaucgagcggaaggcgcgcuacagccggaagaucgagaacaagaccaacaucucccuguucaacgacaccguguacagcgccaagaaggugggguacgacgaccagaucaagcgcaagaaccucaagacccuggacaucgacgaguccgucgaggagaacaagaacagcaaggugaagaagcaguucguguaccggaagcuggucaacgugucccuccugaacaacgacaagcuggccgaccucuucgccgagaaggaggacauccugauguaccgcgccaacccgugggugaucaaccuggcggagcagaucuucaacgaguacacggagaaccggaagaucaagagccagaacgucuucggcaaguacaugcucgaccugaccaaggaguuccccgagaaguucuccgaggccuucgucaagagcaugcugcgcaacaagaccgccaucaucuacaacguggagaagaagguggugcaccgcaucaagcggcucaagauccuguccagcgagcugaaggagaacaagcucuccaacgugaucauccgcagcaagaacgaguccgggaccaagcugagcuaccaggacacgaucaacuccgucgcccugaugaucaugcggagcaucgaccccaccgccaagaagcaguacauccgcgugccccucaacacccugaaccugcaccucggcgaccacgacuucgaccugcacaacaucgacgcguaccugaagaagccgaaguucgugaaguaccucaaggccaacgagaucggggacgaguacaagcccuggcggguccugaucuccggcagccugcucauccacaagcgcgacaagaagcugauguacaucuccagcuuccagaaccugaacgaccucaucgagaucaagaaccugaucgagaccgaguacaaggagaacguggacagcgaccccaagaagaagaagaaggccucccagauccugcggagccucuccacgauccugaacgacuacauccugcucgacgccaaggacaacuucgacauccugggccugagcaagaaccgcaucgacgagauccucaacuccaagcuggaccuggacaagaucgcgaaguga

SEQ ID NO: 1754 - RNA, 3822 nt, Artificial Sequence
  Cas9 variant
augaagaagauccugggccucgaccuggggaccaacagcaucggcugggcccugaucgagguggacgagaacaacuuccccauccgcaucaucgccauggggucccggaucaucccgcucagcuccaacgacaaggacgaguuccagcgcggccugagcaucaccaagaaccagucccggacggucagccgcacccagcggaagggguacgaccgcaagcagcugaagaaguccgacgacuucaaguacagccuccggcgcauccugaacaaguacaacaucuuccccuccgaggagcugcucaagcugcccaugcuggaccucuggaagcugcggagcgacgcggugaaccccaacgagaacaucuccgccgagcagcugggccgcauccucuacaugcugaaccagaagcggggcuacaagagcgcccgcuccgaggccaacgccgacaagaaggacaccgacuacgugcuggcggucaaggggcgguacgcccagcucaaggaccgcaaccagaccaucggccaguacuucuacgaggagcugcacaacgccaagacgaccaacagcuacuuccggaccaaggaggagguguacccgcgcgaggccuacaucgaggaguucgacaccaucaucaacgcgcagaaguccaagcacgacuuccugacggacgaggugguccaccagcuccggaacgagaucaucuacuuccagcgcaagcucaagagccagaaggggcugguguccaucugcgaguucgagggcuucgagaagaccaucuucgacaaggagaaggacaagaacaagguggucuucguggggcccaagguggcccccaagaccagcccccuguuccagcugugccggaucugggaggucgugaacaccaucacgcugaagaucaagaacccggagggcuccaaguacaaguggggcgagaagauccccaacaucaaggagaaggaggcccucgccgacuaccuguucaagaacgagacccugagcuucaacaagcuccuggacauccuggagcucaagaaggagaacguguacgucaacaagcagaucaucaaggggaucaagggcaacgagaccuacagcgcccugcaccgcauccugggggacaacgagcuccugaaguucgacguguccaucauccccagcaaccacaccuccaugcugguggacaagaagacgggcgagauccucgaggagcgggcgggccuggagcuggacgucagccucgagaaggagccccuguaccagcuguggcacaccaucuacuccaucaaggaccucgacgagugcaagaacgcccugaucaagcgcuucggguucgacgacgagaucgccgagaagcugagccaccucgacuucaacaagcaggccuucggcaacaaguccaacaagagcaugcgcaagauccugccguuccugauggagggguacaacuacucccagagcugcacccuggccggcuacaaccacuccaacagccucaccaaggacgagcgggagcagcaggucacgcuggacaagcuggagcuccugcccaagaacucccugcgccagcccaucguggagaagauccucaaccagaugaucaacguggugaacgcgauccuggaggaguacgggaagcccagcgagauccggaucgagcuggcccgcgagcucaagcaguccaaggacgagcggcacgacgccgaccugcagaacagcaagaacaagaagcugaacgaggagaucggcaagcgccucaccgagcugggccugccggugaccaagcgguacauccagaaguacaaguucaucuuccccucccucagcaagucccugaaggacgcccaggucaacaaccagugcaucuacugcggggagaccuucaaccugacggaggcccucagcggcgacgcguacgacguggaccacaucguccccaagagccugcuguucgacgacucccagaccaacaaggugcucgugcaccgcaagugcaacagcaccaagaccaaccagacggccuacgacuacaucgccuccaagggggaggaggagguccagaucuacagcgcccggguggacgacugguucaagcgcggcaucaucuccuacagcaagaugcagcggcugaaggugucccacaaggaguaccuggagcgcaagagccucaacaaggagaccgagaccgacaagaagcugugggagaacuucaucgaccggcagcugcgcgacacccaguacaucucccgcaagagcaaggagauccuccagaaggucugcaacaacgugacgaccaccgagggcggggugaccgccaagcugcgggaccuguggggcugggacgacauccucaugaaccugcagaugcccaaguacaaggagcugcggcagacggucaucaaggaguggaccuccgagcacgggaagcgcaagcaccagaaggaggagaucgagaacuggaccaagcgggacgaccaccgccaccacgcgaucgacgcccucgugaucgccugcaccaagcagggcuucauccagcgcaucaacacccugaacagcuccgagacgaaggaccugaugcagcaggagaucaacgaggccaagaagcuccugggggagaacuacaaggacaaggaguucgagaacagcaacgagcuggugaagaaccacaagggccggcucuccaagcuggacgacuaccugcgccuccagaagccgaucaaguucaacaccaaguacgucgagaaggaggcggacaagauccugaucagcuucaaggccgggaagaagguggccaccaucaccaaguucaaggccacgggcaagaacaaggacaccggcgugaucgucccccgcggggcccugcacgaggcgggccucuacggggugcggaccaucuacuccaagggcggcaucgccgagaagcacaucaucaagaaguacaaggugggggucagcgcccaggaccacaucuucaccggcaaggagagcuacuccgugaagaaggacaagaacgggaacgagaagguggacgacaagaucaaggucgugcuggacagcaucguggacuccaaggucaaggagaucgugcugaaccggcucaacuucggcuucagcgacggggaggacuacaagaacaacgugaagaaggcccugaacaacuucaagaaccuggacgaguacccccucugguacaacgagaacaagggcaucaagauccuguccaucaagcugaagacgggccucaaggacagcgucgugccccugcgccugaacgaguccaacgaggugaucacccucgucaagaccgggaacaaccaccacaucgccaucuacgaggacaagaacagcaagccggugcagcacuccugcaccuucuggcacgcgguggagcggaagaaguacaacauccccgccgucaucaagaaguccagcgacguguggaaccagcugcuggacaaggagcuccccgagagcuuccugaacaaccugcccgaggacaaccucaaccugaaguucuccaugcagcagaacgagauguucgugcugggccucagccaggaggaguucaaggaggccaucgagaacaacgacaagucccugcugagcaaguaccucuaccuggucugguccgugagcgagaacaacuacugguuccgccaccaccuggagacgaagaacuccgaccucaagaagaccgagggggccaaggagagcaagcggcuguacaacauccgcagcguguccagccuguucucccucaacccggucaaggugcggcugaaccaccugggcgagaucaccaagaucggggaguacuga

SEQ ID NO: 1755 - RNA, 3825 nt, Artificial Sequence
  Cas9 variant
augaccaagcacauccugggccucgaccuggggaccaacagcaucggcugggccaucauccagguggacaacaacaacaacguccccauccagaucaucgccauggggucccgcaucaucccgcuggacagcaacgaccgggaccaguuccagaagggccaggcgaucuccaagaacaaggaccgcacgaccgcccggacccagcgcaagggguacgaccggaagcagcucaagaaguccgacgacuucaaguacagccugaagaagauccuggagaagcucgacaucuuccccaccgaggagcugaugaagcugcccacgcucgaccuguggaagcugcgcagcgacgccguguccaacaucgaggacaucacccccaagcagcucggccggauccuguacaugcugaaccagaagcgcggcuacaagagcgcccgguccgaggccaacgcggacaagaaggacaccgacuacguggccgaggucaaggggcgcuacacccagcucaaggacaagggccagacgcuggggcaguacuucuacaaggagcugagcgacgccaaccagaacaacaccuacuaccgggugaaggagaagguguacccgcgcgaggccuacaucgaggaguucgacgcgaucaucaacguccagaaguccaagcacagcuuccucaccgacgaggugauccacucccugcggaacgagaucaucuacuaccagcgcaagcucaagagccagaagggccugguguccaucugcgaguucgagggguucgagaccacguacuucgacaagaagacccagcaggacaagaccaucuucaccggccccaaggucgcgccccggacgagcccccuguuccaguucugcaagaucugggagguggugaacaacaucucccugaagaccaagaacccggagggcagcaaguacaagugguccgaccgcauccccaccaucgaggagaagcagaccaucgccaacuaccuccaggagaacgagaaccugagcuucaucgagcugcucaagauccugcagcugaagaaggagcaggucuacgccaacaagcagauccucaaggggauccagggcaacacgaccuucagcgccauccacaagaucaucgggaacuccgagcaccugaaguucgacaucgagaccauccccagcaagcacuucgccgugcugguggacaagaagaccggcgagauccucgacgagcgggacucccuggagcugaacagcgcccucgagcaggagcccuucuaccagcuguggcacacgaucuacuccaucaaggaccuggacgagugcaagaaggcccucaucaagcgcuucaacuucgaggaggagaucgccgagaagcugagcaagaucgacuucaacaagcaggccuucggcaacaaguccaacaaggcgaugcggaagaugcugccguaccucaugcugggguacaaccagagcgaggccgaguccuucgccggcuacaaccgccggcugaccaaggaggagaaguccaagaacgucagcgacgagccccuccagcugcuggccaagaacagccuccgccagcccgugguggagaagauccugaaccagaugaucaacgucgugaacgccaucaucgagaaguacgggaagcccgaggagauccgcguggagcuggcgcgggagcugaagcaguccaaggacgagcgcgaggacgccgacaagcagaacggcuucaacaagaagcucaacgagcuggucgccaccaagcugaccgagcucgggcugccgacgaccaagcacuacauccagaaguacaaguucaucuuccccgccaaggacaagaacuggaaggaggcccagguggcgaaccagugcaucuacugcggcgacaccuucaaccugaccgaggcccucagcggcgacaacuucgacguggaccacaucguccccaaggcccugcuguucgacgacucccaggccaacaaggugcucguccaccggagcugcaacuccacgaagaccaacaacaccgcguacgacuacaucaccaagaaggggagccaggcccugaacgacuacguggcccgcguggacgacugguucaagcggggcaucaucuccuacgggaagaugcagcgccugaaggucagcuucgaggaguaccaggagcggaagaagaucggcaaggagacggaggccgacaagcgcaucugggagaacuucaucgaccggcagcuccgcgagaccgccuacaucgcgaagaaggccaaggagauccuggagaaggugugccacaacgugaccagcaccgaggggaacgucaccgccaagcugcggcagcucuggggcugggacaacgugcugaugaaccugcagcuccccaaguacaaggagcuggagaagaagacgaagcagaccuucacccagcugaaggaguggaccuccgaccacggcaaccgcaagcaccagaaggaggagaucaucaacuggacgaagcgggacgaccaccgccaccacgccaucgacgcccucgugaucgcgugcacccagcagggguucauccagcggaucaacacccugagcuccagcgacgucaaggacgagaugaagaaggagcuggaggaggacaagaccguguacaacgagcgccucacgcugcuggagaacuaccuccuggagaagaagccguucuccaccgaggagaucgagaaggaggccgacaagauccuggugagcuucaaggccggcaagaaggucgccacccucuccaaguacaaggccaccgggaucaacgagaucaagggcgugcuggugccccgggggccccugcacgagcagagcgucuacggcaagaucaaggugaucgagaaggacaagccccucaaguaccuguucgagaacuccgacaagaucgugaacccgcugaucaagcaccucgucaagacgcgccugcuggagaacgagaacaacgcgcaggccgcccucgugacccugaagaacaagcccauccugcucaacaacaagcagaccgagauccuggagaaggccagcugcuacaacgaggcgaccgugcugaaguacaagcuccagucccugaaggccagccagaucgacgacaucgucgacgagaagaucaaguuccugaucaaggagcggcucuccaaguucggcaacaaggagaaggaggccuucaaggacauccugugguucaacgagaagaagcagauccccaucacgagcauccgccuguucgcccgccccgacgccaacaaccuccaggugaucaagaagcacgagaaggggaagaacaucggcuucgugcuguccgggaacaaccaccacaucgcgaucuacgaggacaagaacaacaagcugauccagcacaucugcgacuucuggcacgccgucgagcggaagcgcaacaacaucccggugcucaucgaggacaccagcaccaucuggaaccaccugaucaacgaggacuucuccgagagcuuccugaacaagcuccccaacgacagccugaagcugaaguucucccuccagcagaacgagauguucauccugggccugcccaaggagcagagcgaggaggccaucaaguccaacaacaagagccuccuguccaagcaccuguaccucguguggagcaucaccgacggcgacuacuucuuccggcaccaccuggagacgaagaacaccgagcugaagaagaucgacggguccaaggagagcaagcgcuaccuccggcuguccaccaagagccuggucgaccucaacccgaucaaggugcgccugaaccaccugggcgagaucaccaagaucggggaguga

SEQ ID NO: 1756 - RNA, 3846 nt, Artificial Sequence
  Cas9 variant
auggaggacgacagccagcacgacauccgcgagaucuaccuggccauccaccacauggugaaguaccggggcaacuuccucgucgaggggacccuggaguccagcaacgccuucaaggaggacgagcugcucaagcugcugggccgcaucacccgguacgagauguccgagggggagcagaacagcgacaucgagcaggacgacgagaacaagcucguggcgcccgccaacggccagcuggccgacgcccugugcgccacgcgcgggucccggagcaugcgcguggacaacgcgcucgaggcccuguccgccgucaacgaccugagccgggagcagcgcgccaucgugaaggcgaucuucgccggccucgagggcaacaagcuggaccuggccaagaucuucguguccaaggaguucagcuccgagaacaagaagauccucgggaucuacuucaacaagagcgacuacgaggagaagugcguccagaucguggacuccggccugcuggacgacgaggagcgggaguuccucgaccgcaugcaggggcaguacaacgccaucgcccugaagcagcugcucggccggagcaccuccgugagcgacuccaagugcgcgagcuacgacgcccaccgcgccaacuggaaccugaucaagcugcagcuccggaccaaggagaacgagaaggacaucaacgagaacuacgggauccuggucggcuggaagaucgacuccggccagcgcaagagcgugcgcggggagagcgccuacgagaacaugcggaagaaggccaacguguucuucaagaagaugaucgagaccuccgaccugagcgagacggacaagaaccggcucauccacgacaucgaggaggacaagcuguucccgauccagcgcgacuccgacaacggcgucaucccccaccagcugcaccagaacgagcucaagcagaucaucaagaagcaggggaaguacuaccccuuccugcuggacgcguucgagaaggacggcaagcagaucaacaagaucgagggccuccuggccuuccgggugcccuacuucguggggccgcuggucgugcccgaggaccuccagaaguccgacaacagcgagaaccacuggauggugcgcaagaagaagggcgagaucacccccuggaacuucgacgagauggucgacaaggacgccagcgggcggaaguucaucgagcgccuggugggcaccgacuccuaccugcucggggagcccacccugccgaagaacagccugcucuaccaggaguacgaggugcugaacgagcugaacaacguccgccucuccgugcggacgggcaaccacuggaacgacaagcgccggaugcgccugggccgggaggagaagacccugcucugccagcgccuguucaugaaggggcagaccgugaccaagcggacggccgagaaccugcugcgcaaggaguacggccggaccuacgagcucagcgggcuguccgacgagagcaaguucaccuccagccuguccaccuacggcaagaugugccgcaucuucggggagaaguacgucaacgagcaccgggaccucauggagaagaucguggagcugcagacggucuucgaggacaaggagacccugcuccaccagcugcgccagcuggagggcaucagcgaggccgacugcgcgcuccuggugaacacccacuacaccggcugggggcggcugucccgcaagcuccugacgaccaaggccggcgagugcaagaucagcgacgacuucgcgccccggaagcacuccaucaucgagaucaugcgcgccgaggaccggaaccugauggagaucaucaccgacaagcagcucggguucagcgacuggaucgagcaggagaaccugggcgccgagaacgggagcucccugauggagguggucgacgaccuccgcgugagccccaaggugaagcggggcaucauccaguccauccgccugaucgacgacaucagcaaggccgucggcaagcgccccucccggaucuuccuggagcucgccgacgacauccagccgagcgggcgcaccaucucccgcaagagccggcugcaggaccuguaccggaacgccaaccucggcaaggaguucaaggggaucgccgacgagcugaacgcgugcuccgacaaggaccugcaggacgaccgccucuuccuguacuacacgcagcugggcaaggacauguacaccggcgaggagcucgaccuggaccggcugagcuccgccuacgacaucgaccacaucaucccccaggccgugacccagaacgacagcaucgacaaccgcgugcucgucgcccgggccgagaacgcgcgcaagaccgacuccuucacguacaugccccagaucgccgaccggaugcgcaacuucuggcagauccugcuggacaacgggcucaucagccgggugaaguucgagcgccugacccggcagaacgaguucuccgagcgcgagaaggagcgguucgugcagcgcagccuggucgagacccggcagaucaugaagaacguggccacccucaugcgccagcgguacggcaacuccgccgccgugaucgggcugaacgcggagcugacgaaggagaugcaccgcuaccucggcuucagccacaagaaccgcgacaucaacgacuaccaccacgcccaggacgcccugugcgucgggaucgccggccaguucgccgcgaaccggggcuucuucgccgacggggaggugagcgacggcgcccagaacuccuacaaccaguaccugcgcgacuaccuccggggguaccgcgagaagcugagcgccgaggaccggaagcagggccgcgcguucggguucaucgugggcuccaugcggagccaggacgagcagaagcgcgucaacccccggaccggcgagguggugugguccgaggaggacaaggacuaccugcgcaaggucaugaacuaccggaagaugcucgugacccagaaggugggggacgacuucggcgcccuguacgacgagacccgcuacgccgccacggacccgaaggggaucaagggcauccccuucgacggggccaagcaggacaccagccuguacggcggcuucuccagcgcgaagcccgccuacgccguccucaucgaguccaaggggaagacccggcuggugaacgugaccaugcaggaguacagccugcucggcgaccgccccuccgacgacgagcugcggaagguccuggccaagaagaaguccgaguacgccaaggcgaacauccuccugcgccacgugccgaagaugcagcugauccgguacgggggcgggcucauggugaucaagagcgccggcgagcugaacaacgcccagcagcuguggcuccccuacgaggaguacugcuacuucgacgaccugagccagggcaaggggucccuggagaaggacgaccucaagaagcugcuggacagcauccucggcuccguccagugccuguaccccuggcaccgcuucaccgaggaggagcuggccgaccuccacguggccuucgacaagcugcccgaggacgagaagaagaacgugaucacggggaucgucagcgcgcugcacgccgacgccaagaccgccaaccucuccaucgugggcaugaccggcagcuggcggcgcaugaacaacaagagcggguacaccuucuccgacgaggacgaguucaucuuccagagcccguccggccuguucgagaagcgcgugacggucggggagcugaagcggaaggcgaagaaggaggugaacagcaaguaccgcaccaacgagaagcggcuccccacccuguccggcgccagccagcccuga

SEQ ID NO: 1757 - RNA, 3861 nt, Artificial Sequence
  Cas9 variant
augaccaagaacauccugggccucgaccuggggaccaacagcaucggcugggcccugaucgagguggacgagaacaacacgcccauccgcaucaucgccauggggucccggaucaucccgcucagcaccuccgacaaggaggaguuccagcgcggccugagcaucaccaagaaccagucccggaccgucagccgcacgcagcggaagggguacgaccgcaagcagcugaagaaguccgaccucaagaagauccugaacaaguacaacaucuuccccagcgaggagcugcucaagcugcccaugcuggaccucuggaagcugcgguccgacagcgcgaaccccaacgagaacaucuccgccgagcagcugggccgcauccucuacaugcugaaccagaagcggggcuacaagagcgcccgcuccgaggccaacgccgacaagaaggacaccgacuacgugcaggcggugaaggggcgguacgcccagcugaaggagcgcaaccagaccaucggccaguacuucuacgaggagcucuacaacgccaacaccaacaacagcuacuuccggaucaaggaggaggucuacccgcgcgaggccuacacggaggaguucgacaccaucaucaacgcgcagaagaacaagcacgacuuccugaccgacgagguggugcaccagcugcggaacgagaucaucuacuuccagcgcaagcucaagucccagaaggggcuggucagcaucugcgaguucgagggcuucgagaagaccguguucgacaaggagaagaacaaggacaagguggucuucgugggguccaagguggcccccaagacgagcccccuguuccagcucugccggaucugggaggucgugaacaccaucucccugaagaucaagaaccccgagggcagcaaguacaaguggggcgagaagaccccgaaccugaaggagaaggagauccucgccgacuaccuguucaagaacgacagccuguccuucaccaagcuccuggagauccuggaccucaacaagaacgacguguacgucaacaagcagauccugaaggggaucaagggcaacgagacguucagcgcccugcacaccgugcucggggacaacgagcugcugaacuucgacguguccaucauccccagcaaccacaccuccaugcucgucgacaagaagaccggcgagauccuggaggagcgcgccggccuggagcucgacgcgagccuggagaaggagccccuguaccagcucuggcacacgaucuacucccugaaggugcuggacgagugcaagaacgcccucaucaagcgguucggguucgacgacgagaccgccgagaagcugagccacaucgacuucaacaagcaggccuucggcaacaaguccaacaagagcaugcgcaagauccugcccuuccugauggagggguacgacuacucccagagcugcucccucgccggcuacaaccacagcaacucccugaccaaggacgagcgggagcagcagaucacccuggaccgccucgagcugcugagcaagaacucccuccgccagccgaucguggagaagauccugaaccagaugaucaacgucgugaacgcgauccuggagcaguacgggaagcucagcgagauccggguggagcuggcccgcgagcugaagcaguccaaggacgagcggaacgacgccgaccuccagaacagcaagaacaagaagcugaacgaggagaucggcaagcgccuggccgagcucggccugcccgucacgaagcgguacauccagaaguacaaguucaucuuccccagccuguccaagaaccucaaggacgcccacgugaacaaccagugcaucuacugcggggagaccuucaaccugaccgaggcgcugagcggcgacgccuucgacgucgaccacaucgugcccaaggcccuccuguucgacgacucccagaccaacaaggugcugguccaccgcaagugcaacagcacgaagaccaaccagaccgccuacgacuacaucgggaccaagggcgaggagcagguccggaucuacuccgagcgcguggacgacugguucaagcgggggaucaucagcuacuccaagaugcagcgccucaaggugagccacaaggaguaccuggagcggaagaagcugggcaaggagacggagaccgacaagaagcucugggagaacuucaucgaccgccagcugcgggacacccaguacaucucccgcaaggcccgggagauccugcagaaggugugcaacaacgugaccacgaccgagggcgggaucaccgcgaagcuccgcaaccuguggggcugggacgacguccugaugaaccuccagaugccgaaguacaaggagcuggggcagaccgugaucaaggaguggaccagcgagcacggcaagcggaagcaccagaaggaggagaucgagaacuggacgaagcgcgacgaccaccggcaccacgccaucgacgcccugguggucgccugcaccaagcagggguucauccagcgcaucaacacccucaacuccagcgacaccaaggaccugaugcagcgcgagaucaaggaggcgaagaagcugcucggcgagaacuacaacgagaaggaguucgagaacgacaacgaguucgugaagaaccacaaggagcggcugucccagcuggacgacuaccuccgccugcagaagcccgugaaguucgacacgaaguacgucgagcaggaggccgacaaggugcuggugagcuucaaggccggcaagaaggucgccaccaucaccaaguucaaggccaccgggaagaacaaggacacgggcgugaucgugcuccgcggggcgcugcacgagcaguccgucuacggcaagaucaaggugaucgagaaggacaagccccugaaguaccucuucgagaacagcaagaagaucgugaaccccaagaucaagguccugguggaggagcggcuggccgagaacgagaacaacuccaagcucagccugagcacccugaagaagaacccgaucuuccucaacgaggagaagaccgagauccuggagaaggccuccugcuacaacgacgccaccgugcugaaguacaagcuccagagccugaaggccucccaggcggacgacaucgucgacgaccgggugaaguuccuggugaaggagcgccucgcccaguucggcaacaaggagaaggaggccuucaaggacacgcuguggcugaacgaggagaagcagauccccaucaucaccguccgccucuucgcccggcccgacgccaacaaccugcaggcgaucaagaaggacaagaacgggcgggacaucggcuucgugcugaccgggaacaaccaccacaucgccaucuacgaggacaaggacaacaagcucgugcagcacagcugcaccuucuggcacgccgucgagcgcaagaagaacaacgugcccgccgugaucaagaacuccagcgacgucuggaaccagcugcuggacaaggagcucccggaguccuuccugaacaagcugcccaucgacaagcucaagcugaaguucagccugcagcagaacgagauguucgugcucggccugcugcaggaggacuucgaggcggccaucgagaacaacgacaagacgcuccuguccaagcaccuguaccucguguggagcaucaccgacggggacuacuucuuccggcaccaccuggagaccaagaacaccgagcugaagaagacggagggcgccaaggaguccaagcgcuacuuccggcucagcaccaagggccugaucgaccugaaccccgucaaggugcgccucaaccaccugggggagaucaccaagaucggcgaguacuga

SEQ ID NO: 1758 - RNA, 3864 nt, Artificial Sequence
  Cas9 variant
augaagaccgugcugggccucgaccuggggaccaacagcaucggcugggcccugaucgagcucgacgagaacaacauccccauccgcaucgucgccauggggucccggaucaucccgcugagcacguccgacaaggaggaguuccagcgcggccugagcaucaccaagaaccagucccggaccgugagccgcacccagcggaagggguacgaccgcaagcagcucaagaaguccuaccugaagaagauccugaacaaguacaacaucuuccccagcgacgagcuccugaagcugcccaugcucgaccuguggaagcugcgguccgacagcgcgaaccccaacgagaacaucuccgccgagcagcucggccgcauccuguacaugcugaaccagaagcggggcuacaagagcgcccgcuccgaggccaacgccgacaagaaggacacggacuacauccaggcggugaaggggcgguacgcccagcucaaggaccgcaaccagaccaucggccaguacuucuacggggagcugaacgacgccaacgagaacaacagcuacuuccggaucaaggaggaggucuacccgcgcgaggccuacaccgaggaguucgacaccaucaucaacgcgcagaaggacaagcacgacuuccugacggacgaggugauccaccagcuccggaacgagaucaucuacuuccagcgcaagcugaagucccagaagggccuggugagcaucugcgaguucgagggguucgagaagaccgucuucgacaaggagaagaacaaggacaaggugguguucgucggccccaagguggcccccaagaccagcccccucuuccagcugugccggaucugggagguggucaacaccaucacgcugaagaucaagaacccggagggcagcaaguacaaguggggcgagaagauccccgacgugaaggagaaggagauccucgccgacuaccuguucaagaacgagucccugagcuucaccaagcuccuggagauccugaagcucaacaagaacaacguguacuucaacaagcagauccugaaggggaucaaggggaacgagaccuacagcauccugcacuccauccucggcgacagcgagcugcugaacuucgacgucuccaucauccccagcaaccacaccuccaugcucaucgacaagaagacgggcgagauccuggaggagcgcgccgggcuggagcucgacaccagccuggagaaggagccccugaaccagcucuggcacaccaucuacuccaucaaggaccuggacgagugcaagagcgcccugaucaagcgguucggcuucgacgacgagaccgcggacaagcucucccgcaucgacuucaacaagcaggccuucgggaacaagagcaacaaguccaugcggaagauccugccguuccugauggagggcuacgacuacagccaguccugcagccuggccggguacaaccacuccaacagcuucacgaaggacgagcgcgagcagcagaucacccucgacaagcuggagcugcuccccaagaacucccugcgccagcccaucguggagaagauccugaaccagaugaucaacguggucaacgccauccucgagcgguacggcaagcccagcgagauccgcguggagcuggcccgggagcugaagcaguccaaggacgagcgcaacgacaccgaccuccagaacagcaagaacaagaagcugaacgaggagaucggcaagcggcuggcggagcucgggcugccgcugaccaagcgcuacauccagaaguacaaguucaucuuccccagccucuccaagaaccugaaggacgcccacgugaacaaccagugcaucuacugcggcgagacguucaaccugaccgaggcccucagcggggacgccuucgacgucgaccacaucgugcccaaggcccugcuguucgacgacucccagaccaacaaggugcucguccaccggaagugcaacagcaccaagacgaaccagaccgcguacgacuacaucgccaccaagggcgacgagcagguccgcguguacuccgagcggguggacgacugguucaagcgcgggaucaucagcuacuccaagaugcagcggcugaaggugagccacaaggaguaccuggagcgcaagaagcucggcaaggagaccgagacggacaagaagcugugggagaacuucaucgaccggcagcugcgcgacacccaguacaucucccggaagucccgcgagauccuccagaaggucugcaacaacguggccaccaccgagggcggggugacggccaagcugcggaaccuguggggcugggacgacguccucaugaaccugcagaugcccaaguacaaggagcuggggcagaccguggugaaggaguggaccuccgagcacggcaagcgcaagcaccagaaggaggagaucgagaacuggaccaagcgggacgaccaccgccaccacgccaucgacgcgcucgucguggccugcaccaagcagggguucauccagcgcaucaacacgcugaacagcuccgagaccaaggaccugaugcagcaggagaucaaggaggccaagaagcuccugggcgagaacuacaacgagaaggaguucgagaacaacaacgagagcgugaagaaccacaaggagcggcugucccagcucgacgacuaccugcgccugcagaagccggucaaguucgacaccaaguacguggagcaggaggccgacaaggugcucgucagcuucaaguccggcaagaagguggcgaccaucacgaaguucaaggccaccgggaagaacaaggacaccggcgugaucgucccccgcggggcccugcacgagcagaacguguacggcaagaucaaggugaucgagaaggacaagagccugaaguaccucuucgagaacagcgagaagaucgucaaccccaagaucaagaacaucguggagaucauccuguccgagaacgagaacaacagcaagauggcccuguccacccucaagaagaaccccaucuuccugaacgaggagaagacggaccugcucgagaaggccagcugcuacgaguacgugaccguccggaaguacccgcugaacaccaucaaggcgucccaggccgacgacaucguggacgagcgggugaaguuccuggucaaggagcgccucacccaguucggcaacaaggagaaggaggccuucaaggacacgcugugguucaacgaggagaagcagauccccaucaucaccgugcggcuguucgcccgccccgacgccaacaaccuccaggcgaucaagaaggacgagagcgggaaggagaucggcuucguggucauggggaacaaccaccacaucgccaucuacgaggacaaggacggcaagcuggugcagcacuccugcaccuucuggcacgccguggagcggaagaaguacaacaucagcaccgucaucaagaacuccagcgacgccuggaaccaguuccuggacaacgagcuccccgagccguuccugaacaagcugcccgccgacaaccucaaccugaaguucucccugcagcagaacgagauguucauccucgggcugagccaggaggaguucgacaaggcgcugaaguccaacgacaagagccuccuguccaagcaccuguaccucguguggagcaucuccgagaacaacuacugguuccgccaccaccuggagacgaagaacagcgaccugaagaagaccaacggcgugaaggaguccaagcggcucuacaacauccgcagccugggcagccuguucucccucaaccccaucaagauccggcugaaccaccugggggagaucaccaagaucggcgaguacagcuga

SEQ ID NO: 1759 - RNA, 3867 nt, Artificial Sequence
  Cas9 variant
augcgccuguucgaggagggccacaccgccgaggaccggcgccucaagcggaccgcccgccggcgcaucagccggcgccggaaccgccugcgguaccugcaggcguucuucgaggaggccaugacggaccucgacgagaacuucuucgcccgccugcaggaguccuuccuggugcccgaggacaagaaguggcaccggcacccgaucuucgccaagcucgaggacgaggucgccuaccacgagaccuaccccaccaucuaccaccuccgcaagaagcuggcggacagcuccgagcaggccgaccuccggcugaucuaccuggcccucgcccacaucgugaaguaccgcgggcacuuccugaucgagggcaagcugagcaccgagaacacguccgugaaggaccaguuccagcaguucauggucaucuacaaccagaccuucgugaacggggagagccggcucguguccgcgccccugcccgagagcguccugaucgaggaggagcucaccgagaaggccucccgcaccaagaaguccgagaaggugcugcagcaguucccgcaggagaaggccaacggccuguucgggcaguuccucaagcugauggugggcaacaaggccgacuucaagaaggucuucggccuggaggaggaggccaagaucacguacgcgagcgagagcuacgaggaggaccucgaggggauccuggccaaggugggcgacgaguacuccgacguguuccuggccgccaagaacgucuacgacgccguggagcucagcaccauccuggcggacuccgacaagaagucccacgccaagcugagcagcuccaugaucgugcgguucaccgagcaccaggaggaccucaagaaguucaagcgcuucauccgggagaacugccccgacgaguacgacaaccuguucaagaacgagcagaaggacggguacgccggcuacaucgcccacgccgggaaggucagccagcugaaguucuaccaguacgugaagaagaucauccaggacaucgcgggcgccgaguacuuccucgagaagaucgcccaggagaacuuccugcgcaagcagcgcaccuucgacaacggcgugaucccccaccagauccaccuggccgagcuccaggccaucauccaccggcaggcggccuacuaccccuuccugaaggagaaccaggagaagaucgagcagcuggucacguuccgcaucccguacuacguggggccccucagcaagggcgacgccuccaccuucgccuggcugaagcggcagagcgaggagcccauccgccccuggaaccugcaggagaccguggaccucgaccaguccgcgaccgccuucaucgagcggaugacgaacuucgacaccuaccugccgagcgagaagguccugcccaagcacucccuccuguacgagaaguucaugguguucaacgagcugaccaagaucagcuacaccgacgaccgcgggaucaaggccaacuucuccggcaaggagaaggagaagaucuucgacuaccucuucaagacgcggcgcaaggugaagaagaaggacaucauccaguucuaccggaacgaguacaacaccgagaucgucacccugagcggccuggaggaggaccaguucaacgccuccuucagcaccuaccaggaccugcucaagugcgggcugacgcgcgccgagcuggaccaccccgacaacgcggagaagcucgaggacaucaucaagauccugaccaucuucgaggaccggcagcgcauccggacccagcuguccaccuucaagggccaguucagcgccgaggugcucaagaagcuggagcgcaagcacuacacgggguggggccggcuguccaagaagcucaucaacgggaucuacgacaaggagagcggcaagaccauccuggacuaccuggucaaggacgacggcguguccaagcacuacaaccgcaacuucaugcagcucaucaacgacagccagcuguccuucaagaacgccauccagaaggcccagagcuccgagcacgaggagacccugagcgagaccgugaacgagcucgccgggagccccgcgaucaagaagggcaucuaccagucccugaagaucgucgacgagcugguggccaucaugggguacgccccgaagcggaucguggucgagauggcccgcgagaaccagacgaccagcaccggcaagcggcgcuccauccagcgccucaagaucguggagaaggccauggcggagaucgggagcaaccugcugaaggagcagcccaccacgaacgagcagcuccgggacacccgccuguuccuguacuacaugcagaacggcaaggacauguacaccggcgacgagcucucccugcaccggcugagccacuacgacaucgaccacaucaucccccaguccuucaugaaggacgacagccucgacaaccuggugcuggucggguccaccgagaaccgcggcaagagcgacgacgugcccuccaaggagguggucaaggacaugaaggccuacugggagaagcucuacgccgccgggcugaucagccagcggaaguuccagcgccugaccaagggcgagcagggcgggcucacgcuggaggacaaggcgcacuucauccagcggcagcugguggagacccgccagaucaccaagaacguggccggcauccucgaccagcgguacaacgccaaguccaaggagaagaagguccagaucaucacccugaaggccagccugacgucccaguuccgcagcaucuucgggcucuacaaggugcgggaggugaacgacuaccaccacggccaggacgccuaccugaacugcgucguggcgaccacccugcucaagguguacccgaaccuggcccccgaguucgucuacggggaguaccccaaguuccagaccuucaaggagaacaaggccacggccaaggccaucaucuacaccaaccugcuccgcuucuucaccgaggacgagccccgguucaccaaggacggcgagauccugugguccaacagcuaccugaagacgaucaagaaggagcucaacuaccaccagaugaacaucgugaagaagguggagguccagaagggcggguucagcaaggaguccaucaagccgaagggccccagcaacaagcugauccccgugaagaacgggcuggacccccagaaguacggcggguucgacuccccgguggucgcguacaccguccucuucacccacgagaagggcaagaagccccugaucaagcaggagauccugggcaucaccaucauggagaagacgcgcuucgagcagaaccccauccucuuccuggaggagaagggguuccugcggccgcgcgugcucaugaagcugcccaaguacacccuguacgaguuccccgagggccggcgccggcuccuggccagcgccaaggaggcccagaaggggaaccagauggugcugcccgagcaccuccugacccugcucuaccacgccaagcagugccugcugccgaaccaguccgagagccucgcguacguggagcagcaccagcccgaguuccaggagauccuggagcgcguggucgacuucgccgaggugcacacccuggccaaguccaaggugcagcagaucgucaagcuguucgaggccaaccagacggcggacgugaaggagaucgccgccagcuucauccagcugaugcaguucaacgccaugggcgcccccuccaccuucaaguucuuccagaaggacaucgagcgggcgcgcuacaccagcaucaaggagaucuucgacgccaccaucaucuaccagucccccacggggcuguacgagacccgccggaagguggucgacuga

SEQ ID NO: 1760 - RNA, 3903 nt, Artificial Sequence
  Cas9 variant
auguggggcgugagccuguucgaggccgggaagaccgccgcggagcgccggggcuaccgcuccacccggcgccggcucaaccaccgcaaguuccggcugcgccugcucgaggacauguucgagaaggagauccugagcaaggaccccuccuucuucauccggcugaaggaggccuuccucagcccgaaggacgagcagaagcaguucaaggggaacauccuguucaacgacaaggacuacacggacgccgacuacuacgagcaguacaagaccaucuaccaccuccgcuacgaccucaucucccagcaccggcaguucgacauccgcgaggucuaccuggccauccaccaccugaucaaguaccggggccacuucaucuacgaggaccagaccuucaccacggacgggaaccagcuccagcaccacaucaaggccaucaucaccaugaucaacagcacccugaaccgcaucaucauccccgagaccaucgacaucaacguguucgagaagauccugcucgaccggaugaugaaccgcuccagcaaggugaaguuccugaucgagcugacgggcgaggacaagcaggacaagccccuccugaaggagcuguucaaccucaucgucggccugaaggcgaagcccgccuccaucuucgagcaggagaaccuggccaccaucguggagaccaugaacaugagcaccgagcagguccagcucgaccugcugacgcucgccgacgugcuggcggacgaggaguacgaccugcuccugaccgcccagaagaucuacuccgccaucauccuggacgagagcauggacggguacgaguacuucgccgaggccaagaaggaguccuaccggaagcaccaggaggagcucgugcuggugaagaagaugcucaagagcaacgcgaucaccaacgacgagcgcgccaaguucgaguacuucuacaccgacuacaucggcgccaaguccagcaacuacgaggaguccaagaacaucaagaaggggcugagcgccgccuacggcaaguacuccaaggaggagcggcuguucaagcacaucgagcugcuccuggcgaaggagaacguccugacgaccguggagcacgcccuccuggagaagaacaucaccuucgccagccugcucccgcugcagcgcagcucccggaacgccgugauccccuaccagguccacgagaaggagcugguggccauccucgagaaccaggcgaccuacuaccccuuccugcuggagcagaaggacaacauccacaagcugcucacguuccgcauccccuacuacguggggccgcuggccgaccagaaggacagcgaguucgccuggaugguccgcaagcaggccggcaagaucacccccuucaacuucgaggagaugguggacaucgacgccuccagcgaggcguucaucaagcggaugaccaacaagugcaccuaccugauccacgaggacgugauccccaagcacuccuucagcuacgccaaguucgagguccucaacgagcugaacaagauccgccuggacggcaagcccaucgacaucccgcucaagaagcggaucuucgaggggcuguuccuggagaagacgaaggugacccagaccucccucaagaaguggcuggccgagcacgagcacaugaccgugagcgucgugcagggcacgcagaaggagaccgaguucgccaccucccugcaggcguuccaccgcuucgugaagaucuucgaccgggagaccgucagcaaccccgccaacgaggagauguucgagaagaucaucuacugguccacgguguucgaggacaagaagaucaugcgccggaagcucagcgaguacccccagcugaccgagcagcagcagguccagcuggcccaggugcgcuuccggggguggggccgccucucccagcggcugaucaaccgcaucaagacccccgugagcggcgacgaggaccacaagcuguccaucaacgagauccucuggcagaccaacgagaacuucaugcagaucauccggaacaaggacuaccuguucaagaagaucaucgaggagcaguucgagaacgagacggcccugcucaacaagcagcgcaucgacgagcuggccgcgagcccggccaacaagaaggggaucuggcaggccaucaagaucgucaaggagcuggagaaggugcuccagcagcccgccgagaacaucuucaucgaguucgcccgguccgacgaggagagcaagcgcuccacgccccgggacaaguucaucgagaaggcguacgcccagcugaagaaggagaccgacaccuucaaccuggagcaccucaaggagcugaagcagcgcagcaagcagcugagcucccagcggcuguuccuguacuucauccagaacggcaagugcauguacagcggggagcaccuggacaucgagcgccucgacuccuacgagguggaccacauccugccccagagcuacaucaaggacaacuccaucgagaaccuggcccucgucaagaagguggagaaccagcgcaagaaggacagccugcugcucaacuccagcaucaucaaccagaacuacucccggugggagcagcugaagaacgccggccugaucggggagaagaaguuccgcaaccucacccggaccaagaucaccgaccgcgacaaggagggcuucaucgcccggcagcugguggagacccgccagaucaccaagcacgucacgcagcugcuccagcaggaguacaaggacaccaccaagguguucgcgaucaaggccacccuggugagcggccugcggcgcaaguucgaguucaucaagaaccggaacgucaacgacuaccaccacgcccaggacgccuuccucguggcguuccuggggacgaacaucaccuccaacuacccgaagaucgagauggaguaccuguucaagggcuaccagcacuaccucaacgaggugggcaagagcgccgccaagcccaaguucaccuucaucgucgagaaccuguccaagcagcaguacaacagcaccacgggggaggugaaguggaaccccgagguggacaucgccaagcugaagcgcauccucaacuucaagcagugcaacaucguccggaagguggaggagcaguccggggcccuguucaaggagaccaucuaccccguggaggagagcuccagcaagaccaucccgcugaagaagcaccucgacaccgcgaucuacggcggcuacacggccgucaacuacgccagcuacgcccugauccaguucaagaaggggcgcaagcugaagcgggagaucaucggcaucccccucgccgugcagacccgcaucgacaacuccgagaccagccugcaggcguacaucgccgagcagaucaaguccgagguggagauccugaacgggcggauccucaaguaccagcugaucagcaacaacggcaaccgccuguacaucgccgggcccuccgagcggcacaacgcccgccagcucaucgucagcgacgaggccgcgaaggugaucuggcugaucuccaccaagcaggccgacgaggccauguuccugaaguacuaccggcucgagcaccuggaggccguguucgaggagcugauccgcaagcaggcggccgacuaccagaucuucgagaagcucaucaagaagaucgaggucaacaagguguacuucuacagcugcacguacaacgagaaggugaaggucaucgaggagcugcugaagaucacccaggccaacgccaccaacggcgaccucaagcugcugaagauguccaaccgggagggccgccucgggagcguguccguggcccuggacuucaagaucaucaaccagagcgucaccggccuguaccaguccaucgaggacuacaacaacuga

SEQ ID NO: 1761 - RNA, 3930 nt, Artificial Sequence
  Cas9 variant
augggcagcgugggguucgccggcaucgacaaccaguacaaccugguccgcaccaaggggaagaacgugaucggcgugcggcuguucgacgaggccgacuccgcggccgagcgccgggggcaccgcaccaaccggcgccggcugcagcgccggcgcuggcggcugcgccuccuggacgacaucuucgccaagccccugcaggccgucgacccgaacuuccucgcccggcugaaguacagcuacgugaacaagaaggaccagggccagcaggaccacuacuacggcggguacguguucggcuccacggcggccgaccaggccuaccaccaggccuaccccaccaucuaccaccuccgcaagcggcucauggaggacgaccagaagcacgaccugcgcgaggucuaccuggcgauccaccacaucgugaaguaccgggggaacuuccucaacccccagagcucccuggacaucgaccagcaguucgacgugaccgacuucgcccaggcccuggcccgcuucgccgaccaccaggcgcucagcugggcccuggaggcccccauccgguuccuggaggccgagcucgccaccggccuguccaacagcgcgcgcgucgacgccgccaucgaggccuucuccuucgacacgaagguggaccgggccgcgaucaaggagaugcugaaggggcucagcggcaaccagaucgacuucaccaagcuguucgugaacgucgacuccgccgacugggaccaggaggagcgcaagcaguggaagaugaagcugagcgaggaggacuucgacgagcaggcccucccgauccuggagcgccugucccaggacgagaccgaguucuuccucgccaucaagcgggccuacgacggcaucgcgcugaugcgcuuccugggggacgagcagagccucuccagcgccaugaucaaggccuacgaggaccaccggcgcgaccugaccuuccugaagacccaggugcggacgccccagaaccgccaggcccucuccgagggcuacaccaacuaccugagcguggacgacaagaagcacaagcgcggggcgaaggagcuggcccagcucaucgaggccuccgacgccagcgagcaggacaaggccaccaugcuggaccggaucgcgaacgaccaguucgcccccaagcagcggacgaaggccaacggccugauccccuaccagcuccaccuggccgagcugaagaagauccucgccaagcagggccaguacuacccguuccugcuggacaccuucgcgaagcaggggcagagcgucaacaagaucgaggagcucgugcaguuccgcgugcccuacuacgucggccccauggugcccaaguccgagaccgccgggaacgccgagaaccacuggguggagaagaacgacggccagaccaaggucagcgugacgccguggaacuucgaccagguguucaaccgggaccgcgccgccaaguccuucaucgaccggcugaccgggaccgacaccuaccugaucggcgagcccacgcucccccgccacagccugaccuacgagaccuucaccguccugaacgagcugaacaacauccggaucgacggcaagcgccuccccguggagacgaagcaggcgaucgucgaggaccuguucaagaaguaccggcuggugaccaagaagcgccuccaggacuacuucgccuccuucgggaagcgggagguggagcugaccggccuggccgacgagagccgcuucaccuccagccucacguccuaccacgaccugcaggggcugcucggcaccgacuucaucaccaacccgcagaaccacagccugcuggagaagaucgucgagauccagaccguguucgaggacuccgacaucgccgagcgcgagcucgggaagcugggccuggagcagaagcucaucccccggcuggcgaagaagcacuacacgggcugggggaaccugagccgcaagcuccuggacaccuccuucauccacgaccccgagcggcccgaggagccggugagcaucauggaccugcucuacaccaccaacaagaacuucauggagauccugcacgacuccgaguacggcgucgaggaguggcucaagagccagaacaugaucgacgaccagaaggacauccagaugcgcaucgacgagcugacgaccucccccgccaacaagcgggggaucaagcaggccuucaacgugcuggacgacaucacccaggccaugggcgaggagcccgccuacguguaccuggaguucgcgcgcgagaagcaggccagccggcgcaccgucucccggaagaagcgccucgagacccuguacaagaacgccgcccugaagacggaguucaaggccaucaaggaggcgcucgccgaggagagcgacgaccggaugcaggacgaccgccuguaccuguacuacgcccagcucgggcgggacauguacaccggccagagcaucuccaucgaccagcugagcucccacuacgacaucgaccacaucgugccccgcgccuucaucaaggacgacagccuggagaacaaggugcucgucaaccggaccgacaacgcccgcaagaccgacuccgcgacguucaccgccgacgugaaggccaaggccuucccgcuguggcagcagcugaagaagcucggccugaucagcgcgaagaaguuccggcugcucacccgcaccggggacuucacggagauggagcgggagcgcuucaucgcccggcagcugguggagacccgccagaucaucaagaacgucgccgcccugaucgagggccacuucucccagacccaggccguggcgauccgcgccgaggugaccggggagcuccggcagcugacgcagaucaagaaggaccgcgacaucaacgacuaccaccacgcccaggacgcccugcucgucgccaccgcgggcaccuaccugcaccggcacuuccccaagcgcgacgcccgguucaucuacaacgaguucgacuacuacacccagcacuggcugaagaaccagggcgagaaccgccggcgccaccccuacagcuucgugguggggacgauguccaagggcaacgaggacuggacccccgacaaccucaacuaccugcggaaggucaugcaguacaagaccaugcugaugacccgcaagccgguggggcccgagggcgcccucuacaaggagacgcugaucgccgccgaccccaagaagcggcuggugggggcgagcaaggagcgccaggacccgaccaucuacggcggcuacaccaaggaguccagcgccuacaugucccucguccgggccgggggcaagaaccagcuggugaagauccccgugcgcaucgccaacgagauccacagcgggcagcggaagcuggacgacuacguccaggccaaggugaagaaguucgagcgcauccuccugcccaagaucucccugggccagcucguggaggacgaggggcagcgguucuaccuggcgaccaacgagaugaagcacaacgccaagcagcuguggcucgaccagaaggucgugacgaccuacaagcgccugaccgccgagagccccguggaggacuuccugaccgucuucgacgcccucacguccagcgcgaccauccaccacuucaaguucuaccagcgggaccuggagcugcuccgcgacaaccgcgccggcuuccaggaccuggccaaggccacccagcugaaggugcucaaggacgugcuguacgagcugcacgacaacgccggcuggcgggacccgaucaagcaguacuucaaggagaucgggcucaagguccgcauguggaccaagcugcagaaggagggcgggaucaagcugacggaccaggcggagcucaucuaccagagccccuccggccuguucgagaagcggcgccgggugcaggaccugcucuga

SEQ ID NO: 1762 - RNA, 3939 nt, Artificial Sequence
  Cas9 variant
augcagaacggcuuccuggggaucaccgugagcuccgagcaggucggcugggccgugaccaaccccaaguacgagcucgagcgcgccagccggaaggaccuguggggcgugcgccuguucgacaaggcggagacggccgaggaccggcgcauguuccggaccaaccgccggcucaaccagcgcaagaagaaccggauccacuaccugcgcgacaucuuccacgaggaggucaaccagaaggacccgaacuucuuccagcagcuggacgaguccaacuucugcgaggacgaccggaccguggaguucaacuucgacaccaaccucuacaagaaccaguuccccacgguguaccaccuccgcaaguaccugauggagaccaaggacaagcccgacauccggcucgucuaccuggccuucagcaaguucaugaagaaccgcgggcacuuccuguacaaggggaaccucggcgaggugauggacuucgagaacuccaugaagggcuucugcgagagccuggagaaguucaacaucgacuuccccacccuguccgacgagcaggucaaggaggugcgggacauccucugcgaccacaagaucgccaagaccgugaagaagaagaacaucaucacgaucaccaaggucaagagcaagaccgccaaggcguggaucgggcuguucugcggcugcuccgugccggugaaggugcuguuccaggacaucgacgaggagaucgucaccgaccccgagaagaucagcuucgaggacgccuccuacgacgacuacaucgccaacaucgagaagggggugggcaucuacuacgaggccaucgugagcgcgaagaugcuguucgacugguccaucaugaacgagauccugggggaccaccagcugcucagcgacgccaugaucgccgaguacaacaagcaccacgacgaccugaagcgccugcagaagaucaucaagggcacgggcucccgggagcucuaccaggacaucuucaucaacgacgucagcgggaacuacgugugcuacgugggccacgccaagaccauguccagcgccgaccagaagcaguucuacaccuuccugaagaaccgccugaagaacgucaacgggaucuccagcgaggacgcggaguggaucgacaccgagaucaagaacggcacgcuccugcccaagcagaccaagcgggacaacagcgugaucccccaccagcugcagcuccgcgaguucgagcugauccuggacaacaugcaggagauguacccguuccucaaggagaaccgggagaagcugcugaagaucuucaacuucgugauccccuacuacgucggcccccucaagggggugguccgcaagggcgaguccaccaacuggauggugcccaagaaggacggggugauccacccguggaacuucgacgagauggucgacaaggaggccagcgccgagugcuucaucucccgcaugaccggcaacugcagcuaccuguucaacgagaaggugcugcccaagaacucccuccuguacgagacguucgaggugcugaacgagcucaacccccugaagaucaacggggagcccaucagcgucgagcugaagcagcggaucuacgagcagcuguuccugaccggcaagaaggugaccaagaagucccugaccaaguaccucaucaagaacggcuacgacgaggacaucgagcugagcgggaucgacaacgaguuccacuccaaccucaagagccacaucgacuucgaggacuacgacaaccuguccgacgaggagguggagcgcaucauccuccggaucacggucuucgaggacaagcagcugcugaaggacuaccucaaccgcgaguucgugaagcugagcgaggacgagcggaagcagaucugcucccugagcuacaagggcugggggaaccucuccgagaugcugcugaacggcaucaccgugaccgacagcaacggggucgagguguccgugauggacaugcucuggaacaccaaccugaaccugaugcagauccucagcaagaaguacggcuacaaggccgagaucgagcgcuacaacaaggagcacgagaagaacaucuacaaccgggaggaccugauggacuaccugaacaucccgcccgcccagcgccggaaggucaaccagcucaucacgaucgugaagucccugaagaagcgcugcggcgugcccaacaagaucuucuucaaggucagccgggagcaccaggacgaccccaagcgcaccagcucccggaaggagcagcugaaguaccucuacaagagccugaaguccgaggacgagaagcaccugaugaaggagcucgacgagcugaacgggcacgagcugagcaacgacaagguguaccucuacuuccugcagaagggccgcugcaucuacuccgggaagaagcugaaccucagccggcugcgcaaguccaacuaccagaacgacaucgacuacaucuacccgcugagcgcggugaacgaccgguccaugaacaacaagguccucaccggcauccaggagaaccgcgccgacaaguacaccuacuuccccguggaccccgagauccagaagaagaugaagggguucuggauggagcuggugcugcagggcuucaugagcaaggagaaguacuuccggcucucccgcgagaacgacuucagcgagaacgagcuggucuccuucaucgagcgcgagaucagcgacaaccagcaguccggccggaugaucgccagcgugcugcaguacuacuuccccgaguccaagaucguguucgucaaggagaagcucaucagcagcuucaagcgcgacuuccaccugaucuccagcuacgggcacaaccaccuccaggccgccaaggacgcguacaucacgaucguggugggcaacgucuaccacaccaaguucaccauggacccggccaucuacuucaagaaccacaagcggaaggacuacgaccucaaccgccuguuccuggagaacaucucccgggacgggcagaucgccugggagagcggccccuacggcuccauccagaccgugcgcaaggaguacgcccagaaccacaucgccgugacgaagcgggucguggaggugaagggcggccucuucaagcagaugccccugaagaaggggcacggggaguacccccugaagaccaacgacccgcgcuucgggaacaucgcgcaguacggcggcuacaccaacgucaccgggagcuacuucgugcucguggaguccauggagaagggcaagaagcggaucagccuggaguacguccccguguaccugcacgagcgccucgaggacgaccccgggcacaagcugcugaaggaguaccucguggaccaccggaagcugaaccacccgaagauccugcucgccaagguccgcaagaacucccugcugaagaucgacggcuucuacuaccggcucaacgggcgcagcggcaacgcccugauccugaccaacgccguggagcucaucauggacgacuggcagacgaagaccgcgaacaagaucuccggcuacaugaagcggcgcgccaucgacaagaaggcccggguguaccagaacgaguuccacauccaggagcuggagcagcuguacgacuucuaccucgacaagcuggagaacggggucuacaagaaccgcaagaacaaccaggccgagcugauccacaacgagaaggagcaguucauggagcucaagaccgaggaccagugcgugcugcugaccgagaucaagaagcuguucgugugcagccccaugcaggccgaccugacgcugaucggcggguccaagcacaccggcaugaucgcgaugagcuccaacgucaccaaggccgacuucagcaucaucgccgaggacccccucgggcugcggaacaaggugaucuacucccacaugggcgagaaguga

SEQ ID NO: 1763 - RNA, 3939 nt, Artificial Sequence
  Cas9 variant
augcagaacggcuuccuggggaucaccgugagcuccgagcaggucggcugggccgugaccaaccccaaguacgagcucgagcgcgccagccggaaggaccuguggggcgugcgccuguucgacaaggcggagacggccgaggaccggcgcauguuccggaccaaccgccggcucaaccagcgcaagaagaaccggauccacuaccugcgcgacaucuuccacgaggaggucaaccagaaggacccgaacuucuuccagcagcuggacgaguccaacuucugcgaggacgaccggaccguggaguucaacuucgacaccaaccucuacaagaaccaguuccccacgguguaccaccuccgcaaguaccugauggagaccaaggacaagcccgacauccggcucgucuaccuggccuucagcaaguucaugaagaaccgcgggcacuuccuguacaaggggaaccucggcgaggugauggacuucgagaacuccaugaagggcuucugcgagagccuggagaaguucaacaucgacuuccccacccuguccgacgagcaggucaaggaggugcgggacauccucugcgaccacaagaucgccaagaccgugaagaagaagaacaucaucacgaucaccaaggucaagagcaagaccgccaaggcguggaucgggcuguucugcggcugcuccgugccggugaaggugcuguuccaggacaucgacgaggagaucgucaccgaccccgagaagaucagcuucgaggacgccuccuacgacgacuacaucgccaacaucgagaagggggugggcaucuacuacgaggccaucgugagcgcgaagaugcuguucgacugguccauccugaacgagauccugggggaccaccagcuccugagcgacgccaugaucgccgaguacaacaagcaccacgacgaccugaagcgccuccagaagaucaucaagggcacgggcucccgggagcuguaccaggacaucuucaucaacgacgucagcgggaacuacgugugcuacgugggccacgccaagaccauguccagcgccgaccagaagcaguucuacaccuuccugaagaaccgccucaagaacgucaacgggaucuccagcgaggacgcggaguggaucgacaccgagaucaagaacggcacgcugcugcccaagcagaccaagcgggacaacagcgugaucccccaccagcuccagcugcgcgaguucgagcugauccucgacaacaugcaggagauguacccguuccugaaggagaaccgggagaagcugcucaagaucuucaacuucgugauccccuacuacgucggcccccugaagggggugguccgcaagggcgaguccaccaacuggauggugcccaagaaggacggggugauccacccguggaacuucgacgagauggucgacaaggaggccagcgccgagugcuucaucucccgcaugaccggcaacugcagcuaccuguucaacgagaaggugcuccccaagaacucccugcuguacgagacguucgaggugcucaacgagcugaacccccugaagaucaacggggagagcaucuccgucgagcucaagcagcggaucuacgagcagcuguuccugaccggcaagaaggugaccaagaagucccucaccaaguaccugaucaagaacggcuacgacaaggacaucgagcugagcgggaucgacaacgaguuccacagcaaccugaagucccacaucgacuucgaggacuacgacaaccucagcgacgaggagguggagcagaucauccugcgcaucacggucuucgaggacaagcagcugcucaaggacuaccugaaccgggaguucgugaagcuguccgaggacgagcgcaagcagaucugcagccucuccuacaagggcugggggaaccugagcgagaugcugcucaacggcaucaccgugaccgacuccaacggggucgaggugagcgugauggacaugcuguggaacaccaaccugaaccucaugcagauccuguccaagaaguacggcuacaaggccgagaucgagcacuacaacaaggagcacgagaagacgaucuacaaccgggaggaccugauggacuaccucaacaucccgcccgcccagcgccggaaggucaaccagcugaucaccaucgucaagagccugaagaagaccuacggcgugcccaacaagaucuucuucaaggugagccgcgagcaccaggacgaccccaagcggaccuccagccgcaaggagcagcucaaguaccuguacaagucccucaagagcgaggacgagaagcaccugaugaaggagcuggacgagcugaacgggcacgagcucuccaacgacaagguguaccuguacuuccugcagaagggccggugcaucuacagcgggaagaagcucaaccugucccgccugcgcaagagcaacuaccagaacgacaucgacuacaucuacccccucuccgcggugaacgaccggagcaugaacaacaagguccugacgggcauccaggagaaccgggccgacaaguacaccuacuucccgguggaccccgagauccagaagaagaugaagggguucuggauggagcuggugcuccagggcuucauguccaaggagaaguacuuccgccugagccgggagaacgacuucuccgagaacgagcuggucagcuucaucgagcgcgagaucuccgacaaccagcagagcggccggaugaucgccuccgugcuccaguacuacuuccccgagagcaagaucguguucgucaaggagaagcugaucagcuccuucaagcgcgacuuccaccugaucagcuccuacgggcacaaccaccuccaggccgccaaggacgcguacaucaccaucguggugggcaacgucuaccacgccaaguucaccauggaccccgccaucuacuucaagaaccacaagcgcaaggacuacgaccugaaccggcuguuccucgagaacaucagccgcgacgggcagaucgccugggaguccggcccguacggcagcauccagacggugcggaaggaguacgcccagaaccacaucgcggugaccaagcgcgucguggaggugaagggcgggcuguucaagcagaugccccugaagaaggggcacggcgaguacccccucaagaccaacgacccccgguucgggaacaucgcccaguacggcggcuacaccaacgucaccggguccuacuucgugcugguggagagcauggagaagggcaagaagcgcaucucccuggaguacgucccgguguaccuccacgagcggcuggaggacgaccccgggcacaagcugcucaaggaguaccugguggaccaccgcaagcugaaccaccccaagauccuccuggccaagguccggaagaacagccugcucaagaucgacggcuucuacuaccgccugaacgggcgguccggcaacgcccugauccucacgaacgcgguggagcugaucauggacgacuggcagaccaagaccgccaacaagaucagcggcuacaugaagcgccgggccaucgacaagaaggcccgcguguaccagaacgaguuccacauccaggagcuggagcagcucuacgacuucuaccuggacaagcuggagaacggggucuacaagaaccggaagaacaaccaggccgagcucauccacaacgagaaggagcaguucauggagcugaagaccgaggaccagugcgugcugcucacggagaucaagaagcuguucgugugcuccccgaugcaggcggaccugacccucaucggcgggagcaagcacaccggcaugaucgccauguccagcaacgucaccaaggccgacuucgccgugaucgccgaggacccccuggggcugcgcaacaaggugaucuacucccacaugggcgagaaguga

SEQ ID NO: 1764 - RNA, 3942 nt, Artificial Sequence
  Cas9 variant
augcacuaccuggacgagaucuucgcgccccaccuccaggagguggacgagaacuuccugcgccggcugaagcagagcaacauccacccggaggaccccgccaagaaccaggccuucaucggcaagcuccuguuccccgaccugcucaagaagaacgagcgcggguaccccacccugaucaagaugcgggacgagcugccggucgagcagcgcgcccacuaccccgugaccaacaucuacaagcuccgggaggccaugaucaacgaggaccgccaguucgaccugcgggagguguaccuggccguccaccacaucaugaaguaccgcggccacuuccucaacaacgccuccguggacaaguucaagguggggcggaucgacuucuacaagagcuucaacguccugaacgaggcguacgaggagcugcagaacggcgagggguccuucacgaucgagcccagcaagguggagaagaucggccagcuccugcuggacaccaagaugcgcaagcucaaccggcagaaggccguggccaagcugcuggaggucaagguggccgacaaggaggagaccaagcgcaacaagcagaucgcgaccgccauguccaagcucgugcugggcuacaaggccgacuucgccacggucgccauggcgaacgggaacgaguggaagaucgaccugagcuccgagaccagcgaggacgagaucgagaaguuccgggaggagcucuccgacgcccagaacgacauccugaccgagaucaccagccuguucucccagaucaugcucaacgagaucgugcccaacggcaugagcaucuccgagagcaugauggaccgcuacuggacgcacgagcggcagcuggccgaggugaaggaguaccuggccacccagccggccuccgcgcgcaaggaguucgaccaggucuacaacaaguacaucgggcaggcccccaaggagcggggcuucgaccucgagaaggggcugaagaagauccugagcaagaaggagaacuggaaggagaucgacgagcuccugaaggccggcgacuuccugcccaagcagcgcaccuccgccaacggcgugaucccccaccagaugcaccagcaggagcucgaccggaucaucgagaagcaggccaaguacuacccguggcuggcgaccgagaaccccgccacgggggagcgcgaccggcaccaggccaaguacgagcuggaccagcucgugagcuuccgcauccccuacuacgucggcccccuggugaccccggaggugcagaaggccaccuccggggccaaguucgcgugggccaagcgcaaggaggacggcgagaucacccccuggaaccugugggacaagaucgaccgggccgagagcgccgaggcguucaucaagcgcaugacggucaaggacaccuaccuccugaacgaggacgugcugcccgccaacagccuccuguaccagaaguacaacgugcugaacgagcucaacaacguccgggugaacggccgccggcuguccgucgggaucaagcaggacaucuacaccgagcuguucaagaagaagaagaccgugaaggugagcgacgucgccucccuggugauggccaagacgcgcggcgugaacaagcccagcgucgaggggcucuccgacccgaagaaguucaacagcaaccuggccaccuaccuggaccucaaguccaucgugggcgacaagguggacgacaaccgguaccagaccgaccuggagaacaucaucgaguggcgcagcgucuucgaggacggggagaucuucgcggacaagcugaccgagguggaguggcucacggaccagcagcgguccgcccuggugaagaagcgcuacaagggcuggggccggcugagcaagaagcuccugaccgggaucgucgacgagaacggccagcgcaucaucgaccugauguggaacaccgaccagaacuucaugcagaucgugaaccagcccguguucaaggagcagaucgaccagcucaaccagaaggccaucaccaacgacgggaugacgcugcgggagugggucgaguccgugcuggacggcgccuacaccagcccccagaacaagaaggccaucuggcaggucgugcgcgugguggaggacaucgucaaggcgguggggaacgcccccaaguccaucagcaucgaguucgcccggaacgagggcaacaagggcgagaucacccgcucccggcgcacccagcuccagaagcuguucgaggaccaggcccacgagcuggugaaggacacgagccucaccgaggagcuggagaaggccccggaccuguccgaccgguacuaccucuacuucacccagggcgggaaggacauguacaccggggaccccaucaacuucgacgagaucagcacgaaguacgacaucgaccacauccugccccaguccuucgucaaggacgacagccuggacaaccgcgugcucgugagccgcgcggagaacaacaagaaguccgaccggguccccgccaagcuguacgccgccaagaugaagccguacuggaaccagcugcucaagcagggccugaucacccagcgcaaguucgagaaccugaccauggacguggaccagaacaucaaguaccggagccucggguucgugaagcgccagcuggucgagacccgccaggugaucaagcugaccgcgaacauccucggcuccauguaccaggaggccggcacggacaucaucgagacccgggccgggcugaccaagcagcugcgggaggaguucgaccuccccaaggugcgcgaggucaacgacuaccaccacgccguggacgccuaccugaccacguucgcgggccaguaccugaaccggcgcuaccccaagcuccggagcuucuucguguacggggaguacaugaaguucaagcacggcuccgaccugaagcugcgcaacuucaacuucuuccacgagcucauggagggcgacaagagccaggggaaggucguggaccagcagaccggcgagcugaucaccacccgggacgagguggccaaguccuucgaccgccugcucaacaugaaguacaugcuggucagcaaggaggugcacgaccgguccgaccagcuguacggggccacgaucgugaccgccaaggagagcggcaagcucaccuccccgaucgagaucaagaagaagcgccccgucgaccuguacggggccuacaccaacggcacgagcgcguucaugaccaucaucaaguucaccggcaacaagcccaaguacaaggugaucggggugcccaccacguccgccgucggccugaagcggguggggaagccgggcagcgaguccuacaaccaggagcuccaccgcaucaucaagagcaaccccaaggugaagaaggacuucgagaucgucgugccccacguguccuacagccagcugaucgucgacgacgacugcaaguucacccuggccagcgacaccuaccagcaccccgccacccagcucgugcuguccaaggagagcauggagaucaucgccgacgacuucaaguucgucaaggagaacacggcgaccgccgacgagcagcuggugcggguguucgacgagaucgucaaccagaugaaccacuacuucaccaucuucgaccagcgcuccaaccggcagaaggugaccaaggcccgcgacaaguucgugagccucccgacggaguccgaguacgagggggccaagaagacccaggucggcaagaccgaggugaucaccaaccugcugaugggccuccacgcgaacagcgcccagggggaccugaaggugcugggccucuccacguucggguucuuccagagcuccggcgggcugaaccugagcgaggacgccaugaucgucuaccagucccccaccggccucuucgagcgccggaucugccugaaggacaucuga

SEQ ID NO: 1765 - RNA, 3942 nt, Artificial Sequence
  Cas9 variant
augagcuucaaggagaacuccaagaucuacuacggccuggacaucgggaccgacagcgugggcugguccaccacgaacgagaaguacgagcuccugcgcuacaagaacaaccugauguggggcgucagccucuucgaggccgccucccuggcggaggagcggcgcgggcaccggacccagcgccggcgcuacgaccggcgccagcagcggguggcccugcucggggagcuguucgccaaggagauccugaagaccgaccccgacuucuuccuccgccugaaggagagcucccuguacccggaggaccggaccagcaagaacgugaacacguacuucgacgacgccgacuucaaggacuccgacuacuucaagauguaccccaccguccaccaccucaucaaggagcugagcgaguccaacaagccccacgacgugcgccugguguaccucgccugcgcguucaucgucgcccaccggggccacuuccugaacggcgccgacgagaacaacgugcaggccgugcuggacuucgacagcuccuacugcgaguucaccgacugguucaagagcaacgacaucgaggacaaccccuucuccgagagcgucaagaacgaguucuccgugauccuccgcaagaagaucgggaucaccgcgaaggagcgggagaucaagaaccugcuguucggcacgaccaagaccccggacugcuacaaggacgaggaguaccccaucgacaucgacgugcucaucaaguucaucagcgggggcaagaccaaccuggccaagcuguuccgcaaccccuccuacgacgagcucgacauccagacggucgagguggggaaggccgacuucgccgacaccaucgaccugcuggccagcagcauggaggacaccgacgugccccuccuguccgcggucaaggccauguacgacuggagccugcucaucgacgugcugaagggccagaagaccaucuccgacgccaaggugugcgaguacgagcagcacaagagcgaccugaaggcccucaaguacaucguccggaaguaccuggaccgcgcccaguacgacgagaucuuccggacggcgggcgagaagccgaacuacguguccuacagcuacaacgugaccgacgucaagcugaagcagcuccccuccaacuucaagaagaagaacagcgaggaguucugcaaguacaucaaguccaagcuggagaagaucaagcccgagagcgacgacgaggccguguacaacgagcugaucgagaagugcaacuccaagacccucugccccaagcaggucaccgacgagaaccgcgugaucccguaccagcuguacuaccacgagcugagcaugauccucgacaaggccuccgccuaccuggacuuccugaacaagacggaggacgggaucagcgugaagcagaagauccucacccugaugaaguuccggauccccuacuucgucggcccccuggugaagcgcaacgagaccgacaacguguggaucguccgcaaggccgaggggcggaucuaccccuggaacuucgagaacaugguggacuucgacaaguccgaggacggcuucauccgccggaugaccugcaagugcacguaccucgcgggcgaggacgugcugccgaaguacagccugcuguacuccaaguacaccguccucaacgagaucaacaacaucaaggugaacggggagaagaucagccccgagcugaagcaggacaucuucaacgagcuguucaugaagaccucccgcgugaccgucaagaagaucacggagcuccugaagcggaagggcgccuucagcgaggagaagggggacagccuguccggcguggacaucaacaucaagagcucccucaagagcuaccuggacuuccgccggcugcucgagaacgggucccugagcgagaacgacguggagcgcaucaucgagcggaucaccgucaccaccgacaagccccgccugguguccuggcucaaggccgaguacagcgaccugcccgccgaggacauccgguacaucucccgccugagcuacaaggacuacggccggcucuccgccaagcugcugacgggcugcuacgagcucgacaccaacaccggggagaucggcgggcgcagcaucaucgacuucaugugggcggagaacaucaaccugaugcagauccuguccgacagcuacggcuacaaguccuucaucgaggaggagaacaagaaguacuacaugaucaacccgaccgggagcaucgcccagacgcuccgggagauguacgugucccccagcgucagccgcgccaucauccggaccauggagaucgugaaggagcugcgcaagaucaccaagaaggaccccgacaagaucuucguggagauggcccggggcggcaagcccgaggagaaggggaagcgcaccuccagccgccgggagcagaucgagaagcuguacgacuccgcgaaggccuucgucagcgacgaggacaucucccacaugcgcagccagcucggcucccugagcgacgagcagcugcggcgcgagaaguacuaccucuacuucauccaguucgggaagugcauguacuccggcgaggccaucgacuucagccggcugggggacaaccacugcuacgacaucgaccacaucuucccgcaguccaagaucaacgacgacagccugcacaacaaggugcucgugaagucccagcugaacggcgagaaguccgacgacuaccccaucaaggccgagauccgcaacaagaugcacccccuguggaagaaccucuucuaccgggaccccaagaacccggccgacaaggucaaguacgagcgccugacccggagcacgcccuucaccgaggacgagcuggcgggcuucaucgagcgccagcucguggagacccggcagagcaccaaggccguggccacgcugcugaaggagauguuccccgacuccaagaucgucuacgugaaggccggccaggugagcgaguuccgccacgacuucgacaugcucaagugccgggagaucaacgaccugcaccacgccaaggacgcguaccugaacaucgucaucgggaacgugcacgacgugaaguucaccuccaacccgaugaacuucgucaagaacgccgacaagcacuacaccaucaaggugaaggagacccucaagcacaaggugagccgcaacggggagacggccuggaaccccgagaccgacuucgacaccgucaagcggaugaugagcaagaacuccgugcgcuacgugcgguacugcuacaagcgcaagggcggcuucuucaaccagaaccccgaccgggccgggaaccccgaccuggcccgccugaagaaggaccucgacccggucaaguacggcggguacaacagcaaguccaucagcugcuucucccugaucaagugcaccggcgugggggcggugaucauccccgucgagcugcucugcgagaagcgguacuucagcgacgacuccuucgccagcgaguacgccuacuccgugcugaagaacgcccugcccgcgaagaacaucgccaagaucagcaucgacgacaucuccuucccccucaagcgccgcccgaucaagaucaacacgcuguucgaguucgacggcuaccgggugaacauccgcagcaaggacuccuaccacuacuucaccaucagcuccgccauggccgccaucuacagcaaggacaccuccgacuacaucaaggcggucagcuccuacaucgacaagagcgacaagggcagcaaguucaagcccggggaggccuucgacgugcuguccaaccucaagguguacgacgagaucgccaagaagugcaucagcgagcccuucuccaagaucagcaagcuggccgaggccggcaagcgguggaagaaggaggagaucucccugcagaacugccuccuguga

SEQ ID NO: 1766 - RNA, 3945 nt, Artificial Sequence
  Cas9 variant
augcugaagaaggacuacagcaucggccucgacaucgggaccaacuccgugggccacgccgucgugaccgacgacuacaaggugcccacgaagaagaugaaggucuucggggacaccagcaagaagaccaucaagaagaacaugcugggcgugcuccucuucaacgaggggcagaccgccgcggacacgcgccugaagcggggcgcccgccggcgcuacacccggcgcaagaaccggcugcgcuaccuccaggagaucuucgccccggcccuggccaagguggaccccaacuucuucuaccggcuggaggaguccagccucgucgcggaggacaagaaguacgacguguaccccaucuucggcaagcgcgaggaggagcugcuguaccacgacacccacaagaccaucuaccaccuccgguccgagcuggccaacaacgaccgccccgccgaccugcggcucguguaccuggcccuggcgcacaucaucaaguaccgcgggaacuuccuccuggagggcgagaucgaccugcggacgaccgacaucaacaaggucuucgccgaguucagcgagacccucaacgagaacuccgacgagaaccuggggaagcuggacguggccgacaucuucaaggacaacaccuucagcaagacgaagaaguccgaggagcuccugaagcugagcggcgccaagaagaaccagcucgcccaccagcuguucaagaugaugguggggaacaugggcuccuucaagaagguccugggcaccgacgaggagcacaagcucagcuucgggaaggacaccuacgaggacgaccugaacgaccugcucgcggaggccggcgaccaguaccuggacaucuucguggccgccaagaagguguacgacgccgcgauccuggccuccauccucgacgucaaggacacccagacgaagaccguguucagccaggccaugaucgagcgcuacgaggagcaccagaaggaccugaucgagcugaagcggguguucaagaaguaccucccggagaagugccacgacuucuucuccgagcccaagaucagcggguacgccggcuacaucgacggcaaggucuccgaggaggacuucuacaaguacaccaagaagacccugaaggggauccccgagacggaggagauccugcagaagaucgacgccaacaacuaccuccgcaagcagcggaccuucgacaacggcgcgaucccccaccaggugcaccugaaggagcugguggccaucgucgagaaccaggggaaguacuacccguuccuccgcgagaacaaggacaaguucgagaagauccugaacuuccggauccccuacuacgugggcccccuggcccgcgggaacagcaaguucgccuggcucacccgcgccggcgagggcaagaucacccccuacaacuucgacgagaugaucgacaaggagacguccgcggaggacuucaucaagcggaugaccaucaacgaccuguaccugccgaccgagcccgugcugcccaagcacagccuccuguacgagcgcuacaccaucuucaacgagcuggccgggguccgguacgugacggagaacggcgaggccaaguacuucgacgcccagaccaagcgcagcaucuucgagcuguucaagcuggaccggaaggucuccgagaagauggugaucaagcaccugaagguggucaugcccgcgauccgcauccaggcccucaaggggcuggacaacggcaaguucaacgccagcuacgggaccuacaaggaccugguggacaugggcguggccccggagcuccugaacgacgaggucaacuccgagaagugggaggacaucaucaagacccugacgaucuucgagggccggaagcucaucaagcgccggcuggagaacuaccgcgacuuccugggggaggacauccuccggaagcugagccgcaagaaguacaccggcugggggcggcuguccgccaagcuccuggacggcaucuacgacaagaagacccacaagaccauccuggacugccucaugacggaggacuacagccagaacuucaugcagcugaucaacgacgacaccuacuccuucaaggagaccaucaagaacgcccaggugaucgagaaggaggagacccuggccaagaccgugcaggagcuccccgggagccccgccaucaagaagggcauccugcagucccuggagaucgucgacgagaucaucaaggugaugggcuacaagcccaagagcaucguggucgagauggcccgcgagacgcagaagacccacgggacccggaagcgcgaggaccgggugcagcagaucgugaagaaccucaaggacgccaacgagcugccgaagaagcugcccuccaacgcggagcucagcgacgagcgcaaguaccuguacugccugcagaacggccgggacauguacaccggggcgccccucgacuacgaccaccuccaguucuacgacgucgaccacaucaucccccaguccuuccugaaggacgacagcaucgagaacaaggugcugacgaucaagaaggagaacgugcgcaagaccaacggccugccguccgaggccgucauccagaagaugggcagcuucuggaagaagcugcucgacgccggggccaugaccaacaagaaguacgacaaccugcgccggaaccugcacggcgggcucaacgagaagcugaaggagcgcuucaucgagcggcagcugguggagacccgccagaucacgaaguacguggcgcagcuccuggaccagcggcugaacuacgacggcaacggggucgagcucgacgagaagaucgccaucgugacccugaaggcccagcuggccucccaguuccgcagcgaguucaagcuccggaaggugcgcgcgcugaacaaccugcaccacgcccacgacgccuaccucaacgccgucguggccaaccugaucauggcgaaguaccccgagcuggagcccgaguucguguacggcaaguaccggaagaccaaguucaagggccucgggaaggccaccgccaagaacacgcuguacgccaacguccuguacuuccucaaggagaacgagguguaccccuucugggacaaggcccgcgaccugccgaccaucaagcgguaccuguaccgcgcccaggugaacaagguccggaaggcggagcgccagaccggcggguucuccgacgagaugcucgugcccaagagcgacagcggcaagcugcugccccggaaggaggggcucgacccggugaaguacggcggcuacgccaaggccgucgaguccuacgccgugcugaucaccgcggacgaggugaagaaggggaagacgaagaaggucaagacccuggugaacauccccaucaucgacagcaagaaguacgaggccgaccccaccgccuaccucgccucccgcggcuacaccaacgugacgaacagcuucauccugcccaaguacucccugcucgaggacccggaggggcggcgccgguaccuggcgagcuucaaggaguuccagaaggccaacgagcugauccucccccagcaccuggucgagcugcucuacugggugaacgccaaggacggcgagcagaagcuggaggaccacaaggccgaguucaaggagcuguucgacaagaucauggaguucgccgacaaguacguggucgcgcccaagaacuccgagaagauccgccggcucuacgaggagaaccaggacgccacccccauggagcuggggaagaacuucguggagcugcuccgcuacaccgccgacggcgccgccagcgacuucaaguucuucggcgagaacaucccgcgcaagcgguacaacuccgcggggagccugcugaacggcacccucaucuaccaguccaagacggggcuguacgagacccgcaucgaccugggcaagcucuga

SEQ ID NO: 1767 - RNA, 3948 nt, Artificial Sequence
  Cas9 variant
augggcuacagcguggggcuggacaucggcaccggguccgucggcuggguggugaccaacgaggacgggaagcucgcccgcgccaagggcaagaaccugaucggcguccggcuguucaagacggcggagcccgccgccgaccgccggaccaaccgcaccacccggcgccggcucagccgccggaaguggcgccugcggcugcucgacgagcuguucgccaacgagcuggggaagaucgacuccaacuuccucacgcgccugaaguacagcuacgugcacccgaaggacgacgccaaccgggcgaacuacuacggcggguaccuguuccccacccaggaggagaccaagaaguuccacgccaaguaccccaccaucuaccaccuccgccuggcccugaugacggagucccggcaguucgaccuccgcgagaucuaccuggccaugcaccagaucgugaaguaccggggccacuuccugaacagccaguccaagaugaccaucgggaacaccuacaacccccaggaccuccagaccgcgauggagaacuacgccgaggccaagggccugagcaucgagcugaagcagccggaggagauggucgccauccucacgggcgaggccggguucggccuguccaagaaggcgaaggccgagaagcugcucaacaacuucuucuucgacaccaaggaggagaaggccaccgugcaggccauccuggccgggaucgugggcaacaccaucgacuucacgaaggucuucaaccgccagcugaccggcgacacccucaaggcguggaagcugaagcuggacagcgagaccuucgacguggacuccgagcccauccucagcgaccuggacgacgacgagacggagcuguucuucgccauccggcaggccuucgacggguucacccucaugaaccugcugggcgaccagaccuccaucagcgccgccaugguggagcgcuacacccagcaccacgacgaccuccugacggucaagcaggucgcgaagaagcaggggcugucccacaaggaguucagcaacaucuacuccgccuuccucaaggacgacaccgacaagggcaugaagaagcugcuggaggagagcaaccucuccaccgaggacgugaacgggauccagcugcggauggacagccacgacuuccugccccagcagcgcaccaaggccaacagcgugaucccccaccagcuccaccuggccgagcuggaggccaucaucgagaaccagggccaguacuacccguuccuccuggagacguucgagaaggagggcaccgcggccaacaagaucgccgagcugcugaaguuccgcauccccuacuacguggggcccauggugaccaagaaggacgucgagaacgccggcggggacgcgaccaaccacugggugacgcggaacgagggcuacgagaaguccgccgugaccgccuggaacuucgaccaggucuucaaccgcgaccaggccgcccucgacuucauccagcggcugaccgggaccgacacguaccugaucggcgagcccacccucccgcagaacagccugaaguaccagauguucaccgugcugaacgagcucaacaacgugaaggucaacggccgccggaucgacaaccagaccaagcacgaccugauccaggaccuguucaaguccaagaagaccgugagccucaaggcguuccaggacuacuaccagucccagggcaagagcgacauccaggucguggggcuggccgacaagacgaaguucaacuccaaccugagcaccuacaucgaccucuccaagaccuucagcgccgaggagauggagaacccccagaaccaggaccugcuggagcagaucguggagauccagaccgucuucgaggacuccaagaucgccgagcgcgagcucagcaagcuggagcugacgcccgagcaggucaccaagcucgccaagacccacuacaccggguggggcaaccuguccaacaagcugcucacgacccccaucguggacgugagcgggaagaagguguccauccuggaccagcuggcgaagaccagcaagaacuucauguccaucaucagcaacgagcaguacggcgugcaggacuggaucaaggagcagaacaccacggagaccaccggcacccucgaggacaagcuggccgaccugacgaccuccccggccaacaagcgggggaucaagcaggccuucaacguccucuucgacauccagaaggccaugaaguccgagcccgaccgcguguaccuggaguucgcgcgggagacccagaccagcgugcgcacgaugagccgguacaacuaccugaagggccucuaccagagcaagucccuggacgccgaggccaagaaccugaagaaggagcucgccgagaccgaccagaagaaguucgacaacgaccgccuguaccuguacuuccagcagcaggggaaggacauguacaccggccagcccaucaacaucgacaagcucagcuccgacuacgacaucgaccacaucaucccccaggcguucaccaaggacgacagcaucgacaaccggguccuggugucccgcccggagaacgcccgcaagagcgacuccggcacguacaccaccgaggugcaggccgccgccagcgggcuguggaagacccucguccaguccggcuucaucagccggaagaaguacgaccggcugacgcacgcgggggacuacuccgagggccagaagaccggguucaucgcccgccagcugguggagacccggcagaucaucaagaacguggccgcccucaucgagagcgaguucgaccagacccaggccgucgcgauccgcgccgagaucacgggcgacaugcgccggcugguggccaucaagaagcaccgcgagaucaacuccuuccaccacgccuucgacgcccugcucaucaccgcggccggccaguacaugcagaagcgguaccccgaccgcgacagcaacaacguguacaacgaguucgaccgguacaccaacgacuaccugaagaagcugcgcgaguccagcagcaaggacgagguccggaagcucaagcccuucggguucaucgugggcaccauggccaaggggaacgaggacuggacgaccgagcagaccgaguaccugcgccacaucaugaacuucaagaacauccugaccaccuacaagacgggccccgaccgggggccgcucuccaaggagaccaucuacgccguggaccccaaggcgaagcugaucggcaccaacaagcaccgccaggacgucagccuguacggcggguacaccuaccccuacuccgccuacaugacgcucgugcgggccaacggcaagaaccagcuggugaaggucagccgcuccgccgccagccugaugaaguccgggcagcucaagcuggaggacuacgugcagcagcagcccgaggugaagaaguucgagaagauccugcucgagcaccucccgcugggccagcuggucgacaacgacgggaagcugauguaccugaccagcuacgaguucuaccacaacgcgaagcagcucuggcuguccaccgagaacgccgaccugaucagcucccucagcaucgacuccgacgaccagaagcugaucaaggccuucgacauccugaccgccgacagcgugaucgagcgguuccccuucuacgagaucgaccucaagaagcugaucgagcugcgcgacaaguucgugcucaucgacaacaagcuggacguccugcggguggugcucaaggcccugcagcuggacuccgcgcagcagaagccccucaagcugaucgacaaggccgccacggacuggaagaacuaccgccaggccggcggcaucaagcugagcgacaacgccgagaucaucuaccaguccaccaccgggaucuucgagaagcggaucaagaucagcgaccuccuguga

SEQ ID NO: 1768 - RNA, 3951 nt, Artificial Sequence
  Cas9 variant
augcugcagaagaacuacaccaucggccucgacaucgggaccaacagcgugggcuacgccgucaucaacgacaacuacaaggugcccgccaagaagaugaaggugcuggggaacacggacaagaagaccaucaagaagaaccugaugggcguccuccuguucgacgcgggggagaccgccgccaccacgcgccugaagcggggcacccgccggcgcuacacccggcgccggaaccgccuccgguaccugcaggagauccugggcccggagcucgccaagguggacgccaacuuccugcaccgccuggcggaguccagccucgugaccgaggacaaggaguucuccgccuaccccaucuucggggaccgggaggaggagcugcuguaccacaagacguacaagaccaucuaccaccuccgcagcgcccuggccaacaaggacgagaaggcggaccugcggcucaucuaccuggcccuggcccacaucaucaaguaccgcggcaacuuccucaucgagggggagaucgagcuguccgacaccgacaucgacaaggucuacgccgacuucugccggagcuucaacgagcuguucgacaccgaggugcuccaggagaucgagguggaggccaucuucaaggacaagacgcuguccaagaccaagaaggcggaggagcuggucaaggugagcggcgugaagaagaaccaggucgcccaccaguuccucaagaugaugguggggaacaccgugaacuucaagaaggucuucaaccugaccgaggaccagaagcuguccuucggcacggacagcuacgaggacgagcucaacgaccugcuggccaaguccgacgaccgcuaccucgacguguucguggccgccaagaaggucuacgacaccgcgauccuggccaacauccugaacaccaagaacagcguggccaccaagacgaucuucucccagagcaugaucgagcgguucaaggaccaccagaaggaccucaaggagcugaagcagcuguucaagaccuaccuccccgagaaguaccccgacuucuucggcaacuccaaggaggacggguacgccggcuacaucgaggggaagaccaacgaggagaaguucuacacccacacgaagaagauccugaagaacaucccgcaggccgcgagcgugcuggcccagaucgacgucggcaacuaccuccgcaagcagcggaccuucgacaacggcgugaucccccaccagauccagcugaaggagcugcucgccaucaucgagaaccaggggaaguacuaccccuuccugcuggagaacaaggagaagaucgccaagauccucaccuuccgcauccccuacuacgugggcccgcuggcccgggggaacucccgcuucgcguggcugaagcgcgucggcaaggagaagaucacccccuucaacuucgagaacguggucgaccuggagagcuccgccgagcgguucaucgagcgcaugacgcucaacgaccuguaccugcccgaggagaaggugcuccccaagcacagcaugcuguacgagaaguucagcaucuucaacgagcuggccgggauccgguacaucaccgacaacggcgagaugaaguuccucgacgcccagaccaagcaguccaucuucgagcuguucaagcaggagcgcaccgugaaggagaagaagguccuggaccuccugaagacgcugaugccgagcgagcgggugguggcgaucaagggcaucgacaacgggaaguucaacgccuccuucggcaccuaccacgaccucagcaagaugggguucaagaccgagaagaucgccuccgagagcaaccaggcccgcugggaggagaucaucaagacccugacgaucuucgaggaccggaagcugaucaagucccgccuccggaaguacgacgacuuccugaacgagaaggagaucggcgcccugagcaagcgcaaguacaccggguggggccggcucuccgcgaagcugaucgacggcaucuacgacaagaagacccaccagaccauccuggacuuccucaugaacgaggacuacaaccagaacuucaugcagcugaucagcaacgacaacuacuccuucaagaagaucaucgaggacagccaggucaucaaggaggaggggucccugaccgaggugauccaggagcuccccggcagccccgccaucaagaaggggauccugcaguccaucgagaucguggacgagcuggucaaggugaugggcgggaaccccaagaagaucguggucgagauggcccgcgagacgcagaagacccacggcaccacccggcgcgaggcccggaucaaggagaucaucaagaaccucaacaagcugaagcugaacgagcucccgaaggaccugcccagcaacgaggagcuguccgacgagaagguguaccucuacugccugcagaacggccgcgacauguacacgggggcgccccuggaccucgacaaccugagccaguacgagguggaccacaucaucccccaguccuuccugaaggacgacagcaucgagaacaagguccucaccgccaagaucgagaacagccggaagaccaacggccugccguccguggagaucgccaagaagaugggggccuucuggcgcagccugcucaaggugggcgccaucuccgagaagaaguaccggaaccugcgccgcagccugcacggcgggaugaccgagaagcucaaggagacguucgucaagcggcagcugguggagacccgccagaucaccaaguacguggcccagauccugaacucccgguucaacgaggagaagaacgaggacaaggucgcgaucgugacccucaaggcccagcugacgagccaguuccgcaaggacuucgagcuguacaaggugcgggagaucaacaaccuccaccacgcccacgacgccuaccugaacgcgguccuggccacccuccugaugaccuccuuccccgagcuggagcccgaguucguguacggcaaguaccgcaagaccaaguucaaggggcucggcaaggccacggccaagaacaaccuguacaccaacauccugcagcuccugaaggaggagagcgcccaguacugggacaccaaggagcgggaccuggcgaccaucaagaagaacguguaccaggcccaggucaacaaggugcgcaagguggagcggcagacgggguccuucuacgacgagaccgucgccaagaaguccgccagccagaagcuguucccccgcaagaacggccuggacccggugaaguacggcggguaccagcgggccaacgagggcuacagccuccucuuccgcgcggacaugcugaacaagcgggggaagaccaaguccgugaagacccuggucaagauccccaucaucgagagcgcccaguaccucgccgaccccacggaguaccuggccaagcgcggcuacuacaacguguccgagcacagccugcuccugcccaaguucucccugcucgagaacaacaacgggcugcggcgcuaccuggccagcagcaacgaguuccagaaggcgaacgagcucauccugccgaagcaccuggugcggcuccuguacuggucccagagcaagcagcgcaaggaggagcugaacaagcaccgggccgaguucgccgagcuguucaccuacaucauggacuucgccgacaaguacgucguggcgcccaagaacuccgagaagaucaagaacaucuacgagaacaacaaggacagcuccguggagguccucggcaagaacuucaucgagcugcucaaguacaccgccgacggcgccgccagcgacuucaccuucuucgacacgaagaucccccgcaagcgguacaacuccgccggggaccugcuggacggcacccucaucuaccagagcaagaccgggcuguacgagacccgcaucgaccugggcgcgaucuga

SEQ ID NO: 1769 - RNA, 3957 nt, Artificial Sequence
  Cas9 variant
augaugaucaagcugaacaacaugaagaagauccucggccuggaccuggggaccaacagcaucggcugggccguggucgagaccgaggacaacaagaaguucgagcuccuggacaagggggugcgcaucuuccaggagggcgugaagaucgagaaggggaucgaguccagcaaggccgcggagcggacgggcuaccgcuccgcccggcgcaucaaguuccggcgccggcugcgcaagaucgagacccucaagguccugaucgagaacaacaugugcccccugagcauggacgagcucaucguguggaaggagaacaagaacaacuacccgaagaacaagaucuucuacaacuggcugaagaccaaggaccccaaggagggcaccaacgggacguacaucaaccccuacuacuuccggaccgaggccaucaagcgcaagcuggagaacaccaacgacgugggccgggcccucuaccaccuggcccagcgccggggguucaaguccaaccgccuggagagcaccgacgagaagucccggggcaucgucaagacggagaucaacaagcucagcuccgagcugaacgggcgcuaccugggcgaguacuucuacgagcucuaccugaagggcgagaagauccggaagcgccacaucagccgggaggagcacuaccugaacgaguucaagaagaucugcgaggugcagaacuucaacaaggagcucgcggagaagcuggagcgcgccaucuucuaccagcggccccugaagucccagaaggggcucgugggcaagugcacccugcagaacaacaagcaccgcugcccgaucagccgccccgaguucgaggaguuccggauguggcaguucaucaacuccaucaaguacaagaacagcgacgggaaguucgacuuccugaacaaggagcagcgcgagaacaucauccccgccuucgucuccaacaagaacgccaccuucgaguucagcaagaucgagaagauccucaacaagggcgugcacaucuaccaguucaacuacaaguccaaccacaccaucggcagcaaccagacgaugaucaacuucauggacguguucgacaucgaccggaagcugaccaacgcguggcugcucugcgucaacaagaucuacgagcuguacaccgccaagaccaagaaggacgggucccucaagagcaagagcgaggugaucacggacguguggcacguccuguucaccuucgacaacgaggagaaccugaaggaguucgcccgcaacaagcugcuccuggacgaguccagcgcccagaaguucuccaagaucaaccugaagcaggacuacagccagcucucccugaaggccaucaacaagauccugcccuaccuccaggagggccugaucuacagcuacgcgguguucaucgccaacaucgagaacgugaucgggaaguccaucuggaacaucaaggagaaccagcagaucauccggaccagcaucaagaagaucaucgacaaccacaagaccgagcuggacaucaacacgaucaccaacucccucaucaacgacuucaaggucaacuacaacaacgcccacaaggaguacaagguggacgacaucgaccugaagaacauccgcgagaagaucaucaaguacuacggcaacaagaccuggaacugccugccggaggacgagaagcucuacgugaaggagaaggucgagaagcuguacgagaagcagcucaagagcgggaagcggggcaucuucaucgagaagauccgccuggacgaccggaucgagaacuuccugaaggacaacuucgacuccagcgagcugaaccugaagaagcucuaccaccccuccgacgugagcguguacaaguccgucaagaucaccgaccugggccugcgccuccuggggagccccaugauccccuccaucaagaacccgauggccaugcgggccaugcaccagcugcgcaagcucaucaaccaccugaucaucgagggcgugaucgacgacagcacgaucaucaacgucgagaugucccgggagcugaacgacgcgaacaugcgcaaggccaucgagcgguaccagcgccagcgggccaccgagaacgaggaguucaagaccaagaucaaggagcucuacaagaaggagugcgggaccgacuucgagcccaacaacgacgacaucaugaaguaccgccugugggaggagcagaaccacaagugccuguacacgggcaagagcaucgggaucugcgacuucaucggcagcaaccccgccuucgagaucgagcacaccaucccccggucccucagcuacgacaacucccuggagaacaagacccugugcgagaaggaguucaaccagcaggucaagaagaaccgcaucccguucgagcucagcaacuacaaggagaucaucucccgcaucaacaacugggagaucaaggccgaggagcuguucaagcagauccagaaggugaagauccagagccggauggcggccaccaaggagaucaaggacaacgccauccagcgcaagcaccuccugcagauggaguucaacuacuggaacggcaagcugucccgguucacgcgcgaggacgugcccgagggguucaagaacagccagcugguggacaucggcaucaucaccaaguacgcccgggccuaccucaagaccguguucaacaacgucaacaccgugaagggguccacgguggcggaguuccgcaacaucuggggccugcaggaguacuucgagaagaaggaccggagcaaccacauccaccacugcaucgacgccaucaccaucgccugccugaccaaggacaaguacgacuuccucgcccaccuguaccaccuggacgagcagaacaaccgcgacgcgguccaccgggccaugaucaaguccaagcccugggagaacuucgugcaggacgugaaggagaucgagaaccagauccucgucagccacuacacccccgacaaccugccgaagcaguccaagaagauccugcgcaagcgggggaagauccagaagaacgagaacggcgaccucaucuacgagaagggcgacgccgugcgcgggagccugcacaaggaguccuucuacggcgccaucaagcgggagaucaucaacaagaagggggagaccgaggagaaggugcuguacgucaagcgcaagccccucgaguucagcgaccugggcuucaagacgaucuccgagcuggagaacaucguggacgacgccgugcgggacaagguccucaacgcggugaaggacaagggccugaagcaggcccugaacgagcccaucuggaugaacgaggagaagcagauccccaucaagaaggugcgcugcuacaccccgagcgucaccaaccccaucaaccucaagaagcaccgggacaagagcaagcacgaguacaagcaguccuaccacgugaccaacgacgggaacuaccugauggugaucuacgagggcaaggacagccaggagaaggucaagcgcgacuacgagaucguguccaaccugcaggccggggaguacuucaagcagagcgugcacggcguccucaaggcccaggggaucaacaaccuggagggccugauccccaaguucaaggaguccggcaagaacauccucccccugaaguacauccugaagacggggaccauggugaucuucugggagaacuacccggaggagaucugggacaucgacaagaaccagcucuacaagcggcuguucaaggugacccaguucgagagcgacggccgcauccaggcccgguuccaccagaucgcgaagcccgacaacgagcugaccaaggucuccgagcucgacuucagcaacaucgccgagaagauccgccuguccaaggggaaccugaacaugcucgugaacggcuacgacuucaagaucaacgugcuggggcacaucgagaagcugagcuga

SEQ ID NO: 1770 - RNA, 3957 nt, Artificial Sequence
  Cas9 variant
augggcagcaacaugcugaagaaggacuacuccaucgggcucgacaucggcaccaacagcguggggcacgccgucgugaccgacgacuacaaggugcccacgaagaagaugaaggucuucggcgacaccuccaagaagaccaucaagaagaacaugcugggggugcugcuguucaacgagggccagaccgccgcggacacgcgccugaagcggggcacccgccggcgcuacacccggcgcaagaaccggcugcgcuaccuccaggagaucuucgccccggagcuggccaagguggaccccaacuuccuguaccggcucgaggagagcucccuggucgccgaggacaagaaguacgacguguaccccaucuucgggaagcgcgaggaggagcugcucuaccacgacaccuacaagacgaucuaccaccuccggagcgcccuggcgaacaacgaccagcccgccgaccuccgccugguguaccuggcccucgcccacaucaucaaguaccggggcaacuuccugcuggagggggagaucgaccuccgcaccaccgacaucaacaaggucuucgcggaguucuccgagacccugaacgagaacagcgacgagaaccugggcaagcucgacguggccgacaucuucaagaacaacacguucuccaagaccaagaaguccgaggagcugcugaagcucagcggggccaagaagaaccagcuggcccaccagcuguucaagaugauggugggcaacaugggcagcuucaagaagguccucgggaccgacgaggagcacaagcuguccuucggcaaggacaccuacgaggacgaccugaacgaccuccuggccgaggcgggggaccaguaccuggacaucuucguggccgccaagaagguguacgacgccgccauccucgcgagcauccuggacgucaaggacacgcagaccaagaccguguucucccaggccaugaucgagcgguacgaggagcaccagaaggaccugaucgagcucaagcgcguguucaagaaguaccugccggagaagugccacgacuucuucagcgagcccaagaucuccggcuacgccggcuacaucgacgggaaggucagcgaggaggacuucuacaaguacaccaagaagacgcugaagggcauccccgagaccgaggagauccuccagaagaucgacgccaacaacuaccugcggaagcagcgcaccuucgacaacggggccaucccccaccaggugcaccugaaggagcucguggcgaucgucgagaaccagggcaaguacuacccguuccugcgggagaacaaggacaaguucgagaagauccugaacuuccgcauccccuacuacguggggccccucgcccggggcaacuccaaguucgccuggcugacccgcgccggcgaggggaagaucacgcccuacaacuucgacgagaugaucgacaaggagaccagcgccgaggacuucaucaagcacaugaccaucaacgaccuguaccugccgaccgagcccgugcuccccaagcacagccugcuguacgagcgcuacacgaucuucaacgagcucgcgggcguccgguacgugaccgagaacggggaggccaaguacuucgacgcccagaccaagcgcuccaucuucgagcuguucaagcuggaccggaaggucagcgagaagauggugaucaagcaccucaagguggucaugcccgccauccgcauccaggcgcugaagggccuggacaacgggaaguucaacgccuccuacggcaccuacaaggaccucguggacaugggcguggccccggagcugcugaacgacgaggucaacagcgagaagugggaggacaucaucaagacgcucaccaucuucgaggggcggaagcugaucaagcgccggcuggagaacuaccgcgacuuccucggcgaggacauccugcggaagcugucccgcaagaaguacaccggguggggccggcucagcgccaagcugcuggacgggaucuacgacaagaagacccacaagacgauccucgacugccugaugaccgaggacuacucccagaacuucaugcagcugaucaacgacgacaacuacagcuucaaggagaccaucaagaacgcccaggugaucgagaaggaggagacccucgcgaagaccgugcaggagcugcccggcucccccgccaucaagaagggcauccugcagagccucgagaucgucgacgagaucaucaaggugaugggguacaagcccaaguccaucguggucgagauggcccgcgagacgcagaagacccacggcacccggaagcgcgaggaccgggugcagcagaucguggagaaccugaaggacgccaacgagcugccggagaagcuccccagcaacgccgagcuguccgacgagcgcaaguaccuguacugccuccagaacgggcgggacauguacaccggcgcgccccuggacuacgaccaccuccaguucuacgacgucgaccacaucaucccccagagcuuccucaaggacgacuccaucgagaacaaggugcugacgaucaagaaggagaacgugcgcaagaccaacggccugccgagcgaggccgucauccagaagaugggguccuucuggaagaagcuccuggacgccggcgccaugaccaacaagaaguacgacaaccugcggcgcaaccuccacgggggccugaacgagaagcugaaggagcgcuucaucgagcggcagcucguggagacccgccagaucacgaaguacguggcccagcugcuggaccagcggcucaacuacgacgggaacggcgucgagcuggacgagaagaucgcgaucgugacccugaaggcccagcucgccagccaguuccgcuccgaguucaagcugcggaaggugcgcgcccugaacaaccuccaccacgcgcacgacgccuaccugaacgccaucgucgccaaccugaucauggccaaguaccccgagcucgagcccgaguucguguacggcaaguaccggaaggcgaaguucaaggggcugggcaaggccaccgccaagaacacccuguacgccaacgugcucuacuuccugaaggagaacgaggucuaccccuucugggacaaggcccgcgaccugccgacgaucaagcgguaccucuaccgcgcccaggugaacaaggugcggaaggcggagcgccagaucgggggcuucagcgacgagaugcugguccccaagagcgacuccgggaagcugcucccccggaaggagggccuggacccggugaaguacggcggguacgccaaggccguggagagcuacgccguccugaucaccgcggacgaggugaagaagggcaagaccaagaaggugaagacccucgucaacauccccaucaucgacuccaagaaguacgaggccgaccccacggccuaccuggccagccgcggguacaccaacgugaccaacuccuucauccugcccaaguacagccuccuggaggacccggagggccggcgccgguaccuggcguccuucaaggaguuccagaaggccaacgagcucauccugccccagcaccugguggagcuccuguacugggucaacgccaaggacggggagcagaagcuggaggaccacaaggccgaguucaaggagcuguucgacaagaucauggaguucgccgacaaguacgugguggcgcccaagaacagcgagaagauccgccggcuguacgaggagaaccaggacgccacccccauggagcugggcaagaacuucgucgagcuccugcgcuacacggccgacggcgccgccuccgacuucaaguucuucggggagaacaucccgcggaagcgcuacaacagcgcgggcucccugcucaacgggacccugaucuaccagagcaagaccggccuguacgagacccgcaucgaccucgggaagcuguga

SEQ ID NO: 1771 - RNA, 3960 nt, Artificial Sequence
  Cas9 variant
auguucagccagcgcaacaaccccuacugcgagcuccuguucaagaucaucgugaccaacaucgaggagaagaaccuggaggucaucaugggcauccggaacuccgacaucuucuucaucagcaacuucaugugguaccagaagcugaucaugaugaucaagaacauccucgggcuggaccugggcaccaacuccaucgggugggcccucaucgagguggacgagaacaacaucccgauccgcaucaucgccaugggcagccggaucaucccccuguccacgagcgacaaggaggaguuccagcgcgggcuguccaucaccaagaaccagaaccggaccgugagccgcacccagcggaagggcuacgaccgcaagcagcuccggcgcuccgaccugaagaagauccugaagaaguacaacaucuuccccagcgaggagcuccugaagcugcccaugcucgaccuguggaagcugcgguccgacagcgcgaacccgaacgaggacaucuccgccgagcagcucggccgcauccuguacaugcugaaccagaagcggggguacaagagcgcccgcuccgaggccaacagcgacaagaaggacacggacuacguccaggccgugaagggccgguacgcgcagcucaaggaccgccggcagaccaucgggcaguacuucuacgaggagcuguccaccgccuucagcgacaagaacaaccagcaguacuuccgcgugaaggaggaggucuacccccgggaggccuacaucgaggaguucgacaccaucaucaacgcccagaaggacaagcacggcuuccugacggacaaggugauccaccagcuccgcaacgagaucaucuacuuccagcggaagcugaagucccagaaggggcuggugagcaucugcgagcucgagggcuucgagaagaccgucuacgacaaggagaagaacaagaacaaggugguguucgucggccccaagguggcgcccaagaccagcccgcuguuccagcugugccgcaucugggagguggucaacaccaucucccucaagaucaagaaccccgaggggagcaaguacaaguggggcgagaaggugcccaaccugaagcagaaggagauccuggccgacuaccucuucaagaacgagaaccuguccuucagcacgcugcucgagauccuggagcugaagaaggaggacguguacgucaacaagcagauccucaaggggaucaagggcaacgaggccuacgccgcccugcacaacgugcugggcgaccacgagcuccugaacuucgacguguccaucaucaccagcgaccacaccgcgauccuggucgacaagaagaccggggagauccucgaggagcgcgccggccuggagcuggacgccucccucgagcgggagccccuguaccaguucuggcacacgaucuacagccugaaggaccuggacgagugcaagaacgcccucaucaagcgcuucgggcuggacgaggacaucgccgagaagcugucccacaucgacuucaacaagcaggcguucggcagcaaguccaacaagagcaugcggaagauccucccguuccugauggagggguacaacuacuccgagagcugcucccuggccggcuacaaccacagcaacucccucaccaaggacgagcgcgagagccagaucacccuggagcggcuggagcuccugcccaagaacaaccugcgccagcccaucguggagaagauccucaaccagaugaucaacguggucaacaccauccuggagaaguacggcaagcccuccgagauccggguggagcuggcccgcgagcucaagcagagcaaggacgagcggaacgacacggaccugcagaacagccgcaacaagaagcugaacgaggagaucgggaagcggcucgccgagcugggccugccggucaccaagcgcuacauccagaaguacaaguucaucuuccccucccucagcaagaaccugaaggacgcccacgugaacaaccagugcaucuacugcggggagaccuucaaccugaccgaggcgcucaacggcgacgccuacgacguggaccacaucguccccaaggcccugcuguucgacgacucccagacgaacaaggugcucgugcaccggaagugcaacagcaccaagaccaaccagaccgccuacgacuacaucacggccaagggggaggaggagguccgcaucuacuccgagcggguggacgacugguucaagaagggcaucaucagcuacuccaagaugcagcgccugaaggugagccacaaggaguaccuggagcggaagaagcucggcaaggagaccgagaccgacaagaagcugugggagaacuucaucgaccgccagcugcgggacacccaguacaucucccgcaagagccgcgagauccuccagaaggucugcaacaacgugacgaccaccgagggcggggugaccgcgaagcugcggaaccugugggggugggacgacauccucaugaaccugcagaugcccaaguacaaggagcugggccagacgaucaccaaggaguggaccuccgagcacgggaagcgcaagcaccagaaggaggagaucgagaacuggaccaagcgggacgaccaccgccaccacgccaucgacgcccucgucguggccugcaccaagcagggcuucauccagcggaucaacacgcugaacagcuccgagaccaaggaccugaugaucaaggagguggaggaggcgaagaucgaguucaacgagaagaccacccuccuggagaaguaccugaagacgcagaagccguucaccacccgcgaggucaugaaggaggccgacaagauccucaucagcuucaaggccggcaagaagguggccaccaucacgaaguucaaggccaccgggaagaacaaggagaccggcgugaucgucccccgcggggcgcugcacgagcaguccguguacggcaagaucaaggugaucgagaaggacaagccccugaaguaccucuucgagaaccccgacaagaucgucaacagccggauccgggaccugguggagacccgccuguccgagaacgagaacaacagcaagaaggcccucagcacggugaagaagaacccgaucuucuucaacgaggagaagaacgagauccuggagaaggccuccugcuacaacgacgccaccguccugaaguacaagcuccagaaccugaaggccaaccagguggacgacaucguggacgagcgggucaaguuccuggugaaggagcgccucacccaguucggcagcaaggagaaggaggcguucaaggacauccugugguucaaccaggagaagcagauccccaucaucaccgugcggcuguucgcccgccccgacgccaacaaccuccagaucaucaagaaggacaagaacgggaaggacaucggcuucguccugacggggaacaaccaccacaucgccaucuacgaggacaaggacuccaagcuggugcagcacagcugcgccuucuggcacgcgguggagcggaagaaguacaacauccccgccgucaucaagaacuccgccgacguguggagccuccugcuggacaaggagcucccggugcuguuccuggacaagcuccccgccgacgagcugaaccugaaguucuccaugcagcagaacgagauguucauccucggccugagccaggagggguucgacgaggcgaucaagaacaacgacaagucccugcucagcaagcaccuguaccuggucugguccaucagcaacaacgacuacuacuuccgccaccaccucgagaccaagaacaccgagcugaagaacauccccaccgccaaggacuccaagcgguacuuccgcuucaagagcgugggcgcccuggugggcaucaacccgaucaagguccggcucaaccaccugggggagaucacgaagaucggcgaguga

SEQ ID NO: 1772 - RNA, 3960 nt, Artificial Sequence
  Cas9 variant
augggcuacaacaucgggcuggacaucggcaccgggagcgugggcugggccgcccucaccgacgaggggaagcuggcgcgcgccaagggcaagaaccugaucggcguccgccucuucgacuccgcccagagcgccgcccagcggcgguccuaccgcacgacccggcgccggcugagccgccggaaguggcgccugcggcuccuggagaacaucuucuccgacgagauggggaugaucgacgagaacuucuucgcgcgccugaaguacagcuacgugcaccccaaggacgaggugaacaacgcccacuacuacggcggguaccucuucccgacccagcaggagacccacgacuuccacgagaaguuccagacgaucuaccaccuccggcugaagcucaugaucgaggacugcaaguucgaccugcgcgagaucuaccuggccaugcaccacaucgucaaguaccggggccacuuccucaacucccagagcaagaugaccaucggggacuccuacaacccccgcgacuuccagcaggccauccagaacuacgcggaggccaagggccugaucuggagccugaacgacgcccaggagaugaccgacgugcucgugggccaggccggguucggccuguccaagaaggccaaggcggagcggcugcucagcgccuucuccuucgacaccaaggaggacaagaaggccauccaggccauccuggccgggaucgucggcaacacgaccgacuucaccaagaucuucaaccgcgagcggagcggcgacgagcugaagaaguggaagcucaagcuggacuccgaggcguucgacgagcagagccaggccaucguggacgagcuggacgacgacgagauggagcuguucaacgccauccgccaggccuucgacggguucacccugauggaccugcucggcgaccagacguccaucagcgccgcgauggugaagcgguaccagcagcaccacgacgaccugaagauggucaaggagaucgccaagaagcaggggcugucccaccaggacuucagcaagaucuacaccgccuuccucaaggacgacaccgacaagggcaugaaggcccugcuggacaaggccgaccucgcggacgacgugcugguggagauccagcagcgcaucgagagccacgacuuccugcccaagcagcgcaccaaggccaacuccgucauccccuaccagcuccaccuggccgagcuggagaagaucaucgagaaccaggggaaguacuacccguuccuccuggacacguucaccaacaaggccggcgagaccaucaacaagcugguggagcucgugaaguuccggguccccuacuacgugggccccauggugaccgcggccgacgucgagaaggccgggggcgacgccacgaaccacugggugaagcgcaacgagggguacgagaagucccccgugaccccguggaacuucgaccaggucuucaaccgggaccaggccgcgcaggacuucaucgaccgccugaccggcaccgacacguaccugaucggggagcccacccuccugaagaacagccugaaguaccagcuguucaccgugcucaacgagcugaacaacgugaagaucaacggccacaagaucgacgagaagaccaagcacguccugauccaggaccucuucaagagcaagaagacgguguccgagaaggccaucaaggacuacuaccugagccagggcaugggggagauccagaucgucggccuggccgacaagaccaaguucaacuccaaccucagcuccuacaucgaccugagcaagaccuucgacgccgaguucauggagaaccccgccaaccaggagcugcucgagaacaucauccagauccagaccguguucgaggacgugaagaucgcggagcgggagcugcagaagcuggcccuccccgacgagcagguccagcagcuggccaagacgcacuacaccggguggggcaaccuguccgacaagcuccugagcaccccgaucauccaggaggggucccagaaggugagcauccugaacaagcuccagaccacguccaagaacuucaugagcaucaucaccgacaacaaguucggcgugcagcaguggauccaggagcagaacaccgccgagaccgccgacuccauccaggaccgcaucgacgagcugaccacggcgcccgccaacaagcggggcaucaagcaggccuucaacguccuguucgacauccagaaggccaugggggaggagcccaaccgcguguaccucgaguucgcgaaggagacccagaacagcgugcggaccaacucccgcuacaaccggcugaaggaccuguacaagagcaagacccucagcgacgacgucaaggcccugaaggaggagcuggagucccagaaguccagccuccagagcgagcgcaucggcgaccggcuguaccuguacuuccuccagcaggggaaggacauguacacgggccagcccaucaacaucgacaagcuguccaccgacuacgacaucgaccacaucaucccgcaggccuacaccaaggacgacagcaucgacaaccgcgugcuggugucccggcccgagaacgcccgcaagagcgacuccgccaccuacacgaccgagguccagcagagcgcgggcgggcucuggaagucccugaagaacgccggcuucaucagccagaagaaguacgaccggcugaccaagggcggggacuacuccaaggggcagaagaccggcuucaucgcccgccagcucguggagacgcggcagaucaucaagaacguggccagccugaucgaguccgaguucagccagaccaaggccgucgcgauccgcuccgagaucaccgccgacaugcgccggcugguggccaucaagaagcaccgcgagaucaacagcuuccaccacgccuucgacgcccuccugaucaccgcggccggccaguacaugcaggcccgguaccccgaccgcgacggggccaacguguacaacgaguucgacuacuacacgaacaccuaccugaaggagcuccggcagagcuccagcuccagccagguccgccggcugaagcccuucggcuucgugguggggaccauggcgaagggcaacgagaacugguccgaggacgacacccaguaccugcgccacgucaugaacuucaagaacauccucacgacccggcgcaacgacaaggacaacggggcccugaacaaggagaccaucuacgccguggacccgaaggccaagcugaucggcaccaacaagaagcggcaggacgugagccucuacggcggguacaucuaccccuacuccgccuacaugacgcugguccgcgcgaacggcaagaaccugcucgugaaggugaccaucagcgccgccgagaagaucaaguccgggcagaucgagcugagcgaguacguccagcagcggcccgaggugaagaaguucgagaagauccugaucaacaagcucgccaucggccagcuggugaacaacgacgggaaccugaucuaccucaccuccuacgaguucuaccacaacgccaagcagcuguggcugcccaccgaggaggcggaccucaucagccagcugaacaaggacuccagcgacgaggaccugaucaagggcuucgacauccucacguccccggccauccugaagcgcuuccccuucuacgagcuggaccucaagaagcuggucaacauccgggacaaguucaucgccguggagaacaaguucgacauccugauggugauccucaaggcccugcagcuggacgccgcgcagcagaagcccgucaagaugaucgacaagaaguccgccgacuggaaggacuaccgccagcggggcgggaucaagcucagcgacaccagcgagaucaucuaccaguccaccaccggcaucuucgagaagcgcgugaagaucagcaaccugcuguga

SEQ ID NO: 1773 - RNA, 3963 nt, Artificial Sequence
  Cas9 variant
augaccgagcagcagcgccccuacaacaucggccuggacaucgggaccagcuccaucggcugggccgugacggaccagaacgacaagcuccugcacauccgggggcacaacggcaucgggguccgccuguucaaggagggcgagagcgccgcggagcggcgcggcuuccggaccacccgccggcgccucucccggcgccgguggcgccugcgguuccuggaccgcaucuucgacgccgagcucgccaagguggacccgaacuuccuggcccggcugaagcagagcaacaucagcccccucgaccccaacaagcagauguucgggaacauccuguucgacgacgcccaguucgacgaccagaaguuccaccagcaguaccccaccaucuaccaccuccgcagcgcgcuggcccagccggacgcgccccaggccgacgugcggcugaucuaccuggcccuccaccacaugaucaaguuccgcggccacuuccugaacggggccgccgucgagaaguuccacggcgggcagcugcaccucgaggccgaguuccaggagcugaaccagaucuucuccaaccagcagcgggaccacgugcagcugcagacgagcucccucgacgagguggccaccauccugaaggacaaccagcgcacccccagcgaccggcagcgcgagcuguccgcgcgccucuucguccccguggacaagaccaucgacaaggagaacaagaagcuggccacggagcugcucaaggccgugcugggccugaaggccaaguucgacgucauccucggcguggaggccaccgacccgcaggcguucaagcugcaguucagcuccgacgacuucgacgacaagaucgccgagcuggccagcgagcucaccgacgaggccaacgagauccugaccgugcugcagcggcucuacuucucccugaaccuggccgacauccucacgaaccgccagaccaagcaggucgcggacagcaucuccaccgccaugaucaaccgguacgacgaccacaagcaccaccugaagaugcugaaggagcucgagacccaggugacgcaggagcagcgcgacgggcugaagaaggccuacgacgaguacaucgacggcgacaagcccaccaucgacaccuucuacaccaacgugaagaagaaccuggacgacagcgagcucgccaaccagaucaagucccugaucgaccugcaggccuucaugcccaagcagcggagcaaggagaacgggagcaucccccaccagcuccaccagcgcgagcuggaccagcugaucgagguccagggcaaguacuacccguggcugcucgcggccaaggacaagcuggacgcccugaucgccuuccgggugcccuacuacgugggccccaugaucgaccccaacgaguccgacgacccgcagaacacgaaguucgcguggaugguccgcaaggaggccggggagaucacccccuggaacuucgaggagaagguggacaagaccggcagcgccaccaacuucaucaagcggaugacgaccaccgacaccuaccuccugggggagcccgugcugcccaagaacucccuccuguaccagcaguucacgguccugaacgagcucaacaagcugaagguggacggcaaggcccugaccguggaccagaagaaguaccucuacgagcacgucugcaagaagcagcgccgggugacccugaagaagcugagcgacugccucauggcccgcggggacuucccgaugggcgcgaucuucaccggcacgaccgaccagaagaacaugaacaacacccugaagaccuaccaggacuuccaggagaucuucggggacgagaucgacaaccccgaccggcaggucgacuucgagaagaugaucgagugguccacgaucuucgaggaccgcgagaucuucaagcugaagcucgccgagcugaacuggcugaccagcgagcagcucgagcggguguccaagaagcgcuaccagggcugggggcggcugagccagaagcugcucacccacaucgugaacgagaacggcgagcgcaucaucgaccagcuguggaacaccaaccagaacuucauggagaucauggggcaggacggcgucaagcaggccauccaggagcacaacggcgccaacguggcccagaccgggaucaacgagacgaucgacgagcuguacaccagcccccagaacaagaaggcgauccggcagauccuccugguggucgacgacaucaagaaggccgugggcuacgcccccgccaacaucaugauggaguucgcccgcgaggaccgcgacgaccaccggcugaucgcgucccgcgcccggcagcucgagaagaccuaccaggagaucuccaagaacugguucgacaacgagagcgugacccaggagcugaaggaccagaucaagaacaagacgaaguucaccgaccgccuguaccucuacuucauccagggcgggaucgaccuguacaccgggcacccgcugaacaucgaccagcucuccagcuacgacaucgaccacauccugccccaguccuuccugcucgacaacagccugaacaaccggguccugaccucccagagcgagaaccgcgugcacaaggaggaccggcuccccggcgagacgguggccaacaagaugcgccccaccuggaagaugaugcgggagcagggccugaugacccagcgcaaguacaacaaccugacccucaagccggaccagaucuccaaguucaacaaccgggggcaguucaucaaccgccagcuggucgagacgcgccaggugaucaagcuggccgcggacaucaugaaccagaaguaccaggccgaccagaccaagguggucaccgugaaggccaaccucacccaccacaugcgggagaaguucaacuucuacaagagccggaacgugaacgacuaccaccacgccuucgacgccuaccugacggucuucgugggcaacuggcugcucaaggaguaccccaagcugcagcccuacuucguguacggggacuucgcgaagaccggcaccaacaaccugaaguccuucaacuuccucuaccgcuucgagcgggaccacaagcugaacgacaagggcgccaucgacaccgacaaggaccagcagcugggguacaugaagcgcaucuaccgguucaagaagaugcucgucacgaagcagcuggagaccaacgagggcgcccuguacaagcagaccaucuacaaggccccggccaacgagaagaacaccaagaagaaccgcucccucaucaacacgaagaagaaccggcccagcgacaucuacgggggcuacucccagagcgugaccgcguacaugucccugguguucuucaagaacaccuucaagcugaucaagaugccccucgucgccgccaacgccaucaagaacagccuguccagcuaccacgacaccauccugaagauccucggguccaacgaguucaaggugcugauccccaaggugaagaugaaccagcugaucaaggagggcgacagccucuacacggucgugggcguguacaagcacaacgcccagcagcugauccuguccgacaacagcauggggaucaucaccaagccgauccgcgagaucugcgacuccgaccucgacagcgucuucaacgagcugguggacaacaucgacaaguaccugaaccucuacaagaucgaggacaagcugaccaucaaggagaaguucuacgcgcugaagaacaaggaguccaaguucaagugcaucagcgacauccucgugggcacccacugcaacgccgggcgcuccaaccugaagaucaucggccugagcagcuacugggggauguucuccggcaacaacgacggccucaagaucaacgagaacagccagcugaucuaccagucccccacggggcuguucgagcaccgggucaaggugagcgaccucuga

SEQ ID NO: 1774 - RNA, 3972 nt, Artificial Sequence
  Cas9 variant
augaaggacuucuacaucgggcuggacauggggaccgacagcgugggcugggccgucgccgacgaggacuacaaccucugcaaguucaaggggaaggcgauguggggcgugcgccuguucgacgaguccgccaccgccgccgagcggcgcggguuccggacggcccgccggcgcgcgcagcggaagcgccagcggauccuguggcuccagaugcuguucaacgaggagaucagcaagaaggacaucgccuucuuccagcgccugaacgaguccaagcucuaccuggaggacaagagcaccaacgugcccuacgccgucuucgccgacgaguccuucaccgacguggacuaccacaagcuguacccgaccaucuaccaccuccggaaggagcuggugcagagcgacgagccccacgacguccgccugguguaccucgcgcugcaccaccugaucaagaaccggggccacuuccucuucgagaacgugggcuccgacuucgagaaggagagcuccuucgagguccuguucaagaaccugcagaacuacauccucggggaguacgagcuggcccuggagugcaucagcccccuccagaucgccgacauccugaaggacaaguccaagcgcaagacgaccaagagcuccgagaucugcaagcugcucggcaucagcaagaaggggcagccccggcugaacgccaucgugcugcucaugugcggccaguccgugaagcuggccgaccuguacggggacgagaacuacaacaaggaggagaaguccagcaucagcuucgagaagggcuacgaggacaacgaggagaccuaccgcgagcuccugcuggagcgguucgagcucaucgagaagaucaaggcgcuguacgacugggccauccuggccgacauccucaagggcgagaccuacaucuccuucgccaaggucaagacguacgacgagcaccgccacgaccugcagcagcugaaggccuucgugaaggagcggugccgcagcgacuacaacgagaucuuccgggagaccagcgacaagcucaacaacuacaccgcguacugcgggaaguucaaggagaacggccgcaacggggugauccugcacuccgccaaccagaccgacuucugcaaguaccucaagagcaaguucgacaagcucgacaaguccggcuacgaggacauguucgagaagaucgagaacggcagcuucaugccgaagaucgucgugaaggacaacggggugauccccaugcaggucaacgaguccgaggugcgcgccauccugaagaacgccagcggcuaccuggacuuccucaacaaccaggacaaggacgggaucacgguggccgacaagauccugcagaucuucgaguuccggauccccuacuacgucggcccccugaacgugcacuccgacaacagcuggcucgugcgcaaggacgggaagaucuacccguggaacuucaacaagaucgucgacguggacaaguccgcggaggaguucaucaacaagcugaccgccaagugcaccuaccugcccgaccgggacgucauccccaagaacagcauccuguacucccgcuacauggugcucaacgagcugaacaaccugaagcucgacggcaagaagcccgacgugagcuucaagcaggccgucuucaacgaccuguucaugcaccggcgcaaggugacccagaaggcccugcgggaguacaucaaggcccagacgggcaccgagccggagaucaccgggaucgacggcgacuucaaggcgaacaugcgccccgccaucgagcucgccggguacaaccuguccgagcccgacaaggaggagaucaucaaggccaucaccaucuucggcgacgacaagaagcugcucaagcggcgcaucaaggacaaguacagcgagaugcuguccgaggacgagaucaagaagaucugcaagcugaaguacaaggacugggggcggcucagccgcgaguuccugacggagaucuucgacguggacaccgcgaccggcgagugcaaggacaacaucaucaacacccuguggaacacgaacgacaaccucauggagcugcugggcgccaaguacaacuucacccaguccaucgagcaggccaucagcaaguccacccacaaggccagcaucgagaagauggucgaggacauguacgugagccccaaggugaagcggaccgucuuccagucccucaagaucaugaaggagaucgugaagaucaaggggcacgccccgaagaagguguucgucgagaugacgcgccacgacggcaccaagggggacaacggccggaccaagagccgcaagaagcagcuggaggagcuguacaagaagugcaaggaggacuccaccgagcucugggacgagcuggagaagacggacgacgacgaguuccggcaggacaagcuguuccucuacuacacccagauggggcgcugcauguacagcggcgagcggaucgagcugcgcgaccuguucaacaagaaccucuacgacaucgaccacaucuucccccgcuccaaggugaaggacgacagcaucgacaaccgggugcuggucaagaagcagaucaacucccacaaggacaacgacuacccccuggacagcaccgugcgcgagaagaugcggggccacuggcaguaccuccugcgccacggguucaucuccaagaagaaguacgaccggcugacccgcgugacgccccucaccgacgacgagcuggcggacuucaucgcccggcagcuggucgagaccagccaguccaccaaggccguggccacccuccugaagacgcuguacccgaccaccgagaucguguacgucaaggccgagcucgugagccgcuuccggaccgaguacaaguucaucaagugccgcgaggugaacgaccugcaccacgcgaaggacgccuaccugaacaucgucgugggcaacguguacaacguccgguacacgcacuccaaggccaucuucaucaaggggcuccagaccaagaaguacagccugaaccgcauguucgccuucgacacccccggcgccuggaacaucgagaacgagaagucccugagcaucgugaagaagaccgugaugaagaacaacauccucuacacgcgguacuccuacaugaagaagggcgggcuguucaagauccagccccugaagaagggcaacgggcaggcgccccucaagaaggaccugccgcugagcgacaucggcaaguacgggggcuacgacaagcccaccgccagcuacuucuccuacaucaaguacgagggcaagaaggggaaggagugccgccagcucgucgccaucgacaacuaccugaagaaguacuacgaggagaaccccaucgaguaccugaccaaccggcucggccugaagaaccccgccgugcugaucccggugaucaaguacaacagcugcaucgagaucgacggguuccgcaugaacaucuccagcaaguccaacgagggcaagaccaucgucuacaagcccgcggugcagcucgugcugggggccgagaaggaggccuacgucaagaagaucagcaaggugcuguccaagcccgaggagcagaagaucacgagcuacgacggcguguccgccgaggagaacaucgagcuguucgacgcccugaccgcgaagaugaccaacaccaucuucaagaucaagcuggaggacaucggcaacaagaucaagagcgggcgggacaaguucgucacgcucgacgugaagaagcagugcuacgugaucaacgagauccugaagaucaugcacugcaacgucgugaccggcgaccugucccucaucggggccgccaagaaggccggcaucgugagcaccaacuccgcccugagcgagaucaagaaggucuccagcaucaugcugaucaaccaguccgugaccggccucuucgagacgaagaucgaccugcugaacaucuga

SEQ ID NO: 1775 - RNA, 3975 nt, Artificial Sequence
  Cas9 variant
augcgcgccaagggcaagacccugaucgggaccagccucuuccgggagggcaacacggccgcggagcgccggggguaccgcaccacccagcggcgccugaagcggcgcaagcggcgccugaagcuccuggaggccuucuucgaccccuacaucuucgagguggacgagaacuuccuggcccggcuccacgaggccgacaucuccccgaaggacgagaacaagcgcuucuggggcagccugcuguuccccaacgagaaggacgccaacuucuaccggaaguaccccaccaucuaccaccuccgcaaggcgcugauggaggaggaccggaaguucgacguccgcgccaucuuccuggccauccaccacaucaugaaguaccgggggaacuuccucagcccccugagcguggacuccuucaagcaggagggccuggagcucaaggagcagcuggaccgccagcugaagcggguggccgagcucuacaacgagcugaacacggacgucaagaucaacgugagcgacguggagaccauccaggacaucaucaucgacaagaacaagucccgccgggacaaggcgggcgcccugaagaagcuccuggccgucagcuccgaccgcaaggagaucaacaagcugaacgccagccucgccaaggagcuguccaacgcgauccuggggaugaaggcccaguucgccaaccuccugcuggccgacgaccucgagaucgacaagaacaagaagaacuucagccugcuggacaccaacgccgaggagaacguguccggccuccuggagcuggugaacgagaagcaggcggagcuguucgacgccaucaagaccauccacgaccagaucauccugaacgagaucgucccggacggcaagagcaucucccagagcaugguggacaaguacgaggcccaccgcgagcagcuccaggugcucaaggcccuguacgagaagauggacgccaagcagaucaaggcgaucaagaaggccuacucccuguacaucgacgggaaggaccccaaggccaagaaggucgacaagcgggcccaccagaaccgcgccgacuucuacaaggaggugaagaaggugcucgucgagcuggacgacagccgggcggagaagcugcucgggcugaucgagaugggccaguuccugcccaagcagcgcacggccaugaacggcgugauccccaaccagcuccaccagguggagcuggacaagaucaucgagaugcaguccaaguacuacccguggcuggccgagaagaaccccgucaagagccaccagaagcgggcccccuacaagcuggacgagcuccugaccuuccgcgugcccuacuacguggggccgauggucaccagcaagaagcagcagcagaccuccaacagcaacuucgcguggauggugcggaagcaggagggcgagaucacgcccuggaacuucgaggagaagguggacaccaucgccuccgccaacgacuucaucaagcgcaugaccgccaaggacaccuaccuggucggggaggacgugcuccccgccaacagccugcuguaccagcgguacaagguccucaacgagcugaacaacaucaaggugaacggccgccggcugcccguggagcucaagcgcgaggcguacgucgcccuguucgagaacggcgacuccaagacggugagcgccaagugcuucaagaacuggcugaacgugaagcucaagaaccugaacucccugaagcucgaggggcugagcaccggcaccaaguucgacaacaaccuguccaccuaccacgaccucaagaagaucuucgggaaggccgucgacgacgccggccggcagaaggacuucgagcagaucaucgaguggcugacgaucuucgaggacaagaagauccugcgcaucaagcucaaggagaucgaguggcugaccgaggagaacaucacccagcugacccggcucaacuacaacggguggggccgccugagccggcgccugcucacgggcaucugcgacuccaacgggcagcggaucauggacuggcugugggacaccaccaacaacuucaugcagauccagagccagccggacuuccagaaggcgaucguggaguacaacuccgacaagcuggagcagggcgacaucgagcagauccucggggaggccuacaccagcccccagaacaagaaggccauccgcaaggugaucaaggucgugcaggacguggagaaggccaugggcgccaagcccacguccaucagcaucgaguucacccgcuccgacgggcggagcgagcugaccaacucccgcaugacccagcugcagaagacgcucaugagccugagcgaggagaugaccgaccaggcgcugcucgccgaguucaaggacuuccaggccuccaagaagaagcugaccaacaaguacuaccuguacuucacccagcucggccgggacauguacacgggcgagccccugaacaucgaccagcugagccucuacuccgacggggaccacauccugccgcgcagcuucaucaaggacgacucccuggacaaccggguccucaccaagcgcgccgugaacaacgagaaguccgacaccgugcccgucugcgaguacggcgcgaagaugaaggacuucuggaacgaccuguacgacaacgggcugaucuccaagcagaagcucgccaaccugcugaccgaccccgacgagaucggccccuacaaggccaacggguucauccggcgccagcucguggagaccagccaggugaucaagcuguccgccgagauccugcagacgcucuaccaggacaccaagaucaucgagguccggcagaaguacacccacgagcugcgcgagcacuucaacuucgugaagauccggcagcugaacgacuaccaccacgccuucgacgcguaccucaccgccuucagcggccgcuaccuguaccagcgguacccgaagcugcgcggcuacuucguguacggggacuacaacaaguucgacgccaagaaggaccggaacuaccucaaguccuacaacuuccuguacgaccuggaggagggcaagacggaccagaucgucgacaacguggagcacaagguguucaugaaccgccaggacgccaucaaccagcucaagaaggccuacgaguacaaguacaugcuggucagccaggagaccuacaccaacuccggggcgauguucaaggagaccaucuaccccgugaaccccaagcagaagcugauccagaagaagaacgacaagcccguggacaucuacggcggcuacagcaacaacuacgacgccuaccucuccaucguccggcuggaggacaagaaggggaucaaguuccgcguggugggcaucccgaugcggaacaaggccgagcuggacaaccucgccaaggaggaccacaacggguacaugcagcgccugaacgagaucgucgacgagcagaucaacagcuccggcaagaagaagacguuccggaucauccugcccaaggugcacuucaagcagcucguggaggacgacagcgggaaguucaugcugggcagcgccgcguaccccuacaacgccaagcagcugguccucuccgucaagagcaucgagucccuggccaacaaggacgccagcgaccgcgagcugguggcgguguacgaggagauccucaacguggugaacgacaaguucacccuguacgacgcccgccaguuccggaacaagcugaccuccagcaaggacaaguucgucgagcucaacaccgccgacaaggugacggagcugcuggacauccucgacggccugcacgccaacccgguggucaagaagcugaagaucaucuccgggagccccuucggcuuccuccagcgccccuccgggaucgugcugaccgagaacgccaagcugaucuaccagagccccaccggcaucuucgagcggguggucuaccuccgcgaccuguga

SEQ ID NO: 1776 - RNA, 3984 nt, Artificial Sequence
  Cas9 variant
auggagggccagaugaagaacaacgggaacaaccugcagcagggcaacuacuaccucgggcuggacgugggcaccagcuccgucgggugggccgugaccgacacggacuacaacgugcugaaguuccgcggcaagagcauguggggcgcccgccucuucgacgaggcguccaccgccgaggagcggcggacccaccgcgggaaccggcgccggcuggcccgccggaaguaccgccugcuccugcuggagcagcuguucgagaaggagauccggaagaucgacgacaacuucuucguccgccuccacgagagcaaccugugggccgacgacaaguccaagcccagcaaguuccuccuguucaacgacaccaacuucacggacaaggacuaccugaagaaguacccgaccaucuaccaccuccgguccgaccugauccacaacagcaccgagcacgacauccgccugguguuccucgcccugcaccaccugaucaaguaccggggccacuucaucuacgacaacuccgcgaacggggacgugaagacccucgacgaggccgucagcgacuucgaggaguaccugaacgagaacgacaucgaguucaacaucgagaacaagaaggaguucaucaacgugcuguccgacaagcaccucacgaagaaggagaagaagaucagccugaagaagcuguacggcgacaucaccgacuccgagaacaucaacaucagcgugcucaucgagaugcuguccgggagcuccaucagccuguccaaccucuucaaggacaucgaguucgacggcaagcagaaccugagccuggacagcgacaucgaggagacccucaacgacgucguggacauccugggcgacaacaucgaccugcucauccacgccaaggagguguacgacaucgccguccugaccuccagccuggggaagcacaaguaccucugcgacgcgaagguggagcuguucgagaagaacaagaaggaccugaugauccucaagaaguacaucaagaagaaccaccccgaggacuacaagaagaucuucuccagccccacggagaagaagaacuacgccgccuacucccagaccaacagcaagaacgugugcucccaggaggaguucugccuguucaucaagcccuacauccgcgacauggucaagagcgagaacgaggacgaggugcggaucgccaaggagguggaggacaaguccuuccugaccaagcucaagggcaccaacaacagcgucgugccguaccagauccacgagcgcgagcugaaccagauccugaagaacaucguggccuaccuccccuucaugaacgacgagcaggaggacaucuccgucguggacaagaucaagcugaucuucaaguucaagauccccuacuacguggggccccugaacaccaagagcacgcgguccugggucuaccgcagcgacgagaagaucuacccguggaacuucuccaacgugaucgaccuggacaagaccgcgcacgaguucaugaaccggcucaucggccgcugcaccuacacgaacgaccccguccugcccauggacagccugcucuacuccaaguacaacgugcugaacgagaucaaccccaucaaggugaacggcaaggccaucccggucgaggugaagcaggccaucuacaccgaccuguucgagaacagcaagaagaaggugacccgcaaguccaucuacaucuaccuccugaagaacggguacaucgagaaggaggacaucgucagcggcaucgacaucgagaucaagagcaagcugaagucccaccacgacuucacccagaucgugcaggagaacaagugcacgcccgaggagaucgagcggaucaucaaggggauccucguguacagcgacgacaaguccaugcugcgccgguggcugaagaacaacaucaagggccucagcgagaacgacgucaaguaccuggccaagcugaacuacaaggagugggggcgccucuccaagacccugcugaccgacaucuacaccaucaaccccgaggacggcgaggccugcagcauccucgacaucauguggaacacgaacgcgacccugauggagauccuguccaacgagaaguaccaguucaagcagaacaucgagaacuacaaggccgagaacuacgacgagaagcagaaccuccacgaggagcuggacgacauguacaucagccccgccgcccggcgcuccaucuggcaggcccugcggaucguggacgagaucguggacaucaagaaguccgcgccgaagaagaucuucaucgagauggcccgcgagaagaaguccgccaugaagaagaagcggaccgagagccgcaaggacacccuccuggagcuguacaagagcugcaagagccaggccgacggcuucuacgacgaggagcuguucgagaagcucuccaacgagagcaacucccggcugcgccgggaccagcucuaccuguacuacacgcagauggggcgcagcauguacaccggcaagcggaucgacuucgacaagcugaucaacgacaagaacaccuacgacaucgaccacaucuacccccgcagcaagaucaaggacgacuccaucaccaaccggguccucguggagaaggacaucaacggggagaagacggacaucuaccccaucagcgaggacauccgccagaagaugcagcccuucuggaagauccugaaggagaagggccugaucaacgaggagaaguacaagcggcucacccgcaacuacgagcugaccgacgaggagcuguccagcuucguggcccgccagcucgucgagacccagcaguccaccaaggcgcuggccacgcugcucaagaaggaguacccgagcgccaagaucguguacuccaaggccgggaacgugagcgaguuccggaaccgcaaggacaaggagcugcccaaguuccgggagaucaacgaccugcaccacgcgaaggacgccuaccucaacaucgucgugggcaacguguacgacaccaaguucaccgagaaguucuucaacaacauccgcaacgagaacuacucccugaagcgggucuucgacuucagcgugcccggcgccugggacgccaagggguccaccuucaacacgaucaagaaguacauggccaagaacaaccccaucaucgcguucgccccguacgaggugaagggcgagcuguucgaccagcagaucguccccaaggggaagggccaguuccccaucaagcaggggaaggacaucgagaaguacggcggcuacaacaagcucagcuccgccuuccuguucgccguggaguacaaggggaagaaggcccgcgagcggagccuggagaccguguacaucaaggacgucgagcucuaccugcaggaccccaucaaguacugcgaguccgugcugggccucaaggagccgcagaucaucaagcccaagauccugauggggagccuguucuccaucaacaacaagaagcucguggucaccggccgcagcggcaagcaguacgugugccaccacaucuaccagcuguccaucaacgacgaggacagccaguaccugaagaacaucgcgaaguaccuccaggaggagcccgacgggaacaucgagcggcagaacauccugaacaucaccagcgugaacaacaucaagcuguucgacguccucugcacgaaguucaacuccaacaccuacgagaucauccugaacagccugaagaacgacgugaacgagggccgcgagaaguucuccgagcucgacauccuggagcagugcaacauccugcuccagcugcugaaggccuucaagugcaaccgggagagcuccaaccucgagaagcugaacaacaagaagcaggccggggugaucgucaucccgcaccuguucaccaagugcagcguguucaaggugauccaccaguccaucaccggccucuucgagaaggagauggaccugcugaaguga

SEQ ID NO: 1777 - RNA, 3984 nt, Artificial Sequence
  Cas9 variant
augaagaacuacagcaucggccuggacaucgggaccggcuccguggggugggucugcaucgacgagaacuaccagauccuccgcuacaacaaccgggccgccuucggcgugcacgaguucgagaccgcgcacguggccgaggagcgccggaucaagcgcggggcccggcgccgguacaaccgccggaagaagcgcauccagcugcugcagagccucuucgucccccacaugcagcagaaggccuucuucgccccgacgaucaccgagcacuacuggaagaacgacaaccaguucgagaaccggacccuguccgaggugcugaugagccucggcaugaaccccaacaccuaccccacgaucuuccaccuccgccacgagcugaucgaguccagcgugaagaaggacgcgcggcugaucuaccuggcccugcacaaccucgucaaguuccgcggccacuuccugcaggagggguccaccuggaacgccaacaugagcgacgccaaccuguccgagcaguucgagcagcuccugcacaucuacaccgagauggaggagcugccccaggugagccucaccgcgcagcaguccacggacguggagcacauccugcugaacaaccacaucagcaaggccgagcgggcccgccagcucaccgcccuguucgagcggaccuacgagccguucuucaagcugaucgucggccucgacaucgccgcggcccagcuguucaagcaguccgagcagcagcugcucuacaaggagagcaagaccaaggugaaccugacggccgagacccugcccgaggugcuccagaccaugcuggagcccgaggucgccuucaucgaggccgugcagcccuucuaccagcagaccgugcuguucgaccuccugaaggggcaguccuacgucgcggccgccaagguggaggccuucaaccaguacgagcgcgaccuggcccuccucaagagcgugaucaacgaggucggcuccgagaagcaguaccgggcguucuucaucacgagcaagcagaagaagcgccaguucgagcagaagccgaacauggagcugcugugccaccuggaccgguucaaccgcgagaagaaguacgaggagaccuucuacaaggagguguccaagcugcucaccgcccugaucaaggaggccaccggggaggugaaggagcacaucgagcagaucauccaggccauggagagccagagcuuccuggucaagcagaagggcauccagaacgccuccauccccuaccagaacagccucuacgaggcggagaugauccugcgcaaccagcaggccuacuaccccuggaucacggacgaguucaucgagaaggugaagcagcugaucgccuuccggauccccuacuacaucggcccgcucgugcagggggacgagcagcccuucggcuggcugcagcgccaggccgacgggaacaucacccccuggaacuucgacgagaaggucaacaaggcggccuccgccgagagcuucaucacccggaugaccaagaacugcacguaccugaaggaggagaaggugcugcccaagcagucccucauguacgagaaguucacccugcugaacgagcucaacagcguccagauccgcuccagccuggagcagccgcacaagaagcaccggcugugcgaggacaugaagcaguggaucaucgagcacguguucaagaagaccaagaccgugacgcacaagacccucauccaggcccugaagaagucccccuacaaggacgagcuguacgacgagagcaccggcaacuggaaggacgucuacggcacccagaaggaggaccgcuucgccuccagccucuccacguacaucagccugaaggagaucgugggggacaucguggacaacgcguucauggaggagaucaucuacuggcugaccgucuucaccgaccgggacaucaucacccucaagaugaacgacaaguaccccuucaucacggagcagcagauccagcgccugcugucccucaacaucagcggcugggggcagcugucccagcggcugcuccagagcauccccguggacgacaugaaccgcuccgugaucgaguacauggagaagcacgccgucaacuucauggagcugcugagcccgcggcagagcgaccucgccuacaagaucgagcaggucaacaagcagcacuccaagaagauccacaagauccgcuacgaggacaucgagcagcugaccggcagccccgcccugaagcgggggaucuggcgcuccgugaagaucaucgaggagcucaccgccaucuucggcgagcccaagaacaucaugaucgagguggcgcgggaggaccaggccagccaccgcaccaagucccggaaggagcagugggagagcaucggcaagucccuggccaaggaggagaaggagcugaaggccuucuucaaggagauggcccaguaccccaagcagcaguucgaccgcacccgguucuggcucuacgugacgcagcaggggaagugccuguacaccggcaagacccugcgccucgaggaccugagcuccuacgagaucgaccacauccugccgcgcaacuucgugaaggacgacagcaucgacaaccucgcgcuggucuaccccauggccaaccaggagaagaacaaggccgggaacaacaagaugccccuggagaucaucgacgccaagcagcagcccgcgaugauggcccacuggaagcggcucaaccagcugaagcugaucuccgacagcaagcuccacaagcugaugaagccguccuucaacgacguggacaaggagaacuucaucgcccgccagcugguggagacccggcagaucaucaagcacguccgcgaccuccugcaggagcgguucgagcacacggacauccacguggugaaggccaagauggucagccaguuccgcaaguucucccggauccccaagauccgcgacuacaacaacaagcaccacgccauggacgcgcuguucaccaccgugcucauccaguucauccugcagaaguacggcaagaacuuccugcaguucgaccuccagcacaaggacaucagcaagaagugguccaagaucgcccagagcaccaagcacuucuuccuguuccagcaguucgccgagcagcagaucaagagccccgugacgaaggagcuggucuccggggugcaguacuucgagcacaucuucuacgagcagagcuggcagaccaccaagaugacccagacgaucgacuccaacuucuacaaggagaccaucuucagcccgaagcucaagaccgccaaguacaccuccgccaaggcggagaaguucgugcacgacgccaucgucaaguacgccgugugcggcauccaguacacgagccugaagaagaacaaggagcagcaccacgugcugcucaccgacaucaacgucaucgagcacuaccagcugaaggaggccucccugaacgagcucgcccugcaccuggcgaagcgggagagcaaggacgacgugaucgacgcccagaugcucguggucauccccaaguacaagaagaucaugcugaacggcucccccuacuacugcaucagcuccgacgagcgccacaucgccacccaguucgugcugcggaaggaccuccuggaggccgugcugcacgucaacgacgagaccagcguggacgagcuccgcacgcuguuccgguccaucguggaggagaugaugacccaguacaaggucuacaacaaggacaccauccgcaacaagaucgacgcguucaucgagaccgagcugaucgacguggagacguuccaggugggguucaccgagaucaagaagauggucgccgccaacgcccagcggagcgacaaguucggcgggcgccuccgccaggugaugaagguggaggacaucuacaucaucgacgaguccaucaccggccugcgguaccggaagccccgcaagcuggucaaguga

SEQ ID NO: 1778 - RNA, 3984 nt, Artificial Sequence
  Cas9 variant
augaagaagaacuacaccaucggccuggacaucgggaccgccagcgugggcugggccguccucacggaggacuacgagcugaucaagcgcaagaugaagaucuccgggaacacccagaagaaggcggugaagaagaacuucuggggcgugcggcuguucgagcagggggagaccgccgagggccgccggcucaagcgcaccacgcggcgccggaucgcccgccggcgccagcggauccaguaccugcgcaccaucuucgacgagggcaugaaccaggucgacgccaacuucuucgcccggcuggacgagagcuucuccaucaucgacgagaaggagaacgagcgccaccccaucuucgggaacguggcggaggaggccgccuaccacgagcaguucccgaccaucuaccaccuccgggagcaccuggccaacagcuccgagcaggcggaccugcgccucguguaccuggcccuggcccacaucaucaaguuccggggccacuuccucaucgagggggagcugaacaccgagaacagcuccgucagcggcacguucgagcaguucaucaagguguacaacgagaccuucaacguggagaaggcccuggaccucaccgucgaccuggacgggaucgccgagcagaagaucucccgcaugaagcgggcggagcugauccucagccuguuccccgaggagaaguccaccggcgacuucgcccaguucaucaagaugaucgugggcaaccaggggaacgugaagaagacguucagccugaacgaggacgccaagauccaguucuccaaggaggaguacgaggagaaccucgagacccugcuggccgagaucggcgaggacuuccgcagcgucuucgacgccgcgaaguccguguacgacgccaucagccucgccaacauccugaaggugaccgacgccaccacgcgggccaagcuguccagcuccauggucgugcgcuucaccgaccacaaggaggaccucaagacccugaagcgcuucgugcgggagaaccugcccgacgaguacgacgaccucuucaagaacaagaaggucgcgggguacgccggcuacaucgacggcaacgagacccaggaggccuucuacaaguaccugaagaagacgcuggccaaggccaccggggcggagggcuuccucgccaagauggagcaggaggacuuccugcgcaagcagcggaccuucgacaacggggugauccccuaccagcugcaccucgaggagcugaaggccaucaucaagaaccagaaguccuacuacagcuuccuggacgaggagaagaucagccagcucaugaccuuccgcaucccguacuacgugggcccccuggccaaggagaaggggcaguucgcguggcugacgcggaaggagaugggcaagaucacccccuggaaccucaacgagaaggucgacaucgagaaguccgccaccgacuucguggagcgcaugaccaacaacgacagcuaccugcccauggagaaggugcugccgaagcacagccuccuguacgagacguucaccgucuacaacgagcugaccaaggugcgguacaucgacgacaacggccgcgcccagaacuucuccagcaaggagaagcggcagaucaucaacgagcuguucaagcagcagcgcaaggucaagaaggagaugcuggaggccuuccugaagaacgaguacgggaucgagaaccccaagguggagggcaucgagaaguccuucaacgccugccuggggaccuaccacgaccucaucaagcugggcauccggcccgagcuguucgagcagcccgagcacgagcagcaguucgagcagaucgugaagauccucacggucuucgaggaccgcaagaugcggcgcaagcagcuggagaaguucagcaacauccugaccgaggaggagcagaagcagcucgagcggaagcacuacaagggguggggccgccuguccgcgaagcugauccacggcaucguggaccagaagacccagaagaccauccucgacuaccugaucgacgacgacgaccugccgaagaaccggaaccgcaacuucaugcagcucaucaacgacgagaaccugagcuucaaggaggagaucgagaagaucgccuucgacaacgacaaguccacggaggagaucgugcaggagcuggccgggagccccgccaucaagaagggcauccuccagucccugaagaucgucgaggagaucaucgacaucaugggggagcugcccaccaacaucgugguggagauggcccgggagaaccagaccaccgcgcagggcaaccgcgccagcaaggcccgcaugaaguaccucgaggaguccaucaagaagcuggggagcuccauccuggaggacgagcccaucagcaaggacgccaaccuccugcggaacgaccgccuguuccucuacuaccugcagaacggccgggacauguacaccggcaacgagcuggacaucaacaaccucuccagcuacgacaucgaccacaucgucccgcagagcuucgugaaggacgacuccaucgacaaccgcgugcugacgaccagcuccaugaaccggggcaagagcaacaccguccccgccgaguccguggugaagaagaugcgccccaccugggagcggcugcucgcgagcgggcugaucuccaagaagaaguucagcuaccugacgaaggccaccaacgggggccucaccgaggaggacaaggcccacuucauccagcgccagcuggucgagacccggcagaucacgaagaacguggcccagauccugcaccagaaguacaacaacgagcagcucuccgagaagcccgugcgcgucaucacccucaagagcgcgcuggccucccaguuccggaaggacuucagccucuacaagauccgcgagcugaacgacuaccaccacgcccaggacgccuaccugaacggcgugaucgcccaggcgcuccugaagguguacccgaagcuggagcccgaguucgucuacggggaguaccagaagguguccauccgggcccucaacaaggccaccgccaagaaggaguucuacagcaacaucaugaacuucuucaccuccgacgagaugguggccaacgaggagacgggcgagguccuguggaaccgccagcgggacaucaagaccaucaagaaggugaugaacuaccaccagaugaacaucgugaagaaggucgagauccagaccggggcguucaccaaggagagcauccugcccaagggccccuccaagaagcucaucgcccgcaagaacaacugggccccggugaacuacgggggcguggacagccccacggucgccuacagcgugaucaucacccacgagaagggcaaggccgcgaaggugguccagcagcugguggggaucaagauccuggagcggcaggccuucgagcaggacgagguggccuuccucgaggagaagggcuucauccaccccaagguccagcugaagcugcccaaguacucccucuaccaguucgccgacgggcgccggcgccugcuggcgagcgccgaggagucccagaagggcaaccagauggugcucccggugcaccugaucgagcugcucuaccacgccaagcacgucagcgacuccagcgggaagucccuggaguaccugaacgagcaccggcacgaguucgccgagcuccuggaggccauccugcaguucaccgagcaguacaucgacgcgggcaagaaccagaagaaggugcgcgaccucuacgagaagaaccaggacgccgacaugcgcgagcuggccagcuccuucauccagcugcuccagcugaacaagcagggcgcccccgccgacuucaaguucuucggggagaccaucccccggcgccgguacaagaacacggcggagaucguggacgccaccuucaucaaccagagcaucaccggccuguacgagacccagaagcgccucgucuga

SEQ ID NO: 1779 - RNA, 3984 nt, Artificial Sequence
  Cas9 variant
augaccgagcagcagcagcccuacaacaucggccuggacaucgggaccagcuccaucggcugggccgugacggaccagaacgacaagcuccugcacauccgcgggcacaacggcaucgggguccggcuguucaaggagggcgagagcgccgcggagcgccggggcuuccgcaccacccggcgccggcucucccgccggcgcuggcggcugcgcuuccuggaccggaucuucgacgccgagcucgccaagguggacccgaacuuccuggcccgccugaagcagagcaacaucagcccccucgaccccaacaagcagauguucgggaacauccuguucgacgacccccaguucgacgaccagaaguuccaccagcaguacccgaccaucuaccaccuccggagcgcccucgcgcagcccgacgcgccccaggccgacgugcgccugaucuaccuggcccuccaccacaugaucaaguuccggggccacuuccugaacggggcggccgucgagaaguuccacggcgggcagcugcaccucgaguccgaguuccaggagcugaaccagaucuucagcaaccagcagcgcgaccacgugcagcugcagacguccagccucgacgagguggccaccauccugaaggacaaccagcggacccccuccgaccgccagcgggagcugagcgcccgccucuucgucccgguggacaagaccaucgacaaggagaacaagaagcuggccacggagcugcucaaggcggugcugggccugaaggccaaguucgacgucauccucggcguggaggccaccgacccccaggccuucaagcugcaguucuccagcgacgacuucgacgacaagaucgccgagcuggcguccgagcucaccgacgaggccaacgagauccugaccgugcugcagcgccucuacuucagccugaaccuggccgacauccucacgaaccggcagaccaagcaggucgccgacuccaucagcaccgccaugaucaaccgcuacgacgaccacaagcaccaccugaagaugcugaaggagcucgaggcccaggugacccaggagcagcgggacgggcugaagaaggccuacaacgaguacaucgacggcgacaagcccacgaucgacaccuucuacaccaacgugaagaagaaccuggacgacuccgagcucgccaaccagaucaagagccugaucgaccugcaggccuucaugcccaagcagcgcagcaaggagaacggguccaucccgcaccagcuccaccagcgggagcuggaccagcugaucgagguccagggcaaguacuaccccuggcugcucgccgcgaaggacaagcuggacgcccugaucgccuuccgcgugcccuacuacgugggccccaugaucgacccgaaccagagcgacgacccccagaacaccaaguucgccuggaugguccggaaggaggcgggggagaucacgcccuggaacuucgaggagaagguggacaagaccuccagcgccaccaacuucaucaagcgcaugaccacgaccgacaccuaccuccugggcgagcccgugcugccgaagaacucccuccuguaccagcaguucaccguccugaacgagcucaacaagcugaaggugaacgggaaggcccugacgguggaccagaagaaguaccucuacgaccacgucugcaagaagcagcggcgcgugacccugaagaagcugagcgacugccucgucgcccggggcgacuuccccaugggggccaucuucaccggcaccacggaccagaagaacaugaacaacacccugaagaccuaccaggacuuccaggagaucuucggcgacgagaucgacaaccccgaccgccagguggacuucgagaagaugaucgagugguccaccaucuucgaggaccgggagaucuucaagcugaagcucgcggagcugaacuggcugacgagcgagcagcucgagcgcguguccaagaagcgguaccagggguggggccgccugagccagaagcugcucacccacaucgucaacgagaacggggagcggaucaucgaccagcuguggaacaccaaccagaacuucauggagaucaugggccaggacuccgugaagcaggccauccaggagcacaacggggccaacguggcccagaccggcaucaacgagaccaucgacgagcuguacacgagcccccagaacaagaaggccauccgccagauccuccuggucguggacgacaucaagaaggcggugggcuacgccccggccaacaucaugauggaguucgcccgggaggaccgcgacgaccaccgccugaucgccucccgggcgcgccagcucgagaagaccuaccaggagaucagcaagaacugguucgacaacgaguccgucacccaggagcugaaggaccagaucaagaacaagaccaaguucacggaccggcuguaccucuacuucauccagggcgggaucgaccuguacaccgggcacccccugaacaucgaccagcucagcuccuacgacaucgaccacauccugccccagagcuuccugcucgacaacucccugaacaaccgcgugcugaccagccaggccgagaaccgggugcacaaggaggaccgccuccccggcgagaccgucgccaacaagaugcggccgacguggaagaugaugcgcgagcaggggcugaugacccagcggaaguacaacaaccugacccucaagcccgaccagaucagcaaguucaacaaccgcggccaguucaucaaccggcagcugguggagacccgccaggugaucaagcuggccgcggacaucaugucccagaaguaccaggccgaccagacgaaggucgugaccgugaaggccaaccucacccaccacaugcgggagaaguucaacuucuacaagagccgcaacgucaacgacuaccaccacgccuucgacgccuaccugacccuguucgugggcaacuggcuccugaaggaguaccccaagcugcagccguacuucguguacggggacuucgcgaagacgggcaccaacaaccucaaguccuucaacuuccuguaccgguucgagcgcgaccacaagcugaacgacaagggggccaucgacaccgacaaggaccagcagcucggcuacaugaagcggaucuaccgcuucaagaagaugcuggucaccaagcagcuggagacgaacgagggcgcccucuacgggcagacccuguaccccgcccccaagaacgacaagaagacccggaaccugaucaacagcaagaagaaccgccccuccgacaucuacggcggguacagcaacgagaacggcuccuuccucacccuggugaagcugaagaaggggagcaaguacgacuaccggcucguggccgucccgguguccaagaucagcgagaucaaggaguccgagcuggcgacgaucgagaaggccaucgcgccccaguuccugaaguccuccggcaaguaccgcgacuuccaggugguccucagcaagauccugaucaaccagaaggugaucgacgacggcaugaucuucaccaucggguccaagagcuacaagcacaacgccaagcaggucgugcuguccgacaacagcauccagaucgugagcacccucucccgcaucagcgacaaggagaagcugaucaccguguucgacgagaucgucgacaucacguccaaguaccugcccugguacaaggugaacgacguggagaagaccaagaugcuguuccggcagaugcaggacaucgacgagaugaagaagaucaucgacaacagccugaucggccugcacugcaacgccuccaucaccgaccucgggaaggucggccugagcaaguacugggggcgcuucgugcugaccgccggcaucucccucacgguggacgcccagcugaucuaccagagccccaccggccuguucgagcaccgggucaagguguccgaccucuga

SEQ ID NO: 1780 - RNA, 3990 nt, Artificial Sequence
  Cas9 variant
augaacaagcagcccuacaacaucggccuggacaucgggaccagcuccgugggcuggagcgccaccgagcucgacaaccgccugcugcacaucaaggggcacaacggcaucgggguccggcuguucaaggagggcgaguccgccgcggaccgccggggcuuccgcacgacccggcgccggcuggcccgccggaaguggcgccugcggcuccugaacgagaucuucgccaccgagaucgccaagguggacccgagcuucuucgcccgccugaagcaguccaacgugagccccaaggaccccaacaagaccauguucgggaacauccucuucgacgacgagaaccuggacgaccagaaguuccaccacgacuacaagacgaucuaccaccuccggcaggcgaucaucaaccaccccgagcagaaguucgacauccgccucaucuaccuggccaugcaccacaucaucaaguaccggggccacuuccugaaccaggccaacguccaggacuucaagggcgggaagaucgaccucgagaaguccuucaaggcccugaacgacaucuucgagaaccaggggcgcgaccugcggcucgugaccgacgaggcgaaccaguacgugaagguccugagcgacaacgccaagacccgcuccgaccggaagaaggagcugagcaagcuccuguacgugccgaucgacaaggacaccgacaagaacuccaagaaggugacgggcgagauccugaaggccauccucggcaacaaggccaaguucgacgucaucuucgggaucgagguggagaaccccaaggagugggugcugaccuucaacagcgacgacuucgacgacaagaucgagggccuguccagccagaugaccgacgaggacuccgagauccuccugauccugaaggagcucuacuucgcccugaaccugagcgacauccucaacaacuccgucaccgacaagaacgcgaagacgcugagcgaggccaugaucaaccgcuacgacgaccacaagaaccagcuggccaugcucaagaaggugaucgacuccagcgacaagaagcacgccaaggagcugaaggaggccuacagcgcguacaucgacggggagaacaacaagaagaucuccuucgaggaccugaagaagcggauccagaagaaccucguggacagcgagcugucccagaagaucaacgaccugcucgaccacgacuacuuccugcccaagcagcgcagcaaggagaacggcgccaucccccaccagcugcagcagcaggagcucgaccagaucaucgagucccagaagcaguacuacccguuccuggccgagcugaaccccaacgagaagcgcagccggcaggccaaguacaagcucgacgagcuggucgccuuccgcguguccuacuacgugggccccauggucgaggugaccgacagcaaccaggagaacaacgggaaguucgcguggaugauccggaaggagcagggcgagaucacccccuggaacuucgacgagaagguggaccgcaccgagacggccaccaaguucaucacccggaugaccacgaccgacaccuaccugaucggggagccgguccugcccaagaacucccuccuguaccagaaguucguggugcugaacgagcucaacaaccugaagaucaaccaggagaccaucacgcccggccagaagcaguaccuguacgagcacgucaugaagaagaacaagcgcgugacccucaagaagaucgccgacgcccuggucaucaagggggacuaccccuacgccccggaggugaagggcaccaccgaccagaagaaccugaacaacggccucacgaccuacaucgaccuggcgaagaucuucgggaacgagcuggacgacguggaccgggaggccgacuucgagaagaucaucgaguggagcaccaucuucgaggaccagcacaucuucguccucaagcugcaggagcugaaguggcucaccgagaagcagcgcaaccagguggugaagcugcgguaccagggcugggggaagcuguccaaggagcuccuggccggccuggucgacgacaacgggcagcgcaucaucgaccuccuguggagcgacaaccagaacuucaugcagaucgugaaccagaaguccuucaaggagagcaucgccgaccacaacggcgcgcaccuggaggagaagaaccucaaggacgugaucaacgaccuguacacgagcccccagaacaagaaggccauccggcaggucauccuggugguggacgacaucaucaacgccgucggcuacgagcccgccaacaucaugauggaguucgcccgcgaggacuccaacgaccaccggcucaccaacucccgcagccggcagcuggagaacguguacaaggacaucaccaacuccugguucgacaacgacagcgugaaggacgagcuggaggacaagaucaagaacaaggacaaguucaccgaccgccucuaccuguacuucacgcagggcgggaaggaccuguacaccggggagccccucaacaucgacgaccugagcuccuacgacaucgaccacauccugccgcagagcuucauccucgacaacucccuggacaaccggguccugaccagccagcgcaacaaccggguguccaaggaggaccagcuccccggcgagcuguucgggaccaagaugcacgcguucuggaagcgccugaaggccgcccaccucaucagcaacaagaaguacuacaaccugacccugacgcccaacuccaucagcaaguucaacaaccagggccgcuucaucaaccggcagcucguggagacccgccaggucaucaagcuggccgccgagauccugcacaaccgguacuccgaggagaagggcaccaacaucgugaccaucaaggcgaaccucacgcaccacaugcgcgagaaguucaacuucuacaagaaccggaacgugaacgacuaccaccacgccuucgacgccuaccugaccgccuucgucgggaacuggcugcuccagcaguaccccaagcugaagccguacuucguguacggcgacuucgccaagaccgagaucaacaaccucaagagcuucaacaugcucuacaaguucgagcaggcgcaccagcugaacgagaaggacgggaagaucgccaaggacaccgacgcccugcucggcuacaugaagaacguguaccacuucaagaagaugcuggucacgaaggagcuggagaccaaccacggcgcccucuucaaccagacccuguaccccucccccgcgcacgacaucaagaagcgccagcugaucaagcccaaggacaaccggccgaccgacaucuacgggggcuacacgcacgaggagcgcaaguacaugagccucgugaaggugaucgggaagaaggacaacgaguaccggauggccaacgucccccugcugaagaucaacaagaacaacgacaucaaggagauccucaagucccaguucagcaacaagaaguucgagaucgugcugcccaaggugcugaagaaccagcuguucuccgagaacggcgcccuguucgucaucgggagcaagggcuacaaguacaacgccaaccagcuggugcucuccgaccuggacaugaagcugcucaacgaccugagcaacaacaagagcaucgacgaggugaccaucaaccagcuguucaagaacaucgucgacuccaccaacaaguacaugccgcucuacgagaucaagaaccugaacgaggugguggagaaguucaacaaccuggaguucaacgacaagaagaagaccaucacggacuuccuccuggccacccacgcgaaccccaccaugagcaaccugaagaacaucggccuccccuacuucgggcgcuucauccggaacaccggcaucaagcuguccgagaacgccaacgucaucuaccagagccccacggggcuguucucccgcaagaucaagaucagcgacuucuga

SEQ ID NO: 1781 - RNA, 3993 nt, Artificial Sequence
  Cas9 variant
augaagaacgacuacaccaucggccuggacaucgggaccaacagcgugggcuacuccgucgugacggacgacuacaaggugaucagcaagaagaugaacgucuucgggaacaccgagaagaaguccaucaagaagaacuucuggggcgugcgccucuucgagagcgggcagaccgcccaggaggcccggaugaagcgcaccucccggcgccggaucgcgcgccggaagaaccgcaucugcuaccugcaggagaucuuccagcccgagaugaaccaccuggacaacaacuucuucuaccggcucaacgagagcuuccugguggccgacgacgccaaguacgacaagcacccgaucuucggcacgcuggacgaggagauccacuuccacgagcaguuccccaccaucuaccaccuccgcaaguaccuggccgacggcgacgagaaggccgaccugcggcucgucuaccuggcgaucgcccacaucaucaaguuccgcgggaacuuccugaucgagggcgagcucaacaccgagaacaacuccgugaucgagcugagcaagguguucguccagcuguacaaccagacccucuccgagcuggagggguuccaguucaucgacgagagcaucgacuucuccgaggugcugacgcagcagcucagcaaguccgagcgggccgacaacgugcugaagcuguuccccgacgagaagggcaccgggaucuucgcccaguucaucaagcucaucgucggcaaccagggcaacuucaagaagguguuccagcuggaggaggaccagaagcugcagcucagcaccgacgacuacgaggagaacaucgagaaccugcuggcgaucaucggggacgaguacggcgacaucuucguggccgcccagaaccucuaccaggccauccugcuggccgggauccucaccuccacggagaagacccgcgcgaagcugagcgccuccaugauccagcgguacgaggagcacgccaaggaccugaagcuccugaagcgcuucgucaaggagcacauccccgacaaguacgccgagaucuucaacgacgccaccaagaacggcuacgcgggcuacaucgacgggaagaccaaggaggaggaguucuacaaguaccugaagacgacccucgugcagaaguccggcuaccaguacuucaucgagaagaucgagcaggagaacuuccugcggaagcagcgcaucuacgacaacggggugaucccgcaccagguccacgccgaggagcugcgggccauccuccgcaagcaggagaaguacuacagcuuccugaaggagaaccacgagaagaucgagcagaucuucaaggugcggauccccuacuacgugggcccccuggccaagcacaacgagcagagccgcuucgccuggaacauccgcaagagcgacgagcccauccggccguggaacaugaacgacgucguggacgagaacgcguccgccguggccuucaucgagcgcaugaccaucaaggacaucuaccucaacgagaacguccugccccggcacagccugaucuacgagaaguucaccguguucaacgagcucacgaagguccuguacgccgacgaccgcgggguguuccagcgguucuccgccgaggagaaggaggacaucuucgagaagcuguucaagagcgagcgcaaggugaccaagaagaagcucgagaacuaccugcggaucgagcuguccaucagcucccccagcgucaagggcaucgaggagcaguucaacgcgaacuucggcaccuaccuggaccucaagaaguucgacgagcugcaccccuaccuggacgacgagaaguaccaggacacccucgaggaggugaucaaggugcugacggucuucgaggaccgcuccaugauccagaaccagcuggagcagcucccgcugaaccugagcaccaagaccaucaaggcccucucccggcgcaaguacaccggguggggccggcugagcgcccgccugaucgacgggauccacgacaagaacuccggcaagacgauccucgacuaccugaucgaggacgagagcgacuccuacaucgugaaccggaacuucaugcagcugaucaacgacgaccaccucagcuucaagaagaucaucgaggacucccagcccuacaaggagcagcagagcgccgaggagaucguguccgagcugagcgggagccccgcgaucaagaagggcauccugcagucccucaagaucgucgacgagcugguggccaucaugggcuacaagcccaagaacaucguggucgagauggcccgcgagaaccagaccaccgggcggggcaagcagaacagcaagccgcgccugaaggggaucgagaacggccucaaggaguucuccgacagcgugcugaagggguccagcaucgacaacaagcagcugcagaacgaccggcucuaccuguacuaccugcagaacggcaaggacauguacaccggccacgagcucgacaucgaccaccuguccacguacgacaucgaccacaucaucccccagagcuuccugaccgacaacuccaucgacaaccgcgugcucaccaccagcaaguccaaccggggcaagagcgacaacguccccuccgaggagguggugcgcaagauggaccgcuucuggcggaagcugcugaacgccaagcucaucagcgagcgcaaguacacgaaccugaccaagaaggagcugaccgaguccgacaaggccggguuccucaagcggcagcuggucgagacccgccagaucaccaagcacguggcgacgauccuggacagcaaguucaacgaggacuccaacaaccgggacgugcagaucaucacccucaagagcgcccuggucagcgaguuccgcaagaccuucaaccuguacaaggugcgggagaucaacgaccuccaccacgcccacgacgccuaccugaacgccguggucgcgcugucccuccugcgcguguacccccagcugaagccggaguucguguacggggaguacggcaagaacagcauccacgaccagaacaaggccaccaucaagaagcaguucuacuccaacaucacgcgguacuucgccagcaaggacuacaucaucaacgacgacggcgagauccucuggaacaagcaggagaccaucgcccaggucaucaagacccuggggaugcaccaggugaacguggucaagaagguggagauccagaagggcggguucuccaaggagagcauccagcccaagggcgagucccagaagcugauccgccggaagcagcaguggaacaccaagaaguacgggggcuucgacagccccguggucgccuacgcgauccuccuguccuucgacaagggcaagcgcaaggcccggagcuucaagaucguggggaucacgauccaggaccgcgaguccuucgagggcaaccccauccuguaccucagcaagaaggacuaccacaacccgaagguggaggccauccugcccaaguacucccuguucgaguucgagaacgggcggcgccggauggucgccagcgcguccgagacccagaagggcaaccagcucaucauccccgggcaccugauggagcugcucuaccacagcaagaagaucaucaacggcaagaacuccgacagcguguccuacauccagaacaacaaggagaaguuccgcgagaucuucgaguacaucguggacuucagcagcaaguacaucuccgccgacgccaaccugaacaagaucgagaagaucuucgagaacaacuuccacaaggccagcgagcaggagaucgccaaguccuucaucaaccugcucaccuucaccgcgaugggcgcccccgccgacuucgaguucuucggggagaagaucccgcggaagcgcuacgucagcaucuccgagaucaucgacgccguguucauccaccagagcaucacgggccuguacgagacccgggugcgccugaccgaggucuga

SEQ ID NO: 1782 - RNA, 3993 nt, Artificial Sequence
  Cas9 variant
auggagaaggaguacaccaucggccuggacaucgggaccaacagcgugggcugggccguccucacggacgacuaccgccugguggcccggaagauguccauccagggggacagcaaccgcaagaagaucaagaagaacuucuggggcgcgcggcuguucgaggaggggaagaccgcccaguuccgccggaucaagcgcaccaaccggcgccggaucgcccgccggcgccagcgggugcucgcccugcaggacaucuucgccgaggagauccacaagaaggaccccaacuucuucgcgcgccuggaggagggcgaccgggucgaggccgacaagcgcuucgccaaguucccgguguucgccacccucuccgaggagaagaacuaccaccggcaguaccccacgaucuaccaccuccgccacgaccuggcgaacagcaaggagcaggccgacauccggcucguguaccuggccaucgcccacugccugaaguaccgcggccacuuccucuucgagggggagcuggacaccgagaacaccuccgucaccgagaacuaccagcaguuccugcaggccuaccagcaguucuuccccgagcccaucggcgaccucgacgacgcggugccgauccugacggagcggcugagcaaggccaagcgcguggagaagguccucgccuacuaccccuccgagaaguccaccgggaacuucgcccaguuccugaagcugauggugggcaaccaggccaacuucaagaagaccuucgaccucgaggaggagaugaagcugaacuucacccgcgacugcuacgaggaggaccugaacgagcuccuggagaagacguccgacgacuacgcggagcuguuccucaaggccaaggggguguacgacgccauccugcugagccagauccucuccaagagcgacgacgagaccaaggccaagcuguccgccaacaugaagcugcgguucgaggagcaccagcgcgaccucaagcagcugaaggagcugguccggcgcgaccuccccaagaaguacgacgacuucuucaagaaccggagcaagaacggcuacgcgggcuacgugaaggggaaggccacccaggaggacuucuacaaguuccugcgcaccgagcuggccggccucgaggagucccagagcaucauggagaagaucgaccuggagaucuaccugcucaagcagcggacguucgccaacggggugaucccccaccagauccaccuggucgagaugcgcgagaucauggaccggcagaagcgcuucuacccguuccugaagggcgcccagggcaagaucgagaagcuccugaccuuccggauccccuacuacguggggccccuggcgcaggagggccagucccccuucgccuggaucaagcgcaagagcccgucccagaucacccccuggaacuucgccgagguggucgacaaggagaacagcgccaucgaguucaucgagcggaugaccaaccaggacacguaccuccccaaggagaaggugcugcccaagcagagccugaucuaccagcgcuucaugaucuucaacgagcugaccaagguguccuacaccgacgagcggggcaagagccacuacuucuccagcgagcagaagcgcaagaucuucaacgagcuguucaagcagcacccgcgggucaccgagaagcagcugcgcaaguuccuggagcucaacgagcagaucgacuccacggagaucaaggggaucgagaccagcuucaacgcguccuacagcaccuaccacgaccugcugaagcucuccgaccagauggacacccugcuggacgaccccgacaugacgaccauguucgaggagaucaucaagauccucaccaucuucgaggaccgggagaugauccgcgagcagcugaagcccuacgagaccgugcuggggcuccccgccaucaagaagcuggccaagaagcacuacacgggcuggggccgccugagcgagaagaugauccaggggaugcgggagaagcagucccgcaagaccauccucgacuaccugaucgacgacgacgacuucccgugcaaccggaaccgcaacuucaugcagcugaucaacgacgaccaccucagcuucaaggagaccaucgccaacgagcugaucauguccgacagcaacgugcugcucgaccaggucaaggccauccccggcucccccgcggugaagaaggggaucuggcagagcaucaagaucgucgaggagaucaucggcaucaucgggaaggcccccaagaacaucgugaucgagauggcccgggagaaccagcgcaccucccggagccgcccgcggcugaaggcccuggaggaggcccucaagaacaucgacagcccccugcugaaggacuaccccacggacaaccaggcgcuccagaaggaccgccuguaccuguacuaccuccagaacggcaaggacauguacaccggcgagccccuggagauccaccggcugagcgaguacgacaucgaccacaucaucccgcgcagcuucaucguggacaacucccucgacaacaagguccuggugagcuccaaggugaaccgggggaagcuggacaacgcccccgacccccucgucgugaagcgcaugcggagccacugggagaagcugcaccaggccaagcugaucuccgacaagaagcucgccaaccugaccaagcagaaccugaccgaggccgacaaggcgcgcuucauccagcggcagcucguggagacccgccagaucacgaagcacgucgccaaccugcugcaccagcacuucaaccucccggaggaggugagcgccaccgagaagaccuccaucaucacccucaagagcacgcugaccucccaguuccggcagauguucgacaucuacaaggugcgcgagaucaaccaccaccaccacgcccacgacgcguaccugaacggcgucguggccaugacccugcugaagaaguaccccaagcucgcccccgaguucguguacgggagcuacaucaagggcgacaucaaccagaucaacaaggccaccgccaagaaggaguucuacuccaacaucaugaaguucuucgagagcgaggagaucaucugcgacgagcagggggaggucaucuggaacaagaagcgggaccuguccacgaucaagaagaccaucggcgcgcaccaggugaacaucgugaagaaggucgagaagcagaagggcggguucuacaaggagaccaucaacagcaaggccaaccccgagaagcugaucccgcgcaaggccucccucgacccccugaaguacggcggguacggcagcccccugguggccuacaccgugaucuucaucuucgagaagggcaagcagaagaaggucacgaaggggaucgagggcaucaccgugauggagcagcuccgcuucgagcaggacccccgggaguuccugaagaccaagggguacgagggcgugaagcaguggcugauccucccgaaguacauccuguucgaggcccagggcggguaccgccggaugaucgcgucccaccaggagacccagaaggccaacagccugauccuccccgagaaccuggucacgcugcucuaccacgcccgccacuacgacgagaucaaccacaaggugagcuucgacuacgugaacgcccacaaggagggcuucaacgacaucuucgacuucaucuccgacuucgggguccgguacauccuggcgccccagcaccuggagaagaucaagguggccuacgagaagaacaaggagguggaccucaaggagaugaucgacgccauccugagccugcucaaguucacccuguucggcgccuccgucgaguucaaguucuucgacaucaagauccugaagcgcuacaagagccucaccgacaucugggaggccaccaucaucuaccaguccgugacggggcuguacgagcggcgcguggagguccggaagcugugggacggcgagcgccucuga

SEQ ID NO: 1783 - RNA, 3996 nt, Artificial Sequence
  Cas9 variant
augaacaagcagcccuacaacaucggccuggacaucgggaccagcuccgugggcuggagcgccaccgagcucgacaaccgccugcugcacaucaaggggcacaacggcaucgggguccgccucuucaaggagggcgaguccgccgcggaccggcggggcuuccgcacgacccggcgccggcuggcccgccggaaguggcgccugcggcuccugaacgagaucuucgccaccgagaucgccaagguggacccgagcuucuucgcccgccugaagcaguccaacgugagccccaaggaccccaacaagaccauguucgagaacauccucuucgacgacgagaaccuggacgaccagaaguuccaccacgacuacaagacgaucuaccaccuccggcaggcgaucaucaaccaccccgagcagaaguucgacauccgccucaucuaccuggccaugcaccacaucaucaaguaccgggggcacuuccugaaccaggccaacguccaggacuucaagggcgggaagaucgaccucgagaaguccuucaaggcccugaacgacaucuucgagaaccagggccgcgaccugcggcucgugaccgacaaggcgaaccaguacgugaagguccugagcgacaacgccaagacccgcuccgaccggaagaaggagcugagcaagcuccuguacgugccgaucgacaaggacaccgacaagaacuccaagaaggugacgggggagauccugaaggccauccucggcaacaaggccaaguucgacgucaucuucggcaucgagguggagaaccccaaggagugggugcugaccuucaacagcgacgacuucgacgacaagaucgaggggcuguccagccagaugaccgacgaggacuccgagauccuccugauccugaaggagcucuacuucgcccugaaccugagcgacauccucaacaacuccgucaccgacaagaacgcgaagacgcugagcgaggccaugaucaaccgcuacgacgaccacaagaaccagcuggccaugcucaagaaggugaucgacuccagcgacaagaagcacgccaaggagcugaaggaggccuacagcgcguacaucgacggcgagaacaacaagaagaucuccuucgaggaccugaagaagcggauccagaagaaccucguggacagcgagcugucccagaagaucaacgaccugcucgaccacgacuacuuccugcccaagcagcgcagcaaggagaacggggccaucccccaccagcugcagcagcaggagcucgaccagaucaucgagucccagaagcaguacuacccguuccuggccgagcugaaccccaacgagaagcgcagccggcaggccaaguacaagcucgacgagcuggucgccuuccgcgugcccuacuacgugggccccauggucgaggugaccgacuccaaccaggagaacaacggcaaguucgcguggaugauccggaaggagcagggggagaucaccccguggaacuucgacgagaagguggaccgcaccgagacggccaccaaguucaucacccggaugaccacgaccgacaccuaccugaucggcgagcccguccugcccaagaacagccuccuguaccagaaguucguggugcugaacgagcucaacaaccugaagaucaaccaggagaucaucacccccgggcagaagcaguaccuguacgagcacgucaugaagaagaacaagcgcgugacgcucaagaagaucgccgacgcccuggucaucaagggcgacuacccguacgcccccgaggugaaggggaccaccgaccagaagaaccugaacaacggccucaccacguacaucgaccuggcgaagaucuucggcaacgagcuggacgacguggaccgggaggccgacuucgagaagaucaucgagugguccaccaucuucgaggaccagcacaucuucgcccucaagcugcaggagcugaaguggcucaccgagaagcagcgcaaccaggucgugaagcugcgguaccagggguggggcaagcugagcaaggagcuccuggccgggcugguggacgacaacggccagcgcaucaucgaccuccugugguccgacaaccagaacuucaugcagaucgucaaccagaaguccuucaaggagagcaucgcggaccacaacggggcccaccuggaggagaagaaccucaaggacgugaucaacgaccuguacaccagcccccagaacaagaaggccauccgccaggugauccuggucguggacgacaucaucaacgccgugggcuacgagcccgccaacaucaugauggaguucgcgcgggaggacuccaacgaccaccggcucacgaacagccgcucccggcagcuggagaacgucuacaaggacaucaccaacagcugguucgacaacgacuccgugaaggacgagcuggaggacaagaucaagaacaaggacaaguucaccgaccgccucuaccuguacuucacccagggcgggaaggaccuguacacgggcgagccgcucaacaucgacgaccugagcagcuacgacaucgaccacauccugccccaguccuucauccucgacaacagccuggacaaccgggugcugaccucccagcgcaacaaccgggucagcaaggaggaccagcuccccggggagcuguucggcaccaagaugcacgccuucuggaagcgccugaaggccgcccaccucaucuccaacaagaaguacuacaaccugacccugacccccaacagcaucuccaaguucaacaaccaggggcgcuucaucaaccggcagcucguggagacgcgccaggugaucaagcuggccgcggagauccugcacaaccgguacagcgaggagaagggcaccaacaucgucaccaucaaggccaaccucacccaccacaugcgcgagaaguucaacuucuacaagaaccggaacgugaacgacuaccaccacgccuucgacgccuaccugacggccuucgugggcaacuggcugcuccagcaguacccgaagcugaagcccuacuucgucuacggggacuucgcgaagaccgagaucaacaaccugaaguccuucaacaugcucuacaaguucgagcaggcccaccagcugaacgagaaggacggcaagaucgccaaggacgccgacgcgcugcucggguacaugaagaacguguaccacuucaagaagaugcuggugaccaagaagcuggagaccaaccacggcgcccucuucaagcagacgcuguaccccagccccgcccacgacaucaagaagcgccagcugaucaagccgaaggacaaccggcccaccgacaucuacggcggguacacccacgaggagcgcaaguacaugucccucgucaaggugaucggcaagaaggacaacgaguaccggauggccaacgugccccugcugaagaucaacaagaacaacgacaucaaggagauccucaagagccaguucuccaacaagaaguucgagaucguccugccgaaggugcugaagaaccagcuguucagcgagaacggggcccuguucgugaucggcuccaagggguacaaguacaacgcgaaccagcugguccucagcgaccuggacaugaagcugcucaacgaccuguccaacaacaagagcaucgacgaggugaccaucaaccagcuguucaagaacaucguggacagcacgaacaaguacaugccccucuacgagaucaagaaccugaacgaggucguggagaaguucaacaaccuggaguucaacgacaagaagaagaccaucaccgacuuccuccuggccacccacgccaaccccacgauguccaaccugaagaacaucggccuccccagcuacuucggccgcuucaccuccgggaacgccggcaucaagcugagcgagaacgccaacgugaucuaccaguccccgaccgggcuguucagccggaaggucaagaucuccgacuucuga

SEQ ID NO: 1784 - RNA, 3999 nt, Artificial Sequence
  Cas9 variant
augaagaaccgcgagaacaucaaguacuacaucggcguggacaucgggaccaacagcgucggcugggccgugaucgacgagaacgggaaccugcucaagaagggcaagcaccaccugugggggucccggcuguucgaccaggcccagaccgcgcagaaccgccggaacuaccgcagcucccggcgccgguacaacaagcgccggcagcgcaucggccuccugcggcugaucaugagcgacauggugcucgaggucgaccccuccuucuucauccgccuggagaagacgaccuuccuggacaaggaggacaagaaggccauccucaaggacaacuacaagaugaacuacaaccuguucugcgacgaggacuacaacgacaagaaguacuucaaggacuacccgaccaucuaccaccuccggaagaagcucugcgagagcgacgagaaggccgacccccgccugaucuaccuggcccuccaccacaucgugaaguaccggggcaacuuccuguacgaggggcaggagcugcaccucgagcccuccaacaaggaggaggaccugaagauccuguucgacauccucggcaagaacaacgacaccguguacgacaucagcgaggagcagauccaguucauccugaagacggucguggagaacaucuccaagaccgccaagguggacgagugcaugagccagcugaagcucaacuccgaggacaagaagaucgucaaggaguucaugcgcgggcuggugggcaacaaguucaacgugagcaagcuguacaugcacgaggaccuccaguucgacgacgaggaccugaagcugcaguucuccgacaagagcuacgaggagaagaucaccgaguacgagaacguccucgaggagaagauggaguucaucgaccugaugcagcgguucuacuccuggaucgagcugagcaagaucgugggguccgacagccagcacgcguccaucagcggcgccauggugaacaucuacgagagccaccgcgaggaccuccggacccugaaggaggucaugcugaagaucggcaagaaggaguacgacgagauguucaagcccacguccaagaacguggugaacuacuacaacuacgucaacccgguggccugcagcggggacaagaccgacggcuucuacaaguacgugaagaaggccaucgagaaguccgacgacagccgcaaggacgagauccuccagaagaucgcgaacgagaccuacaugcugaagcagaccuccaagaacaacgccuacauccccuaccagaugcagaaggacgagcugaucaagauccucgaccaccaggagaaguacuaccccguccugaaggagaaccgggacaagaucaucagcauccuggaguuccgcauccccuacuacuacgggccgcucgacggcaacaagcaguucggcuggcugaucaagaagaaggggaaggagaacgagcgcauccugcccuggaaccaccaggagaucguggacgugcaggagacggccgcccaguucaucaagaagcucaccaacuacugcaccuaccugcccaucgagaaggucaugccccagaagucccugaccugcagcauguacgaggugcucuccgaggucaacaagauccggaucgacggcaagcugcugccgaucgacacgaagaaccgccugaucgaggaccucuucuucaagcggaagaccgugaaggagaaggaccugaucaacuggcugaagcagaaccagcucaccgugggggagaucaccggcuaccagaaggagaaggccuucagcuccagccuggcgcccuggaucgacuucaaggagaucuucgacgagaucaacgacuccaacuacgaccugaucgagaagaucaucgaggacaugacgaucuucaacgaggggagcauccucaaggagcgccugaagaaggccuacaaccuggaccagaacaaggucaagaagaucaugaagcucaaguacuccggcuggagccggcuguccaagaagcugaucaacggcauccgcgccgacaacaaguucgggagcuccgugagcauccucgacgugaugaaggagagccacauggcccugauggagaucaucaacgaccaggaccugggcuucaagcagaucaucgagaaggagaacuucaagaacgagaccggguccuucgaguacgaggacaucgagaaccucgccggcagccccgcgcugaagcgggggaucuggcagacccugcaggucaucgaggagaucaagaacuacaugggccacgagcccaagaacaucuacaucgaguucgcccgcgaggagcaggagaaggugcggaccacgacccgcgugaagaagcucaaguccaucuacaacgacaucaagaaccagcuggacguccacggcaaggagguguacagcaaccugaacaagcaggacgagaaguccagcaucgagaagcggcucuaccuguacuacacccagcuggggaagugcauguacuccggcgagagccucgacaucgacaagcuguccaacuacgagaucgaccacaucuucccgcgcacccugacgagcgacgacucccucgacaaccuggugcuggucaagaagaaggagaaccagcggaagcucgacgaccuggugcugccccucgagauccgcaacaagauggagguguucuggaagaagcuguacgacaacgggcugaucacccagaccaaguacuaccggcucaugcgcgacgaguuccggcgcgaccagaucgacaaguucaucaaccggcagcuggucgagacccgccagaucaucaagcacguggccaacaucaucgagaaccacuacgaggacacgaagguguucaccguccgcgccaaccugagccacgaguuccgggagaaguacggcaucuacaagaaccgcaacgugaacgacuuccaccacgcccacgacgcguacaucgccugcaucaucgggcgguacauccagauccgcuuccccggccucgaggccaaguacguguacggccaguacaugcagaacgucaagaagaccaagaacaacaucgacaaggagaaccacggguucaucaucaacuccaugaaguacgagugcaucgacgaggacaccggcgaggugaucuggaaccccgagcggauccuggacuacaucaagugcuucaacuaccgcgacguguacaucacgaagaagcuggacaccaacaaccgggagcuguucaacgucaccauccugccgaacgacaagaacagcgagaaggggaagaccaaggccaccauccccgugaacaagcugcgcuccaacgugcggaaguacggcggcuucagcgggcuccaguccgacaucgucgccaucgagggcaagaaggggaagaagaucgaccgccggcugaucaaccugcccauccuccugcgcuacgugagcaucgaggaccagugcaaguacaucauggagaacaacaaguacagcgacgugaagaucaucaagaagaucaagaagaaccagcugaucgagaucgacggcaucugcuacuaccucaaguccgcggacgagcuggacacggccuaccagcugauccucagccgggacgacaacgagaugaucuaccgcaucgaccgggccauccagaacaacgacuucuccuacuucgacaacaagaaggagaacaucgacgagcuguaccgccugaucugccacaagaugaucgagaacuaccccaaguacaagaagaaggucuacgaguucaucaaggagcgggaggaggaguucuucgagcucgacaacagccagaagugcaucgugaucuucgagaugauccgcgugaugaagcgcggggagcaguacaucaacaucccguucgagcccuacaaccugaagaacgaccggaagggccggcugaacugccaguccauccuccuggacaacaccuacuucuacgacgucagcaucaccggcaucuacuccaagaaguacaagcuguga

SEQ ID NO: 1785 - RNA, 3999 nt, Artificial Sequence
  Cas9 variant
augcagaagaacuacaccaucggccuggacaucgggaccaacagcgugggcugggccgucaugaaggacgacuacacgcucauccgcaagcggaugaaggugcuggggaacaccgacaucaagaagaucaagaagaacuucuggggcgugcgccuguucgacgagggggagaccgccaaggagacccggcucaagcgcggcacgcggcgccgguaccagcgccggcgcaaccggcugaucuaccugcaggacaucuuccagcagcccaugcucgcgaucgacgagaacuucuuccaccgccuggacgacuccuucuucgucccggacgacaagagcuacgaccggcaccccaucuucggcucccuggaggaggagguggccuaccacaacaccuaccccaccaucuaccaccuccgcaagcaccuggccgacaaccccgagaaggccgaccugcggcucguguacaccgcccuggcgcacaucgucaaguaccgcgggcacuuccugaucgagggcgagcucaacacggagaacaccagcaucuccgagaccuucgagcaguuccuggacaccuacagcgacaucuucaaggagcagcuggugggggacaucuccaagguggaggagauccucagcuccaagcagagccggucccgcaagcacgagcagaucauggcccuguucccgaacgagaacaagcugggcaacuucgggcgguucaugaugcucaucgucggcaacacgagcaacuucaagcccguguucgaccuggacgacgaguacaagcugaagcucuccgacgagaccuacgaggaggaccuggacacccugcucggcaugaccgacgacguguuccuggacgucuucauggccgccaagaacguguacgacgcgguggagaugagcgccaucaucuccacggacaccgggaacagcaaggccguccuguccaaccagaugaucaacuucuacgacgagcacaagguggaccucgcccagcugaagcaguucuucaagacccaccuccccgacaaguacuacgagugcuucagcgaccccuccaagaacggcuacgccggguacaucgacggcaagaccaaccaggaggacuucuacaaguacaucgagaaggugaugaagacgaucaagagcgacaagaaggacuacuuccucgacaagaucgaccgcgaggucuuccugcggaagcagcgcagcuucuacaacuccgugaucccgcaccagauccaccuccaggagaugcaggcgauccuggaccgccagagccaguacuaccccuuccuggccgagaaccgggacaagaucgagucccuggugaccuuccgcauccccuacuacgucggcccccucaccgugagcgaccaguccgaguucgccuggauggagcggcagagcgacgagccgauccgccccuggaacuucgacgagaucgugaacaaggagcgguccgccgagaaguucaucgagcgcaugaccaacauggacacguaccugcuggaggagaagguccuccccaagcggagccugcuguaccagaccuucgagguguacaacgagcucaccaagguccgcuacaccaacgagcaggggaagacggagaagcugaaccggcagcagaaggccgagaucaucgagacccuguucaagcagaagaaccgcgugcgggagaaggacaucgcgaacuaccucgagcaguacggcuacguggacgggaccgacaucaagggcgucgaggacaaguucaacgccucccugagcaccuacaacgaccuggccaagaucgacggggccaaggccuaccuggacgaccccgaguacgcggacgugugggaggacaucaucaagauccucacgaucuucgaggacaaggccaugcgcaagaagcagcugcagaccuacuccgacacccugagcccggagauccucaagaagcuggagcggaagcacuacaccggcuggggccgcuucuccaagaagcugaucaacgggcuccgggacgagggcagcaacaagacgauccuggacuaccugaaguccgacgaggggagcuccggccccaccaaccgcaacuucaugcagcucauccgggacaacacccugagcuucaagaagaagaucgaggacgcccagaccaucgaggacaccacgcacaucuacgacaccguggccgagcugcccgggucccccgccaucaagaagggcauccgccaggcgcucaagaucgucgaggagaucaucgacaucaucggcuacgagccggagaacaucgugguggagauggcccgggagagccagaccaccaagaaggggaaggaccugagcaaggagcgccuggagaagcucacggaggccaucaaggaguucgacggccccuccgacgucaaggugaaggaccugaagaacgagaaccugcgcaacgaccggcucuaccuguacuaccugcagaacgggcgcgacauguacaccaacgagccccucgacaucaacaaccugagcaaguacgacaucgaccacaucaucccccaguccuucaccaccgacaacagcaucgacaacaaggugcuggucucccggacgaagaaccagggcaacaagagcgacgacgugccguccaucaacaucgugcacaagaugaagcccuucuggcgccagcuccacaaggccgggcugaucagcgaccggaaguucaagaaccugaccaaggcggagcacggcggccucaccgaggccgaccgcgcccacuuccugaaccggcagcuggucgagacccgccagaucacgaagcacguggccaaccuccuggacucccaguacaacaccgccgaggagcagcggaucaacaucgugcugcucaagagcuccaugaccagccgcuuccggaaggaguucaagcuguacaagguccgcgagaucaacgacuaccaccacgggcacgacgcguaccugaacgccgugguggccaccacgaucaugaaggucuaccccaaccucaagccccaguucguguacggccaguacaagaagaccuccauguucaaggaggagaaggccaccgcccggaagcacuucuacagcaacaucaccaaguucuucaagaaggagaagguggucaacgaggagacgggggagauccugugggacaccgagcgccaccuguccaccaucaagcgggugcucagcuggaagcagaugaacaucgugaagaaggucgagaagcagaagggccagcuguggaaggagaccaucuacccgaagggcgacuccagcaagcugauccccgugaaggaggggauggacccccagaaguacggcgggcucagccagguguccgaggcguucgccgucgugaucacgcacgagaagggcaagaagaagcagcucaagagcgaccugaucuccaucccgaucguggaccagaaggccuacgagcagcaccccaccgccuaccuggaggaggccggguacaacaaccccaccguccugcacgagcuguucaaguaccagcuguucgagcuggaggacggcagccgccggaugaucgcguccgccaaggaguuccagaagggcaaccagauggugcugccccucgagcugguggagcugcucuaccacgccaaccgcuacgacaaggucaaguucccggacagcaucgaguacgugcacgacaaccuggccaaguucgacgaccugcucgaguacgugaucgacuucuccaacaaguacaucaacgcggacaagaacguccagaagauccagaagaucuacaaggagcacgggaccgaggacguggagcugacgguggagagcuucgucaaccugaugaccuucaccgccaugggcgcccccgccaccuucaaguucuacggggaguccaucacgcggagccgcuacaccuccaucaccgaguuccggggcagcacccucaucuuccaguccaucacggggcuguacgagacccgcuacaagcuggaggacaacuga

SEQ ID NO: 1786 - RNA, 3999 nt, Artificial Sequence
  Cas9 variant
augaugaaggaguacagcaucggccuggacaucggguccagcuccgugggcuucgucgccguggacgaccaguaccgcgugguccgggccaaggggaagaacgugaucggcacccgccucuucgacgaggggaagaccgcggccgaccggcgcggccugcggacgacccgccggcgccugagccggcgcaaguggcggcuccgccugcugcggggcaucuucgagccccacaucaacgagaucgacgaguccuucuucaugcgccucaaggagagcaacaucuccccgaaggacagcaacaagcacuuccccggggacauccuguucaacgaccgguccgaccgcgaguucuacgagaacuaccccaccaucuaccaccuccggcaggcccucaagaccgagaagcgccaguucgacauccgggagaucuaccuggccaugcaccacaucgugaaguaccgcggccacuuccuggagggcgggacggucaccgacuucgaggugggggagcucgaccuggccggcaaguucagccggcugaacgagcuguucgaguccaucaaccuggaggugcccuucguccugcgccucgacaaccuggaggacgugaaggcggugcugaucgacagccagcgcuccgcccaggaccggcagcgcacccucaccccggacaucuacguccccagcacggacaagaucaccgagaagcgguucaagggcaucgccaccgagcugcugaaggccaucguggggaacaaggcgaaguucgacgugcucgccggccuggagcuggacaaggaggaggccaagcucugggcccugaccuucgacuccgagacguucgacgaggacaucgagcagcuggagggggacaugaccgaggccacccaggaccucaucgagauccucaagagccugcgcucccucauccggcuggcggucaacaugcccgagggcgugagccuguccgagaugaugauccagcgcuacgaggaccacgccgaccaccucaagcugcugcgggacaucauccacaacaccgacgccgagaaggccgccggccuccaggcggccuacgacggguacaucgacggcgugaaggggaagaagacgcccgucgacgacuucuacaaggccaucaagaagaaccuggacgacagcgaggccgcccaccagauccuggcgcucaucgacaagaacgaguucaugccgaagcagcgcagcaaguccaacggcuggaucccccaccagauccagcagaaggagcuggaccggaucaucgagaaccagaagcaguacuaccccuggcuggccgacgugaaccccaacgagagccgccggaagguggccccguacaagaucgacgagcucgucaccuuccgcgugcccuacuacguggggccccuggucaccuccgaggagcagaagaaguacggcagcaaguucgccuggauggugcggaaggaggagaagggcgagaucacccccuggaacuucgaccagaaggucgaccgcgccgcguccgccacggaguucaucaaccggaugaccaccauggacaccuaccugcucaacgaggacgugcugccggcccacagccugaucuaccagaaguacgaggugcugaacgagcucaacaaggucaagaucaacggggacgccaucacgcccgagcugaagcagaagaucuaccacgaccuguucgagaagcagaccaccguguccaucaagaaccuccagaccuaccuggugagcgaguccgaggcgagcgagguccccgagaucaagggccuggccgacgagaagaaguuccucuccgggcugacgaccuaccacgaccugaugaagaucuucgaccgcaacguggugaacgaccccgagcgggccgaggacuucgagaagaucauccgcuggagcaccgucuucgaggacaagcacaucuaccgggagaagcucgacucccugagcuggcugaccacggaccagaaggaccgccucgccgugaagcgcuaccggggcugggggcgccuguccgagaagcugcucaucggccugcgggacgagggccaccgcagcaucauggacuaccugugggagaccaccuccaacuucaugcagauccaggcccagaacgacuucagcgagaagaucgcggccgagaacaaggaguuccucgacaacacccaguccgugcaggggaucaucaacgagcuguacacgagcccgcagaacaagaaggccauccggcagacccugcucgucguggaggacaucaagaaggccuuccacggcgaggcccccaagcgcaucuucguggaguucgcgcgggagaacgagagcacgccccagcgcuccauccagcggcagcgccaggucgagaacgccuacgagaaggugacccagaaccugcugguggacgacaagauccgggccgagcucaaggacagcaucaacgagaagcgccuguuccacgaccggcuguuccucuacuucaugcagggcgggaucgacauguacuccgggaagaagaucaacaucgacaaccugagcgccuacgacaucgaccacauccugccccaguccuucaccgucgacaacagccucgacaaccgcgugcugaccaaccagaaggacaaccgggagaagggcaacucccugccgagcgagcucuaccgcggcuccaugaaggagaccugggagaugaugcggaaccaggggcugcugagcaagggcaaguuccaccgccucaugaugacccccaacuccaugaccgccuacgaccagcagggguucaucaaccggcagcugguggagacgcgccaggucaucaagcuggcgguggagauccucgccagcgaguucgaccaggccgacgagaagguggagaucgucuccgugaaggccggccugacccaccagaugcggcaggacuucagccugaucaagaaccgcgacgugaacgacuaccaccacgcguucgacgccuaccucaccgccuucgucggcaccuaccugcugaagcgcuaccccaagcuccggcccuacuucguguacggggaguucaagaaguucucccagaagcaggccaaccugacgaacuucaacuuccugugggcccucaagcacaaggaccagguggcggucgaggacaccggcgagaagaucuggaacaagccgcaggaccuggccuacauccgccaccuguucgccuucaagaagauccucaucagccgggagguguccgagcgccacggggcccuguucgaccagacccuguacaaggccagcgacgacaaggcgagcggccagggguccaagaagcucauccccgccaaggacaaccggcccaccgagcuguacggcggcuacagcgggcagacguccgccuucauggccaucgugaaggucaccaagggcaagaagaccaaguaccugguggugggggucccgaccgccgcgaucagccagcuccagggcauggacgugaaguccagccaguacacggagaagaucuacaacauccugucccccaagcugcucagcaagaacgacgacuucgaggugaucguccccaaggugcgcuaccggcagcugauccuggacaacaaccagcuguucacccugggguccgacaccuacaaguacaacgcccgccagcuggugcucagcaacgagguccuggccgugaucaaccgggacaaguccuucaucgacaagaagcugagcgaggaggccgagaaccaggcgcucaacgacgccuucgacgagaucguggucgccauggacaagcacuucgaccuguacgacaagaacggcuuccgcgagaaggugaaggccggcaagcagcgguucgaggagcugcccgugucccucuucagcgaggacaaggagaacgaggggaucaccaagcgcacgguccugaagcggauccugcagggccuccacgccaacgcgaccaccuccgaccugaaggugcuggacgggaaguucuacaacuga

SEQ ID NO: 1787 - RNA, 4002 nt, Artificial Sequence
  Cas9 variant
augaagaacuacaccaucggccuggacaucgggguggccagcgucggcugggugugcaucgacgagaacuacaagauccucaacuacaacaaccgccacgccuucggggugcacgaguucgaguccgcggagagcgccgccggccggcgccugaagcgggggaugcgccggcgcuacaaccggcgcaagaagcggcugcagcuccugcagucccuguucgacagcuacaucaccgacuccggcuucuucagcaagacggacucccagcacuucuggaagaacaacaacgaguucgagaaccgcagccucaccgagguccuguccagccugcggaucuccagccgcaaguaccccaccaucuaccaccuccgguccgaccugaucgagagcaacaagaagauggaccugcgccucguguaccuggcccugcacaaccucgugaaguaccggggccacuuccugcaggaggggaacugguccgaggccgcgagcgccgagggcauggacgaccagcugcucgagcuggucacccgcuacgccgagcuggagaaccucuccccgcuggaccugagcgagucccaguggaaggccgcggagacgcuccugcugaaccggaaccucaccaagaccgaccagagcaaggagcugaccgccauguucgggaaggaguacgagcccuucugcaagcugguggccggccucggggugagccugcaccagcuguuccccuccagcgagcaggcccucgccuacaaggagacgaagaccaagguccagcuguccaacgagaacguggaggaggugauggagcugcuccuggaggaggagagcgcgcugcucgaggccguccagcccuucuaccagcaggucgugcuguacgagcugcucaagggcgagaccuacguggccaaggccaagguguccgccuucaagcaguaccagaaggacauggcgagccugaagaaccugcucgacaagaccuucggcgagaagguguaccgcuccuacuucaucagcgacaagaacucccagcgggaguaccagaagucccacaaggucgaggugcugugcaagcuggaccaguucaacaaggaggccaaguucgccgagacguucuacaaggaccucaagaagcugcuggaggacaagagcaagaccagcaucgggaccaccgagaaggacgagaugcugcgcaucaucaaggccaucgacuccaaccaguuccuccagaagcagaagggcauccagaacgccgcgaucccgcaccagaacagccuguacgaggccgagaagauccugcggaaccagcaggcccacuaccccuucaucacgaccgaguggaucgagaaggugaagcagauccucgccuuccgcauccccuacuacaucgggccccuggucaaggacaccacccaguccccguucagcuggguggagcgcaagggcgacgcccccaucacgcccuggaacuucgacgagcagaucgacaaggcggccuccgccgaggccuucaucagccggaugcgcaagaccugcaccuaccugaagggccaggaggugcuccccaaguccagccugaccuacgagcgguucgagguccugaacgagcucaacgggauccagcugcgcacgaccggcgcggagagcgacuuccggcaccgccuguccuacgagaugaagugcuggaucaucgacaacguguucaagcaguacaagaccgucagcaccaagcggcuccugcaggagcugaagaaguccccguacgccgacgagcucuacgacgagcacacgggggagaucaaggagguguucggcacccagaaggagaacgccuucgccaccagccuguccggguacaucagcaugaaguccauccugggcgccguggucgacgacaaccccgcgaugaccgaggagcucaucuacuggaucgccguguucgaggaccgcgagauccugcaccugaagauccaggagaaguaccccagcaucacggacgugcagcggcagaagcucgcccuggucaagcugcccggcugggggcgcuucucccggcuccugaucgacggccugccgcucgacgagcaggggcagagcgugcuggaccacauggagcaguacuccagcguguucauggagguccugaagaacaagggcuucgggcucgagaagaagauccagaagaugaaccagcaccagguggacggcaccaagaagauccgcuacgaggacaucgaggagcuggccggcucccccgcccugaagcgggggaucuggcgcagcgugaagaucgucgaggagcucguguccaucuucggcgagcccgcgaacaucgugcuggaggucgcccgggaggacggggagaagaagcgcaccaagagccggaaggaccagugggaggagcugaccaagacgacccucaagaacgaccccgaccugaaguccuucaucggcgagaucaagagccagggggaccagcgcuucaacgagcagcgguucuggcuguacgugacccagcagggcaagugccucuacaccggcaaggcccuggacauccagaaccugagcauguacgagguggaccacauccucccgcagaacuucgucaaggacgacucccuggacaaccuggcccucgugaugcccgaggccaaccagcgcaagaaccagguggggcagaacaagaugccccuggagaucaucgaggcgaaccagcaguacgccaugcgcacccugugggagcggcuccacgagcugaagcugaucagcuccggcaagcucgggcgccugaagaagcccagcuucgacgaggucgacaaggacaaguucaucgcccggcagcugguggagacgcgccagaucaucaagcacgugcgggaccuccuggacgagcgcuucuccaagagcgacauccaccuggucaaggccggcaucguguccaaguuccggcgcuucagcgagaucccgaagauccgggacuacaacaacaagcaccacgcgauggacgcccucuucgccgccgcccugauccaguccauccugggcaaguacgggaagaacuuccucgcguucgaccugagcaagaaggaccgccagaagcaguggcgguccgugaagggcagcaacaaggaguucuuccuguucaagaacuucgggaaccuccgccugcagucccccgucaccggcgaggaggugagcgggguggaguacaugaagcacgucuacuucgagcugcccuggcagaccaccaagaugacgcagaccggcgacggcauguucuacaaggaguccaucuucagccccaaggugaagcaggccaaguacguguccccgaagaccgagaaguucguccacgacgaggugaagaaccacagcaucugccucguggaguucaccuucaugaagaaggagaaggagguccaggagacgaaguucaucgaccugaaggugaucgagcaccaccaguuccugaaggagcccgagucccagcucgccaaguuccuggccgagaaggagaccaacagccccaucauccacgcccggaucauccgcaccaucccgaaguaccagaagaucuggaucgagcacuuccccuacuacuucaucagcacccgggagcugcacaacgcgcgccaguucgagaucuccuacgagcucauggagaaggugaagcagcugagcgagcgguccagcgucgaggagcugaagaucguguucgggcuccugaucgaccagaugaacgacaacuaccccaucuacacgaaguccagcauccaggaccgcgugcagaaguucgucgacacccagcuguacgacuucaaguccuucgagaucggcuucgaggagcucaagaaggccguggccgccaacgcccagcggagcgacaccuucgggucccgcaucagcaagaagcccaagccggaggagguggcgaucggcuacgaguccaucaccgggcugaaguaccggaagccccgcagcgucgugggcacgaagcgcuga

SEQ ID NO: 1788 - RNA, 4002 nt, Artificial Sequence
  Cas9 variant
augagccagaacaucguggacuacugcaucggccuggaccucgggaccggcuccgucgggugggccgugguggacaugaaccaccgccugaugaagcggaacggcaagcaccugugggggagccgccucuucuccaacgccgagaccgcggccaaccggcgcgccagccgguccauccgccggcgcuacaacaagcggcgcgagcggauccgccugcugcgggccauccuccaggacaugguccuggagaacgaccccacguucuucauccgccuggagcacaccagcuuccucgacgaggaggacaaggccaacuaccugggcgcggacuacaaggacaacuacaaccuguucaucgacgaggacuucaacgacuacaccuacuaccacaaguacccgaccaucuaccaccuccggaaggcccugugcgaguccacggagaaggccgacccccgccugaucuaccucgcccugcaccacaucgugaaguaccggggcaacuuccuguacgaggggcagaaguucaacauggacgcgagcaacaucgaggaccgccucuccgacguguucacccaguucgccgacuucaacaacauccccuacgaggacgacgagaagaagaaccuggagauccuggagauccucaagaagccccugagcaagaaggccaaggucgacgaggugauggcccugaucgccccggagaaggacuucaaguccgcguacaaggagcucgugaccggcaucgccgggaacaagaugaacgucaccaagaugauccugugcgagcccaucaagcagggcgacagcgagaucaagcugaaguucuccgacagcaacuacgacgaccaguucuccgagguggagaacgaccucggggaguacguggaguucaucgacagccugcacaacaucuacuccugggucgagcugcagacgaucaugggcgccacccacaccuacaacgccagcaucuccgaggccauggugagccgguacaacaagcaccacgaggaccuccagcugcugaagaagugcaucaaggacaacgugcccaagaaguacuucgacauguuccgcaacgacagcgagaagcucaagggcuacuacaacuacaucaaccaccccuccaaggcgccggucgacgaguucuacaaguacgugaagaagugcaucgagaagguggacacccccgaggccaagcagauccugcacgacaucgagcuggagaacuuccuccugaagcagaacagccggacgaacggguccguccccuaccagaugcagcuggacgagaugaucaagaucaucgacaaccaggccaaguacuaccccgugcucaaggagaagcgcgagcagcugcugagcauccucaccuucaagaucccguacuacuucggcccccugaacgagaccuccgagcacgccuggaucaagcgccuggaggggaaggagaaccagcggauccuccccuggaacuaccaggacaucguggacgucgacgccaccgcggagggcuucaucaagcgcaugcggagcuacugcacguacuuccccgacgaggaggugcugccgaagaacucccugaucgugagcaaguacgaggucuacaacgagcucaacaagauccgcguggacgacaagcugcuggaggucgacaucaagaacgacaucuacaacgagcuguucaugaacaacaagaccgugaccgagaagaagcucaagaacuggcuggugaacaaccagugcugcaacaagaacgccgagaucaagggcuuccagaaggagaaccaguucuccaccagccugacgcccuggaucgacuucaccaacaucuucggggagaucaaccaguccaacuucgaccucaucgaggacaucaucuacgaccugaccgucuucgaggacaagaagaucaugaagcggcgccugaagaagaaguacgcccuccccgacgacaagaucaagcagauccugaagcugaaguacaaggacuggagccggcucuccaagaagcugcuggacggcaucguggccgacaacaaguucgggagcuccgugaccguccucgacgugcuggagaugagccgccugaaccucauggagaucaucaacgaccgggaccugggcuacgcccagaugaucgaggcggccgccuccugccccgaggacgggaaguucacguacaaggaggugcagcgccuggccggcagcccggcgcucaagcggggcaucuggcagucccugcagaucgucgaggagaucaccaaggugaugaagugccgccccaaguacaucuacaucgaguucgagcggagcgaggagaccaaggagcgcaccgagagcaagaucaagaagcuggagaacguguacaaggaccucgacgagcagacgaaggucgaguacaagaccgugcuggaggagcugaagggguucgacaacaccaagaagaucuccagcgacucccucuuccuguacuucacccagcugggcaagugcauguacagcgggaagaagcucgacaucgacucccuggacaaguaccagaucgaccacaucgugccccagagccuggucaaggacgacuccuucgacaaccgggugcucgugguccccagcgagaaccagcgcaagcuggacgaccugguggugccguccgacauccgggucaagaugaacagcuucuggaagcuccuguucgaccacgagcugaucucccccaagaaguucuacagccucaucaagacggaguacaccgagcgcgacgaggagcgguucaucaaccgccagcugguggagacccgccagaucaccaagaacgugacgcagaucaucgaggaccacuacuccaccaccaaggucgccgccauccgggccaaccugagccacgaguuccgcgugaagaaccacaucuacaagaaccgggacaucaacgacuaccaccacgcccacgacgcguacaucguggcccucaucggcggguucaugcgcgaccgguaccccaacaugcacgacuccaaggccgucuacagcgaguacaugaagauguuccgcaagaacaagaacgacaagaagcgguggaaggacggcuucgugaucaacuccaugaacuaccccuacgagguggacggcgagcugaucuggaacccggacaucaucaacgagauccgcaagugcuucuacuacaaggacugcuacugcaccaccaagcuggaccagaaguccgggcagauguucaaccucacgguccugcccaacgacgcccacagccccaagggcaccaccgaggccgugaucccggugaacaagaaccggaaggacgucaacaaguacgggggcuucagcgggcugcaguacgugaucguggcgaucgagggcaagaagaagcgcggcaagaagaccaagcucgucaagaagaucagcggggugccccugcaccugaaggccgccucccucgacgagaagaucaaguacaucgaggagaaggagaaccugacggacgugaagaucaucaaggacagcauccccgucaaccagaugaucgagauggacggcggggaguaccugcucaccucccccaucgaguucgugaacggccggcagcuggugcugaacgagaagcagugcgcccucaucgccgacaucuacaacgcgaucuacaagcaggacugcgacaaccuggacgacguccugaugauccagcucuacaucgagcugaucaacaagaugaaggcccuguacccggccuaccagagcaucgccgagaaguucgaguccaugaccgaggacuacguggcggugagcaaggaggagaaggccgacaucaucaagcagaugcucaucaucaugcaccgcggcccccggaacgggaagauccaguacgccgacuucaacgucggcgaccgcaucgggcggaagaacaagaugucccuggaccuggagcgcgugaccuucgugagccagucccccacgggcaucuacaccaagaaguacaagcucuga

SEQ ID NO: 1789 - RNA, 4002 nt, Artificial Sequence
  Cas9 variant
augggcaaggaguacuaccuggggcucgacaucggcaccgacagcguggggugggccgucugcgacaccaacuacaagauccccaaguucaagggcaacgccaugugggggauccgccuguucgagaaguccaacagcgcggaggagcggcgcggcuuccgguccagccgccggcgcacgcagcggaagcgcgagcggcugaagcuccuggagaugcuguucgacgaggagaucuccaagaucgacccggccuucuucaucaagcuccgcgagagcaaccuguaccuggaggacaaguccaccaagauccccuacugcguguucagcgacgagaacuacaccgacaaggacuuccaccgggacuaccccaccaucuaccaccuccgcaacgagcugaucaaguccaacaagccccacgacgugcggcuggucuaccucgcccugcaccacaucaucaagaaccgcggccacuuccuguucgacuacagcuacaagaacgacaaguccggggacuucaugccgaucuacaacgaccucaagaacuacuucuacgacaacuacgagaucgagcuggacugcagcgacguggacgaguucgccaacacgcugaaggacaaguccaagggcaagaccaagaagaacgccgagaucgcggagcuguucggggugagcaagaaguacgacaagguccuguacuccgcccugagccuccuguccggcagcuccgugaagcuguucgacaucuucgacgacgaggcccucaaggacguggagaagaaguccgucagcuucuccagcggguucgacgacaacgccaacgacuuccaguccuaccugggcgagcgguucgagcugcucgagaagcugaaggcgguguacgacugggccgugcuggccgacauccucgacggcaaggaguacaucagcgaggccaaggucgccaucuacgagaagcacaagcgcgaccugaagacccugaagaaguacaucaagaucuacaugcccgagaagaaggcggagaucuucaacaucuccagcaaggacaacaacuacguggccuacuccaagcacaucaagaccagcaacgggacgggcgugcucaucuccacgugcacccaggaggaguucugcgccuaccugaagaagacccuggggaucugcaaggacgccagcuacgaggagauguucaaggagaucgagaacuccaccuucaugcccaagcaggucaccaaggacaacggcguggugcccaugcaggucaacgagaaggagcucguggccauccuggacaacgcgaaggaguaccugccguuccuccugaacaaggacaacgacggcaagaccguguacgacaagaucaaggcccuguucgaguaccggauccccuacuacaucgggccccucaacacccacagcacgaaguccuggcugguccgcagcaacgagaagaucuaccccuggaacaucgaggacgugguggacuucgacaaguccgccgagaaguucaucgagaaccugaccagcaagugcaccuaccucccgcaguacgacgucauccccaagcacucccugcuguacaacaaguucugcgugcucaacgagcugaacaaccugaagaucgacggcgagaagaucagcguccagcugaagcaggacaucuacaacgaccucuucaagaaguacuacaaggugaccaacaagaagcugugcgacuaccugaagucccggaacaucgccuucgacgagaucagcgggaucgacaacgacuucaagagcucccucaagagcuacaaggaccugguggccuacaaccugacggacgagcagaaggaggagaucgucaaggcgaucaccaucuucggcgacgacaagaagcuccugaagaagcgccugaagaacgaguucgggggcugccucuccgacgacgagaucaagaagaucugcaagcugaaguacaccggcuggagcaagcugucccgggaguuccucaccgacgugacggccguguacaaggagaccggggagcugaucaacaucaucugcgcccugugggagaccaacuacaaccucaccagccugcuguacuccgacgaguucugcugcgacgacaaggagaacaagacguucaacgacaagaucaacgagcucaacagcuucggcaacgacaagacccugaaccagaucgucgaggagcuguacgugagcccccucgugaagcgccccaucuaccagagccugcugaucaccaaggagcucgagaagaucaugaagugcccgcccaagaagaucuucgucgagguggcccgcggggccgaggagaagaagcggaccgugucccgccggaacaagcugcuggaccucuacaagagcugcaagaacgacuacccccugcuguucgacgagcuccagaacaacacgaccgacgacgagcugaaguccgacaagcuguaccucuacuucacccaguucggcaagugcauguacaccggggagaacaucgagcugggcgaccuguucaacaagaaccucuacgacaucgaccacaucuacccccagagcaagaucaaggacgacucccuggacaaccgcguccuggugaagaagacgaccaacgcgaagaaggacaacgaguacccgcucagcucccagauccgggagaagaugacgccccacuggaaggcccugcuggacaagggccucaucaacaagaagaaguacgagcgccuggugcggaacuacccccugagcgacgaggagcucagccaguucaucucccgccagcuggucgagacccggcagagcaccaaggccguggccaacauccuggagcagcucuacccccgcccggacaccgagaucguguacgucaaggcggcccuggccuccgaguuccggcaccaguacgacaugcugaagugccgcgaggugaacgaccuccaccacgccaaggacgccuaccugaacaucguggucgggaacgcguacaacggcaaguucacccacaacaaggccaacuucaucaaggggcugcagaacaacgacaaggccuacaccgugaagcucgacagcaugcugaagcacaacaucgacggcgccuggaucgccgacaacaacgagucccugaacaucgucaagagcaccaugaacaagaacaacauccgguacacgcgcuacgcguucgagaagaagggcggccucuucaaggugaccauccugaagaaggggaacgggcaggccuccaucaagaagaacgacaagcggaacagcaucgagaaguacggcggguacaaccagguguccagcaccuacuucuccugcguggagcacggcaaggacaacaaccgcaugaucagcauguucuccgucaaccuguacgacaagaacaaguacgaggagaaccccaucgccuaccucaucgagaacuacggccugaucaaccccaucaucaaggugaagaaggugaagauccagagcugcaucuccuucgacaacaugcugugccaccucgggggcaaggacagcgggggcucccagaucagcuaccggcccgggguccagcuggugcugggcuacgacaacgagcgcuacauccggaacgugauccgcugcgccggcggggaccuccaccuccagaccuccaagaacgagaaggacaucgucacggccgagaagaacaucgagcuguucaaccuccugaucgagaagaugaagaacaacaucuacggcgugcuguacagcaaccucggggacaagcuguacugcagcaaggagaaguucgagaagcuggacaucguggagcagugcaacgucaucaagaacgugcucaccauccugaagaacaacgcguccaagggcgaccucaagagcaucgggaucaaggccaacggcgccauccgccugaacaacaacaucuccgagaucaagaaggucaagagcaucaagcugaucaaccaguccgugaccggccuguucgagcaggagaucgagcuccugaaccuguga

SEQ ID NO: 1790 - RNA, 4002 nt, Artificial Sequence
  Cas9 variant
augagccagaacaucguggacuacugcaucggccuggaccucgggaccggcuccgucgggugggccgugguggacaugaaccaccgccugaugaagcggaacggcaagcaccugugggggagccgccucuucuccaacgccgagaccgcggccacgcggcgcagcucccggagcauccgccggcgcuacaacaagcggcgcgagcggauccgccugcugcgggccauccuccaggacaugguccuggagaaggaccccaccuucuucauccgccuggagcacaccuccuuccucgacgaggaggacaaggccaaguaccugggcaccgacuacaaggacaacuacaaccuguucaucgacgaggacuucaacgacuacacguacuaccacaaguacccgaccaucuaccaccuccggaaggcccugugcgagagcaccgagaaggcggacccccgccugaucuaccucgcccugcaccacaucgugaaguaccggggcaacuuccuguacgaggggcagaaguucaacauggacgccuccaacaucgaggacaagcucagcgacguguucacccaguucgccgacuucaacaacauccccuacgaggacgacgagaagaagaaccuggagauccuggagauccucaagaagccccuguccaagaaggcgaaggucgacgaggugauggcccugaucagcccggagaaggaguucaaguccgccuacaaggagcucgugacgggcaucgccgggaacaagaugaacgucaccaagaugauccugugcgagagcaucaagcagggcgacuccgagaucaagcugaaguucagcgacuccaacuacgacgaccaguucagcgagguggagaacgaccucggggaguacguggaguucaucgacucccugcacaacaucuacagcugggucgagcugcagaccaucaugggcgccacccacacggacaacgcgagcaucuccgaggccauggugagccgcuacaacaagcaccacgaggaccuccagcugcugaagaagugcaucaaggacaacgugcccaagaaguacuucgacauguuccggaacgacuccgagaaggucaagggcuacuacaacuacaucaaccgccccaacaaggcccccguggacgaguucuacaaguucgugaagaagugcaucgagaaggucgacaccccggaggccaagcagauccuccacgacaucgagcuggagaacuuccugcucaagcagaacagccggaccaacggguccgugcccuaccagaugcagcuggacgagaugaucaagaucaucgacaaccaggccaaguacuaccccgugcugaaggagaagcgcgagcagcuccugagcauccugaccuuccgcauccccuacuacuucggcccgcucaacgagacguccgagcacgcguggaucaagcggcuggaggggaaggagaaccagcgcauccugcccuggaacuaccaggacaccgucgacguggacgccaccgccgagggcuucaucaagcggaugcgcagcuacugcaccuacuuccccgacgaggaggugcuccccaagaacucccugaucgucagcaaguacgagguguacaacgagcugaacaagauccgggucgacgacaagcuccuggagguggacgugaagaacgacaucuacaacgagcuguucaugaagaacaagacggucaccgagaagaagcugaagaacuggcucgugaacaaccagugcugccgcaaggacgccgagaucaagggcuuccagaaggagaaccaguucuccaccagccugaccccguggaucgacuucacgaacaucuucgggaagaucgaccaguccaacuucgaccugaucgagaagaucaucuacgaccucaccguguucgaggacaagaagaucaugaagcggcgccugaagaagaaguacgcccugcccgacgacaagaucaagcagauccucaagcugaaguacaaggacuggagccggcuguccaagaagcuccuggacggcaucgucgcggacaaccgcuucgggagcuccgugaccgugcuggacguccucgagaugagccggcugaaccugauggagaucaucaacgacaaggagcucggcuacgcccagaugaucgaggaggccuccagcugccccaaggacgggaaguucaccuacgaggagguggccaagcuggccggcagccccgcgcugaagcgcggcaucuggcagucccuccagaucguggaggagaucacgaaggucaugaagugccggccgaaguacaucuacaucgaguucgagcgcagcgaggaggccaaggagcggaccgaguccaagaucaagaagcuggagaacguguacaaggaccuggacgagcagaccaagaaggaguacaagagcgugcucgaggagcugaagggguucgacaacaccaagaagaucuccagcgacucccuguuccucuacuucacgcagcugggcaagugcauguacagcgggaagaagcuggacaucgacucccucgacaaguaccagaucgaccacaucgucccccagagccuggugaaggacgacuccuucgacaaccgcgugcugguccuccccagcgagaaccagcggaagcuggacgaccugguggugcccuucgacauccgcgacaagauguaccgguucuggaagcuccuguucgaccacgagcugaucuccccgaagaaguucuacagccucaucaagaccgaguacaccgagcgcgacgaggagcgcuucaucaaccggcagcuggucgagacccgccagaucacgaagaacgugacccagaucaucgaggaccacuacuccaccaccaagguggccgccauccgggcgaaccugagccacgaguuccgcgucaagaaccacaucuacaagaaccgggacaucaacgacuaccaccacgcccacgacgccuacaucguggcccucaucggcggguucaugcgcgaccgguaccccaacaugcacgacuccaaggccguguacagcgaguacaugaagauguuccgcaagaacaagaacgaccagaagaaguggaaggacggcuucgucaucaacagcaugaacuaccccuacgagguggacggcaagcugaucuggaaccccgaccugaucaacgagaucaagaagugcuucuacuacaaggacugcuacugcaccacgaagcucgaccagaaguccgggcagauguucaaccugaccgugcugccgaacgacgcgcacagcgccaagggcaccaccgaggccgucauccccgugaacaagaaccggaaggacgugaacaaguacgggggcuucuccgggcuccaguacgucaucgccgccaucgagggcacgaagaagaagggcaagaagcuggugaaggugcgcaagcugagcgggaucccccucuaccugaagcaggcggacaucaaggagcagaucgaguacgucgagaaggaggagaagcuguccgacgugaagaucaucaagaacaacaucccgcucaaccagcugaucgagaucgacggccggcaguaccugcucaccagccccaccgagugcgugaacgccaugcagcugguccugaacgaggagcagugcaagcucaucgccgacaucuacaacgccaucuacaagcaggacuucgacgggcuggacaacaugcugaugauccagcucuaccugcagcugaucgacaagcucaagacccuguaccccaucuacaugggcaucguggagaaguucgagaagcugacggaggacuucguguccaucagcaaggaggagaaggccaacgucaucaagcagaugcucaucaucaugcacaagggcccccagaacgggaacaucaucuacgacgacuucaacgugggcaagcgcaucgggcggcugaacggccgcaccuucuaccuggacaacaucgaguucaucucccagagcccgaccgggaucuacaccaagaaguacaagcucuga

SEQ ID NO: 1791 - RNA, 4002 nt, Artificial Sequence
  Cas9 variant
auguacaccuacuacuucaaggagagcgagaugguguacgacgucggccuggacaucgggaccggcuccgugggguggguggcccucgacgagaacggcaagcuggcccgcgcgaaggggaagaaccuggucggcgugcggcuguucgacacggcccagaccgccgccgaccgccggggcuuccgcaccacccggcgccggcugagccgccggaaguggcgccugcggcuccuggacgagcuguucuccgccgagaucaacgagaucgacagcuccuucuuccagcgccucaaguacagcuacgugcaccccaaggacgaggagaacaaggcgcacuacuacgggggcuaccuguucccgacggaggaggagaccaagaaguuccaccgguccuaccccaccaucuaccaccuccgccaggagcucauggcccagcccaacaagcgguucgacauccgcgagaucuaccuggccauccaccaccuggucaaguaccgggggcacuuccucagcucccaggagaagaucaccaucggcagcacguacaaccccgaggaccuggccaacgcgaucgagguguacgccgacgagaaggggcuguccugggagcucaacaacccggagcagcugaccgagaucaucagcggcgaggccggcuacgggcugaacaaguccaugaaggccgacgaggcccucaagcuguucgaguucgacaacaaccaggacaagguggcgaucaagacccugcucgccggccugaccgggaaccagaucgacuucgccaagcuguucggcaaggacaucagcgacaaggacgaggccaagcucuggaagcugaagcuggacgacgaggcccucgaggagaagucccagacgauccugagccagcugaccgacgaggagaucgagcuguuccacgcggucgugcaggccuacgacggcuucgugcugaucgggcugcucaacggcgccgacuccgucagcgccgccauggugcagcuguacgaccagcaccgcgaggaccggaagcugcucaagucccuggcgcagaaggccgggcugaagcacaagcgcuucagcgagaucuacgagcagcucgcccuggccaccgacgaggccaccaucaagaacggcaucagcacggcgcgggagcugguggaggaguccaaccucagcaaggaggucaaggaggacacccugcgccgccuggacgagaacgaguuccuccccaagcagcggaccaaggccaacuccgugaucccccaccagcugcaccuggccgagcugcagaagauccuccagaaccaggggcaguacuaccccuuccugcuggacaccuucgagaaggaggacggccaggacaacaagaucgaggagcuccugcgcuuccggaucccguacuacgugggcccccuggucacgaagaaggacguggagcacgccgggggcgacgcggacaaccacuggguggagcgcaacgagggguucgagaagucccgggucacccccuggaacuucgacaagguguucaaccgcgacaaggccgcccgggacuucaucgagcgccucaccggcaacgacaccuaccugaucggggagaagacgcugccccagaacagccuccgguaccagcuguucaccgugcugaacgagcucaacaacguccgcgugaacggcaagaaguucgacagcaagaccaaggccgaccugaucaacgaccuguucaaggcccggaagaccgucucccucagcgcgcugaaggacuaccugaaggcccagggcaagggggacgugacgaucaccggccucgccgacgaguccaaguucaacagcucccugagcuccuacaacgaccugaagaagaccuucgacgccgaguaccucgagaacgaggacaaccaggagacccuggagaagaucaucgagauccagacgguguucgaggacagcaagaucgccucccgcgagcugagcaagcucccgcuggacgacgaccaggucaagaagcugucccagacccacuacaccggguggggccggcucagcgagaagcugcuggacuccaagaucaucgacgagcgcgggcagaaggugagcauccucgacaagcucaagagcaccucccagaacuucaugagcaucaucaacaacgacaaguacggcgugcaggcguggaucacggagcagaacaccggcuccagcaagcugaccuucgacgagaaggucaacgagcucaccaccucccccgccaacaagcgggggaucaagcagagcuucgccgugcugaacgacaucaagaaggccaugaaggaggagccccgccggguguaccuggaguucgcccgcgaggaccagacguccguccggagcgugccccgcuacaaccagcucaaggagaaguaccaguccaagagccuguccgaggaggcgaaggugcugaagaagacccucgacggcaacaagaacaagaugagcgacgaccgcuacuuccuguacuuccagcagcaggggaaggacauguacaccggccggccgaucaacuucgagcgccugucccaggacuacgacaucgaccacaucaucccccaggccuucaccaaggacgacagccucgacaaccggguccuggugucccgccccgagaacgcccgcaagagcgacuccuucgccuacacggacgaggugcagaagcaggacggcagccuguggaccagccuccugaaguccggguucaucaaccggaagaaguacgagcggcugaccaaggcgggcaaguaccucgacgggcagaagaccggcuucaucgcccgccagcuggucgagacgcggcagaucaucaagaacguggccagccugaucgagggggaguacgagaacuccaaggccguggccauccgcagcgagaucaccgcggacaugcggcuccuggucggcaucaagaagcaccgcgagaucaacuccuuccaccacgccuucgacgcccugcucaucaccgccgccggccaguacaugcagaaccgguaccccgaccgcgacagcaccaacguguacaacgaguucgaccgguacacgaacgacuaccugaagaaccugcgccagcucuccagccgggacgaggugcgccggcugaaguccuucggguucgucgugggcaccaugcgcaaggggaacgaggacuggagcgaggagaacaccuccuaccugcggaaggugaugauguucaagaacauccucaccacgaagaagaccgagaaggaccgcggcccgcugaacaaggagaccaucuucagccccaaguccgggaagaagcugaucccccucaacagcaagcgcuccgacaccgcgcuguacggcggcuacagcaacgucuacuccgccuacaugacgcuggugcgggccaacgggaagaaccuccugaucaagauccccaucagcaucgccaaccagaucgaggugggcaaccugaagaucaacgacuacaucgucaacaacccggccaucaagaaguucgagaagauccucaucuccaagcugccccuggggcagcucgugaacgaggacggcaaccugaucuaccuggcgagcaacgaguaccgccacaacgccaagcagcucuggcugagcaccaccgacgccgacaagaucgccuccaucagcgagaacuccagcgacgaggagcugcucgaggcguacgacauccugaccuccgagaacgugaagaaccgguuccccuucuucaagaaggacaucgacaagcugagccagguccgcgacgaguuccucgacuccgacaagcggaucgccgugauccagacgauccugcgcgggcugcagaucgacgccgccuaccaggcccccgugaagaucaucagcaagaaggucuccgacuggcacaagcuccagcagagcggcggcaucaagcuguccgacaacagcgagaugaucuaccaguccgcgaccgggaucuucgagacccgggugaagaucagcgaccugcucuga

SEQ ID NO: 1792 - RNA, 4005 nt, Artificial Sequence
  Cas9 variant
augaagaaccccuacaccaucggccuggacaucgggaccaacagcgugggcugggccguccucacgaaccaguacgaccuggugaagcgcaagaugaagguggccgggaacuccgacaagaagcagaucaagaagaacuucuggggcguccggcuguucgacgacgggcagaccgcgguggaccgccggaugaaccgcaccgcccggcgccggaucgagcgccggcgcaaccggaucagcuaccuccaggagaucuucgccguggagauggccaacaucgacgccaacuucuucugccgccugaacgacuccuucuacgucgacagcgagaagcggaacucccgccacccguucuucgcgaccaucgaggaggagguggccuaccacaagaacuaccggacgaucuaccaccuccgcgaggagcucgugaacagcuccgagaaggccgaccugcggcuggucuaccucgcccuggcgcacaucaucaaguaccgcggcaacuuccugaucgagggcgcccucgacaccaagaacaccagcguggacgggguguacgagcaguucauccagaccuacaaccaggucuucauguccaacaucgaggagggcacgcuggccaagguggaggagaacaucgagguggccaacauccuggccgggaaguucacccggcgcgagaaguucgagcggauccuccagcuguaccccggcgagaaguccaccgggauguucgcgcaguucaucagccugaucgucggcagcaagggcaacuuccagaagguguucgaccucaucgagaagaccgacaucgagugcgccaaggacuccuacgaggaggaccuggaggcccugcucgccaucaucggggacgaguacgccgagcuguucguggcggccaagaacacguacaacgccgucgugcugagcuccaucaucaccgugaccgccaccgagacgaacgccaagcucagcgcguccaugaucgagcgcuucgacgcccacgagaaggaccugggcgagcugaaggccuucaucaagcuccaccuccccaagcaguaccaggagaucuucaacaacgccgccaucgacggguacgcgggcuacaucgacggcaagaccaagcaggucgacuucuacaaguaccugaagaccauccucgagaacaucgagggggccgacuacuucaucgccaagaucgaggaggagaacuuccugcgcaagcagcggaccuucgacaacggcgccaucccccaccagcugcaccucgaggagcuggaggcgaucauccaccagcaggccaaguacuacccguuccugcgcgaggacuacgagaagaucaagagccucgugacguuccggauccccuacuucguggggccccuggccaagggccaguccgaguucgccuggcugacccgcaaggccgacggggagauccggcccuggaacaucgaggagaaggucgacuucggcaagagcgcgguggacuucaucgagaagaugaccaacaaggacaccuaccucccgaaggagaacguccugcccaagcacagccugugcuaccagaaguacaugguguacaacgagcucacgaaggugcgcuacaucgacgaccagggcaagaccaacuacuucuccgggcaggagaagcagcagaucuucaacgaccuguucaagcagaagcggaaggucaagaagaaggaccuggagcuguuccugcgcaacaucaaccacaucgagagccccaccaucgagggccuggaggacuccuucaacgccagcuacgccaccuaccacgaccuccugaagguggggaugaagcaggagauccuggacaacccccugaacacggagaugcucgaggacaucgugaagauccugaccgucuucgaggacaagccgaugaucaaggagcagcugcagcaguucuccgacgugcucgacggcggggugcugaagaagcuggagcggcgccacuacaccggcuggggccggcucagcgccaagcugcuggucgggauccgcgagaagcagucccaccucaccauccuggacuaccugaugaacgacgacggccucaaccggaaccugaugcagcugaucaacgacagcaaccucuccuucaagagcaucaucgagaaggagcaggucuccacgaccgacaaggaccugcagagcaucguggccgaccuggcggggucccccgccaucaagaagggcauccuccagagccugaagaucgucgacgagcugguguccaucaugggguacccgccccagaccaucguggucgagauggcccgcgagaaccagaccacgggcaagggcaagaacaacagcaagccccgguacaagucccucgagaaggccaucaaggaguucgggagcaagauccugaaggagcaccccaccgacaaccaggagcugaagaacaaccgccucuaccuguacuaccugcagaacggcaaggacauguacaccgggcaggagcucgacauccacaaccuguccaacuacgacaucgaccacaucgugccccagagcuucaucaccgacaacagcaucgacaaccuggugcucaccuccagcgccggcaaccgggagaagggcggggacgugcccccgcuggagaucgugcgcaagcggaagguguucugggagaagcuguaccagggcaaccucauguccaagcgcaaguucgacuaccugacgaaggcggagcgcgggggccugaccgacgccgacaaggcccgguucauccaccgccagcucgucgagacccggcagaucaccaagaacguggccaacauccugcaccagcgcuucaacaacgagacggacaaccacgggaacaccauggagcagguccggaucgugacccucaagagcgcgcuggugucccaguuccgcaagcaguuccagcuguacaaggugcgggaggucaacgacuaccaccacgcccacgacgccuaccugaacggcgugguggccaacacccuccugaaggucuacccccagcuggagcccgaguucguguacggcgaguaccaccaguucgacugguucaaggccaacaaggcgacggccaagaagcaguucuacaccaacaucaugcuguucuucgggcagaaggagcgcaucaucgacgagaacggcgagauccugugggacaagaaguaccuggagaccaucaagaaggugcucgacuaccggcagaugaacaucgucaagaagaccgagauccagaagggggaguucagcaaggccacgaucaagcccaagggcaacuccagcaagcugaucccgcgcaaggagaacugggaccccaugaaguacgggggccuggacucccccaacauggccuacgccgugaucaucgagcacgcgaagggcaagaagaagcucaucuucgagaagaagaucauccggaucaccaucauggagcgcaagauguucgagaaggacgaggaggccuuccuggaggagaagggguaccggcaccccaaggugcugaccaagcucccgaaguacacccuguacgagugcgagaagggccgccggcgcaugcuggccagcgccaacgaggcccagaaggggaaccagcucguccuguccaaccaccuggugagccuccuguaccacgcgaagaacugcgaggccuccgacggcaagagccugaaguacaucgaggcccaccgggagacguucuccgagcuccuggcccaggugagcgaguucgcgacccgcuacacccuggccgacgccaaccucuccaagaucaacaaccuguucgagcagaacaaggagggggacauccaggccaucgcccagagcuucgucgaccugauggcguucaacgccaugggcgcccccgccagcuucaaguucuucgaggccaccaucgaccggaagcgcuacacgaaccucaaggagcugcuguccagcaccaucaucuaccaguccaucaccggccucuacgagagccggaagcgccuggacgacuga

SEQ ID NO: 1793 - RNA, 4005 nt, Artificial Sequence
  Cas9 variant
augaagaagcccuacaccaucggccuggacaucgggaccaacagcgugggcugggccgcccucacggaccaguacgaccuggucaagcgcaagaugaagguggcggggaacuccgagaagaagcagaucaagaagaaccuguggggcgugcggcucgucgacgaggggaagaccgccgcccaccgccgggugaaccgcaccacccggcgccggaucgagcgccggcgcaaccggaucagcuaccugcaggagaucuucacggccgagauguucgagguggacgccaacuucuucuaccgccuggaggacuccuucuacaucgagagcgagaagcggcagucccgccacccguucuucgcgaccaucgaggaggaggucgccuaccacgagaacuaccggaccaucuaccaccuccgcgagaagcuggugaacagcuccgacaaggccgaccugcggcucguguaccuggcccuggcgcacaucaucaaguaccgcggcaacuuccucaucgagggcaagcuggacaccaagaacacgagcgucgacgagguguucaagcaguucaucaagaccuacaaccagguguucgccuccgacaucgaggaggggagccugacccggaucgaggagaacaacgaggucgccaagaucuucuccgagaagcucaccaagcgcgagaagcuggacaagauccugaaccucuaccccaacgagaaguccacggaccuguucgcccaguucaucagccugaucaucggcagcaaggggaacuucaagaaguucuucaaccucaccgagaagaccgacaucgagugcgccaaggacuccuacgaggaggaccuggaggugcugcucgcgcgggugggcgacgaguacgccgagaucuucgucgccgccaagaacgccuacaacgcgguggugcugagcuccaucaucaccgucagcaacacggagaccaaggccaagcuguccgccagcaugaucgagcgcuucgacaagcacgacaaggaccucaagcgcaugaaggccuucuucaaggugcggcugcccgagaacuucaacgagguguucaacgacgucgagaaggacggguacgccggcuacaucgagggcaagaccaagcaggaggcguucuacaaguacaugaagaagaugcuggagcacguggagggggccgacuacuucaucaaccagaucgaggaggagaacuuccuccgcaagcagcggaccuucgacaacggcgccaucccccaccagcugcaccuggaggagcucgaggccauccugcaccagcaggccaaguacuacccguuccugaagguggacuacgagaagaucaagagccucgucacguuccgcauccccuacuucguggggccccuggcgaacggccaguccgaguucagcuggcugacccggaaggccgacggcgagauccgccccuggaacaucgaggagaaggucgacuucgggaaguccgccaucgacuucaucgagaagaugaccaacaaggacaccuaccucccgaaggagaacgugcugcccaagcacagcaugugcuaccagaaguacaugguguacaacgagcugacgaagauccgguacaccgacgaccagggcaagacccacuacuucuccgggcaggagaagcagcagaucuucaacgaccucuucaagcagaagcgcaaggucaagaagaaggaccuggagcuguuccucuacaacaugaaccacguggagagccccaccguggagggcgucgaggacgccuucaacuccagcuucacgaccuaccacgaccugcagaaggugggggugccccaggagauccuggacgacccgcucaacaccgagaugcuggaggagaucaucaagauccugaccgucuucgaggacaagcggaugaucaacgagcgccugcaggaguucuccaacgugcucgacgaggcggugcugaagaagcuggagcggcgccacuacacgggcuggggccggcucagcgccaagcugcugaucgggauccgcgacaaggagucccaccucaccauccuggacuaccugaugaacgacgacaagcacaaccggaaccucaugcagcugaucaacgacagcaaccuguccuucaagagcaucaucgagaaggagcaggucuccaccgccgacaaggacauccagagcaucguggccgaccucgccggcucccccgcgaucaagaaggggauccugcagagccugaagaucguggacgagcucgucggcaucaugggguacccgccccagaccaucgugguggagauggcccgcgagaaccagacgaccggcaagggcaagaacaacuccaagccccgguucaccagccuggagaaggccaucaaggagcuggggagccagauccucaaggagcaccccaccgacaaccagggccugaagaacgaccgccuguaccucuacuaccugcagaacgggaaggacauguacaccggccaggagcuggacauccacaaccucuccaacuacgacaucgaccacgucgugccccagagcuucaucacggacaacuccaucgacaaccgggugcuggccagcuccgccgcgaaccgcgagaagggggacaacguccccagccuggagguggugcgcaagcggaaggucuacugggagaagcucuaccaggccaagcugauguccaagcgcaaguucgacuaccugaccaaggccgagcggggcggccucaccgaggccgacaaggcccgcuucauccaccggcagcugguggagacccgccagaucacgaagaacguggcgaacauccugcaccagcgguucaacugcaagaaggacgagagcgggaacgucaucgagcagguccgcaucgugacccucaaggccgcccuggugucccaguuccggaagcaguuccagcuguacaaggugcgcgaggugaacgacuaccaccacgcccacgacgcguaccucaacugcgucguggccaacacccugcugaagguguacccgcagcucgagcccgaguucgucuacggcgacuaccaccaguucgacugguucaaggccaacaaggccaccgccaagaagcaguucuacacgaacaucaugcuguucuucgcgaagaaggaccggaucaucgacgagaacggggagauccugugggacaagaaguaccucgacaccaucaagaaggugcugaacuaccgccagaugaacaucgugaagaagaccgagauccagaagggcgaguucagcaacgccaccgccaaccccaagggcaacuccagcaagcugaucccccggaaggccgacugggacccgaucaaguacgggggcuucgacggguccaacauggccuacgcgaucgucaucgagcacgagaagcgcaagaagaagacggugaucaagaaggagcucauccagaucaacaucauggagcggaccgccuucgagaaggaccagaaggaguuccuggagggcaagggguaccgcaaccccaaggugaucaccaagauccccaaguacacccuguacgagugcgagaacggccggcgccggaugcucggcagcgccaacgaggcccagaaggggaaccagaugguccugcccaaccaccugaugacgcuccuguaccacgccaagaacugcgaggcguccgacggcaagagccuggccuacaucgagucccaccgcgagauguucgccgagcuccuggacagcaucagcgaguucgccucccgguacacccuggcggacgccaaccucgagaagaucaacaccaucuucgagcagaacaagagcggggacgugaaggugaucgcccaguccuucgucaaccugcuggaguucaacgccaugggcgccccggcgagcuucaaguacuucgagaccaacaucgagcgcaagcgcuacaacaaccucaaggagcugcugaacgccacgaucaucuaccaguccaucaccgggcucuacgaggcccggaagcgccuggacgacuga

SEQ ID NO: 1794 - RNA, 4005 nt, Artificial Sequence
  Cas9 variant
augaagaaccccuacaccaucggccuggacaucgggaccaacagcgugggcugggccguccucacggaccaguacgaccuggugaagcgcaagaugaagguggccgggaacuccgacaagaagcagaucaagaagaacuucuggggcguccggcuguucgacgacgggcagaccgcgguggaccgccggaugaaccgcaccgcccggcgccggaucgagcgccggcgcaaccggaucagcuaccuccaggagaucuucgccguggagauggccaacaucgacgccaacuucuucugccgccugaacgacuccuucuacgucgacagcgagaagcggaacucccgccacccguucuucgcgaccaucgaggaggagguggccuaccacaagaacuaccggacgaucuaccaccuccgcgaggagcuggugaacagcuccgagaaggccgaccugcggcuggucuaccucgcccuggcgcacaucaucaaguaccgcggcaacuuccugaucgagggcgcccucgacaccaagaacaccagcguggacgagguguacaagcaguucauccagaccuacaaccaggucuucauguccaacaucgaggagggggcccuggccaagguggaggagaacacggagguggccagcauccuggcgggcaaguucacccggcgcgagaaguucgagcggauccuccgccuguaccccggggagaaguccaccggcauguucgcccaguucaucagccugaucgucgggaacaagggcaacuuccagaagguguucaaccucguggagaagaccgacaucgagugcgccaaggacuccuacgaggaggaccuggaggcccugcucgccaucaucggcgacgaguacgcggagcuguucgucgccgccaagaacacguacaacgccguggugcugagcuccaucaucaccgucaccgccaccgagacgaacgcgaagcucagcgccuccaugaucgagcgcuucgacgcccacgagaaggagcugggggagcugaaggccuucaucaagcuccaccuccccaagcaguaccaggagaucuucaacaacgccgagaucgacggcuacgcgggguacaucgacggcaagaccaagcaggucgacuucuacaaguaccugaagaccacccuggagaacguggagggcgccgacuacuucaucacgaagaucgaggaggagaacuuccugcggaagcagcgcaccuucgacaacggggugaucccccaccagcugcaccucgaggagcuggaggccauccugcaccagcaggccaaguacuacccguuccuccgggagggcuacgacaagaucaagagccuggugaccuuccgcauccccuacuucgucgggccccuggcgaacggccaguccgaguucgccuggcucacccggaaggacgacggggagauccgccccuggaacaucgaggagaagguggacuucggcaagagcgccguggacuucaucgagaagaugacgaacaaggacaccuaccugccgaaggagaacguccugcccaagcacagccucugcuaccagaaguacaugguguacaacgagcugaccaagauccgguacaucgacgaccagggcaagaccaacuacuucuccgggcgcgagaagcagcagaucuucaacgaccuguucaagcagaagcggaaggugaagaagaaggaccucgagcuguuccugcgcaacaucaaccacaucgagagccccacgaucgagggccucgaggacuccuucaacgccagcuacgccaccuaccacgaccugcugaaggucgggcugaagcaggagauccucgacaacccccugaacaccgagauccuggaggacaucgugaagauccucaccguguucgaggacaagcggaugaucaaggagcagcuggagcaguucuccgacguccuggacggcguggugcucaagaagcuggagcgccggcacuacacgggguggggccgccugagcgcgaagcuccuggucggcauccgggacaagcagucccaccugaccauccucgacuaccugaugaacgacgacgggcugaaccgcaaccucaugcagcugaucaacgacagcaaccuguccuucaagagcaucaucgagaaggagcaggucuccaccaccgacaaggaccuccagagcaucguggccgaccuggccggcuccccggccaucaagaaggggauccugcagagccucaagaucguggacgagcugguguccaucaugggcuacccgccccagacgaucguggucgagauggcccgggagaaccagaccaccgggaagggcaagaacaacagcaagccccgcuacaagucccuggagaaggcgaucaaggacuucggcagccagauccucaaggagcaccccaccgacaaccaggagcugaagaacaaccggcuguaccucuacuaccugcagaacgggaaggacaucuacaccggccaggagcuggacauccacaaccucuccaacuacgacaucgaccacaucgugccccagagcuucaucacggacaacagcaucgacaaccuggugcugaccuccagcgccgggaaccgcgagaagggcggcgacgucccgccccucgagaucgugcgcaagcggaagguguucugggagaagcuguaccaggggaaccugauguccaagcgcaaguucgacuaccucaccaaggccgagcggggcgggcugaccgaggccgacaaggcccgcuucauccaccggcagcuggucgagacgcgccagaucaccaagaacguggcgaacauccuccaccagcgguucaacaaggagaccgacaaccacggcaacaccauggagcagguccgcaucgugacgcucaagagcgcccuggugucccaguuccggaagcaguuccagcuguacaaggugcgcgaggucaacgacuaccaccacgcccacgacgccuaccugaacggggugguggcgaacacccugcucaaggucuacccccagcuggagcccgaguucguguacggcgaguaccaccaguucgacugguucaaggccaacaaggccaccgccaagaagcaguucuacaccaacaucaugcuguucuucgcccagaaggagcggaucaucgacgagaacggcgagauccucugggacaagaaguaccuggagacgaucaagaaggugcuggacuaccgccagaucaacaucgucaagaagaccgagauccagaagggggaguucagcaaggcgaccaucaagcccaagggcaacuccagcaagcucaucccccggaaggagaacugggacccggugaaguacgggggccuggacucccccaacauggccuacgccgugaucaucgagcacgccaaggggaagaagaagaucgucaucgagaagaagcugauccagaucaacaucauggagcgcaagauguucgagaaggacgaggaggccuuccucgaggagaagggcuaccaccagcccaaggugcugaccaagcugcccaaguacacgcucuacgagugcgagaagggccggcgccggaugcugagcuccgcgaacgaggcccagaaggggaaccagcuggugcucagcaaccaccuggucucccugcucuaccacgccaagaacugcgaggccagcgacggcaagucccugaaguacaucgaggcccaccgcgagaccuucagcgagcugcucgcccagguguccgaguucgcgaccaaguacacccuggccgacgccaaccugagcaagaucaacaaccucuucgagcagaacaaggagggggacaucaaggcgaucgcccagagcuucguggaccugauggccuucaacgccaugggcgccccggcguccuucaaguucuucgaggccacgaucgaccggaagcgcuacaccaaccugaaggagcuccugagcuccaccaucaucuaccagagcaucaccgggcuguacgagucccggaagcgccucgacgacuga

SEQ ID NO: 1795 - RNA, 4005 nt, Artificial Sequence
  Cas9 variant
augggccgcaagccguacauccugagccucgacaucgggaccggcuccgugggguacgccugcauggacaagggcuucaacguccugaaguaccacgacaaggacgcccuggggguguaccucuucgacggcgcgcugaccgcccaggagcggcgccaguuccggacgagccgccggcgcaagaaccggcgcaucaagcggcugggccuccugcaggagcugcucgccccgcuggugcagaaccccaacuucuaccaguuccagcgccaguucgccuggaagaacgacaacauggacuucaagaacaagucccugagcgagguccucuccuuccugggguacgagagcaagaaguaccccaccaucuaccaccuccaggaggcccuccugcugaaggacgagaaguucgaccccgagcucaucuacauggcgcuguaccaccuggugaaguaccggggccacuuccucuucgaccaccugaagaucgagaaccugaccaacaacgacaacaugcacgacuucguggagcucaucgagaccuacgagaaccugaacaacaucaagcugaaccucgacuacgagaagacgaaggucaucuacgagauccugaaggacaacgagaugaccaagaacgaccgcgccaagcgggugaagaacaugcagaagaagcuggagcaguucuccaucaugcuccuggggcugaaguucaacgagggcaagcuguucaaccacgccgacaacgccgaggagcugaagggggcgaaccagagccacaccuucgccgacaacuacgaggagaaccugaccccguuccucacgguggagcaguccgaguucaucgagcgcgccaacaagaucuaccugagccugacccuccaggacauccugaagggcaagaaguccauggccaugagcaaggucgccgcguacgacaaguuccggaacgagcugaagcaggucaaggacaucguguacaaggccgacuccacccgcacccaguucaagaagaucuucgugagcuccaagaagucccucaagcaguacgacgccacgcccaacgaccagaccuucagcagccugugccuguucgaccaguaccucauccggcccaagaagcaguacucccugcugaucaaggagcucaagaagaucaucccccaggacagcgagcuguacuucgaggccgagaacgacacccugcugaaggugcucaacaccacggacaacgccagcaucccgaugcagaucaaccuguacgaggcggagaccauccugcgcaaccagcagaaguaccacgccgagaucaccgacgagaugaucgagaaggugcucucccugauccaguuccggauccccuacuacgucggcccccuggugaacgaccacaccgccagcaaguucggguggauggagcgcaaguccaacgagagcaucaagcccuggaacuucgacgagguggucgaccgguccaagagcgccacgcaguucauccgccgcaugaccaacaagugcuccuaccucaucaacgaggacgugcugccgaagaacagccugcucuaccaggagauggaggugcugaacgagcugaacgccacccagauccggcuccagaccgaccccaagaaccgcaaguaccggaugaugccccagaucaagcuguucgcggucgagcacaucuucaagaaguacaagacggugucccacagcaaguuccuggagaucaugcucaacuccaaccaccgcgagaacuucaugaaccacggcgagaagcugagcaucuucgggacccaggacgacaagaaguucgccuccaagcugagcuccuaccaggacaugaccaagaucuucggcgacaucgagggcaagcgggcccagaucgaggagaucauccaguggaucaccaucuucgaggacaagaagauccucgugcagaagcugaaggagugcuaccccgagcugacgagcaagcagaucaaccagcucaagaagcugaacuacuccggguggggccgccugagcgagaagcuccugacccacgccuaccaggggcacuccaucaucgagcugcuccggcacagcgacgagaacuucauggagauccugaccaacgacgucuacggcuuccagaacuucaucaaggaggagaaccaggugcagagcaacaagauccagcaccaggacaucgccaaccugaccacguccccggcgcucaagaaggggaucuggagcaccaucaagcugguccgcgagcugaccuccaucuucggcgagcccgagaagaucaucauggaguucgccaccgaggaccagcagaagggcaaggagcagaagucccggaagcagcucugggacgacaacaucaagaagaacaagcucaagagcguggacgaguacaaguacaucaucgacguggccaacaagcugaacaacgagcagcugcagcaggagaagcuguggcuguaccucagccagaacgggaagugcauguacuccggccagagcaucgaccuggacgcccugcucucccccaacgcgacgaagcacuacgaggucgaccacaucuucccccgcagcuucaucaaggacgacuccaucgacaacaaggugcuggugaucaagaagaugaaccagaccaagggggaccaggucccgcugcaguucauccagcagcccuacgagcggaucgccuacuggaagucccucaacaaggccggccugaucagcgacagcaagcugcacaagcucaugaagcccgaguucaccgccauggacaaggagggguucauccagcgccagcugguggagacccggcagaucuccgugcacguccgcgacuuccugaaggaggaguaccccaacaccaaggugaucccgaugaaggccaagauggugagcgaguuccggaagaaguucgacauccccaagauccgccagaugaacgacgcgcaccacgccaucgacgccuaccucaacggcgucguguaccacggcgcccagcuggccuaccccaacguggaccuguucgacuucaacuucaagugggagaagguccgggagaaguggaaggcgcucggggaguucaacacgaagcagaagucccgcgagcuguucuucuucaagaagcuggagaagauggaggugagccagggcgagcggcucaucagcaagaucaagcuggacaugaaccacuucaagaucaacuacucccgcaagcuggccaacaucccccagcaguucuacaaccagaccgccgugagcccgaagaccgccgagcucaaguacgaguccaacaagagcaacgaggucguguacaaggggcugacccccuaccagacguacguggucgccaucaaguccgugaacaagaagggcaaggagaagauggaguaccagaugaucgaccacuacguguucgacuucuacaaguuccagaacgggaacgagaaggagcuggcgcucuaccuggcccagcgcgagaacaaggacgagguccuggacgcccagaucguguacagccucaacaagggcgaccugcuguacaucaacaaccaccccugcuacuucgugucccggaaggaggucaucaacgccaagcaguucgagcucaccguggagcagcagcugagccuguacaacgugaugaacaacaaggagaccaacgucgagaagcuccugaucgaguacgacuucaucgcggagaaggugaucaacgaguaccaccacuaccugaacuccaagcucaaggagaagcgcgugcggaccuucuucagcgaguccaaccagacgcacgaggacuucaucaaggcccuggacgagcuguucaaggucgugaccgccagcgccacccgcuccgacaagaucggcagccggaagaacuccaugacccaccgcgccuuccucgggaagggcaaggacgugaagaucgcguacacgagcaucuccgggcugaagaccaccaagcccaagagccuguucaagcucgccgagucccggaacgagcuguga

SEQ ID NO: 1796 - RNA, 4005 nt, Artificial Sequence
  Cas9 variant
augaagaaccccuacaccaucggccuggacaucgggaccaacagcgugggcugggccguccucacggaccaguacgaccuggugaagcgcaagaugaagguggccgggaacuccgacaagaagcagaucaagaagaacuucuggggcguccggcuguucgacgagggggagaccgcggccgaccgccggaugaaccgcaccgcccggcgccggaucgagcgccggcgcaaccggaucagcuaccuccaggagaucuucgcccuggagauggccaacaucgacgcgaacuucuucugccgccugaacgacuccuucuacguggacagcgagaagcggaacucccgccacccguucuucgccaccaucgaggaggagguggccuaccacaagaacuaccggacgaucuaccaccuccgcgaggagcuggucaacagcuccgagaaggccgaccugcggcucguguaccuggcgcuggcccacaucaucaaguaccgcggcaacuuccucaucgagggcgcccuggacaccaagaacaccagcguggacggggucuacaagcaguucauccagaccuacaaccagguguucaucuccaacaucgaggagggcacgcuggccaagauggaggagaacaccaccguggccgacauccucgcggggaaguucacccggaaggagaagcuggagcgcauccugcagcucuaccccggcgagaaguccacggggauguucgcccaguucaucagccugaucgucggcagcaagggcaacuuccagaagguguucgaccugguggagaagaccgacaucgagugcgccaaggacuccuacgaggaggaccucgaggcccugcuggccaucaucggggacgaguacgcggagcuguucgucgccgccaagaacaccuacaacgccguggugcucagcuccaucaucaccgucacggacaccgagaccaacgccaagcugagcgcguccaugaucgagcgguucgacgcccacgagaaggaccuccgcgagcugaaggccuucaucaagcugcaccuccccaagcaguacgaggagaucuucagcaacguggccaucgacggcuacgccggguacaucgacggcaagaccaagcaggucgacuucuacaaguaccugaagacgcugcucgagaacaucgagggcgcggacuacuucaucgccaagaucgaggaggagaacuuccugcgcaagcagcggaccuucgacaacggggccaucccccaccagcugcaccucgaggagcuggaggccauccugcaccagcaggcgaaguacuacccguucuucaaggaggccuacgacaagaucaagucccucgugaccuuccgcauccccuacuucgugggcccccuggccaacgggcagagcgacuucgccuggcugacccggaaggccgacggcgagauccgccccuggaacaucgaggagaagguggacuucggcaagagcgcggucgacuucaucgagaagaugacgaacaaggacaccuaccucccgaaggagaacgugcugcccaagcacucccuguacuaccagaaguacauggucuacaacgagcucaccaaggugcgguacaucgacgaccaggggaagaccaacuacuucagcggccaggagaagcagcagaucuucaacgacuacuucaagaagaagcgcaagguguccaagaaggaccuggagcaguuccugcggaacaugagccacaucgagucccccacgaucgaggggcucgaggacagcuucaacuccagcuacgccaccuaccacgaccugcugaaggucggcaucaagcaggaggugcuggagaacccccucaacaccgagaugcuggaggacaucgugaagauccugaccgucuucgaggacaagcgcaugaucaaggagcagcuccagcaguucuccgacgugcuggacggggccgugcugaagaagcucgagcggcgccacuacacgggcugggggcggcugagcgccaagcugcucgucggcauccgcgacaagcagucccaccugaccauccuggacuaccucaugaacgacgacggccugaaccggaaccugaugcagcucaucaacgacagcaaccuguccuucaagagcaucaucgagaaggagcaggucuccaccaccgacaaggaccugcagagcaucguggccgaccucgcgggguccccggccaucaagaagggcauccugcagagccugaagaucguggacgagcucguguccaucaugggguacccgccccagacgaucguggucgagauggcccgcgagaaccagaccaccgugaagggcaagaacaacagccggccccgcuacaagagccuggagaaggccaucaaggaguucgggucccagauccugaaggagcaccccaccgacaaccaggagcuccggaacaaccgccuguaccuguacuaccuccagaacggcaaggacauguacaccggccaggagcuggacauccacaaccugagcaacuacgacaucgaccacaucgugccccaguccuucaucacggacaacagcaucgacaaccucguccugaccuccagcgccgggaaccgggagaagggcgacgacgugccgccccuggagaucgugcgcaagcgcaaggucuucugggagaagcuguuccaggggaaccucauguccaagcggaaguucgacuaccugaccaaggcggagcgcggcggccucaccgaggccgacaaggccacguucauccaccggcagcugguggagacccgccagaucaccaagaacguggccaacauccugcaccagcgguucaacaacgagaccgacaaccacgggaacaacauggagcagguccgcaucgugaugcucaagagcgcgcuggugucccaguuccggaagcaguuccagcuguacaagguccgcgaggugaacgacuaccaccacgcccacgacgccuaccucaacggcguggucgccaacacgcugcugaagguguacccccagcucgagcccgaguucguguacggggaguaccaccaguucgacugguucaaggccaacaaggcgaccgccaagaagcaguucuacaccaacaucaugcuguucuucgcccagaaggagcggaucaucgacgagaacggcgagauccugugggacaagaaguaccucgagaccaucaagaagguccuggacuaccgccagaugaacaucgugaagaagacggagauccagaagggggaguucagcaaggccaccaucaagcccaagggcaacuccagcaagcugaucccccggaaggagaacugggacccgaugaaguacggcgggcucgacucccccaacauggccuacgcggugaucaucgagcacgccaagggcaagaagaaggucguguucgagaagaagaucauccgcaucaccaucauggagcggaaggccuucgagaaggacgagaaguccuuccuggagaagcagggguaccgccagcccaaggugcugaccaagcuccccaaguacacgcuguacgagugcgagaacggccggcgccggaugcuggccagcgccaacgaggcgcagaaggggaaccagcagguccucaagggccagcugaucacccugcuccaccacgccaagaacugcgaggccagcgacggcaagucccuggacuacaucgagagcaaccgcgagauguucggggagcugcucgcccacgugagcgaguucgcgaagcgguacacccuggccgacgccaaccuguccaagaucaaccagcuguucgagcagaacaaggacaacgacaucaaggugaucgcccagagcuucgucaaccucauggccuucaacgcgaugggcgccccggccuccuucaaguucuucgaggccaccaucgagcgcaagcgguacacgaaccugaaggagcuccugagcgccaccaucaucuaccaguccaucaccgggcuguacgaggcgcgcaagcgccucgacggcuga

SEQ ID NO: 1797 - RNA, 4005 nt, Artificial Sequence
  Cas9 variant
augaagaaccccuacaccaucggccuggacaucgggaccaacagcgugggcugggccguccucacgaaccaguacgaccuggugaagcgcaagaugaagguggccgggaacuccgacaagaagcagaucaagaagaacuucuggggcguccggcuguucgacgacgggcagaccgcgguggaccgccggaugaaccgcaccgcccggcgccggaucgagcgccggcgcaaccggaucagcuaccuccaggagaucuucgccguggagauggccaacaucgacgccaacuucuucugccgccugaacgacuccuucuacgucgacagcgagaagcggaacucccgccacccguucuucgcgaccaucgaggaggagguggccuaccacgacaacuaccggacgaucuaccaccuccgcgaggagcuggugaacagcuccgagaaggccgaccugcggcuggucuaccucgcccuggcgcacaucaucaaguaccgcggcaacuuccugaucgagggcgcccucgacaccaagaacaccagcguggacgagguguacaagcaguucauccagaccuacaaccaggucuucauguccaacaucgaggagggggcccuggccaagguggaggagaaccuggagguggccagcauccucgcgggcaaguucacgcggcgcgagaaguucgagcggauccugcgccuguaccccggggagaaguccaccggcauguucgcccaguucaucagccucaucgucgggaacaagggcaacuuccagaagguguucaaccugguggagaagaccgacaucgagugcgccaaggacuccuacgaggaggaccuggaggcccuccuggccaucaucggcgacgaguacgcggagcuguucgucgccgccaagaacaccuacaacgccguggugcucagcuccaucaucacggucaccgccaccgagaccaacgcgaagcugagcgccuccaugaucgagcgcuucgacgcccacgagaaggaccugggggagcucaaggccuucaucaagcugcaccuccccaagcaguaccaggagaucuucaacaacgccgcgaucgacggcuacgccggguacaucgacggcaagacgaagcaggucgacuucuacaaguaccugaagaccacccuggagaacguggagggcgccgacuacuucaucaccaagaucgaggaggagaacuuccugcggaagcagcgcacguucgacaacggggugaucccccaccagcuccaccuggaggagcuggaggccauccuccaccagcaggcgaaguacuacccguuccugcgggaggacuacgagaagaucaagagccuggugaccuuccgcauccccuacuucgucggcccccucgccaaggggcaguccgaguucgccuggcugacccggaaggccgacggcgagauccgccccuggaacaucgaggagaagguggacuucggcaagagcgccguggacuucaucgagaagaugaccaacaaggacacguaccugccgaaggagaacguccuccccaagcacagccugugcuaccagaaguacaugguguacaacgagcugaccaaggugcgguacaucgacgaccaggggaagaccaacuacuucuccggccaggagaagcagcagaucuucaacgaccucuucaagcagaagcgcaaggucaagaagaaggaccuggagcuguuccuccggaacaucaaccacaucgagagccccaccaucgaggggcuggaggacuccuucaacgcgagcuacgccacguaccacgaccugcugaaggugggcaugaagcaggagucccucgacagcccccugaacgccgagaugcuggaggacaucgugaagauccucaccgucuucgaggacaagcgcaugaucaaggagcagcugcagcaguucuccgacgugcuggacggggugguccucaagaagcuggagcggcgccacuacaccggcugggggcggcugagcgccaagcuccuggugggcauccgcgacaagcagucccaccugaccauccucgacuaccugaugaacgacgacggccugaaccggaaccucaugcagcugaucaacgacagcaaccuguccuucaagagcaucaucgagaaggagcaggucuccacgaccgacaaggaccuccagagcaucguggccgaccuggcgggguccccggccaucaagaagggcauccugcagagccucaagaucguggacgagcugguguccaucaugggguacccgccccagaccaucgucguggagauggcccgcgagaaccagaccacggugaagggcaagaacaacagccggccccgcuacaagucccuggagaaggccaucaaggaguucgggagccagauccucaaggagcaccccaccgacaaccaggagcugaagaacaaccggcuguaccucuacuaccugcagaacggcaaggacaucuacaccggccaggagcuggacauccacaaccucagcaacuacgacaucgaccacaucgucccccaguccuucaucaccgacaacagcaucgacaaccuggugcugaccuccagcgccgggaaccgcgagaagggcggggacgugccgccccucgagaucguccgcaagcggaagguguucugggagaagcuguaccagggcaaccugauguccaagcgcaaguucgacuaccucacgaaggcggagcggggcgggcugaccgacgccgacaaggcccgcuucauccaccggcagcugguggagacccgccagaucaccaagaacgucgccaacauccuccaccagcgguucaacaacgagacggacaacuacggcaacaccauggagcagguccgcaucgugacccucaagagcgcgcuggugucccaguuccggaagcaguuccagcuguacaaggugcgcgaggugaacgacuaccaccacgcccacgacgccuaccugaacggggucguggccaacacccugcucaagguguacccccagcuggagcccgaguucgucuacggcgaguaccaccaguucgacugguucaaggccaacaaggcgacggccaagaagcaguucuacaccaacaucaugcuguucuucgcccagaaggagcggaucaucgacgagaacggggagauccucugggacaagaaguaccuggagaccaucaagaaggugcuggacuaccgccagaugaacaucgugaagaagaccgagauccagaagggcgaguucagcaaggccacgaucaagcccaagggcaacuccagcaagcucaucccccggaaggagaacugggacccgaugaaguacgggggccuggacucccccaacauggccuacgcggucaucaucgagcacgccaaggggaagaagaagaucgugaucgagaagaagcugauccagaucaacaucauggagcgcaagauguucgagaaggacgaggaggccuuccucgaggagaagggcuaccggcaccccaaggugcugaccaagcugcccaaguacacccucuacgagugcgagaaggggcgccggcgcaugcuggccagcgccaacgaggcgcagaagggcaaccagcugguccucuccaaccaccuggugagccugcucuaccacgccaagaacugcgaggccuccgacggcaagagccugaaguacaucgaggcccaccgggaggcguucuccgagcugcucgcccaggugagcgaguucgccacccgcuacacgcuggccgacgccaaccugagcaagaucaacaaccucuucgagcagaacaaggagggggacaucaaggcgaucgcccaguccuucgucgaccugaugguguucaacgccaugggcgccccggccagcuucaaguucuucgaggcgaccaucgaccggaagcgcuacaccaaccugaaggagcuccuguccagcaccaucaucuaccaguccaucacggggcuguacgagagccgcaagcggcucgacgacuga

SEQ ID NO: 1798 - RNA, 4005 nt, Artificial Sequence
  Cas9 variant
augaagaaccccuacaccaucggccuggacaucgggaccaacagcgugggcugggccguccucacggaccaguacgaccuggugaagcgcaagaugaagguggccgggaacuccgacaagaagcagaucaagaagaacuucuggggcguccggcuguucgacgagggggagaccgcggccgaccgccggaugaaccgcaccgcccggcgccggaucgagcgccggcgcaaccggaucagcuaccuccaggagaucuucgcccuggagauggccaacaucgacgcgaacuucuucugccgccugaacgacuccuucuacguggacagcgagaagcggaacucccgccacccguucuucgccaccaucgaggaggagguggccuaccacaagaacuaccggacgaucuaccaccuccgcgaggagcuggucaacagcuccgagaaggccgaccugcggcucguguaccuggcgcuggcccacaucaucaaguaccgcggcaacuuccucaucgagggcgcccuggacaccaagaacaccagcguggacggggucuacaagcaguucauccagaccuacaaccagguguucaucuccaacaucgaggagggcacgcuggccaagauggaggagaacaccaccguggccaacauccucgcggggaaguucacccggaaggagaagcuggagcgcauccugcagcucuaccccggcgagaaguccacggggauguucgcccaguucaucagccugaucgucggcagcaagggcaacuuccagaagguguucgaccugguggagaagaccgacaucgagugcgccaaggacuccuacgaggaggaccucgaggcccugcuggccaucaucggggacgaguacgcggagcuguucgucgccgccaagaacaccuacaacgccguggugcucagcuccaucaucaccgucacggacaccgagaccaacgccaagcugagcgcguccaugaucgagcgguucgacgcccacgagaaggaccucagcgagcugaaggccuucaucaagcugcaccuccccaagcaguacgaggagaucuucuccaacguggccaucgacggcuacgccggguacaucgacggcaagaccaagcaggucgacuucuacaaguaccugaagacgcugcucgagaacaucgagggcgcggacuacuucaucgccaagaucgaggaggagaacuuccugcgcaagcagcgcaccuucgacaacggggccaucccccaccagcugcaccucgaggagcuggaggccauccugcaccagcaggcgaaguacuacccguuccucaaggaggccuacgacaagaucaagagccuggugaccuuccggauccccuacuucgugggcccccuggccaacgggcagagcgacuucgccuggcucacccgcaaggccgacggcgagauccggcccuggaacaucgaggagaagguggacuucgggaaguccgcggucgacuucaucgagaagaugacgaacaaggacaccuaccugccgaaggagaacgugcugcccaagcacagccucuacuaccagaaguacauggucuacaacgagcugaccaaggugcgcuacaucgacgaccagggcaagaccaacuacuucuccggccaggagaagcagcagaucuucaacgacuacuucaagcagaagcggaaggugagcaagaaggaccuggagcaguuccuccgcaacaugucccacaucgagagccccacgaucgaggggcuggaggacuccuucaacagcuccuacgccaccuaccacgaccugcugaaggucggcaucaagcaggaggugcucgagaacccccugaacauggagaugcuggaggacaucgugaagauccucaccgucuucgaggacaagcggaugaucaaggagcagcugcagcaguucagcggggugcuggacggcgccgugcucaagaagcuggagcgccggcacuacaccggguggggccgccuguccgccaagcuccuggucggcauccgggacaagcagagccaccugacgauccucgacuaccugaugaacgacgacgggcugaaccgcaaccucaugcagcugaucaacgacuccaaccugagcuucaaguccaucaucgagaaggagcaggucagcaccaccgacaaggaccuccaguccaucguggccgaccuggcgggcagcccggccaucaagaaggggauccugcagucccucaagaucguggacgagcuggugagcaucaugggcuacccgccccagaccaucguggucgagauggcccgggagaaccagacgaccgugaaggggaagaacaacagccgcccccgguacaagucccuggagaaggccaucaaggaguucggcagccagauccucaaggagcaccccaccgacaaccaggagcugcgcaacaaccggcuguaccucuacuaccugcagaacggcaaggacauguacaccgggcaggagcuggacauccacaaccucuccaacuacgacaucgaccacaucgugccccagagcuucaucaccgacaacuccaucgacaaccugguccugacgagcuccgccggcaaccgcgagaagggggacgacgugccgccccucgagaucgugcggaagcgcaaggucuucugggagaagcuguuccagggcaaccugaugagcaagcgcaaguucgacuaccucaccaaggcggagcggggcgggcugaccgaggccgacaaggccaccuucauccaccgccagcugguggagacgcggcagaucaccaagaacguggccaacauccuccaccagcgcuucaacaacgagaccgacaaccacggcaacaacauggagcagguccggaucgugaugcugaaguccgcgcuggugagccaguuccgcaagcaguuccagcucuacaagguccgggaggugaacgacuaccaccacgcccacgacgccuaccugaacgggguggucgccaacacccugcucaagguguacccccagcuggagcccgaguucguguacggcgaguaccaccaguucgacugguucaaggccaacaaggcgacggccaagaagcaguucuacaccaacaucaugcuguucuucgcccagaaggagcgcaucaucgacgagaacggggagauccucugggacaagaaguaccuggagaccaucaagaagguccuggacuaccggcagaugaacaucgugaagaagaccgagauccagaagggcgaguucuccaaggccacgaucaagcccaagggcaacagcuccaagcucaucccccgcaaggagaacugggacccgaugaaguacgggggccuggacagccccaacauggccuacgcggugaucaucgagcacgccaaggggaagaagaagaucgucuucgagaagaagaucauccggaucaccaucauggagcgcaaggccuucgagaaggacgagaaguccuuccuggagaagcagggcuaccggcagcccaaggugcucaccaagcugcccaaguacacccuguacgagugcgagaacgggcgccggcgcaugcucgccagcgccaacgaggcgcagaagggcaaccagcagguccugaagggccagcugaucacgcuccugcaccacgccaagaacugcgaggccuccgacggcaagagccuggacuacaucgagagcaaccgggagauguucggggagcuccuggcccacguguccgaguucgcgaagcgcuacacccuggccgacgccaaccucagcaagaucaaccagcuguucgagcagaacaaggacaacgacaucaaggugaucgcccaguccuucgugaaccugauggccuucaacgcgaugggggccccggccagcuucaaguucuucgaggccaccaucgagcggaagcgcuacaccaaccucaaggagcugcugcgggccacgaucaucuaccaguccaucaccggccucuacgaggcgcgcaagcgccuggacggguga

SEQ ID NO: 1799 - RNA, 4005 nt, Artificial Sequence
  Cas9 variant
augaagaaccccuacaccaucggccuggacaucgggaccaacagcgugggcugggccguccucacggaccaguacgaccuggugaagcgcaagaugaagguggccgggaacuccgacaagaagcagaucaagaagaacuucuggggcguccggcuguucgacgagggggagaccgcggccgaccgccggaugaaccgcaccgcccggcgccggaucgagcgccggcgcaaccggaucagcuaccuccaggagaucuucgcccuggagauggccaacaucgacgcgaacuucuucugccgccugaacgacuccuucuacguggacagcgagaagcggaacucccgccacccguucuucgccaccaucgaggaggagguggccuaccacaagaacuaccggacgaucuaccaccuccgcgaggagcuggucaacagcuccgagaaggccgaccugcggcucguguaccuggcgcuggcccacaucaucaaguaccgcggcaacuuccucaucgagggcgcccuggacaccaagaacaccagcguggacggggucuacaagcaguucauccagaccuacaaccagguguucaucuccaacaucgaggagggcacgcuggccaagauggaggagaacaccaccguggccgacauccucgcggggaaguucacccggaaggagaagcuggagcgcauccugcagcucuaccccggcgagaaguccacggggauguucgcccaguucaucagccugaucgucggcagcaagggcaacuuccagaagguguucgaccugguggagaagaccgacaucgagugcgccaaggacuccuacgaggaggaccucgaggcccugcuggccaucaucggggacgaguacgcggagcuguucgucgccgccaagaacaccuacaacgccguggugcucagcuccaucaucaccgucacggacaccgagaccaacgccaagcugagcgcguccaugaucgagcgguucgacgcccacgagaaggaccucagcgagcugaaggccuucaucaagcugcaccuccccaagcaguacgaggagaucuucuccaacguggccaucgacggcuacgccggguacaucgacggcaagaccaagcaggucgacuucuacaaguaccugaagacgcugcucgagaacaucgagggcgcggacuacuucaucgccaagaucgaggaggagaacuuccugcgcaagcagcgcaccuucgacaacggggccaucccccaccagcugcaccucgaggagcuggaggccauccugcaccagcaggcgaaguacuacccguuccucaaggaggccuacgacaagaucaagagccuggugaccuuccggauccccuacuucgugggcccccuggccaacgggcagagcgacuucgccuggcucacccgcaaggccgacggcgagauccggcccuggaacaucgaggagaagguggacuucgggaaguccgcggucgacuucaucgagaagaugacgaacaaggacaccuaccugccgaaggagaacgugcugcccaagcacagccucuacuaccagaaguacauggucuacaacgagcugaccaaggugcgcuacaucgacgaccagggcaagaccaacuacuucuccggccaggagaagcagcagaucuucaacgacuacuucaagcagaagcggaaggugagcaagaaggaccuggagcaguuccuccgcaacaugucccacaucgagagccccacgaucgaggggcuggaggacuccuucaacagcuccuacgccaccuaccacgaccugcugaaggucggcaucaagcaggaggugcucgagaacccccugaacaccgagaugcuggaggacaucgugaagauccucaccgucuucgaggacaagcggaugaucaaggagcagcugcagcaguucagcgacgugcuggacggggccgugcucaagaagcuggagcgccggcacuacacgggcugggggcgccuguccgccaagcuccuggucggcauccgggacaagcagagccaccugaccauccucgacuaccugaugaacgacgacggccugaaccgcaaccucaugcagcugaucaacgacuccaaccugagcuucaaguccaucaucgagaaggagcaggucagcaccaccgacaaggaccuccaguccaucguggccgaccuggcggggagcccggccaucaagaagggcauccugcagucccucaagaucguggacgagcuggugagcaucaugggguacccgccccagacgaucguggucgagauggcccgggagaaccagaccaccgugaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacaccggccaggagcuggacauccacaaccucuccaacuacgacaucgaccacaucgugccccagagcuucaucacggacaacuccaucgacaaccugguccugaccagcuccgccgggaaccgcgagaagggcgacgacgugccgccccucgagaucgugcggaagcgcaaggucuucugggagaagcuguuccaggggaaccugaugagcaagcgcaaguucgacuaccucaccaaggcggagcggggcggccugaccgaggccgacaaggccacguucauccaccgccagcugguggagacccggcagaucaccaagaacguggccaacauccuccaccagcgcuucaacaacgagaccgacaaccacgggaacaacauggagcagguccggaucgugaugcugaaguccgcgcuggugagccaguuccgcaagcaguuccagcucuacaagguccgggaggugaacgacuaccaccacgcccacgacgccuaccugaacggcguggucgccaacacgcugcucaagguguacccccagcuggagcccgaguucguguacggggaguaccaccaguucgacugguucaaggccaacaaggcgaccgccaagaagcaguucuacaccaacaucaugcuguucuucgcccagaaggagcgcaucaucgacgagaacggcgagauccucugggacaagaaguaccuggagaccaucaagaagguccuggacuaccggcagaugaacaucgugaagaagacggagauccagaagggggaguucuccaaggccaccaucaagcccaagggcaacagcuccaagcucaucccccgcaaggagaacugggacccgaugaaguacggcgggcuggacagccccaacauggccuacgcggugaucaucgagcacgccaagggcaagaagaaggucguguucgagaagaagaucauccggaucaccaucauggagcgcaaggccuucgagaaggacgagaaguccuuccuggagaagcagggguaccggcagcccaaggugcucaccaagcugcccaaguacacgcuguacgagugcgagaacggccgccggcgcaugcucgccagcgccaacgaggcgcagaaggggaaccagcagguccugaagggccagcugaucacccuccugcaccacgccaagaacugcgaggccuccgacggcaagagccuggacuacaucgagagcaaccgggagauguucggggagcuccuggcccacguguccgaguucgcgaagcgcuacacccuggccgacgccaaccucagcaagaucaaccagcuguucgagcagaacaaggacaacgacaucaaggugaucgcccaguccuucgucaaccugauggccuucaacgcgaugggcgccccggccagcuucaaguucuucgaggccaccaucgagcggaagcgcuacacgaaccucaaggagcugcuguccgccaccaucaucuaccagagcaucaccgggcucuacgaggcgcggaagcgccuggacggcuga

SEQ ID NO: 1800 - RNA, 4005 nt, Artificial Sequence
  Cas9 variant
augaagaaccccuacaccaucggccuggacaucgggaccaacagcgugggcugggccguccucacgaaccaguacgaccuggugaagcgcaagaugaagguggccgggaacuccgacaagaagcagaucaagaagaacuucuggggcguccggcuguucgacgacgggcagaccgcgguggaccgccggaugaaccgcaccgcccggcgccggaucgagcgccggcgcaaccggaucagcuaccuccaggagaucuucgccguggagauggccaacaucgacgccaacuucuucugccgccugaacgacuccuucuacgucgacagcgagaagcggaacucccgccacccguucuucgcgaccaucgaggaggagguggccuaccacgacaacuaccggacgaucuaccaccuccgcgaggagcuggugaacagcuccgagaaggccgaccugcggcuggucuaccucgcccuggcgcacaucaucaaguaccgcggcaacuuccugaucgagggcgcccucgacaccaagaacaccagcguggacgagguguacaagcaguucauccagaccuacaaccaggucuucauguccaacaucgaggagggggcccuggccaagguggaggagaaccuggagguggccagcauccucgcgggcaaguucacgcggcgcgagaaguucgagcggauccugcgccuguaccccggggagaaguccaccggcauguucgcccaguucaucagccucaucgucgggaacaagggcaacuuccagaagguguucaaccugguggagaagaccgacaucgagugcgccaaggacuccuacgaggaggaccuggaggcccuccuggccaucaucggcgacgaguacgcggagcuguucgucgccgccaagaacaccuacaacgccguggugcucagcuccaucaucacggucaccgccaccgagaccaacgcgaagcugagcgccuccaugaucgagcgcuucgacgcccacgagaaggaccugggggagcucaaggccuucaucaagcugcaccuccccaagcaguaccaggagaucuucaacaacgccgcgaucgacggcuacgccggguacaucgacggcaagacgaagcaggucgacuucuacaaguaccugaagaccacccuggagaacguggagggcgccgacuacuucaucaccaagaucgaggaggagaacuuccugcggaagcagcgcacguucgacaacggggugaucccccaccagcuccaccuggaggagcuggaggccauccuccaccagcaggcgaaguacuacccguuccugcgggaggacuacgagaagaucaagagccuggugaccuuccgcauccccuacuucgucggcccccucgccaaggggcaguccgaguucgccuggcugacccggaaggccgacggcgagauccgccccuggaacaucgaggagaagguggacuucggcaagagcgccguggacuucaucgagaagaugaccaacaaggacacguaccugccgaaggagaacguccuccccaagcacagccugugcuaccagaaguacaugguguacaacgagcugaccaaggugcgguacaucgacgaccaggggaagaccaacuacuucuccggccaggagaagcagcagaucuucaacgaccucuucaagcagaagcgcaaggucaagaagaaggaccuggagcuguuccuccggaacaucaaccacaucgagagccccaccaucgaggggcuggaggacuccuucaacgcgagcuacgccacguaccacgaccugcugaaggugggcaugaagcaggagucccucgacagcccccugaacgccgagaugcuggaggacaucgugaagauccucaccgucuucgaggacaagcgcaugaucaaggagcagcugcagcaguucuccgacgugcuggacggggugguccucaagaagcuggagcggcgccacuacaccggcugggggcggcugagcgccaagcuccuggugggcauccgcgacaagcagucccaccugaccauccucgacuaccugaugaacgacgacggccugaaccggaaccucaugcagcugaucaacgacagcaaccuguccuucaagagcaucaucgagaaggagcaggucuccacgaccgacaaggaccuccagagcaucguggccgaccuggcgggguccccggccaucaagaagggcauccugcagagccucaagaucguggacgagcugguguccaucaugggguacccgccccagaccaucgucguggagauggcccgcgagaaccagaccacggugaagggcaagaacaacagccggccccgcuacaagucccuggagaaggccaucaaggaguucgggagccagauccucaaggagcaccccaccgacaaccaggagcugaagaacaaccggcuguaccucuacuaccugcagaacggcaaggacaucuacaccggccaggagcuggacauccacaaccucagcaacuacgacaucgaccacaucgucccccaguccuucaucaccgacaacagcaucgacaaccuggugcugaccuccagcgccgggaaccgcgagaagggcggggacgugccgccccucgagaucguccgcaagcggaagguguucugggagaagcuguaccagggcaaccugauguccaagcgcaaguucgacuaccucacgaaggcggagcggggcgggcugaccgacgccgacaaggcccgcuucauccaccggcagcugguggagacccgccagaucaccaagaacgucacgaacauccuccaccagcgguucaacaacgagaccgacaacuacggcaacaccauggagcagguccgcaucgugacccucaagagcgcccuggugucccaguuccggaagcaguuccagcuguacaaggugcgcgaggugaacgacuaccaccacgcgcacgacgccuaccugaacggggucguggccaacacgcugcucaagguguacccccagcuggagcccgaguucgucuacggcgaguaccaccaguucgacugguucaaggccaacaaggccaccgcgaagaagcaguucuacaccaacaucaugcuguucuucgcccagaaggagcggaucaucgacgagaacggggagauccucugggacaagaaguaccuggagaccaucaagaaggugcuggacuaccgccagaugaacaucgugaagaagacggagauccagaagggcgaguucagcaaggccaccaucaagcccaagggcaacuccagcaagcucaucccccggaaggagaacugggacccgaugaaguacgggggccuggacucccccaacauggccuacgccgucaucaucgagcacgcgaaggggaagaagaagaucgugaucgagaagaagcugauccagaucaacaucauggagcgcaagauguucgagaaggacgaggaggccuuccucgaggagaagggcuaccggcaccccaaggugcugaccaagcugcccaaguacacccucuacgagugcgagaaggggcgccggcgcaugcuggccagcgccaacgaggcccagaagggcaaccagcugguccucuccaaccaccuggugagccugcucuaccacgcgaagaacugcgaggccuccgacggcaagagccugaaguacaucgaggcccaccgggaggccuucuccgagcugcucgcccaggugagcgaguucgcgacgcgcuacacccuggccgacgccaaccugagcaagaucaacaaccucuucgagcagaacaaggagggggacaucaaggccaucgcgcaguccuucgucgaccugaugguguucaacgccaugggcgccccggccagcuucaaguucuucgaggccaccaucgaccggaagcgcuacaccaaccugaaggagcuccuguccagcacgaucaucuaccaguccaucaccgggcuguacgagagccgcaagcggcucgacgacuga

SEQ ID NO: 1801 - RNA, 4005 nt, Artificial Sequence
  Cas9 variant
augaagaaggaguacaccaucggccuggacaucgggaccaacagcgugggcugggccguccucacggagaacuacgaccuggugaagaagaagaugaagguguacgggaacaccgagaccaaguaccugaagaagaaccucuggggcguccgccuguucgacgagggggagaccgccgcggaccggcgccugaagcggacgacccgccggcgcuacucccggcgccggaaccgcaucugccggcuccaggaccuguucaccgaggagaugaaccagguggacgccaacuucuuccaccgccugcaggagagcuuccucgugcccgacgagaaggaguucgagcggcacgccaucuucggcaagauggaggaggaggucuccuacuaccgcgaguucccgaccaucuaccaccuccggaagcaccuggccgacacgagcgagcaggccgaccuccgccugguguaccuggcgcucgcccacaucgugaaguaccggggccacuuccugaucgagggggagcugaacaccgagaacuccagcgucuccgagaccuuccgcaccuucauccagguguacaaccagaucuuccgggagaacgaggugccccucgccguccccgacaacaucgaggagcuguucagcgagaaggugucccgcgcccggaagguggaggcgauccugagcgucuacuccgaggagaaguccacgggcacccucgcccaguuccugaagcugaugguggggaaccagggccgcuucaagaagaccuucgaccucgaggaggacgggaucauccagauccccaaggaggaguacgaggaggagcuggagacccugcucgccaucaucggcgacgaguacgccgagaucuucagcgccaccaagagcguguacgacgcggucgcccuguccggcauccugagcgugacggacggggacaccaaggccaagcucuccgccagcaugguggagcgcuacgaggcccaccagaaggaccugguccaguucaagcaguucauccggaaggagcugccggagauguacgcgcccaucuuccgcgacaacuccgugagcggcuacgccggguacguggagaacagcaaggucgugacccaggccgaguucuacaaguacaucaagaaggccaucgagaagguccccggcgccgaguacuuccucgagaagaucgagcaggagacguuccuggacaagcagcggaccuucaacaacggcgugaucccccaccagauccaccuggaggagcucgaggcgaucauccagaagcaggccaccuacuacccguuccuggccgacaacaaggaggagaugaagcagcuggugaccuuccgcauccccuacuacgucgggccccucgccgacggcaacucccccuucgccuggcuggagcggaucagcuccgagccgauccgccccgggaaccuggcggaggugguggacaucaagaaguccgccacgaaguucaucgagcggaugaccaacuucgacaccuaccuccccaccgagaagguccugcccaagcacagcaugaucuacgagaaguacaugguguacaacgagcugacgaaggugagcuacgucgacgagcgcggcaugaaccagcgguucuccggggaggagaagaagcagaucguggaggagcuguucaagcagagccgcaaggugaccaagaagcugcuggagaaguuccucuccaacgaguucggccuggucgacguggccaucaagggcaucgagaccagcuucaacgccggguacggcaccuaccacgacuuccugaagaucgggaucacgcgggagcagcuggacaaggaggagaacuccgagacccucgaggagaucgugaagauccugaccgucuucgaggaccgcaagaugauccgggagcagcugaagaaguacaccuaccucuucgacgaggaggugcugaagaagcuggagcgccggcacuacacgggcugggggcgccucagcgcgaagcugcugaucggcaucaaggagaagcggacccacaagaccauccucgacuaccugaucgaggacgacggcgggaagcagccgaucaaccgcaaccugaugcagcucaucaacgacuccgaccugagcuucaaguccgagaucgccgaggcccagagcgacaugaacaccgaggaccugcacgaggugguccagaaccucgccggcucccccgccaucaagaaggggauccugcagagccugaagaucguggacgagcucguggacaucaugggcucccugcccaagaacaucgucguggagauggcgcgggagaaccagaccacgagccgcgggcgcaccaacagcaacccccggaugaaggcccuggaggaggccaugcgcaaccuccgguccaaccugcugaaggaguacccgaccgacaaccaggcccuccagaacgaccgccuguaccuguacuaccuccagaacggcaaggacauguacaccggccuggaccugagccuccacaaccuguccagcuacgacaucgaccacaucgugccccaguccuucacgaccgacaacagccuggacaaccggguccucguguccagcaaggagaaccgcgggaagaaggacgacgugcccuccaaggaggucgugcagaagaacaucacccugugggagacccugaagaacagcaaccucaucucccagaagaaguacgacaaccugacgaagggccugcgcgggggccucaccgaggacgaccgggcccacuucaucaagcggcagcugguggagacccgccagaucaccaagcacgucgcgcggauccuggaccagcgcuucaacagccagaaggacgaggagggcaagacgauccgggccgugcgcguggucacccucaaguccagccugaccucccaguuccggaagcaguucgccauccacaaggugcgcgagaucaacgacuaccaccacgggcacgacgccuaccugaacggcguggucgccaacagccuccugcggguguacccccagcugcagccggaguucguguacggggacuaccccaaguucaacgcguacaaggccaacaaggccaccgccaagaagcagcucuacacgaacaucaugaaguucuucgcggaggacgccgucaucaucgacgagaacggcgagauccugugggacaagaagaacaucgccaccgugaagaaggugauguccuacccccagaugaacaucgucaagaagcccgagauccagaccgggagcuucagcaaggagaccaucaagccgaagggcgacuccgacaagcugaucagccgcaagacgaacuggucccccaagcucuacggcggguucgacagcccccagguggccuacuccgugaucaucaccuacgagaagggcaagaagaagguccgggccaaggcgaucguggggaucaccaucauggagcagagccuguucaagaaggacccggugucccugcucgaggagaagggcuacgccaaccccgagguccugauccaccuccccaaguacacccuguacgagcuggagaacgggcgccggcgccugcucgccagcgccaacgaggcccagaagggcaaccagcuggugcugcccgcgucccucgugacgcugcuguaccacgccaagcaggucgacgaggacagcggcaaguccgaggaguacgugcgcgagcaccgggccgaguucgccgagauccucaacuacguccaggccuucagcgagaccaagauccuggcgaacaagaaccugcagaccauccucaagcuguacgaggagaacaaggaggccgacaucaaggagaucgccgaguccuucgugaaccugaugaaguucagcgccuacggggcgccgauggacuucaaguucuucggcaagaccaucccccgcucccgguacacgagcgugggggagcuccuguccgccaccaucaucaaccagagcaucaccggccuguacgagacccgccggaagcucgucgacuga

SEQ ID NO: 1802 - RNA, 4005 nt, Artificial Sequence
  Cas9 variant
augcgcaagcccuacaccaucggccuggacaucgggaccaacagcgugggcugggccguccucacggaccaguacaaccuggugaagcggaagaugaagguggccggguccgccgagaagaagcagaucaagaagaacuucuggggcguccgccuguucgacgagggggagguggccgccggccggcgcaugaaccggaccacccgccggcgcaucgagcggcgccggaaccgcaucgccuaccuccaggagaucuucgccgcggagauggccgagguggacgccaacuucuucuaccggcuggaggacagcuucuacaucgaguccgagaagcgccacagccggcacccguucuucgccaccaucgaggaggaggucgcguaccacgaggaguacaagacgaucuaccaccuccgcgagaagcuggugaacuccagcgacaaggccgaccugcggcugguguaccucgcccuggcccacaucaucaaguaccgcggcaacuuccugaucgaggggaugcucgacaccaagaacaccuccgucgacgagguguucaagcaguucauccagaccuacaaccagaucuucgccagcgacaucgaggagggcucccugacgcggcuggaggagaacaaggagguggcggagauccucagcgagaagcugacccgccgggagaagcuggacaagauccucaagcuguacaccggggagaaguccaccggcauguucgcccgcuucaucaaccugaucaucgggagcaagggcgacuucaagaaggucuucgaccucgacgagaaggccgagaucgagugcgccaaggacacguacgaggaggaccuggaggcccugcucgcgaagaucggcgacgaguacgccgagaucuucguggccgccaaguccaccuacaacgccgugguccugagcaacaucaucaccgugaccgacacggagaccaaggcgaagcuguccgccagcaugaucgagcgcuucgacaagcacgccaaggaccucaagcggcugaaggccuucuucaagaugcagcugcccgagaaguucaacgagguguucaacgacaucgagaaggacggguacgccggcuacaucgacgggaagaccacccaggagaaguucuacaaguacaugaagaagaugcucgcgaacaucgacggcgccgacuacuucaucgaccagaucgaggaggagaacuuccugcgcaagcagcggacguucgacaacggcaccaucccccaccagcugcaccucgaggagcuggaggccauccugcaccagcaggccaaguacuaccccuuccuccgcaaggacuacgagaagauccggucccuggucaccuuccgcaucccguacuucaucgggccccuggcgaacggccagagcgacuucgccuggcucacccggaaggccgacggggagauccgccccuggaacaucgaggagaagguggacuucggcaaguccgccaucgacuucaucgagaagaugacgaacaaggacaccuaccugcccaaggagaacgugcugccgaagcacagccucugcuaccagaaguacauggucuacaacgagcugaccaagauccgguacaucgacgaccaggggaagacccaccacuucagcggccaggagaagcagcagaucuucaacggccuguucaagcagcagcgcaaggugaagaagaaggaccucgagcgguuccuguacacgaucaaccacaucgagucccccaccaucgaggggguggaggacgccuucaacagcuccuucgcgaccuaccacgaccugcagaagggcggggucacccaggagauccucgacaacccccugaacgccgacaugcuggaggagaucgugaagauccugacggucuucgaggacaagcgcaugaucaaggagcagcuccagagcuucuccgacgugcuggacggcaccauccugaagaagcucgagcggcgccacuacaccggguggggccggcugagcgccaagcugcucaccggcauccgcgacaagcacucccaccugacgauccuggacuaccucaugaacgacgacgggcugaaccggaaccugaugcagcucaucaacgacagcaaccuguccuucaagagcaucaucgagaaggagcaggucuccaccgccgacaagggcauccagagcaucguggccgagcuggcggggucccccgccaucaagaagggcauccuccagagccugaagaucguggacgagcugguggggaucaugggcuacccgccccagaccaucgucguggagauggcccgcgagaaccagaccaccggcaaggggaagaacaacuccaagccccgguucaucagccucgagaaggccaucaaggaguucggcucccagauccugaaggagcaccccacggacaaccagugccugaagaacgaccgccucuaccuguacuaccugcagaacgggaaggacauguacaccggcaaggagcucgacauccacaaccugagcaacuacgacaucgaccacaucaucccgcaguccuucaucaccgacaacagcaucgacaaccgcgugcuggucagcuccaccgccaaccgggagaagggcgacaacgugccccuccuggaggugguccgcaagcggaaggcguucugggagaagcuguaccaggccaagcucaugagcaagcgcaaguucgacuaccugacgaaggccgagcgcgggggccugaccgaggccgacaaggcgaacuucauccagcggcagcucguggagacccggcagaucaccaagaacguggccaacauccuguaccagcgcuucaacugcaagcaggacgagaacgggaacgaggucgagcagguccggaucgugacgcugaaguccacccucgugagccaguuccgcaagcaguuccagcuguacaaggugcgggaggugaacgacuaccaccacgcccacgacgccuaccugaacggcgucguggccaacacccuccugaagguguacccccagcuggagcccgaguucgucuacggggacuaccaccaguucgacugguucaaggcgaacaaggccaccgccaagaagcaguucuacacgaacaucaugcgcuucuucgccaaggagaaccagaucaucgacaagaacggcgagauccucugggacaaccgguaccuggacaccaucaagaaggugcuguccuaccgccagaugaacaucgugaagaagaccgagauccagaagggcgaguucagcaacgccaccgucaacccgaaggggaacuccagcaagcucaucucccggaaggcggacuggaaccccaucaaguacggcggguucgacggcagcaacauggccuacuccaucgugaucgaguacgagaagcgcaagaagaagacggugaucaagaaggagcugauccagaucaacaucauggagcgggucgccuucgagaaggaccagaaggccuuccuggaggagaagggguacuacagccccaaggugcucaccaagauccccaaguacacccuguacgagugcgagaacggccgccggcgcaugcugggcuccgccaacgaggcgcagaaggggaaccagauggugcucccgaaccaccugaugacccugcucuaccacgccaagaacugcgaggccaacgacggcgagagccuggccuacaucgagaugcaccgggagauguucgcggagcugcucgccuacaucuccgaguucgccaagcgcuacacgcuggccaacgaccgccuggagaagaucaacauguucuucgagcagaacaagaagggggacaucaaggucaucgccaagagcuucgacaagcucaagguguucaacgcguucggcgcgccccgggacuucgaguucuucgagaccaccaucaagcgcaagcgguacuacaacaucaaggagcugcugaacgccaccaucaucuaccaguccaucacggggcucuacgaggcccgcaagcggcuggaggacuga

SEQ ID NO: 1803 - RNA, 4008 nt, Artificial Sequence
  Cas9 variant
augaagaacuacaccaucggccuggacaucgggaccaacagcgugggcugggccgucaucaaggacgaccucacgcuggugcgcaagaagaucaagaucuccgggaacaccgacaagaaggaggugaagaagaaccuguggggcagcuuccucuucgagcagggggacaccgcccaggacacccgggucaagcgcaucgcgcggcgccgguacgagcgccggcgcuuccggauccgcgagcugcagaagaucuucgacaaguccaugggcgagguggacagcaacuucuuccaccggcuggacgaguccuuccucguggaggaggacaaggaguacagcaaguaccccaucuucuccaacgagaaggaggacaagaacuacuacgacaaguacccgacgaucuaccaccuccgcaaggaccuggccgacagcaaccagaaggccgaccuccggcugaucuaccuggcccucgcccacaugaucaaguaccgcggccacuuccugaucgagggggaccugaagauggacggcaucuccaucagcgaguccuuccaggaguucaucgacagcuacaacgaggucugcgcgcucgaggacgagaaccuggagaucaucuacaacgacgagcugcucacccagaucgagaacaucuucaagcaggacaucucccggagcaagaagcuggaccaggccaucgcccuguuccagggggugaagcgccagucccucuucggcaucuuccugacccugaucguggggaacaaggccaacuuccagaagaucuucaaccucgaggacgacaucaagcuggaccugaaggaggaggacuacgacgagaaccucgaggagcugcugagcaacaucgacgagggcuaccgggacgucuuccuccaggcgaagaacguguacaacgccaucgagcuguccaagauccugaagaccgacggcaaggagacgaaggcgccccucagcgcccagaugguggagcuguacaaccagcaccgcgaggaccugaagaaguacaaggacuacaucaaggccuaccuccccgagaaguacggggagaccuucaaggacgccaccaagaacggcuacgccggguacaucgacggcaagaccucccaggaggacuucuacaaguucgucaaggcccagcugaagggcgaggagaacggggaguacuuccuggaggccaucgagaacgagaacuuccuccggaagcagcgcagcuucuacaacggcgugauccccuaccagauccaccuccaggagcugacggccgugcuggaccagcaggagaagcacuacagcuuccugaaggagaaccgggacaagaucaucucccugcucaccuuccgcaucccguacuacgucgggccccuggcgaagggcgagagccgcuucgccuggcuggagcgguccaacagcgaggagaagaucaagcccuggaacuucgacaagaucguggacaucgacaaguccgccgagcuguucaucgagaaccugaccagccgcgacaccuaccugcccgacgagccggugcugcccaagcggucccucaucuaccagaaguucacgaucuucaacgagcugaccaagaucagcuacaucgacgagcgcgggauccugcagaacuucuccagccgggagaagaucgccaucuucaacgaccucuucaagaacaaguccaaggucaccaagaaccagcuggugaaguacaucgagaacaaggagcagaucaucgcccccgagaucaagggcaucgaggacagcuucaacuccaacuacagcaccuacaucgaccuguccaagauccccgacaugaagaagcuccuggagaaggacgaggacgagauccuggaggagaucaucaagauccucacgaucuucgaggaccgcaagaugcggaagcgccagcugaugaaguucaaggacaagcugagcgagaaggcgaucaaccagcucuccaagaagcacuacaccggcugggggcagcugagcgagaagcugaucaacggcauccgggacgagcaguccaacaagaccauccucgacuaccugaucgaggacaacgggugcccgaagaacaugaaccgcaacuucaugcagcugaucaacgacgacacccucagcuucaaggagaagauccggaaggcccaggacaucaaccaggugaacgacaucaaggagaucgucaaggaccugcccggcagccccgccaucaagaaggggaucuaccaguccauccgcaucguggacgagaucauccggaagaugaaggaccgccccaagaacaucgugaucgagauggcccgggagaaccagacgacccaggagggcaagaacaagagcaaggcccgccugaagaagauccaggagggccucgagaaccuggacuccguccacguggagaagcaggcgcuggacgaggagaugcucaagagcccgaaguacuaccuguacugccugcagaacgggaaggacaucuacaccggcaaggaccucgacaucgggcagcugcagaccuacgacaucgaccacaucaucccccgguccuucaucacggacaacagcuucgacaaccugguccucaccuccagcaccgugaaccgcggcaagcuggacaacgugcccucccccgacaucguccggcagcagaagggguucuggaagcagcugcuccgcgccggccugaugagccagcgcaaguucaacaaccugaccaagggcaagcucacggaccgggaccgccagcaguucaucaaccggcagcugguggagacccgccagaucaccaagcacguggccaaccugcucucccaccaccugaacgagaagaaggaggucggggagaucaacaucgugcugcucaagagcgcccugaccucccaguuccggaagaaguucgacuucuacaaggugcgcgaggucaacgacuaccaccacgcgcacgacgccuaccugaacggcgugaucgcccucaagcugcuggagcucuacccguacauggccaaggaccugaucuacgggaaguacagcuaccaccggaagaucgagggcgacaaggccacgcaggcgaaguacaagauguccaacaucaucgagcgcuucagccaggaccugcucgccaaccccgacggcgagaucgccugggagaaggacaaggaccugaacaccauccggaaggugcuguccagcaagcagaucaacaucaucaagaaggccgaggaggggaagggccgccucuucaaggagaccaucaacagccggcccuccaagaagaccgagaagcgcauccccaucaagaacaaccuggacccgaacaucuacgggggcuacaucgaggagaagauggccuacuacaucgcgaucaacuaccuggagaacgggaagaccaagaaggccaucgucggcaucagcaucaaggacaagaaggacuucgagggccagacgaccgaguaccucgggaagaucggcuucaacaaggccuccaucaucaacagcuucaagaacuacacccuguucgagcuggagaacgggucccggcgcaugaucgugggcgccagcaaggagaacgacuccaagggggagcuccagaagggcaaccagauguaccugccccagaaccugcucgaguucguguaccaccugaagcacuacaacgaggacgagaccagccacaaguucaucgucgagcacaaggccuacuucgacgagcugcucaacuacaucguggaguucgcgaacaaguaccuggagcuggagaacuccaucgagaagaucaaggaccucuaccacggcaaggggcccgacguggaggagaaggagcuggucgagagcuucaucaaccugcucgccaucacgaagugcggccccgccgccgacaucaccuuccugggggagaagaucucccggaagcgcuaccggagcaccaacugccuguggggcuccgaggugaucuuccagagcccgaccgggcucuacgagacgcgccugcggcuggaguga

SEQ ID NO: 1804 - RNA, 4011 nt, Artificial Sequence
  Cas9 variant
auggacgacaacuaccagcugaugcacgccaagggcaaguacggguacggcacccgcaucuacagcgaggggcagaccgccgcggaccggcgcggcuuccggacgacccgccggcgccucaaccggcgcaaguggcggcugcgccugcuccaggacuucuucgagcccuacauccugccgcaggacgaggccuucuucauccggcagaagcaguccaaccuggugccccaggacaccaagaagcaguaccccgagagcguccucuucgacgacaccuccgacaaggacuucuacacggaguaccccaccaucuaccaccuccgccaggcccugaugaccgagaaccggcaguucgacauccgcgagguguaccuggccauccaccacaucgugaaguaccgggggcacuuccugaacaacgccccggucaagaccuucaagagcggcaaccuggaccucgcgaucaaguucaacgagcugaacgaggaguucaaguccguguaccccgaccuggagcuccaguucaaccuggaccagaucgacgagaucaagaagauccugcucgacagcacgaagucccgcuucgaccggcagggcgaggccgugaagcugaucuacaccgucagcgaggugaagaccaucgagaagcugcagaacaagaucgugaagcaguuccucuccgggauccugggccugaacacccgcuucgacguccucacgaacaccgagagcgacgacuccauguggaaguucagccuggacuccgagagcuccgacgacgcccuggacgagaucaucgcccagcucgacgaccccgcgauccacgugguggagcuggucaacgagauccacagcuccaucacccuggccgggaucgugcccgagggccaggggcucagcgaguccaugguggagaaguacgaggcccacaaggcccaccuccagcugcugaaggccgucgagaagcugguggacaagaaggcggccgacaagcuggagguggccuacgaccaguacaucaacggcaaggacagcaagcaguucaucaaggaggacuucuacaaggccguccagagcgagaucaagggcguggccggggacgagguggcggagaucaaccagcucaucgagcuggaccaguucaugccgaagcagcggaccaaggagaacggcgccaucccccaccagcugcaccagcacgagcucgacgucaucaucgagaaccaguccaaguacuacgacuggcugggggagaaggugggcaacgaguacaagcuggacaagcucgugagcuuccgcguccccuacuacgugggcccccuggucgacacggccuccaaggagaagaaggacgagacccgguucgccuggauggugcgcaagaacccggagagcaccgaggccaucacccccuggaacuucgaggacaucguggacaagaacgcguccgccgagaacuucaucaagcgcaugacgaccaaggacaaguaccugcucaacgaggacguccugcccaagugcagccugcucacccaggacuucgagguguacaacgagcugaacaacauccgggugaacggggagaaguucaccgccgagcagaagcagcugauccacgacgagcuguucacgaagcacgccuccgucagcaucaagcagcucaaggacuuccugguguccgagcugauguacgugcgcgacaaccucaaggucgagggccuggccgacgagaagaagcugaugagcucccucagcacccaguucgacuaccagaagaucauccccgaccagaucaacgacgugaaguaccgggaggacaucgagcagaucaucgagugguccaccaucuucgaggacgcggccaucuucaagaccaagcugaaggagaucgacuggcugacggacgagcagcgcaacaagcucgccaacaagcgguaccgcggguggggcagccuguccaagcggcugcucgccugccugguggacgagaacgggcagcgcaucaucgacauccugcgggacagcuccgacaacuucaugaugaucgucaaccgcccggaguucaagcaggcgaucuucgacgagaacgccaaccucaccgagaccaacagcaagaaggacauguucgagaugaucgacaacuucuacaccagcccccagaacaagaaggccauccgccaggugcugcuggugguccaggacauccagaacgccaugggcggcguggcgccccagaagaucuucaucgaguucgcccgggaggacgaggugaacgggcggcgcacgaacucccgguacagccagauccgcgagauguacuccaaggucaccgacgacgugaucaacaagaccgugcggggcgagcucgaggccaacaaggggagccugaacaaggagaagcuguuccucuacuuccugcagggcgggaucgaccuguacuccggcaagaccaucaacaucgacaacaucagcuccuacgacgucgaccacgugcucccccagagcuucaucaaggacgacuccaucaacaacaaggugcuggucaacgccaagggcaaccgcgugaagaacgacaacgugccgauggagcuguucggggccaagauguaccccacguggaagcggauggucgacaccggcaucaugagcaaggccaaguucaagaaccucacccugaaccccgacaacguggacaaguucaaggcggagggguucaucaaccgccagcugguggagacccgccagaucaucaagcucgucgcccagauccugaacgacaagcugggcgacgacaccaagaucguguccgugaaggccaaccucacgcacgacaugcgggucuucuucgacuuccccaagaaccgcaacgugaacaacuaccaccacgccuucgacgccuaccugagcgcguucguggggaccuaccuguacaagcgguacccgaagcuccagcccuacuucgucuacggcgaguucaagaagauggacaagcugaagaacaugaccuccuucgacuuccugcgcgaccucaagcacaccgacaaggugguggacaaggacacgggcgagaucaucgccgacaagcuggccgucaucaccaacaugaacaagaucuacgacuucaagaaggugcuggugacccacgagguccacgagaacagcggggccauguacgaccagacccucuaccccgcgaagcuggacaagucccugggccggaagggggccaagcagcucauccccaagaaggacgacaugccgacggcccuguacggcggcuacaccgggagcaaggacgccuucauguccaucgugcgccugaagaagaaggacgagguguacuacaaggucaucggcauccccgugcggaucgccgacagcgugcagcacgggaaggaggucgacguggaggcgcucacccaguucaucgagaccaaguucacgaaggagaaccugaacaagaagaccggcgagaucacccgcaagguggagugguucgagcugguccuccccaaggugcuguucgggcaggccgucuucgacggcggccagccguucaugcugggguccagcaccuacccccacaaccuccgggagcuggugcugacgaaggacagcgugaagaagaucgccggcaaggaguccaacaagagcuaccucgacgccuacgacgagaucauggaggccaugaacaaguacuucccccuguacgacaccaacaaguuccgcgagaaggucaucgaggggcgguccaaguucaucgaccugcccgacaaggacgaguacgagaacaacaagcucguccaggugggcaagagcaccaucaucgaccgcauguucaucgggcugcacgcgaacgccgcccggaccgaccugaagaacaucggcaucacgaccccguucggcuucaugcagcaggccuccgggaucaagcucaccaaggacaccguggugcuguuccagagcuccacgggccuguucgagcgcaagguggcccucaaggaccuguga

SEQ ID NO: 1805 - RNA, 4011 nt, Artificial Sequence
  Cas9 variant
augaccaaggacuacaccaucggccuggacaucgggacgaacagcgugggcugggccguccucaccgacgacuaccagcugaugaagcgcaagauguccgugcacgggaacaccgagaagaagaagaucaagaagaacuucuggggcgcccggcuguucgacgaggggcagaccgcggaguuccgccggacgaagcgcaccaaccggcgccggcucgcccgccggaaguaccgccugagcaagcugcaggaccucuucgccgaggagcugugcaagcaggacgacugcuucuucgugcggcuggaggaguccuuccucguccccgaggagaagcaguacaagccggccagcaucuuccccacccuggaggaggagaaggaguacuaccagaaguaccccaccaucuaccaccuccgccagaagcugguggacuccacggagaaggaggaccugcggcugguguaccucgcccuggcgcaccuccugaaguaccgcggccacuuccuguucgagggcuaccuggacaccgagaacaccagcaucgaggaguccuuccgggucuuccucgagcaguacgggaagcagagcgaccagccccugaucgugcaccagccggugcugaccauccucacggacaagcuguccaagaccaagaaggucgaggagauccugaaguacuaccccaccgagaagaucaacagcuucuucgcccagugccucaagcugaucgugggcaaccaggccaacuucaagcgcaucuucgaccuggaggccgaggugaagcuccaguucuccaaggagaccuacgaggaggaccuggagagccugcucgagaagaucggggacgaguaccuggacaucuuccugcaggcgaagaagguccacgacgccauccuccuguccgagaucaucagcuccacggugaagcacacccaggccaagcugagcuccggcaugguggagcgguacgagcgccacaaggccgaccucgccaaguucaagcaguucgucaaggagaacgugccccagaaggcgaccguguucuucaaggacaccacgaagaacggguacgccggcuacaucaagggcaagaccacccaggaggaguucuacaaguucgucaagaaggagcugagcgggguggugggcuccgagcccuuccuggagaagaucgaccaggagaccuuccuccugaagcagcggacguacaccaacggggucaucccgcaccaggugcaccugaucgagcucaaggccaucaucgaccagcagaagcagcacuaccccuuccuggaggaggccggccccaagaucaucgcccuguucaaguuccgcauccccuacuacgugggcccgcucgcgaaggagcaggaggccagcagcuucgccuggaucgagcggaagaccgccgagaagauccaccccuggaacuucuccgaggucguggacaucgagaaguccgccaugcgcuucauccagcgcaugaccaagcaggacacguaccugcccaccgagaagguccugcccaagaacagccugcucuaccagaaguacaugaucuucaacgagcugaccaaggugagcuacaaggacgagcgcggggugaagcaguacuucuccggcgacgagaagcagcagaucuucaagcagcuguuccagaaggagcgggggaagaucaccgucaagaagcuccagaacuuccuguacacgcacuaccacaucgagaacgcgcacaucuucggcaucgagaaggccuucaacgccagcuacuccaccuaccacgacuucaugaagcuggccaagaccaaccagaaguccaugcaggaguggcucgagcagccggagauggagcccaucuucgaggacaucgugaagauccugaccaucuucgaggaccggcagaugaucaagcaccagcugagcaaguaccaggagguguucggggagaagcuccugaaggaguucgcccgcaagcacuacacgggcuggggccgguucagcgcgaagcugauccacgggauccgcgaccggaagaccaacaagaccauccucgacuaccugaucaacgacgacgacguccccgccaaccgcaaccggaaccugaugcagcucaucaacgacgagcaccuguccuucaaggaggagaucgccaaggccaccguguucagcaagcacaagucccugguggacgucauccaggaccuccccggcagcccggcgaucaagaaggggaucuggcagucccugaagaucguggaggagcugaucgccaucaucggcuacaagcccaagaacaucgugaucgagauggcccgcgagaaccagaagacccaccggacgaagccccgccucaaggcccuggagaacgggcugaagcagaucggcagcacccuccugaaggagcagcccaccgacaacaaggcccugcagaaggagcggcucuaccuguacuaccugcagaacggccgcgacaucuacaccggggagccgcucgacaucgagaaccugcaccaguacgaggucgaccacaucaucccccgguccuucaucguggacaacagcaucgacaacaaggugcuggucgcguccaagcagaaccagaagaagcgcgacgacgugcccaacaagcagaucgugaacgagcagcggaucuucuggaaccagcucaaggaggccaagcugaucagccccaagaaguacgccuaccugacgaagaucgagcucaccccggaggacaaggcccgcuucauccagcggcagcuggucgagacccgccagaucaccaagcacguggccaacauccugcaccagagcuuccaccaggaggaggagggcacggacugcgacggggugcagaucaucacccucaaggcgacccugaccucccaguuccgccagacguucggccuguacaagguccgggagaucaacccccaccaccacgcccacgacgccuaccucaacggguucaucgccaacgugcugcugaagcgcuaccccaagcucgccccggaguucguguacggcaaguacgucaaguacagccuggcgcgggagaacaaggccaccgccaagaaggaguucuacuccaacauccugaaguuccucgagagcgacgagcccuucugcgacgagaacggcgagaucuacugggagaaguccuaccaccucccccgcaucaagaaggugcugagcucccaccaggugaacgucgugaagaagguggagcagcagaagggcggguucuacaaggagaccgucaacagcaaggagaagcccgacaagcugaucgagcggaagaacaacugggacgugaccaaguacgggggcuucggcuccccggugaucgccuacgcgaucgccuucgucuacgccaaggggaagacgcagaagaagacccgcgccaucgagggcaucaccaucauggagcaggccgcguucgagaaggaccccaccacguuccugaaggacaagggguucccccaggugaccgaguucaucaagcugcccaaguacacccucuucgaguucgacaacggccggcgccgguuccuggccagccacaaggagucccagaaggggaacccguucauccugagcgaccagcucgugacccugcuguaccacgcccagcacuacgacaagaucacguaccaggaguccuucgacuacgucaacacccaccucagcgacuucuccgccauccugaccgaggugcuggccuucgcggagaaguacacccucgccgacaagaacaucgagcgcauccaggagcuguacgaggagaacaaguacggcgagaucagcaugaucgcccaguccuuccugcagcuccugcaguucaacgccaucggcgcccccgcggacuucaaguucuucggggugacgaucccccggaagcgcuacaccagccugaccgagaucugggacgccaccaucaucuaccagagcgucacgggccucuacgagacccggauccgcaugggggaccugugggccggcgagcaguga

SEQ ID NO: 1806 - RNA, 4011 nt, Artificial Sequence
  Cas9 variant
augaccaaggacuacaccaucggccuggacaucgggacgaacagcgugggcugggccguccucaccgacgacuaccagcugaugaagcgcaagauguccgugcacgggaacaccgagaagaagaagaucaagaagaacuucuggggcgcccggcuguucgacgaggggcagaccgcggaguuccgccggacgaagcgcaccaaccggcgccggcucgcccgccggaaguaccgccugagcaagcugcaggaccucuucgccgaggagcugugcaagcaggacgacugcuucuucgugcggcuggaggaguccuuccucguccccgaggagaagcaguacaagccggccagcaucuuccccacccuggaggaggagaaggaguacuaccagaaguaccccaccaucuaccaccuccgccagaagcugguggacuccacggagaaggaggaccugcggcugguguaccucgcccuggcgcaccuccugaaguaccgcggccacuuccuguucgagggcgaccuggacaccgagaacaccagcaucgaggaguccuuccgggucuuccucgagcaguacagcaagcaguccgaccagccccugaucgugcaccagccggugcugaccauccucacggacaagcugagcaagaccaagaaggucgaggagauccugaaguacuaccccaccgagaagaucaacuccuucuucgcccagugccucaagcugaucguggggaaccaggccaacuucaagcgcaucuucgaccuggaggccgaggugaagcuccaguucagcaaggagaccuacgaggaggaccuggagucccugcucgagaagaucggcgacgaguaccuggacaucuuccugcaggcgaagaagguccacgacgccauccuccugagcgagaucaucuccagcacggugaagcacaccaaggccaagcuguccagcgggaugguggagcgguacgagcgccacaaggccgaccucgccaaguucaagcaguucgucaaggagaacgugccccagaaggcgaccguguucuucaaggacaccacgaagaacggcuacgccggguacaucaagggcaagaccacccaggaggaguucuacaaguucgucaagaaggagcuguccggcgugguggggagcgagcccuuccuggagaagaucgaccaggagaccuuccuccugaagcagcggacguacaccaacggcgucaucccgcaccaggugcaccugaucgagcucaaggccaucaucgaccagcagaagcagcacuaccccuuccuggaggaggccgggcccaagaucaucgcccuguucaaguuccgcauccccuacuacgugggcccgcucgcgaaggagcaggaggccagcuccuucgccuggaucgagcggaagaccgccgagaagaucaaccccuggaacuucagcgaggucguggacaucgagaaguccgccaugcgcuucauccagcgcaugaccaagcaggacacguaccugcccaccgagaagguccugcccaagaacagccugcucuaccagaaguacaugaucuucaacgagcugaccaagguguccuacaaggacgagcggggcgugaagcaguacuucagcggggacgagaagcagcagaucuucaagcagcuguuccagaaggagcgcggcaagaucaccgucaagaagcuccagaacuuccuguacacgcacuaccacaucgagaacgcgcagaucuucgggaucgagaaggccuucaacgccuccuacagcaccuaccacgacuucaugaagcuggccaagaccaaccagaaggccaugcaggaguggcucgagcagccggagauggagcccaucuucgaggacaucgugaagauccugaccaucuucgaggaccggcagaugaucaagcaccagcuguccaaguaccaggagguguucggcgagaagcuccugaaggaguucgcgcgcaagcacuacacgggguggggccgguucagcgccaagcugauccacggcauccgcgaccggaagaccaacaagaccauccucgacuaccugaucaacgacgacgacguccccgccaaccgcaaccggaaccugaugcagcucaucaacgacgagcaccuguccuucaaggaggagaucgccaaggcgaccguguucagcaagcacaagucccugguggacgucauccaggaccuccccgggagcccggccaucaagaagggcaucuggcagucccugaagaucguggaggagcugaucgccaucaucggguacaagcccaagaacaucgugaucgagauggcccgcgagaaccagaagacccaccggacgagcccccgccucaaggcccuggagaacggccugaagcagaucggguccacccuccugaaggagcagcccaccgacaacaaggcgcugcagaaggagcggcucuaccuguacuaccugcagaacggccgcgacauguacaccggcgagccgcucgagaucgagaaccugcaccaguacgaggucgaccacaucaucccccggagcuucaucguggacaacuccaucgacaacaaggugcuggucgccagcaagcagaaccagaagaagcgcgacgacgugcccaagaagcagaucgugaacgagcagcggaucuucuggaaccagcucaaggaggccaagcugaucagccccaagaaguacgccuaccugacgaagaucgagcucaccccggaggacaaggcccgcuucauccagcggcagcuggucgagacccgccagaucaccaagcacguggcgaacauccugcaccaguccuucaaccaggaggaggaggggacggacugcgacggcgugcagaucaucacccucaaggccacccugaccagccaguuccgccagacguucgggcuguacaagguccgggagaucaacccccaccaccacgcccacgacgccuaccucaacggcuucaucgccaacgugcugcugaagcgcuaccccaagcucgcgccggaguucguguacgggaaguacgucaaguacucccuggcccgggagaacaaggccaccgccaagaaggaguucuacagcaacauccugaaguuccucgaguccgacgagcccuucugcgacgagaacggcgagaucuacugggagaagucccaccaccucccccgcaucaagaaggugcugagcagccaccaggugaacgucgugaagaagguggagcagcagaagggcggguucuacaaggagaccgucaacuccaaggagaagcccgacaagcugaucgagcggaagaacaacugggacgugaccaaguacggcggguucggcagcccggugaucgcguacgccaucgccuucgucuacgccaagggcaagacgcagaagaagacccgcgccaucgaggggaucaccaucauggagcaggcggccuucgagaaggaccccaccacguuccugaaggagaagggcuucccccaggugaccgaguucaucaagcugcccaaguacacccucuucgaguucgacaacgggcggcgccgguuccuggccucccacaaggagagccagaagggcaacccguucauccuguccgaccagcucgugacccugcuguaccacgcccagcacuacgacaagaucacguaccaggagagcuucgacuacgucaacacccaccucuccgacuucagcgccauccugaccgaggugcuggcguucgccgagaaguacacccucgccgacaagaacaucgagcgcauccaggagcuguacgaggagaacaaguacggggagacguccaugaucgcccagagcuuccugcagcuccugcaguucaacgccaucggcgcgcccgccgacuucaaguucuucggcgugaccaucccccggaagcgcuacaccagccugaccgagaucugggacgccacgaucaucuaccaguccgucaccgggcucuacgagacccggauccgcaugggcgaccugugggccggggagcaguga

SEQ ID NO: 1807 - RNA, 4014 nt, Artificial Sequence
  Cas9 variant
augaagaacaugaagaagcccuacaccaucggccuggacaucgggaccaacagcgugggcugggccguccucacggaccaguacgaccuggugaagcgcaagaugaagaucgccggggacuccgagaagaagcagaucaagaagaacuucuggggcgugcggcuguucgacgaggggcagaccgcggccgaccgccggauggcccgcaccgcccggcgccggaucgagcgccggcgcaaccggaucagcuaccuccagggcaucuucgccgaggagauguccaagaccgacgcgaacuucuucugccgccugagcgacuccuucuacgucgacaacgagaagcggaacagccgccacccguucuucgccacgaucgaggaggagguggaguaccacaagaacuaccccaccaucuaccaccuccgggaggagcuggugaacuccagcgagaaggccgaccugcgccuggucuaccucgcccuggcgcacaucaucaaguaccggggcaacuuccugaucgagggggcccucgacacccagaacaccuccguggacggcaucuacaagcaguucauccagacguacaaccagguguucgccagcgggaucgaggacggcucccugaagaagcuggaggacaacaaggacgucgccaagauccucguggagaaggugacccgcaaggagaagcuggagcggauccugaagcucuaccccggggagaaguccgccggcauguucgcgcaguucaucagccugaucgucggcagcaaggggaacuuccagaagcccuucgaccugaucgagaaguccgacaucgagugcgccaaggacagcuacgaggaggaccucgagucccugcuggcccucaucggcgacgaguacgccgagcuguucguggccgcgaagaacgccuacagcgccgugguccuguccagcaucaucaccguggccgagaccgagacgaacgccaagcucagcgcguccaugaucgagcgcuucgacacccacgaggaggaccugggggagcugaaggccuucaucaagcuccaccucccgaagcacuacgaggagaucuucagcaacaccgagaagcacggcuacgccggcuacaucgacgggaagaccaagcaggccgacuucuacaaguacaugaagaugacgcuggagaacaucgagggcgccgacuacuucaucgcgaagaucgagaaggagaacuuccugcggaagcagcgcaccuucgacaacggggccaucccccaccagcugcaccuggaggagcucgaggccauccugcaccagcaggccaaguacuaccccuuccugaaggagaacuacgacaagaucaagucccucgugaccuuccgcauccccuacuucgucggcccgcuggcgaacgggcagagcgaguucgccuggcugacccggaaggccgacggcgagauccgccccuggaacaucgaggagaagguggacuucggcaaguccgccguggacuucaucgagaagaugacgaacaaggacaccuaccuccccaaggagaacguccugcccaagcacagccugugcuaccagaaguaccucguguacaacgagcugaccaaggugcgguacaucaacgaccaggggaagaccuccuacuucagcggccaggagaaggagcagaucuucaacgaccuguucaagcagaagcgcaaggucaagaagaaggaccucgagcuguuccugcggaacaugucccacguggagagcccgacgaucgaggggcuggaggacuccuucaacagcuccuacagcaccuaccacgaccuccugaaggucggcaucaagcaggagauccuggacaaccccgugaacaccgagaugcucgagaacaucgugaagauccugaccgucuucgaggacaagcgcaugaucaaggagcagcugcagcaguucuccgacgugcucgacggggugguccugaagaagcuggagcggcgccacuacacgggcuggggccggcucagcgccaagcugcugauggggauccgcgacaagcagucccaccucaccauccuggacuaccugaugaacgacgacggccucaaccggaaccugaugcagcugaucaacgacagcaaccucuccuucaagagcaucaucgagaaggagcaggucaccaccgcggacaaggacauccagagcaucguggccgaccuggccgggucccccgccaucaagaagggcauccugcagagccucaagaucguggacgagcugguguccgugaugggguacccgccccagacgaucgucguggagauggcccgcgagaaccagaccaccggcaagggcaagaacaacagccggccccgcuacaagucccuggagaaggcgaucaaggaguucgggagccagauccucaaggagcaccccaccgacaaccaggagcugcggaacaaccgccuguaccucuacuaccugcagaacggcaaggacauguacacggggcaggaccuggacauccacaaccucuccaacuacgacaucgaccacaucgugccccagagcuucaucaccgacaacuccaucgacaaccugguccugaccagcuccgccggcaaccgggagaagggcgacgacgugccgccccucgagaucgugcgcaagcggaaggucuucugggagaagcuguaccaggggaaccugaugagcaagcgcaaguucgacuaccucaccaaggccgagcgcggcgggcugaccgaggccgacaaggcccgguucauccaccgccagcugguggagacgcggcagaucaccaagaacguggcgaacauccuccaccagcgcuucaacuacgagaaggacgaccacggcaacaccaugaagcagguccggaucgugacccugaaguccgcccuggugagccaguuccgcaagcaguuccagcucuacaagguccgggacgugaacgacuaccaccacgcccacgacgccuaccugaacgggguggucgcgaacacgcugcucaagguguacccccagcuggagcccgaguucguguacggcgacuaccaccaguucgacugguucaaggccaacaaggccaccgccaagaagcaguucuacaccaacaucaugcuguucuucgcccagaaggaccgcaucaucgacgagaacggcgagauccucugggacaagaaguaccuggacaccgucaagaaggugauguccuaccggcagaugaacaucgugaagaagacggagauccagaagggggaguucagcaaggcgaccaucaagccgaagggcaacuccagcaagcugaucagccgcaagaccaacugggaccccaugaaguacgggggccucgacucccccaacauggccuacgccgucgugaucgaguacgccaaggggaagaacaagcugguguucgagaagaagaucauccgggucaccaucauggagcgcaaggccuucgagaaggacgagaaggcguuccuggaggagcagggcuaccggcagcccaaggugcucgccaagcugccgaaguacacgcuguacgagugcgaggagggccgccggcgcaugcucgccagcgccaacgaggcccagaaggggaaccagcagguccugcccaaccaccuggugacccuccugcaccacguggcgaacugcgagguguccgacggcaagagccuggacuacaucgaguccaaccgggagauguucgccgagcuccuggcccacgucagcgaguucgccaagcgcuacacccuggcggaggccaaccucaacaagaucaaccagcuguucgagcagaacaaggagggggacaucaaggccaucgcccaguccuucguggaccugauggccuucaacgcgaugggcgcccccgccagcuucaaguucuucgagaccacgaucgagcggaagcgcuacaacaaccucaaggagcugcugaacuccaccaucaucuaccagagcaucaccgggcucuacgagucccggaagcgccuggacgacuga

SEQ ID NO: 1808 - RNA, 4014 nt, Artificial Sequence
  Cas9 variant
augaagaaguucgagaacuacuaccugggccucgacaucgggaccagcuccaucggcugggccgugaccaacagccaguacgacauccugaaguucaacgggaaguacauguggggcacgcgccuguuccccgaggccaacaccgcgcaggagcggcgcauccaccgguccagccgccggcgccucaagcggcgcaaggagcggauccagauccugcagaugcuguucgacaaggagaucgccaagaucgacuccggguucuuccagcgccucaaggacagcaaguacuacaaggaggacaagaccgagaagcagaccaacuccaucuuccacgacaaggacuacagcgacaaggaguaccaccaggacuucccgacgaucuaccaccuccggaaguuccugcuggagggcaacaagcccaaggacauccgcuucgucuaccuggcccugcaccacauccucacccaccggggccacuuccuguuccccgacauggagguguccaacgugaccgaguucagcaacaucuucuccgagcugaagcaguaccucuacgacgagauggaccuggacuucgaguggaagaacgggaagcugaacgaggucgagaacauccucaaggaccgcaaccuggccaagagcgagaaggagaagaagcugugcggcaucaucgagcucgaggggaagaucgacaaccagcggaaggccaugaucggcaugaugugcgggugcaagaagaaguucuccgaccuguuccagaacgagaacuaccgcgagcuggagaucagcuccuucagcuucgcggacuccagcuacgaggagaagcgggacgagcucgagggcauccuggccgagaacauccugugccucgacuaccugaagaccaucuacgacuggggcaagcuguccgacauccuccagggggaggagagcaucagcguggccaaggugaaguccuacgaggagcaccagcuggaccugaaguaccucaagaacauccugaagcuguacagccacaaggagaaggagaacgucuuccgcaagaaggagggcaaguaccccaaguacaucuccgggaagcucagccaggaggaguucaacaaguccaucaagaagauccuggaggagaucaagagcgugaagcaggaggaccggaagguguucgacacgcugcucaagcgcgccuccaacaaccugcugugcccgaagcaggucaucaaggagaacggcgugauccccuaccagauccacaaguucgagcucgagaagauccugcggaacauggcggacuucuuccccaugcugaaggagaagaaggacggcaagacccucagcgagaagaucaucuccguguucaccuuccgcauccccuacuacgucgggccgcugaaccagaacagcgaccgcgccuggcuggugaagaacaaggacgagaagaucuaccccuggaacuucgaggagaucgugaaccucgaggaguccgccgagaaguucauccagaaccugaccaacaagugcacguaccugguccuggaggacgugcuccccaagagcuccauccuguacagcaaguucauggugcugaacgagcucaacaaccugaagaucgacggcgaggccaucuccgucgaccugaagcagaagaucuaccucaaccuguuccagaaguacaagaaggugacccugaagaagcucaagggguaccucaagagcgagaacauccugaucgacaccuccacccagaucacgggcaucgacggggacuucaagagcucccugggcagcuaccuggacuucuacaacauccugggcgacaaggugaagaccgacuucgggaagaagcucaucgagaacugcauccuguggaucacccuguacaccggcgagaagaagcuccugaagaacaagaucaucgccaacuacaagggggagcugagcgaggaggagaucaagaagaucgucaaccucaaguacaaggacuggggccggcuguccuacgcguuccuggaggagauccagagcgccucccucgagacgggggagcugcgcaacaucauccagaugaugugggagaccaacaacaaccugauggagcuccugagcuccaacuaccaguuccugagcgagaucgagaagcggaacuccgugguggccaucggcaaggaguucaacuacgagaccauccucggcgacagcuacgccucccccagcgucaagcgcaugaucuggcagucccugagcguggucgacgagaucaagaagaucaugaagaaggccccgaagaagaucuucaucgagauggcgcggcaggaggacaugaagaaggagcgcaaggagucccgcaagagcaccuuccugacgcucuacaaguccaucaaggaggaggggcgggacuggaucaaggagaucgagaacuggagcgacuccgaguuccggagcaagaagcuguaccuguacuacacccagaugggcaagugcauguacaccggggagaagaucagccucgaccagcuguucaacaagaacaucuacgacaucgaccacaucuacccccgcuccaagaccaaggacgacagcaucgagaacaucgugcuggugaagcggaacaucaacgccaagaagacggacgaguacccccucgagcgcaacauccagcagaagcagcacgacuucuggaagaugcugcacuccaagaagcugaucggcgacaagaaguacgagcggcucacccgcaccaccgaguucacggacgaggagcugagcgacuucaucgcccggcagcuggucgagacccgccaguccaccaagaucguggccgacauccucaagaaccuguuccccgagaccaagaucguguacgucaaggccaaccugacgagcgacuuccggaagaacuucaagauccucaagucccgcgacaucaacgacuaccaccacgcgcacgacgccuaccugaacaucgugaccgggaacguguacaacaucaaguucaccgacaacccgcggaacuucaucaaggacaagaagcuggagggcaagaaguacaaccucaaggucgagaagaucuucgaguaccgcaaggagaacgagagcuucuggaaccccaagaccauggugaccaagaucgagaacuacaucuucaagaagcgcccccaguucacgcgguacuccuucgagcagcacggcggguucuucgaccagaacaucguggacaaggagagcugcaagaagggcaccggguacauccccaucaaguccagcaacgccauccuguacaacaccuccaaguacggcggcuacgggagcgucaccggcacguacuucuuccugguggagcacaccaugaaggggaagcgcauccggaccaucgagaugaugccgcucuaccuguccaagaagauccacagcaaggaggagcuggagaaguacugcaaggagaagcucgagcugcagaagcccuccgugcgccuggcccggaucaaguacaacagccuccugaagaucaacggcuuccccuaccacaucaccgggaagacgaacgacuccuacuggaucaugagcgccauccagcugcuccugagcaagaacuacuacgaguaccugcgcaagcucuacaucuucugcaaggaggagcggcuggaggaggagaucgucggcgagaagaacaucaagcuguacacgugcauccucgagaagcuggagaaguccaucuacagccacaagcugcucaacaucaacuacaacggcaaguccaagaaccugaaggacauccuggagagcgagaaggagaacuuccuccugcuguccgagaagaagcaggcgcagauccucaucgagaucuucacccugcuggagagcaacaacuucggggccaaccucgaguccuucggcugcgggaagaagugcggcaucaccaagaucaacaagaacaucgacaagcuggaggaggugcugcucaucaaccagagccccaccgggcuguucgagaacuccaucgaccugaagaagguguga

SEQ ID NO: 1809 - RNA, 4014 nt, Artificial Sequence
  Cas9 variant
augaagaaggacuacgugaucggccuggacaucgggaccaacagcgucggcugggccgugaugaccgaggacuaccagcucgugaagaagaagaugcccaucuacgggaacacggagaagaagaagaucaagaagaacuucuggggcguccgccuguucgaggaggggcacaccgccgaggaccggcgccugaagcggaccgcgcgccggcgcaucucccggcgccggaaccgccuccgguaccugcaggccuucuucgaggaggccaugaccgaccuggacgagaacuucuucgcccgccuccaggagagcuuccuggugccggaggacaagaaguggcaccggcaccccaucuucgccaagcuggaggacgagguggcguaccacgagacguaccccaccaucuaccaccuccgcaagaagcuggccgacuccagcgagcaggccgaccugcggcucaucuaccuggcccuggcgcacaucgucaaguaccgcggccacuuccucaucgagggcaagcuguccaccgagaacaucagcgugaaggagcaguuccagcaguucaugaucaucuacaaccagaccuucgugaacggggagucccggcuggucagcgcgccccucccggaguccgugcugaucgaggaggagcugacggagaaggccagccgcaccaagaaguccgagaaggugcuccagcaguucccccaggagaaggccaacggccuguucgggcaguuccugaagcucauggucggcaacaaggccgacuucaagaagguguucgggcuggaggaggaggccaagaucaccuacgccagcgaguccuacgaggaggaccuggagggcauccucgccaaggugggcgacgaguacagcgacgucuuccuggccgccaagaacguguacgacgcgguggagcuguccaccauccucgccgacagcgacaagaagucccacgccaagcugagcuccagcaugaucguccgguucacggagcaccaggaggaccugaagaaguucaagcgcuucauccgggagaacugccccgacgaguacgacaaccucuucaagaacgagcagaaggacggguacgccggcuacaucgcccacgcggggaaggugagccagcugaaguucuaccaguacgugaagaagaucauccaggacaucgccggcgccgaguacuuccuggagaagaucgcccaggagaacuuccuccgcaagcagcgcaccuucgacaacggcgucaucccccaccagauccaccuggccgagcugcaggcgaucauccaccggcaggccgccuacuacccguuccucaaggagaaccaggagaagaucgagcagcuggugaccuuccgcauccccuacuacguggggccccuguccaagggcgacgccagcaccuucgcguggcucaagcggcaguccgaggagcccauccgcccguggaaccugcaggagacggucgaccuggaccagagcgccaccgccuucaucgagcggaugaccaacuucgacaccuaccuccccuccgagaaggugcugcccaagcacagccugcucuacgagaaguucauggucuucaacgagcugacgaagaucuccuacaccgacgaccgcgggaucaaggccaacuucagcggcaaggagaaggagaagaucuucgacuaccuguucaagacccggcgcaaggugaagaagaaggacaucauccaguucuaccggaacgaguacaacaccgagaucgugacgcuguccgggcucgaggaggaccaguucaacgccagcuucuccaccuaccaggaccugcugaagugcggccucacccgcgcggagcuggaccaccccgacaacgccgagaagcuggaggacaucaucaagauccucaccaucuucgaggaccggcagcgcauccggacgcagcugagcaccuucaagggccaguucuccgccgagguccugaagaagcucgagcgcaagcacuacaccggguggggccggcugagcaagaagcugaucaacgggaucuacgacaaggaguccggcaagaccauccucggguaccugaucaaggacgacggcgugagcaagcacuacaaccgcaacuucaugcagcugaucaacgacucccagcucagcuucaagaacgccauccagaaggcccaguccagcgagcacgaggagacgcugagcgagaccgugaacgagcuggcgggcuccccggccaucaagaaggggaucuaccagagccucaagaucgucgacgagcugguggccaucaugggcuacgcccccaagcggaucguggucgagauggcccgcgagaaccagaccaccuccacggggaagcggcgcagcauccagcgccugaagaucguggagaaggcgauggccgagaucggcuccaaccuccugaaggagcagcccaccaccaacgagcagcugcgggacacccgccucuuccuguacuacaugcagaacgggaaggacauguacaccggcgacgagcugagccuccaccggcugucccacuacgacaucgaccacaucaucccccagagcuucaugaaggacgacucccuggacaaccucgugcuggucggcagcacggagaaccgcgggaaguccgacgacgugccgagcaaggagguggucaaggacaugaaggccuacugggagaagcuguacgccgcgggccucaucucccagcggaaguuccagcgccugaccaagggggagcagggcggccugacccucgaggacaaggcccacuucauccagcggcagcugguggagacccgccagaucacgaagaacguggccgggauccuggaccagcgguacaacgccaacagcaaggagaagaagguccagaucaucacccucaaggccucccugaccagccaguuccgcuccaucuucggccuguacaaggugcgggaggugaacgacuaccaccacgggcaggacgcguaccucaacugcgucguggccaccacgcugcugaagguguaccccaaccucgcccccgaguucgucuacggcgaguaccccaaguuccagaccuucaaggagaacaaggccaccgccaaggcgaucaucuacaccaaccugcugcgcuucuucacggaggacgagccgcgguucaccaaggacggggagauccucuggagcaacagcuaccugaagaccaucaagaaggagcugaacuaccaccagaugaacaucgugaagaagguggagguccagaagggcggcuucuccaaggagagcaucaagcccaaggggcccuccaacaagcucauccccgugaagaacggccuggacccgcagaaguacgggggcuucgacagccccaucguggccuacaccguccuguucacgcacgagaaggggaagaagccccucaucaagcaggagauccugggcaucaccaucauggagaagacccgcuucgagcagaacccgauccuguuccucgaggagaagggcuuccugcggccccgcgugcugaugaagcuccccaaguacacccuguacgaguuccccgaggggcggcgccggcugcucgccuccgccaaggaggcccagaagggcaaccagauggugcugccggagcaccuccugacgcugcuguaccacgcgaagcagugccuccugcccaaccagagcgagucccugaccuacgucgagcagcaccagcccgaguuccaggagauccucgagcgcgugguggacuucgccgagguccacacccuggccaagagcaaggugcagcagaucgugaagcuguucgaggccaaccagaccgcggacgucaaggagaucgccgccuccuucauccagcucaugcaguucaacgccaugggggcccccagcacguucaaguucuuccagaaggacaucgagcgggcgcgcuacaccuccaucaaggagaucuucgacgccaccaucaucuaccagagcaccacgggccuguacgagacccgccggaaggugguggacuga

SEQ ID NO: 1810 - RNA, 4014 nt, Artificial Sequence
  Cas9 variant
augaagaaggacuacgugaucggccuggacaucgggaccaacagcgucggcugggccgugaugaccgaggacuaccagcucgugaagaagaagaugcccaucuacgggaacacggagaagaagaagaucaagaagaacuucuggggcguccgccuguucgaggaggggcacaccgccgaggaccggcgccugaagcggaccgcgcgccggcgcaucucccggcgccggaaccgccuccgguaccugcaggccuucuucgaggaggccaugaccgaccuggacgagaacuucuucgcccgccuccaggagagcuuccuggugccggaggacaagaaguggcaccggcaccccaucuucgccaagcuggaggacgagguggcguaccacgagacguaccccaccaucuaccaccuccgcaagaagcuggccgacuccagcgagcaggccgaccugcggcucaucuaccuggcccuggcgcacaucgucaaguaccgcggccacuuccucaucgagggcaagcuguccaccgagaacaccagcgugaaggaccaguuccagcaguucauggugaucuacaaccagacguucgucaacggggagucccggcuggugagcgcgccccucccggaguccgugcugaucgaggaggagcugaccgagaaggccagccgcaccaagaaguccgagaagguccuccagcaguucccccaggagaaggccaacggccuguucgggcaguuccugaagcucauggugggcaacaaggccgacuucaagaagguguucgggcuggaggaggaggccaagaucaccuacgccagcgaguccuacgaggaggaccuggagggcauccucgccaaggucggcgacgaguacagcgacguguuccuggccgccaagaacguguacgacgcggucgagcuguccacgauccucgccgacagcgacaagaagucccacgccaagcugagcuccagcaugaucgugcgguucaccgagcaccaggaggaccugaagaaguucaagcgcuucauccgggagaacugccccgacgaguacgacaaccucuucaagaacgagcagaaggacggguacgccggcuacaucgcccacgcggggaaggugagccagcugaaguucuaccaguacgucaagaagaucauccaggacaucgccggcgccgaguacuuccuggagaagaucgcccaggagaacuuccuccgcaagcagcgcaccuucgacaacggcgugaucccccaccagauccaccuggccgagcugcaggcgaucauccaccggcaggccgccuacuacccguuccucaaggagaaccaggagaagaucgagcagcuggugaccuuccgcauccccuacuacgucgggccccuguccaagggcgacgccagcacguucgcguggcucaagcggcaguccgaggagcccauccgcccguggaaccugcaggagaccguggaccuggaccagagcgccaccgccuucaucgagcggaugaccaacuucgacacguaccuccccuccgagaagguccugcccaagcacagccugcucuacgagaaguucaugguguucaacgagcugaccaagaucuccuacaccgacgaccgcgggaucaaggccaacuucagcggcaaggagaaggagaagaucuucgacuaccuguucaagacccggcgcaaggugaagaagaaggacaucauccaguucuaccggaacgaguacaacacggagaucgucacccuguccgggcucgaggaggaccaguucaacgccagcuucuccaccuaccaggaccugcugaagugcggccucacccgcgcggagcuggaccaccccgacaacgccgagaagcuggaggacaucaucaagauccucacgaucuucgaggaccggcagcgcauccggacccagcugagcaccuucaagggccaguucuccgccgaggugcugaagaagcucgagcgcaagcacuacaccggguggggccggcugagcaagaagcugaucaacgggaucuacgacaaggaguccggcaagacgauccucgacuaccugaucaaggacgacggggugagcaagcacuacaaccgcaacuucaugcagcugaucaacgacucccagcucagcuucaagaacgccauccagaaggcccaguccugcgagcacgaggagacccugagcgagaccgucaacgagcuggcgggcagcccggccaucaagaagggcaucuaccagucccucaagaucguggacgagcugguggccaucaugggguacgcccccaagcggaucgucguggagauggcccgcgagaaccagaccacgagcaccggcaagcggcgcuccauccagcgccugaagaucguggagaaggcgauggccgagaucgggagcaaccuccugaaggagcagcccaccaccaacgagcagcugcgggacacccgccucuuccuguacuacaugcagaacggcaaggacauguacacgggggacgagcugucccuccaccggcugagccacuacgacaucgaccacaucaucccccaguccuucaugaaggacgacagccuggacaaccucguccuggugggcuccaccgagaaccgcggcaagagcgacgacgugccguccaagaaggucgugaaggacaugaaggccuacugggagaagcuguacgccgcggggcucaucagccagcggaaguuccagcgccugaccaagggcgagcagggcgggcugacccucgaggacaaggcccacuucauccagcggcagcugguggagacgcgccagaucaccaagaacgucgccggcauccuggaccagcgguacaacgccaaguccaaggagaagaaggugcagaucaucacccucaaggccagccugaccucccaguuccgcagcaucuucgggcuguacaaggugcgggaggucaacgacuaccaccacggccaggacgcguaccucaacugcgugguggccacgacccugcugaaggucuaccccaaccucgcccccgaguucguguacggggaguaccccaaguuccaggccuucaaggagaacaaggccaccgcgaagaccaucaucuacacgaaccugaugcgcuucuucaccgaggacgagccgcgguucaccaaggacuccgagauccuguggagcaacagcuaccucaagaccaucaagaaggagcugaacuaccaccagaugaacaucgugaagaaggucgaggugcagaagggcggguucuccaaggagagcaucaagcccaagggccccuccaacaagcugauccccgugaagaacggccucgacccgcagaaguacgggggcuucgacagccccgucguggccuacacggugcuguucacccacgagaaggggaagaagccccugaucaagcaggagauccucggcaucaccaucauggagaagacccgcuucgagcagaacccgauccuguuccuggaggagaagggguuccuccggccccgcguccugaugaagcugcccaaguacacgcucuacgaguuccccgagggccggcgccggcugcuggccuccgccaaggaggcccagaagggcaaccagauggugcucccggagcaccuccugacccugcuguaccacgcgaagcagugccugcuccccaaccagagcgagucccuggccuacguggagcagcaccagcccgaguuccaggagauccuggagcgcgucguggacuucgccgaggugcacacccucgccaagagcaagguccagcagaucgugaagcuguucgaggcgaaccagaccgccgacgugaaggagaucgccgccuccuucauccagcugaugcaguucaacgccaugggggcgcccagcacguucaaguucuuccagaaggacaucgagcgggcccgcuacaccuccaucaaggagaucuucgacgccaccaucaucuaccagagcaccacgggccucuacgagacccgccggaaggucguggacuga

SEQ ID NO: 1811 - RNA, 4014 nt, Artificial Sequence
  Cas9 variant
augaagaaggacuacgugaucggccuggacaucgggaccaacagcgucggcugggccgugaugaccgaggacuaccagcucgugaagaagaagaugcccaucuacgggaacacggagaagaagaagaucaagaagaacuucuggggcguccgccuguucgaggaggggcacaccgccgaggaccggcgccugaagcggaccgcgcgccggcgcaucucccggcgccggaaccgccuccgguaccugcaggccuucuucgaggaggccaugaccgcccuggacgagaacuucuucgcccgccuccaggagagcuuccuggugccggaggacaagaaguggcaccggcaccccaucuucgcgaagcuggaggacgagguggccuaccacgagacguaccccaccaucuaccaccuccgcaagaagcuggccgacuccagcgagcaggccgaccugcggcucaucuaccuggcgcuggcccacaucgucaaguaccgcggccacuuccucaucgagggcaagcuguccaccgagaacaucagcgugaaggagcaguuccagcaguucaugaucaucuacaaccagaccuucgugaacggggagucccggcuggucagcgcgccccucccggaguccgugcugaucgaggaggagcugacggagaaggccagccgcaccaagaaguccgagaaggugcuccagcaguucccccaggagaaggccaacggccuguucgggcaguuccugaagcucauggucggcaacaaggccgacuucaagaagguguucgggcuggaggaggaggccaagaucaccuacgccagcgaguccuacgaggaggaccuggagggcauccucgccaaggugggcgacgaguacagcgacgucuuccuggccgcgaagaacguguacgacgccguggagcuguccaccauccucgccgacagcgacaagaagucccacgccaagcugagcuccagcaugaucguccgguucacggagcaccaggaggaccugaagaacuucaagcgcuucauccgggagaacugccccgacgaguacgacaaccucuucaagaacgagcagaaggacggguacgccggcuacaucacccacgcggggaaggugagccagcugaaguucuaccaguacgugaagaagaucauccaggacaucgccggcgccgaguacuuccuggagaagaucgcccaggagaacuuccuccgcaagcagcgcaccuucgacaacggcgucaucccccaccagauccaccuggccgagcugcaggcgaucauccaccggcaggccgccuacuacccguuccucaaggagaaccaggagaagaucgagcagcuggugaccuuccgcauccccuacuacguggggccccuguccaagggcgacgccaacacguucgcguggcucaagcggcagagcgaggagcccauccgcccguggaaccugcaggagaccgucgaccuggaccaguccgccaccgccuucaucgagcggaugaccaacuucgacacguaccuccccagcgagaaggugcugcccaagcacucccugcucuacgagaaguucauggucuucaacgagcugaccaagaucagcuacaccgacgaccgcgggaucaaggccaacuucuccggcaaggagaaggagaagaucuucgacuaccuguucaagacccggcgcaaggugaagaagaaggacaucauccaguucuaccggaacgaguacaacacggagaucgugacccugagcgggcucgaggaggaccaguucaacgccuccuucagcaccuaccaggaccugcugaagugcggccucacccgcgcggagcuggaccaccccgacaacgccgagaagcuggaggacaucaucaagauccucacgaucuucgaggaccggcagcgcauccggacccagcuguccaccuucaagggccaguucagcgccgagguccugaagaagcucgagcgcaagcacuacaccggguggggccggcuguccaagaagcugaucaacgggaucuacgacaaggagagcggcaagacgauccucgacuaccugaucaaggacgacgggguguccaagcacuacaaccgcaacuucaugcagcugaucaacgacagccagcucuccuucaagaacgccauccagaaggcccagagcuccgagcacgaggagacccugagcgagaccgugaacgagcuggcgggcagcccggccaucaagaagggcaucuaccagucccucaagaucgucgacgagcugguggccaucaugggguacgcccccaagcggaucguggucgagauggcccgcgagaaccagaccacgagcaccggcaagcggcgcuccauccagcgccugaagaucguggagaaggcgauggccgagaucgggagcaaccuccugaaggagcagcccaccaccaacgagcagcugcgggacacccgccucuuccuguacuacaugcagaacggcaaggacauguacacgggggacgagcugucccuccaccggcugagccacuacgacaucgaccacaucaucccccaguccuucaugaaggacgacagccuggacaaccucgugcuggucggcuccaccgagaaccgcggcaagagcgacgacgugccguccaaggagguggucaaggacaugaaggccuacugggagaagcuguacgccgcggggcucaucagccagcggaaguuccagcgccugaccaagggcgagcagggcgggcugacccucgaggacaaggcccacuucauccagcggcagcugguggagacgcgccagaucaccaagaacguggccggcauccuggaccagcgguacaacgccaaguccaaggagaagaagguccagaucaucacccucaaggccagccugaccucccaguuccgcagcaucuucgggcuguacaaggugcgggaggugaacgacuaccaccacggccaggacgcguaccucaacugcgucguggccacgacccugcugaagguguaccccaaccucgcccccgaguucgucuacggggaguaccccaaguuccagaccuucaaggagaacaaggccaccgccaaggcgaucaucuacacgaaccugcugcgcuucuucaccgaggacgagccgcgguucaccaaggacggcgagauccucugguccaacagcuaccugaagaccaucaagaaggagcugaacuaccaccagaugaacaucgugaagaagguggagguccagaagggcggguucagcaaggaguccaucaagcccaagggccccagcaacaagcucauccccgugaagaacgggcuggacccgcagaaguacggcggguucgacucccccaucguggccuacacgguccuguucacccacgagaagggcaagaagccccucaucaagcaggagauccuggggaucaccaucauggagaagacccgcuucgagcagaacccgauccuguuccucgaggagaagggcuuccugcggccccgcgugcugaugaagcuccccaaguacacgcuguaccaguuccccgagggccggcgccggcugcucgccagcgccaaggaggcccagaaggggaaccagauggugcugccggagcaccuccugacccugcuguaccacgcgaagcagugccuccugcccaaccaguccgagagccuggccuacgucgagcagcaccagcccgaguuccaggagauccucgagcgcgugguggacuucgccgagguccacacccuggccaaguccaaggugcagcagaucgugaagcuguucgaggcgaaccagaccgccgacgucaaggagaucgccgccagcuucauccagcucaugcaguucaacgccaugggcgcgcccuccacguucaaguucuuccagaaggacaucgagcgggcccgcuacaccagcaucaaggagaucuucgacgccaccaucaucuaccaguccaccacggggcuguacgagacccgccggaaggugguggacuga

SEQ ID NO: 1812 - RNA, 4014 nt, Artificial Sequence
  Cas9 variant
augaagaaggacuacgugaucggccuggacaucgggaccaacagcgucggcugggccgugaugaccgaggacuaccagcucgugaagaagaagaugcccaucuacgggaacacggagaagaagaagaucaagaagaacuucuggggcguccgccuguucgaggaggggcacaccgccgaggaccggcgccugaagcggaccgcgcgccggcgcaucucccggcgccggaaccgccuccgguaccugcaggccuucuucgaggaggccaugaccgaccuggacgagaacuucuucgcccgccuccaggagagcuuccuggugccggaggacaagaaguggcaccggcaccccaucuucgccaagcuggaggacgagguggcguaccacgagacguaccccaccaucuaccaccuccgcaagaagcuggccgacuccagcgagcaggccgaccugcggcucaucuaccuggcccuggcgcacaucgucaaguaccgcggccacuuccucaucgagggcaagcuguccaccgagaacaucagcgugaaggagcaguuccagcaguucaugaucaucuacaaccagaccuucgugaacggggagucccggcuggucagcgcgccccucccggaguccgugcugaucgaggaggagcugacggagaaggccagccgcaccaagaaguccgagaaggugcuccagcaguucccccaggagaaggccaacggccuguucgggcaguuccugaagcucauggucggcaacaaggccgacuucaagaagguguucgggcuggaggaggaggccaagaucaccuacgccagcgaguccuacgaggaggaccuggagggcauccucgccaaggugggcgacgaguacagcgacgucuuccuggccgccaagaacguguacgacgcgguggagcuguccaccauccucgccgacagcgacaagaagucccacgccaagcugagcuccagcaugaucguccgguucacggagcaccaggaggaccugaagaaguucaagcgcuucauccgggagaacugccccgacgaguacgacaaccucuucaagaacgagcagaaggacggguacgccggcuacaucgcccacgcggggaaggugagccagcugaaguucuaccaguacgugaagaagaucauccaggacaucgccggcgccgaguacuuccuggagaagaucgcccaggagaacuuccuccgcaagcagcgcaccuucgacaacggcgucaucccccaccagauccaccuggccgagcugcaggcgaucauccaccggcaggccgccuacuacccguuccucaaggagaaccaggagaagaucgagcagcuggugaccuuccgcauccccuacuacguggggccccuguccaagggcgacgccagcaccuucgcguggcucaagcggcaguccgaggagcccauccgcccguggaaccugcaggagacggucgaccuggaccagagcgccaccgccuucaucgagcggaugaccaacuucgacaccuaccuccccuccgagaaggugcugcccaagcacagccugcucuacgagaaguucauggucuucaacgagcugacgaagaucuccuacaccgacgaccgcgggaucaaggccaacuucagcggcaaggagaaggagaagaucuucgacuaccuguucaagacccggcgcaaggugaagaagaaggacaucauccaguucuaccggaacgaguacaacaccgagaucgugacgcuguccgggcucgaggaggaccaguucaacgccagcuucuccaccuaccaggaccugcugaagugcggccucacccgcgcggagcuggaccaccccgacaacgccgagaagcuggaggacaucaucaagauccucaccaucuucgaggaccggcagcgcauccggacgcagcugagcaccuucaagggccaguucuccgccgagguccugaagaagcucgagcgcaagcacuacaccggguggggccggcugagcaagaagcugaucaacgggaucuacgacaaggaguccggcaagaccauccucggguaccugaucaaggacgacggcgugagcaagcacuacaaccgcaacuucaugcagcugaucaacgacucccagcucagcuucaagaacgccauccagaaggcccaguccagcgagcacgaggagacgcugagcgagaccgugaacgagcuggcgggcuccccggccaucaagaaggggaucuaccagagccucaagaucgucgacgagcugguggccaucaugggcuacgcccccaagcggaucguggucgagauggcccgcgagaaccagaccaccuccacggggaagcggcgcagcauccagcgccugaagaucguggagaaggcgauggccgagaucggcuccaaccuccugaaggagcagcccaccaccaacgagcagcugcgggacacccgccucuuccuguacuacaugcagaacgggaaggacauguacaccggcgacgagcugagccuccaccggcugucccacuacgacaucgaccacaucaucccccagagcuucaugaaggacgacucccuggacaaccucgugcuggucggcagcacggagaaccgcgggaaguccgacgacgugccgagcaaggagguggucaaggacaugaaggccuacugggagaagcuguacgccgcgggccucaucucccagcggaaguuccagcgccugaccaagggggagcagggcggccugacccucgaggacaaggcccacuucauccagcggcagcugguggagacccgccagaucacgaagaacguggccgggauccuggaccagcgguacaacgccaacagcaaggagaagaagguccagaucaucacccucaaggccucccugaccagccaguuccgcuccaucuucggccuguacaaggugcgggaggugaacgacuaccaccacgggcaggacgcguaccucaacugcgucguggccaccacgcugcugaagguguaccccaaccucgcccccgaguucgucuacggcgaguaccccaaguuccagaccuucaaggagaacaaggccaccgccaaggcgaucaucuacaccaaccugcugcgcuucuucacggaggacgagccgcgguucaccaaggacggggagauccucuggagcaacagcuaccugaagaccaucaagaaggagcugaacuaccaccagaugaacaucgugaagaagguggagguccagaagggcggcuucuccaaggagagcaucaagcccaaggggcccuccaacaagcucauccccgugaagaacggccuggacccgcagaaguacgggggcuucgacagccccaucguggccuacaccguccuguucacgcacgagaaggggaagaagccccucaucaagcaggagauccugggcaucaccaucauggagaagacccgcuucgagcagaacccgauccuguuccucgaggagaagggcuuccugcggccccgcgugcugaugaagcuccccaaguacacccuguacgaguuccccgaggggcggcgccggcugcucgccuccgccaaggaggcccagaagggcaaccagauggugcugccggagcaccuccugacgcugcuguaccacgcgaagcagugccuccugcccaaccagagcgagucccuggccuacgucgagcagcaccagcccgaguuccaggagauccucgagcgcgugguggacuucgccgagguccacacccuggccaagagcaaggugcagcagaucgugaagcuguucgaggcgaaccagaccgccgacgucaaggagaucgccgccuccuucauccagcucaugcaguucaacgccaugggggcgcccagcaccuucaaguucuuccagaaggacaucgagcgggcccgcuacacguccaucaaggagaucuucgacgccaccaucaucuaccagagcaccaccggccuguacgagacgcgccggaaggugguggacuga

SEQ ID NO: 1813 - RNA, 4017 nt, Artificial Sequence
  Cas9 variant
augcaggacuacuaccugggccucgacaucgggaccaacagcgugggcugggccgucaccgacgagaacuacaaccugcugcgcaagaaggggaaggaccucuggggcgugcggcuguucaaggaggcccagcccgcgacggagcgccgggggcaccgcuccagccggcgccggaccauccgcaagucccugcggaagcagcuccugcgcgagcuguucgaggaggagaucaacgccaucgacaaggacuucuuccuccggcuggacgagagcaaguacuggcuggaggacaagaagaucgagggcaaguacucccucuucaacgacgagaacuucaccgacaaggacuacuacgagaaguucccgaccaucuuccaccuccgcaaggcccugaucgagagcgacgacaaggaggacauccggcucuacuuccuggccaucaaccagaugaugaagcgccggggccacuuccugaucgacgggaagcucuccaacguggaggacaucacgcccuucaaggagugcauccagaaccugaucaacgaggagcuggacaccgagaucgagaccgaguucuacgacaaggccaucaagaucgucagcgacuacucccucaagaagaccgagaagaagaaccugaucaaggaccuggugaaggagacggacagcaucgaggacuccaagaagaucaucaacaucuucaaccuccugaucagcggcaaguccaaggugaacgggaucuucgacgacgaggagauccuggagaagaucaaggaggacaacaaggaggacuucuaccucaccagcgagaaguacgaggagaaccuggaguacuucucccagcugcucgacuaccgcuucgagcugaucagcucccucaagagcaucuacgacuacaucauccugcaggagguccugaagggcaagaaguaccuguccuacgcccagguggagcgguacaagaaccacaaggaggaccuccgcaagcugaagcagcugaucaagaaguacgacaagaacgggaagaucuacuaccagaucuuccgggacgagaacuucaagaagggcuacguggcguaccucggcuacuacaagaagaacaagaagaacguccccgugaagaagugcgacuacgacaccuucagcaagaacaucaagagcacccuggacaagaucugcgacaaggaggacccccuguacaucgagcucaucgacaagaucgagaagggcggguuccugcugaagcagaucguguccacgaacagcgucaucccgcaccaggugcacgagcucgagcuggacaagauccuggagaaccucgagaagaacuaccccuccuucaaggagaucagcgacgggguguccaagaucgacaagaucaagaugaucuucaacuuccgcauccccuacuacgucggcccccugaacgacuaccacaaggacaaggugaacagcaacaccuggaucgugaagaacgagggcuucgagaacgagaacauccggccguggaacuucuccaagaucgucgacgagcacgccugcgaggaggaguucaucaagcgcaugaucaacgagugcagcuacauccccggggagaaggugcugcccaaguccagccugcucuacuccgaguacauggugcugaacgagcugaacaaccuccgcgucaacggcgacaagcugaaccccaagaucaagaaggagaucguggagaacaucuacaagaaggagcggaaggugacccugaagaagauccgcaacuuccucaucaucaacaacuacgucgacagcaagguggaguucuccgggcugagcgacggcaucaaggccaacauguccagcuacaucgacuucgcggagauccuggacgacaacuucgacaacaacauggucgaggaccucaucgagcagaucaccauccacguggggaacgugaagcugcugacggagaagaucuccaacaaguacccgaaccucgagaagaagcagaucaacaagaucgucaaccugaaguucaaggacugggcccgguucagccgcaagcugcucgugggcaucgagggcaccgagaaggagaccggggagaucaacaccaucaucggcuuccugcgggagacgaacgagaacuucauggagcugauguccaaccgcuacaccuucagcgaggagaucagcgagaucaagaagaaguacauccccaacaagcucuccaagcagaucguggacgaccuguacgucagccccgccgugaagaagaugaucuggcagguccugaacaucaacgacgagcucaucaaggugcuggggaagcagcccaagaagaucuucaucgagauggcccggggcaaggaggagaagccggaggugaaggacucccgcaagaacaagcugaucgagcucuacaagaaccuggggaaggagggcaaggaguggcugaaccggaucgaggacaagaccgaggccgacuuccgcaaccgggcgcucuaccuguacuacacccagaugggccgcugcauguacacgggggagaucaucgacaucgagcggcuguacgacaaggagcucuacgaccuggaccacaucaucccccgcaagaugaagaaggacgacagcauccacaagaaccuggugcucgucacccggaacuccaaccaguacgagaagaaggacaacuaccccgugcccgaggugaucaagagccgcgagaacguccggcaccugugguacgcccugaagaagaagggccucaucaccgaggagaaguacaaccgccugacccggaucaacccgcuguccgacaaggagcucagcgaguucaucgagcgccagcugguggagacgcgccagaccaccaagguggucaaggaccuguucgagaacuacuacaccgacuccaagaucgugacggugaaggccgggcucgucagcgagcugcggcgcgacuucgaggugcugaagugccgggagaucaacgaccucaaccacgcccacgacgccuuccugaacaucaucgugggcgacgucugguccaagaaguucaccagcaaccccuacaacuucgugaagaagaaccgcgagaaguacacccugaacaacaucuucaccaagaaccagaaggaccuccgggggaacgagaucuggaacugcgcggagggcaagaagcgcaucaucaagacgcugaacaagcccuccgugcuguucagcgucgagaacuucgagcagaccggccagcuguucgaccagaacaucaucgggaagcaggacuacaaggagaagaccuccuacgugcccaucaagggcgacgagcggcugcaggacaucagcaaguacgggggcuaccgcggcaucuccggggccuacuucuucaucguggagcacaccgagaagaacaagcgggucaagaccaucgagagccugccgaucuacaugaaguccuacguggaggagaacggccuccuggacuucugcacgaacgagaugaagcugguggaccccaagaucaucgucaagaagcucaacuacaagagcgagaucaucguggacggguucaaguaccugaucagcggcaagaccgagaaccgccugucccucgagaccaacgaguaccuguacuggaaccacacccagacgaccgacaucaagaagauccugaacaucaacgagaagaucgagcucgagaaguacaacggggacaucgagagcgagcgggagaacaucaucaaguacauccagaucauccuggagaaguucaagcugaagcccuucaucaagcgccggaaccuccccaacaucgagaucaacuucgccgacuacgagaccgagaagcugcugcagcuccuggugaaccugaucccgcucaccacgaaguacgucucccccguggaccugaccgugaucagcggcuccaaguacgccggcaagguccugauccccaagaagaucagcaaccucaacgaggugaucuucaucuccaagagcaucaccgggaucuacgagucccgccggcgcaucaucuga

SEQ ID NO: 1814 - RNA, 4017 nt, Artificial Sequence
  Cas9 variant
augaagcaggaguacuuccugggccucgacauggggaccggcagccuggggugggccgugaccgacuccacguaccaggucaugcgcaagcacggcaaggcccugugggggacccggcuguucgagagcgcguccaccgccgaggagcgccggauguuccgcaccgcccggcgccggcuggaccgccggaacuggcgcauccaggugcugcaggagaucuucagcgaggagaucuccaagguggaccccggcuucuuccuccggaugaaggagagcaaguacuacccggaggacaagcgcgacgccgagggcaacugccccgagcugcccuacgcccuguucgucgacgacaacuacacggacaagaacuaccacaaggacuaccccaccaucuaccaccuccggaagaugcugauggagaccaccgagaucccggacauccgccugguguaccucgugcugcaccacaugaugaagcaccgggggcacuuccugcucuccggcgacaucagccagaucaaggaguucaaguccacguucgagcagcugauccagaacauccaggacgaggagcuggaguggcacaucagccucgacgacgcggccauccaguucgucgagcacgugcugaaggaccgcaaccugacccgguccaccaagaagucccgccucaucaagcagcugaacgccaagagcgccugcgagaaggcgauccugaaccuccugagcgggggcaccgugaagcuguccgacaucuucaacaacaaggagcucgacgagagcgagcggcccaaggucuccuucgccgacagcggguacgacgacuacaucggcaucguggaggccgagcuggccgagcaguacuacaucaucgccuccgcgaaggccguguacgacuggagcguccugguggagauccucggcaacagcguguccaucagcgaggccaagaucaaggucuaccagaagcaccaggccgaccugaagacgcugaagaagaucgugcgccaguacaugaccaaggaggacuacaagcggguguucgucgacaccgaggagaagcucaacaacuacuccgccuacaucgggaugaccaagaagaacggcaagaagguggaccucaagagcaagcagugcacgcaggcggacuucuacgacuuccugaagaagaacgugaucaaggucaucgaccacaaggagaucacccaggagaucgaguccgagaucgagaaggagaacuuccuccccaagcaggucaccaaggacaacggggugauccccuaccaggugcacgacuacgagcugaagaagauccuggacaaccucggcacccgcaugccguucaucaaggagaacgccgagaagauccagcagcuguucgaguuccgcauccccuacuacgugggcccccugaaccgggucgacgacgggaaggacggcaaguucacguggagcgugcgcaaguccgacgcccggaucuaccccuggaacuucaccgaggugaucgacgucgaggccagcgccgagaaguucauccgccggaugaccaacaagugcaccuaccucgugggggaggacgugcugccgaaggacucccuggucuacagcaaguucauggugcucaacgagcugaacaaccugcgccucaacggcgagaagaucuccguggagcugaagcagcggaucuacgaggagcuguucugcaaguaccgcaaggucacgcggaagaagcuggagcgcuaccucgugaucgaggggaucgcgaagaagggcguggagaucaccggcaucgacggggacuucaaggccagccugaccgccuaccacgacuucaaggagcggcugaccgacguccagcucucccagcgcgccaaggaggccaucgugcugaacgugguccuguucggcgacgacaagaagcuccugaagcagcggcugagcaagauguaccccaaccucacgaccgggcagcugaagggcaucugcucccugagcuaccagggguggggccgccucuccaagaccuuccuggaggagaucaccgugcccgcgcccggcacgggggagguguggaacaucaugaccgcccuguggcagaccaacgacaaccucaugcagcugcugagccggaacuacggcuucaccaacgaggucgaggaguucaacacgcucaagaaggagaccgaccuguccuacaagaccguggacgagcuguacgugagcccggccgucaagcgccagaucuggcagacccucaagguggugaaggagauccagaaggucauggggaacgcccccaagcggguguucguggagauggcgcgcgagaagcaggagggcaagcggagcgacucccgcaagaagcagcuggucgagcuguaccgcgccugcaagaacgaggagcgggacuggaucaccgagcucaacgcccagagcgaccagcagcugcgcuccgacaagcuguuccucuacuacauccagaaggggcggugcauguacagcggcgagacgauccagcuggacgagcugugggacaacaccaaguacgacaucgaccacaucuacccccaguccaagaccauggacgacagccucaacaaccgcgugcuggugaagaagaacuacaacgccaucaaguccgacaccuacccccugagccucgacauccagaagaagaugauguccuucuggaagaugcugcagcagcagggcuucaucacgaaggagaaguacguccggcuggugcgcagcgacgagcucuccgccgacgagcuggcgggguucaucgagcggcagaucguggagacccgccagagcaccaaggccgucgccaccauccugaaggaggcccucccggacacggagaucguguacgugaaggccggcaacgucuccaacuuccggcagaccuacgagcugcugaaggugcgcgagaugaacgaccuccaccacgcgaaggacgccuaccugaacaucguggucgggaacgccuacuucgugaaguucaccaagaacgccgccugguucauccggaacaaccccggccgcagcuacaaccugaagcggauguucgaguucgacaucgagcgcuccggcgagaucgcguggaaggccgggaacaagggcagcaucgugaccgucaagaaggugaugcagaagaacaacauccucgugacgcggaaggccuacgaggucaagggcgggcuguucgaccagcagaucaugaagaaggggaagggccaggugcccaucaagggcaacgacgagcgccuggccgacaucgagaaguacgggggcuacaacaaggcggccgggaccuacuucaugcucgugaagucccuggacaagaagggcaaggagauccggaccaucgaguucgucccccuguaccucaagaaccagaucgagaucaaccacgagagcgccauccaguaccuggcccaggagcgcgggcugaacagcccggagauccuccuguccaagaucaagaucgacacccuguucaagguggacggcuucaagauguggcucagcggccggacggggaaccagcugaucuucaagggcgccaaccagcugauccucucccaccaggaggcggccauccugaaggggguggucaaguacgugaaccgcaagaacgagaacaaggacgccaagcugagcgagcgggacggcaugaccgaggagaagcuccugcagcuguacgacaccuuccucgacaagcuguccaacaccgucuacagcauccgccuguccgcccagaucaagacgcucaccgagaagcgcgccaaguucaucgggcugagcaacgaggaccagugcaucgugcugaacgagauccuccacauguuccagugccaguccggcagcgcgaaccugaagcugaucggcgggcccggcuccgccgggauccucgugaugaacaacaacaucaccgccugcaagcagaucagcgucaucaaccagucccccaccggcaucuacgagaaggagaucgaccugaucaagcuguga

SEQ ID NO: 1815 - RNA, 4017 nt, Artificial Sequence
  Cas9 variant
augaccaagcccuacagcaucggccuggacaucgggaccaacuccgugggcugggccgucgugacggacggguacaaggugccggccaagaagaugaagguccucggcaacaccgacaagagccacaucaagaagaaccugcugggggcgcuccuguucgacuccggcaacaccgccaaggaccgccggcugaagcgcaccgcccggcgccgguacacgcgccggcgcaaccggauccucuaccugcaggagaucuucgccgaggagauggccaaggcggacgagagcuucuuccagcgccugaacgaguccuuccucaccaacgacgacaaggaguucgacagccaccccaucuucggcaacaaggccgaggaggaggcccaccaccacaaguuccccaccaucuuccaccuccggaagcaccuggccgacuccaccgagaaguccgaccugcgccugaucuaccuggcgcucgcccacaugaucaaguuccgggggcacuuccugaucgagggccagcugaaggccgagaacacgaacgugcagacccucuucgacgacuucguggaggucuacgacaagaccguggaggagagccaccugagcgagaucuccgugagcuccauccugaccgagaagaucagcaagucccgccggcucgagaaccugaucaaguacuaccccacggagaagaagaacacccuguucgggaaccucaucgcccugagccugggccuccagccgaacuucaagaccaacuucaagcuguccgaggacgccaagcugcaguucagcaaggacaccuacgaggaggaccucggggagcugcugggcaagaucggcgacaacuacgcggaccucuucaucuccgccaagaaccuguacgacgccauccugcucagcgggauccugacgaucgacgacaacaccaccaaggcgccccugagcgccuccaugaucaagcgcuacgaggagcaccaggaggaccucgcccagcugaagaaguucauccggcagaaccugcccgaccaguacagcgaggucuucuccgacaagaccaaggacggcuacgccggguacaucgacggcaagacgaaccaggaggccuucuacaaguacaucaagaacaugcucagcaagaccgagggcgccgacuacuuccuggacaagaucgaccgcgaggacuuccugcggaagcagcgcaccuucgacaacggguccgugccccaccagauccaccuccaggagaugcacgccauccugcggcgccagggcgaguacuacccguuccugaaggagaaccaggacaagaucgagaagauccucaccuuccgcauccccuacuacguggggccccuggcgcggaagggcagccgcuucgccugggccgaguacaaggccgacaagaaggucacgcccuggaacuucgacgacauccuggacaaggagaaguccgccgaggaguucaucacccggaugacccugaacgaccucuaccugccggaggagaaggugcugcccaagcacagccucguguacgagaccuucaacgucuacaacgagcugacgaaggugaaguacgugaacgagcaggggaaggcgaucuucuucgacgccaacaugaagcaggagaucuucgaccacgucuucaaggagaaccgcaaggugaccaaggacaagcugcucaacuaccugaacaaggaguucgaggaguuccggaucgugaaccugaccggccucgacaaggagaacaaggccuucaacuccagccugggcaccuaccacgaccugcgcaagauccucgacaaguccuuccuggacgacaaggucaacgagaagaucaucgaggacaucauccagacgcugacccucuucgaggaccgggagaugauccgccagcggcugcagaaguacagcgacaucuucaccacccagcagcugaagaagcucgagcgccggcacuacacgggguggggccgccuguccgccaagcugaucaacgggauccgggacaagcagagcaacaagaccauccucggcuaccugaucgacgacggguacuccaaccgcaacuucaugcagcugaucaacgacgacagccuccccuucaaggaggagaucgcgcgggcccaggugaucggcgagaccgacgaccugaaccagcugguguccgacaucgccggcagccccgccaucaagaaggggauccuccagucccugaagaucgucgacgagcuggugaaggucaugggccacaacccggccaacaucgugaucgagauggcgcgcgagaaccagaccaccgccaaggggcggcgcagcagccagcagcgguacaagcgccucgaggaggccaucaagaaccuggaccacgaccugaaccacaagauccucaaggagcaccccacggacaaccaggcccugcagaacgaccgccuguuccucuacuaccugcagaacggccgggacauguacaccgaggacccccuggacaucaaccgccucuccgacuacgacaucgaccacaucaucccccagagcuucaucaaggacgacuccaucgacaacaaggugcuggucagcuccgccaagaaccggggcaagagcgacaacgugccguccgaggacguggucaaccgcaugcggcccuucuggaacaagcugcucagcugcgggcugaucucccagcgcaaguacagcaaccugaccaagaaggagcucaagcccgacgacaaggcgggcuucaucaagcggcagcugguggagacccgccagaucacgaagcacguggcccagauccuggacgcccgguucaacaccaagcgcgacgagaacaagaaggucauccgggacgugaagaucaucacccucaaguccaaccuggugagccaguuccgcaaggacuucaaguucuacaagguccgggagaucaacgacuaccaccacgcccacgacgccuaccugaacgcggugaucgggaaggcccuccuggacguguacccccagcuggagccggaguucgucuacggcgaguacccccacuuccacggguacaaggagaacaaggccaccgccaagaaguucuucuacuccaacaucaugaacuucuucaagaaggacgacauccgcacggacgagaacggcgagaucguguggaagaaggacgagcacaucagcaacaucaagcgggugcucuccuacccccaggucaacaucgugaagaagguggagauccagaccgucggccagaacgggggccuguucgacgacaaccccaagagcccgcuggaggugacccccuccaagcucgugccccugaagaaggagcugaacccgaagaaguacgggggcuaccagaagcccaccacggcguaccccguccuccugaucaccgacaccaagcagcugauccccaucagcgugaugaacaagaagcaguucgagcagaacccggugaaguuccuccgcgaccggggguaccagcaggucggcaagaacgacuucaucaagcugcccaaguacacccugguggacaucggcgacgggaucaagcgccucugggccagcuccaaggagauccacaagggcaaccagcugguggucagcaagaagucccagauccugcucuaccacgcccaccaccuggacagcgaccuguccaacgacuaccuccagaaccacaaccagcaguucgacgugcuguucaacgagaucaucagcuucuccaagaagugcaagcuggggaaggagcacauccagaagaucgagaacguguacagcaacaagaagaacuccgccagcaucgaggagcucgccgaguccuucaucaagcugcugggcuucacgcagcucggggcgaccagccccuucaacuuccugggcgucaagcugaaccagaagcaguacaagggcaagaaggacuacauccuccccugcaccgaggggacccugauccggcaguccaucacgggccuguacgagacccgcguggaccucagcaagaucggggaggacuga

SEQ ID NO: 1816 - RNA, 4017 nt, Artificial Sequence
  Cas9 variant
augcgcgacuacuacaucggccuggaccucgggaccggcagccuggggugggccgugaccgaccgggaguacgagaucaugcgcgcccacggcaaggcgcuguggggcguccggcuguucgacuccgccaacacggccgaggagcgccggggguuccgcaccgcccggcgccggcuggaccgccggaacuggcgcaucgagcugcuccaggagcuguucggcgaggacaucgggaagguggacagcggcuucuuccugcggaugaaggaguccaaguacaugcccgaggacaagcgcgacgugaacgggaacugcccgaagcuccccuacgcccuguucgucgaggacggcuacaccgacaaggacuaccaccggcaguuccccaccaucuaccaccuccgcaaguggcucauggagacggaggagacccccgacauccggcugguguaccuggcgcuccaccacaugaugaagcaccgcgggcacuuccuguucagcggcaacaucgagaagaucaaggaguuccaggagaccuuccggcaguacaucggcaagauccgcgaggaggagcuggacuuccaccucugcaucgagggggaggagcugcgggagaccgagaacauccugaaggacaagaaccucacgcgcuccgccaagaagacccgccugaucaagcugcucggcgcccacaccgccugcgagaaggcggcccugaaccugguggccgggggcaccgucaagcucagcgacaucuucggcaacuccgagcuggacgccugcgagaagccgaagcugagcuucgccgacgcgggguacgacgacuacgccggcaugaucgaggacgagcucggggagcagcacgugaucaucgagacggccaaggccguguacgacugguccguccuggccgacauccugggcgacuaccggugcaucagcgaggcgaaggccgccguguacgagaagcaccagaaggaccuccgccaccugaaggagcuggugaaggagaaccucgggcgggacgucuacaaggagguguucgugaagaccaacgagaagcugcccaacuacuccgccuacaucggcaugaccaagaagaacggcgucaagagcgagauggaggggaagcgcugcgaccggaaggccuucuacgacuaccugaagaagaccguggugaacgcgauccccgacgaguccaagacggaguaccuccgcaaggagauggagaccgagaccuuccugccccggcaggucaccaaggacaacggcgugaucccgcaccaggugcaccuccaggagcuggacgccauccuggagaaccugagcgggcgcauccccgcccucaaggagaacggcuccaagauccgggacaucuucacguuccgcauccccuacuacgucgggccccugaacggcaucgugaagggcggggagcggaccaacugggugcgccggaagaaggccggccgcaucugcccguggaacuucgacgagauggucgacaccggggccagcgcggaggaguucauccggcgcaugaccuccaagugcacguaccugauccacgaggacgugcuccccaagaacagcaugcuguacuccaaguucaugguccugaacgagcugaacaacgugcggcucaacggcgagcccaucagcguggagcugaagcagaagaccuacgaggaccuguuccagcgccaccggaaggucacccgccgccggcucaccgacuacauccgccgggaggggaucgccggccgcgacgccgacaucacgggcaucgacggggacuucaagggcagccugaccgccuaccacgacuucaaggagaagcugaccgggugcgagcucucccaggcggacaaggagaacaucauccugaacaucacccuguucggcgaggacaaggcccuccugaagaagcggcugggcgcccucuaccccgcccugacggagccgcagaagaaggccaucugcgcgcugagcuacaagggguggggccgccucucccagcggcugcuggaggggaucaccgcccccgcccccgagaccggcgagaucuggaccgugauccgcgccaugugggagacgaacgacaaccucaugcagguccugagcgagaaguacugcuucgccgcggccaucgacgaggagaacgccggggaggagcugaaggagaucaccuacaagaccguggagcagaugaacgugucccccgccgugcggcgccagaucuggcagagccuccaggucaucaaggagaucugcaaggugaugggcggcccgcccaagcggguguucgucgagauggcccgcgagaagauggaguccaagcggaccgagagccgcaagaagcggcugaucgaccuguacaagaagugccgcgaggaggagcgggacuggaucgaggagcucgggaacaccgaggagacgcgccugcgguccgacaagcuguaccucuacuacacccagaagggccgcugcauguacagcggggaggugaucgagcuggaggagcugugggacaaccggaaguacgacaucgaccacaucuacccccaguccaaggugauggacgacagccucgacaaccgcguccuggugaagaaggaguacaacgcggacaagaccgacgaguaccccauccgcgccgacauccggggcaagaugcgcgccuucuggcggauccugcgcgaggagggguucaucuccaaggagaaguacaaccggcucacccgcggcacgggcuucgagccgagcgagcuggccggguucaucgcgcggcagcugguggagacccgccagggcaccaaggccgucgccuccgugcucaagcaggucuuccccgagaccgacaucguguacgccaaggcccggguggcgagccaguuccgccaggaguucgaccugaucaaggugcgggagaugaacgaccugcaccacgccaaggacgccuacgucaacaucgugguggggaacgucuacuacacgaaguucaccuccaacgccgccugguacgugaaggagcaccccggccgcagcuacaaccucaagaagauguucaccuccgagcgggacguggcgcgcaacggggagaccgccuggcgggccggcaacagcggcacgaucgccaccgucaagcgcgugauggggaagaacaacauccuggugacccggcgcagcuacgaggucaagggcgggcuguucgaccagcagcucaugaagaagggcaagggccaggugcccaucaaggggcgggacgagcgccuggccgacaucgacaaguacggcggguacaacaaggcggccggcaccuacuucaugcuggccgaguccgaggacaagaagggggccaagauccgcagcguggaguacgucccgcucuaccugugcaacugcaucgagaaggacgaggaggcggccaagaaguaccugcagaaggagcggggccucaagaacccccgcgugcugaucgccaagaucaagaucgacacgcuguucaagguggacggcuucuacauguggcucuccgggcggaccggcaaccagcugaucuucaagggggccaaccagcugauccucagcgagcccgacaugcgcauccugaagaagguccugaaguacgugaaccggaagaaggagaacaagaacgccgugcucggcgagcacgaccagcugccggagaccgaccugauccgccucuacgacgucuuccuggacaagaucgagaacaccguguaccacgugcggcuguccgcgcagcaggggacgcucaccaagaacaaggacaccuucugcgagcugagcaacgaggacaagugcaucguccuguccgagauccuccacauguuccagugccagagcggcuccgccaaccugaagcugaucaagggccccgggagcgccggcauccucgugcugaacaacaucaucuccaagugcaaccaggugagcaucauccaccagucccccaccgggaucuacgagcaggagaucgaccugaagaagaucuga

SEQ ID NO: 1817 - RNA, 4020 nt, Artificial Sequence
  Cas9 variant
augaacaaggccuacacccugggccucgacaucgggaccaacagcgugggcugggccgucgugacggacgacuaccgccugauggcgaagaagaugcccgugcacuccaagauggagaagaagaagaucaagaagaacuucuggggcgcccggcuguucgacgaggggcagaccgccgaggagcgccggaacaagcgcgccacccggcgccggcuccgccggcgcaaguaccggauccuggagcugcagaagaucuucagcgaggagauccucaagaaggacucccacuucuucgcccgccuggacgagagcuuccugaucccggaggacaagcaguacgcgcgguuccccaucuuccccacccuccuggaggagaaggccuacuaccagaacuaccccacgaucuaccaccuccgccagaagcuggccgacuccaccgagaaggccgacauccggcuggucuaccuggcgcucgcccacaugaucaaguaccgcgggcacuuccuguucgagggcgagcuggacaccgagaacaccagcguggaggagacguucaaggaguucaucgacaucuacaacgagcaguucgaggagggcaucaucuucuacaaggacaucccgcucauccugaccgacaagcuguccaagagcaagaagguggagaagauccuccaguacuaccccaaggagaagaccaccgggugccuggcccaguuccugaagcucaucgucggcaaccaggggaacuucaagcaggccuuccaccuggacgaggaggugaagauccagaucuccaaggagacguacgaggaggaccuggagaagcuccugcgcaagagcaacgaggagaugaucgacguguuccugcaggucaagaagguguacgacgccauccuccuguccgacauccugagcaccaagaugaaggacaccaaggcgaagcucuccgccggcaugaucgagcgguaccagaaccacaagaaggaccuggaggagcugaagcaguucgugcgggcccaccuccacgagaaggucaccguguucuucaaggacagcuccaaggacggguacgccggcuacaucgacggcaagacgacccaggccgacuucuacaaguuccugaagaaggagcugaccggggugcccggcagcgagcccaugcucgcgaagaucgaccaggagaacuuccugcugaagcagcgcaccccgacgaacggggucaucccccaccaggugcaccucaccgaguucaaggccaucaucgaccagcagaagcaguacuaccccuuccuggagaaguccaaggagaagaugauccagcugcucaccuuccggauccccuacuacgugggcccgcuggcccaggacaaggagaccagcuccuucgccuggcuggagcgcaagacgaccgagaagaucaagcccuggaacgccaaggacgucaucgacuacggcgcgagcgccaccaaguucauccagcgcaugaucaacuacgacaccuaccuccccacggagaaggugcugcccaaguacagcaugcuguaccagaaguacaccaucuucaacgagcugaccaagguggccuacaaggacgaccgggggaucaagcaccaguucuccagcgaggagaagcuccgcaucuuccaggagcuguucaagaagcagcggcgcgucaccaagaagaagcugcagcacuuccucuccgccaacuacaacaucgaggacgccgagauccugggcguggacaagguguucaacagcuccuacgcgacguaccacgacuuccuggagcucgccaagccguacaccgagaagaucaucgagcugcuggagcagcccgagauggaggagauguucgaggacaucgucaagaucaucaccaucuucgaggaccgggagauggugcgcacccagcucaagaaguaccagcggauccugggggaggagaucuucaagaagcuggucaagaagaaguacacgggcugggggcgccucagcaagcggcugaucaacggcauccgcgaccagaagaccaacaagaccauccuggacuaccucaucaacgacgacgacuuccccuacaaccggaaccgcaacuucaugcagcugaucaacgacgaccaccuguccuucaaggaggagaucgccaaggagcucacccugagcgacaagcagucccugcucgaggugguggaggccauccccggcagcccggcgaucaagaaggggaucuggcagacccugaagaucgucgaggagcugaucgccaucaucggcuacaagcccaagaacaucgugaucgagauggcccgggagaaccagacgaccaccgggggcaagaaccgcuccaagccccggcucaagagccuggaggaggcccugaagaacuucgacucccagcuccugaaggagcgccccguggacaaccagagccugcagaaggaccggcucuaccuguacuaccugcagaacgggaaggacauguacaccggcgagucccucgacaucgaccgccugagcgaguacgacaucgaccacaucaucccgcgguccuucaucgucgaccacagccuggacaacaaggugcucguguccagcaaggagaaccgccugaagaaggacgacguccccgacagcaagguggugaagcgcaugaaggccuacugggagaagcugcuccgggcgaaccugaucuccgagcgcaaguucagcuaccugacgaagcucgagcugaccgacgacgacaaggcccgguucauccagcgccagcuggucgagacccggcagaucaccaagcacguggccgccauccuccaccaguacuucaaccagacgcaggagcuggagaaggagaaggacauccgcaucaucacccugaaguccagccucgugucccaguuccggcaggucuucggcauccacaaggugcgcgagaucaaccaccaccaccacgcccacgacgcguaccugaacgccguggucgcccuggcccuccugaagaaguacccccggcuggcccccgaguucguguacgggagcuucgcgaaguuccaccucgugaaggagaacaaggccaccgccaagaaggaguucuacuccaacauccugaaguucuucgagaaggaggagcaguucugcgacgagaacggcgagaucuucugggacaagcgcaagcacauccagcagaucaagaaggucaucagcucccaccaggugaacaucgugaagaaggucgaggugcagaccgggagcuucuacaaggagacggugaacaccaaggagaagccggacaagcugaucaagcggaagaacaacugggacgucaccaaguacggcggguucggcucccccgugguggccuacgcggucguguucaccuacgagaagggcaagaaccacaagaaggccaaggccaucgaggggaucacgaucauggagcaggcccucuucgagaaggaccccaucagcuuccugaucgagaagggcuacuccaacgugaaccaguucaucaagcugccgaaguacacccucuucgagcuggccaacgggcagcgccggaugcuggcgagccaccaggagcuccagaaggccaacuccuucauccugcccgagaagcuggucacccuccuguaccacgccaaccacuacgacgagaucgccuacaaggacagcuacgacuacgugaacgagcacuucuccaacuuccaggacauccuggacaaggugaucaucuucgccgagaaguacaccagcgcgccccagaagcucaaccagaucaucgccacguacgagaagaaccaggaggccgaccgcaagaucauggcccacagcuucgucaaccugaugcaguucaacgcccugggcgcgcccgccgacuucaaguucuucgacaccaccaucacccggaagcgcuacacgucccucaccgagaucuggcagagcaccaucaucuaccaguccgugaccggccuguacgagacgcggcgccggauggccgaccugugggacggggugcaguga

SEQ ID NO: 1818 - RNA, 4020 nt, Artificial Sequence
  Cas9 variant
auggagcgcuaccacaucggccuggacaucgggaccagcuccaucggcugggccgugaucggggacgacuucaagaucaagaagaagaagggcaagaaccucaucgggacccggcuguucaacgagggcgccacggcggccgagcgccggggcuuccgcacccagcggcgccggcugaaccgccggaaguggcgccucaagcugcuggaggagaucuucgaccccuacauggccgaggucgacgaguacuucuucgcccggcucaagagcuccaaccugagcccgaaggacuccaacaagaaguaccuggggagccuccuguuccccgacaaguccgacagcaacuucuacgacaaguaccccaccaucuaccaccuccgccgggaccugauggagaaggacgagaaguucgaccugcgcgagaucuaccuggccauccaccacaucgugaaguaccggggcaacuuccucgagaaggugcccgcgaagaacuacaagaacuccggggccagcaucggcuuccugcuggaggaggucaacucccucuacaaggacaucaucggggacgagagcaucgccauccugaacuccgagaaguucgaggacguggagaagaucauccuggacgaggagacccgcaaccucgacaagcagaaguccgugggcaagcugcuggucgaggacaagaagaagaagaacaucgugacggccuucuccaaggcgaucuucggcuacaaguucaacaucgaggaccuccugcugaucgagaacgacgagaagaacaagcucaccuucaacgacgagaacaucgacgacaucuucaacgagcugagccacucccuggacgacaagcagauggaccuccugaccaagacccgggagaucuacuucaaguucaagcugaacaugaucgugccgacgggguacacccucagcgaguccaugaucgagaaguacgagaugcacaaggcccaccugaagauguacaaggaguucaucaacacccugaacaccaaggaccgcaagauccucaagaacgccuacagcgacuacaucaacacggagaaggccaaggccgcgaacgcccaggagaacuucuacaagaccgucaagaagaucaucaaggacaacaacagcgacaccgccaagaagaucaucgugcugaucgacgagggcaacuucaugcccaagcagcggaccggggagaacggcgugaucccccaccagcugcaccagaucgagcucgaccgcaucaucgagaaccaggccaaguacuaccccuggcuggccgaggcgaacccggucgagaagaaccggaaguucgccaaguacaagcuggacgagcucgugacguuccgcgugcccuacuacgucggcccccugaucgacaagaccgaguccaacaagaacgagaaggagaccaaguucgccuggauggugcgcaaggccaaggggaccaucacgcccuggaacuucgagaaccugguggaccggaccgagagcgccaaccgcuucaucaagcggaugaccuccaaggacaccuacaucaucggcgaggacguccucccggcgagcucccugcuguacgagaaguucaaggugcucaacgagcugaacaacaucaaggugaacgagaagaagcuggacaucgagcagaagcaggacaucuaccugaaccucuucacgaccgccaagaacgucaccaagaagucccuggccaccuaccugaacugcagcgccgacagcaucuccgggcucagcgacggcgagaaguucaacuccagccuguccagcuacaucgaccugaaggccauccucgggaacaucguggacgacugcaacaagaacgaggaccuggagaagaucaucgaguacuccacgguguucgaggacggcaacaucuacaaggagaagcugagcgagaucuccuggcucaccgacgagcagaucgagaagcugagcaacauccacuucaagggcugggggcgccuguccaagaagcuccugacccagaucaccaacgagaacggcgagcggaucaucgacgcgcuguggaacacgagcaacaacuucaugcagaucaucaacgacgagagcauccaggccaagcucgccgagaucaacgggaaguacgccggcaaguccgaccuggaggacauccugagcgaggcguacaccagcccccagaacaagaaggccauccgccaggucaugaagguggucgaggacaucgagaaggccaugcagugcgagcccaccagcaucuccaucgaguucacccggaagaagcagaagucccgccucacgaacacccgguacaagaagaucagcgacguguacgagaagaucgccgacgaggugaucagcgaguacgagcugcgcaagcugcaguccgagcucgacagcaacgccaacaacaugcgggaccgcuacuaccuguacuucaugcagcuggggcgggacauguacaccggcgagaagaucaacaucgacgagcuccaccagcgcuacgacaucgaccacauccugccccaguccuucaucaaggacgacagcaucaacaaccggguccugacccgcaaggacgugaacaacaaggagaaguccgacaagaccgcggccgaccucuacgccguggagaugagcgacuucuggcggaagcugcgcaagcagggccugaucacggagcagaaguacaagaaccuccugaccaaguccgacagcaucgacaaguacgccaagaagggguucaucaagcggcagcuggucgagaccucccagguggugaagcucgucgccaacauccugcaggacaaguacagcgacaccaagaucaucgaggugcgcgcgaagcugaacagcaaccuccgcgaggaguacaagcugaucaagaaccgggccgugaacgacuaccaccacgccaucgacggcuaccugacgaccuucaucgggcaguaccucuacaagaccuacccgaagcugcgcuccuacuucgucuacaacgacuucaagaagcuggacagcaacuaccucaagcacaugaagaaguucaacuuccuguggcagcugcaggacgacaagaccaucgacaucuacgacaacgugaacaacaaguucgugcucaacguccccgagaugaagaaguacauccagaagaucuacaacuacaaguacaugcugguguccaaggaggugacgaccaagaacggcgccuucuacgaccagaccaaguacaacgccaagaccgucaaccugauccccaucaagaagaacaagcccacgaacaucuacgggggcuacaagggcaaggugagcuccuacaugaugcucgugaagauccggaagaagaaggaggucaucuacaaguucgugggggugccgcgccuguggaccgacgagcuggaccggcucaaggacaccaccgagcgcaagauccugcugaacgagaucgcgaagaacagccucuccaagacggagcaggacuucgaggucauccuggacaagguguacuacggccagcugaucaucgacgggaaccagaaguacacccucggcagcuccgaguacaaguacaacgccaugcagcugcaccugagcaagcacgcccucgaggugcuggccaaggagaacgucaaggacgcggagaucaccgacaaggaccugguguccguguacgaggagauccucagcgucgugaacaaguacuucgagcuguacgacaucaacaaguuccggcagaagcugaacgagggccucgagaucuuccgcaagcugcccguguacaacgucuacgaguccaacaagaucaagcaggucgggaaguucgaggugcugaaccggauccucaugggccugcacgccaacgccaugaucaccgaccugaaggugcucgggaucaagacgaagcugggccagaugcaggucaacgggggcaucaagcugagccccgacgccaagcucaucuaccagucccccaccggcaucuucagccgcgccgugcgggugaaggaccugggguga

SEQ ID NO: 1819 - RNA, 4020 nt, Artificial Sequence
  Cas9 variant
augagccugaacaccaacaagaaguacaacaucggccucgacaucgggaccacguccgugggcugggccgucaccgacgccgacgggcagaagcugcugaaggcgaagaacaagaaccucuggggcgugagccuguucgaggccgggaagaccgccgccgagcgccggggcuaccgcuccacccggcgccggcugaaccaccgcaaguuccggcuccgccugcuggaggacauguucgagaaggagauccucagcaaggaccccuccuucuucauccggcugaaggaggccuuccugagcccgaaggacgagcagaagcaguucaagggcaacauccucuucaacgacaaggacuacacggacgcggacuacuacgagcaguacaagaccaucuaccaccuccgcuacgaccugaucucccagcaccggcaguucgacauccgcgagguguaccucgccauccaccaccugaucaaguaccgggggcacuucaucuacgaggaccagaccuucaccacggacggcaaccagcugcagcaccacaucaaggccaucaucaccaugaucaacagcauccucaaccgcaucaucauccccgagaccaucgacaucaacgucuucgagaagacccugcuggaccggacgaugaaccgcuccagcaaggugaaguuccucaucgagcugaccggggaggacaagcaggacaagccccugcucaaggagcuguucaaccugaucgugggccucaaggccaagcccgcguccaucuucgagcaggagaaccuggccaccaucgucgagaccaugaacaugagcacggagcagguccagcuggaccuccugacccuggccgacgugcucgccgacgaggaguacgaccugcugcucaccgcccagaagaucuacuccgcgaucauccuggacgagagcauggacggguacgaguacuucgccgaggccaagaaggaguccuaccggaagcaccaggaggagcuggugcucgugaagaagaugcucaagagcaacgccaucaccaacgacgagcgcgccaaguucgaguacuucuacacggacuacaucggcgcgaaguccagcaacuacgaggaguccaagaucaucaagaagggccugagcgccgccuacgggaaguacagcaaggaggagcggcuguucaagcacaucgagcugcugcucgccaaggagaacgugcugaccaccgucgagcacgaccugcucgagaagaacaucaccuucgccucccugcugccgcugcagcgcagcucccggaacgcggugauccccuaccaggugcacgagaaggagcucgucgccauccuggagaaccaggccacguacuaccccuuccugcucgagcagaaggacaacauccacaagcugcugaccuuccgcauccccuacuacgugggcccgcucgccgaccagaaggacagcgaguucgccuggauggugcgcaagcaggcggggaagaucacccccuucaacuucgaggagauggucgacaucgacgccuccagcgaggccuucaucaagcggaugaccaacaagugcacguaccugauccacgaggacgugauccccaagcacuccuucagcuacgccaaguucgaggugcugaacgagcucaacaagauccgccuggacggcaagcccaucgacaucccgcugaagaagcggaucuucgagggccucuuccuggagaagaccaaggucacccacaccucccugaagaaguggcucgcggaguacgagcacaugacggugagcgugguccaggggacccagaaggagaccgaguucgccaccucccugcaggccuuccaccgcuucgugaagaucuucgaccgggagacggucagcaaccccgccaacgaggagauguucgagaagaucaucuacugguccaccguguucgaggacaagaagaucaugcgccggaagcugagcgaguacccccagcucaccgagcagcagcagguccagcuggcccaggugcgcuuccggggcugggggcgccugucccagcggcucaucaaccgcaucaagacccccgugagcggcgacgaggaccacaagcuguccaucaacgagauccuguggcagaccaacgagaacuucaugcagaucauccggaacaaggacuaccucuucaagaagaucaucgaggagcaguucgagaacgagacggcgcugcugaacaagcagcgcaucgacgagcucgccaccagcccggccaacaagaaggggaucuggcaggccaucaagaucgugaaggagcuggagaagguccugcagcagcccgccgagaacaucuucaucgaguucgcgcgguccgacgaggagagcaagcgcagcacgccccgggacaaguucaucgagaaggccuacgcccagcucaagaaggagaccgacaccuucaaccuggagcaccugaaggagcucaagcagcgcuccaagcagcugagcucccagcggcuguuccucuacuucauccagaacggcaagugcauguacagcggcgagcaccuggacaucgagcgccuggacuccuacgagguggaccacauccucccccagagcuacaucaaggacaacuccaucgagaaccuggcccuggugaagaaggucgagaaccagcgcaagaaggacagccuccugcugaacuccagcaucaucaaccagaacuacucccggugggagcagcucaagaacgccgggcugaucggcgagaagaaguuccgcaaccugacccggaccaagaucaccgaccgcgacaaggagggguucaucgcgcggcagcucguggagacgcgccagaucaccaagcacgugacccagcugcugcagcaggaguacaaggacaccacgaaggucuucgccaucaaggccacccucgugagcgaccugcggcgcaaguucgaguucaucaagaaccggaacgugaacgacuaccaccacgcccaggacgcguuccuggucgccuuccucggcaccaacaucaccuccaacuacccgaagaucgagauggaguaccuguucaagggguaccagcacuaccugaacgaggugggcaagagcgccgccaagcccaaguucacguucaucguggagaaccucuccaagcagcaguacaacagcaccaccggcgaggucaaguggaaccccgagguggacaucgccaagcugaagcgcauccugaacuucaagcagugcaacaucgugcggaaggucgaggagcaguccggggcgcuguucaaggagaccaucuaccccguggaggagagcagcuccaagacgaucccgcugaagaagcaccuggacaccgccaucuacggcggguacaccgccgugaacuacgccagcuacgcccucauccaguucaagaagggccgcaagcugaagcgggagaucaucgggaucccccuggcgguccagacccgcaucgacaacuccgagacgagccuccagaccuacaucgccgagcagaucaaguccgagguggagauccugaacggccggauccugaaguaccagcucaucagcaacaacggcaaccgccuguacaucgccgggccccgggagcgccacaacgcccggcagcugaucguguccgacgaggccgcgaaggucaucuggcucaucagcaccaagcaggccguggaggccaccuuccugaagcacuacacgcuggagcaccucgaggccguguucgaggagcugauccgcaagcaggcggccgacuaccagaucuucgagaaccugaucaagaagaucgaggucaacaaggccuacuucuacuccugcaccuacaacgagaaggugaaggugaucgaggagcuccugaagaucacccaggccaacgccaccaacggcgaccugaagcuccugaagaugacgaaccgggaggggcgccugggcagcgucuccguggcgcucgacuucaagaucaucaaccagagcgugaccggccuguaccaguccaucgaggacuacaacaacuga

SEQ ID NO: 1820 - RNA, 4020 nt, Artificial Sequence
  Cas9 variant
augagccugaacaccaacaagaaguacaacaucggccucgacaucgggaccacguccgugggcugggccgucaccgacgccgacgggcagaagcugcugaaggcgaagaacaagaaccucuggggcgugagccuguucgaggccgggaagaccgccgccgagcgccggggcuaccgcuccacccggcgccggcugaaccaccgcaaguuccggcuccgccugcuggaggacauguucgagaaggagauccucagcaaggaccccuccuucuucauccggcugaaggaggccuuccugagcccgaaggacgagcagaagcaguucaagggcaacauccucuucaacgacaaggacuacacggacgcggacuacuacgagcaguacaagaccaucuaccaccuccgcuacgaccugaucucccagcaccggcaguucgacauccgcgagguguaccucgccauccaccaccugaucaaguaccgggggcacuucaucuacgaggaccagaccuucaccacggacggcaaccagcugcagcaccacaucaaggccaucaucaccaugaucaacagcauccucaaccgcaucaucauccccgagaccaucgacaucaacgucuucgagaagacccugcuggaccggacgaugaaccgcuccagcaaggugaaguuccucaucgagcugaccggggaggacaagcaggacaagccccugcucaaggagcuguucaaccugaucgugggccucaaggccaagcccgcguccaucuucgagcaggagaaccuggccaccaucgucgagaccaugaacaugagcacggagcagguccagcuggaccuccugacccuggccgacgugcucgccgacgaggaguacgaccugcugcucaccgcccagaagaucuacuccgcgaucauccuggacgagagcauggacggguacgaguacuucgccgaggccaagaaggaguccuaccggaagcaccaggaggagcuggugcucgugaagaagaugcucaagagcaacgccaucaccaacgacgagcgcgccaaguucgaguacuucuacacggacuacaucggcgcgaaguccagcaacuacgaggaguccaagaucaucaagaagggccugagcgccgccuacgggaaguacagcaaggaggagcggcuguucaagcacaucgagcugcugcucgccaaggagaacgugcugaccaccgucgagcacgaccugcucgagaagaacaucaccuucgccucccugcugccgcugcagcgcagcucccggaacgcggugauccccuaccaggugcacgagaaggagcucgucgccauccuggagaaccaggccacguacuaccccuuccugcucgagcagaaggacaacauccacaagcugcugaccuuccgcauccccuacuacgugggcccgcucgccgaccagaaggacagcgaguucgccuggauggugcgcaagcaggcggggaagaucacccccuucaacuucgaggagauggucgacaucgacgccuccagcgaggccuucaucaagcggaugaccaacaagugcacguaccugauccacgaggacgugauccccaagcacuccuucagcuacgccaaguucgaggugcugaacgagcucaacaagauccgccuggacggcaagcccaucgacaucccgcugaagaagcggaucuucgagggccucuuccuggagaagaccaaggucacccacaccucccugaagaaguggcucgcggagcacgagcacaugacggugagcgugguccaggggacccagaaggagaccgaguucgccaccucccugcaggccuuccaccgcuucgugaagaucuucgaccgggagacggucagcaaccccgccaacgaggagauguucgagaagaucaucuacugguccaccguguucgaggacaagaagaucaugcgccggaagcugagcgaguacccccagcucaccgagcagcagcagguccagcuggcccaggugcgcuuccggggcugggggcgccugucccagcggcucaucaaccgcaucaagacccccgugagcggcgacgaggaccacaagcuguccaucaacgagauccuguggcagaccaacgagaacuucaugcagaucauccggaacaaggacuaccucuucaagaagaucaucgaggagcaguucgagaacgagacggcgcugcugaacaagcagcgcaucgacgagcucgccaccagcccggccaacaagaaggggaucuggcaggccaucaagaucgugaaggagcuggagaagguccugcagcagcccgccgagaacaucuucaucgaguucgcgcgguccgacgaggagagcaagcgcagcacgccccgggacaaguucaucgagaaggccuacgcccagcucaagaaggagaccgacaccuucaaccuggagcaccugaaggagcucaagcagcgcuccaagcagcugagcucccagcggcuguuccucuacuucauccagaacggcaagugcauguacagcggcgagcaccuggacaucgagcgccuggacuccuacgagguggaccacauccucccccagagcuacaucaaggacaacuccaucgagaaccuggcccuggugaagaaggucgagaaccagcgcaagaaggacagccuccugcugaacuccagcaucaucaaccagaacuacucccggugggagcagcucaagaacgccgggcugaucggcgagaagaaguuccgcaaccugacccggaccaagaucaccgaccgcgacaaggagggguucaucgcgcggcagcucguggagacgcgccagaucaccaagcacgugacccagcugcugcagcaggaguacaaggacaccacgaaggucuucgccaucaaggccacccucgugagcgaccugcggcgcaaguucgaguucaucaagaaccggaacgugaacgacuaccaccacgcccaggacgcguuccuggucgccuuccucggcaccaacaucaccuccaacuacccgaagaucgagauggaguaccuguucaagggguaccagcacuaccugaacgaggugggcaagagcgccgccaagcccaaguucacguucaucguggagaaccucuccaagcagcaguacaacagcaccaccggcgaggucaaguggaaccccgagguggacaucgccaagcugaagcgcauccugaacuucaagcagugcaacaucgugcggaaggucgaggagcaguccggggcgcuguucaaggagaccaucuacagcguggaggagagcuccagcaagacgaucccccugaagaagcaccuggacaccgccaucuacggcggguacaccgccgugaacuacgccuccuacgcccucauccaguucaagaagggccgcaagcugaagcgggagaucaucgggaucccgcuggcgguccagacccgcaucgacaacagcgagacgucccuccagaccuacaucgccgagcagaucaagagcgagguggagauccugaacggccggauccugaaguaccagcucaucuccaacaacggcaaccgccuguacaucgccgggccccgggagcgccacaacgcccggcagcugaucgugagcgacgaggccgcgaaggucaucuggcucaucuccaccaagcaggccguggaggccaccuuccugaagcacuacacgcuggagcaccucgaggccguguucgaggagcugauccgcaagcaggcggccgacuaccagaucuucgagaaccugaucaagaagaucgaggucaacaaggccuacuucuacagcugcaccuacaacgagaaggugaaggugaucgaggagcuccugaagaucacccaggccaacgccaccaacggcgaccugaagcuccugaagaugacgaaccgggaggggcgccugggcuccgucagcguggcgcucgacuucaagaucaucaaccaguccgugaccggccuguaccagagcaucgaggacuacaacaacuga

SEQ ID NO: 1821 - RNA, 4020 nt, Artificial Sequence
  Cas9 variant
augaagaaggaguacaccaucggccuggacaucgggaccaacagcgugggcugguccguccucacggacgacuaccgccuggugagcaagaagaugaagguggccgggaacaccgagaaguccagcaccaagaagaacuucuggggcguccggcuguucgacgaggggcagaccgccgaggcgcgccgguccaagcgcacggcccggcgccggcucgcccgccggcgccagcggauccuggagcugcagaagaucuucgcccccgagauccucaagaucgacgagcacuucuucgcccgccugaacgagagcuuccuggugcucgacgagaagaagcagucccggcacccgguguucgcgaccaucaagcaggagaaguccuaccaccagaccuaccccaccaucuaccaccuccgccaggcccuggccgacagcagcgagaaggccgacauccggcucgucuaccuggcgauggcccaccuccugaaguaccgcggccacuuccugaucgagggcgagcugaacacggagaacuccagcgugaccgagaccuuccggcaguuccucuccaccuacaaccagcaguucagcgaggccgacgacaagcagacggagaagcuggacgaggccguggacugcuccuucgucuucaccgagaagaugagcaagaccaagaaggccgagacccugcucaaguacuucccccacgagaaguccaacggguaccugagccaguucaucaagcugauggugggcaaccaggggaacuucaagaacguguucggccucgaggaggcgaagcugcaguucuccaaggagacguacgaggaggaccuggaggagcuccuggagaagaucggggacgacuacaucgaccuguucguccaggccaagaacguguacgacgccgugcuccugagcgagauccugagcgacuccaccaagaacacccgcgccaagcucagcgccggcaugauccggcgcuacgacgcgcacaaggaggaccugguccugcucaagcgguucgugaaggagaaccugcccaagaaguaccgcgccuucuucggcgacaacuccgugaacggguacgccggcuacaucgaggggcacgccacccaggaggacuucuacaaguucgucaagaaggagcugacgggcauccgcggcagcgagguguuccucaccaagaucgagcaggagaacuuccugcggaagcagcgcaccuucgacaacggggugaucccgcaccagauccaccugaccgagcuccgggccaucaucgcgaaccagaagaagcacuaccccuuccugaaggaggagcaggagaagcuggagucccuccugacguucaagauccccuacuacgucggcccccuggccaagaagcaggagaacagcccguucgccuggcucauccgcaaguccgaggagaagaucaagcccuggaaccugcccgagaucguggacauggaggggagcgccgugcgguucaucgagcgcaugaucaacaccgacauguacaugccccacaacaagguccugccgaagaacucccugcucuaccagaaguucagcaucuacaacgagcugaccaaggugcgguaccaggacgagcgcggccagaugaacuacuucuccagcaucgagaagaaggagaucuuccacgagcuguucgagaagaaccggaaggucaccaagaaggaccuccaggaguuccuguaccugaaguacgacaucaagcacgccgagcucuccgggaucgagaaggcguucaacgccagcuacacgaccuaccacgacuuccugaccauguccgagaacaagcgcgagaugaagcaguggcuggaggaccccgagcucgccagcauguucgaggagaucaucaagacccugacgguguucgaggaccgggagaugaucaagacccgccugucccaccacgaggccacccucggcaagcacaucaucaagaagcugaccaagaagcacuacacgggcugggggcggcugagcaaggagcucauccagggcauccgcgacaagcaguccaacaagaccauccuggacuaccugaucaacgacgacgacuucccccaccaccggaaccgcaacuucaugcagcucaucaacgacgacagccugagcuucaagaaggagaucaagaaggcgcagaugaucaccgacaccgagaaccuggaggagaucgugaaggagcucaccgggucccccgccaucaagaagggcauccugcagagccugaagaucgucgacgagaucguggggaucaugggcuacgagccggccaacaucguggucgagauggcccgggagaaccagacgaccggccgcgggcucaaguccagccggccccgccugaaggcccuggaggagucccucaaggacuucggcagccagcugcugaaggaguaccccaccgacaacuccagccuccagaaggaccgccuguaccuguacuaccuccagaacgggcgggacauguacaccggcgcgccccuggacauccaccgccuguccgacuacgacaucgaccacaucaucccgcggagcuucacgaccgacaacuccaucgacaacaaggugcucgugagcuccaaggagaaccgccugaagaaggacgacguccccagcgagaagguggugaagaagaugcgguccuucugguacgaccuguacagcuccaagcucaucagcaagcgcaagcuggacaaccugaccaagaucaagcucaccgaggaggacaaggccggguucaucaagcggcagcuggucgagacgcgccagaucaccaagcacguggccggcauccugcaccaccgguucaacaaggccgaggacaccaacgagcccauccgcaaggugcggaucaucacccucaagagcgcccuggucucccaguuccgcaaccgguucggcaucuacaaggugcgcgagaucaacgaguaccaccacgcgcacgacgccuaccugaacgggguggucgcccucgcccugcugaagaaguacccccagcucgccccggaguucguguacggcgaguaccugaaguucaacgcgcacaaggccaacaaggccacggugaagaaggaguucuacagcaacaucaugaaguucuucgaguccgacacccccgucugcgacgagaacggggagaucuucugggacaagagcaaguccaucgcccaggugaagaaggugaucaaccaccaccacaugaacaucgucaagaagaccgagauccagaagggcggcuucagcaaggagaccguggagcccaagaaggacuccagcaagcugcucccccggaagaacaacugggacccggcgaaguacgggggccuggggucccccaacguggccuacacggucgccuucaccuacgagaagggcaaggcccgcaagcggaccaacgcccuggaggggaucaccaucauggagcgcgaggcguucgagcagagccccgugcuguuccugaagaacaagggcuacgagcaggccgagaucgagaugaagcugccgaaguacgcccucuucgagcuggagaacggccggaagcgcaugguggccuccaacaaggaggcccagaaggcgaacagcuuccugcuccccgagcaccuggucacgcugcucuaccacgccaagcaguacgacgagaucucccacaaggagagcuucgacuacgugaacgagcaccacaaggaguucuccgagguguucgcccggguccuggaguucgccgggaaguacacccuggccgagaagaacaucgagaagcucgagaagaucuacaaggagaaccagaccgacgaccuggcgaagcuggccagcuccuucgugaaccucaugcaguucaacgccaugggcgcccccgcggacuucaaguucuucgacgugaccaucccccgcaagcgcuacacgagccugaccgagaucuggcaguccaccaucauccaccagagcaucaccgggcuguacgagacgcggauccgcaugggcaaguga

SEQ ID NO: 1822 - RNA, 4023 nt, Artificial Sequence
  Cas9 variant
augaagaaggaguacaccaucggccuggacaucgggaccaacagcgugggcugguccguccucacggacgacuaccgccuggugagcaagaagaugaagguggccgggaacaccgagaaguccagcaccaagaagaacuucuggggcguccggcuguucgacgaggggcagaccgccgaggcgcgccgguccaagcgcacggcccggcgccggcucgcccgccggcgccagcggauccuggagcugcagaagaucuucgcccccgagauccucaagaucgacgagcacuucuucgcccgccugaacgagagcuuccuggugcucgacgagaagaagcagucccggcacccgguguucgcgaccaucaagcaggagaaguccuaccaccagaccuaccccaccaucuaccaccuccgccaggcccuggccgacagcagcgagaaggccgacauccggcucgucuaccuggcgauggcccaccuccugaaguaccgcggccacuuccugaucgagggcgagcugaacacggagaacuccagcgugaccgagaccuuccggcaguuccucuccaccuacaaccagcaguucagcgaggccgacgacaagcagacggagaagcuggacgaggccguggacugcuccuucgucuucaccgagaagaugagcaagaccaagaaggccgagacccugcucaaguacuucccccacgagaaguccaacggguaccugagccaguucaucaagcugauggugggcaaccaggggaacuucaagaacguguucggccucgaggaggaggcgaagcugcaguucuccaaggagacguacgaggaggaccuggaggagcuccuggagaagaucggggacgacuacaucgaccuguucguccaggccaagaacguguacgacgccgugcuccugagcgagauccugagcgacuccaccaagaacacccgcgccaagcucagcgccggcaugauccggcgcuacgacgcgcacaaggaggaccugguccugcucaagcgguucgugaaggagaaccugcccaagaaguaccgcgccuucuucggcgacaacuccgugaacggguacgccggcuacaucgaggggcacgccacccaggaggacuucuacaaguucgucaagaaggagcugacgggcauccgcggcagcgagguguuccucaccaagaucgagcaggagaacuuccugcggaagcagcgcaccuucgacaacggggugaucccgcaccagauccaccugaccgagcuccgggccaucaucgcgaaccagaagaagcacuaccccuuccugaaggaggagcaggagaagcuggagucccuccugacguucaagauccccuacuacgucggcccccuggccaagaagcaggagaacagcccguucgccuggcucauccgcaaguccgaggagaagaucaagcccuggaaccugcccgagaucguggacauggaggggagcgccgugcgguucaucgagcgcaugaucaacaccgacauguacaugccccacaacaagguccugccgaagaacucccugcucuaccagaaguucagcaucuacaacgagcugaccaaggugcgguaccaggacgagcgcggccagaugaacuacuucuccagcaucgagaagaaggagaucuuccacgagcuguucgagaagaaccggaaggucaccaagaaggaccuccaggaguuccuguaccugaaguacgacaucaagcacgccgagcucuccgggaucgagaaggcguucaacgccagcuacacgaccuaccacgacuuccugaccauguccgagaacaagcgcgagaugaagcaguggcuggaggaccccgagcucgccagcauguucgaggagaucaucaagacccugacgguguucgaggaccgggagaugaucaagacccgccugucccaccacgaggccacccucggcaagcacaucaucaagaagcugaccaagaagcacuacacgggcugggggcggcugagcaaggagcucauccagggcauccgcgacaagcaguccaacaagaccauccuggacuaccugaucaacgacgacgacuucccccaccaccggaaccgcaacuucaugcagcucaucaacgacgacagccugagcuucaagaaggagaucaagaaggcgcagaugaucaccgacaccgagaaccuggaggagaucgugaaggagcucaccgggucccccgccaucaagaagggcauccugcagagccugaagaucgucgacgagaucguggggaucaugggcuacgagccggccaacaucguggucgagauggcccgggagaaccagacgaccggccgcgggcucaaguccagccggccccgccugaaggcccuggaggagucccucaaggacuucggcagccagcugcugaaggaguaccccaccgacaacuccagccuccagaaggaccgccuguaccuguacuaccuccagaacgggcgggacauguacaccggcgcgccccuggacauccaccgccuguccgacuacgacaucgaccacaucaucccgcggagcuucacgaccgacaacuccaucgacaacaaggugcucgugagcuccaaggagaaccgccugaagaaggacgacguccccagcgagaagguggugaagaagaugcgguccuucugguacgaccuguacagcuccaagcucaucagcaagcgcaagcuggacaaccugaccaagaucaagcucaccgaggaggacaaggccggguucaucaagcggcagcuggucgagacgcgccagaucaccaagcacguggccggcauccugcaccaccgguucaacaaggccgaggacaccaacgagcccauccgcaaggugcggaucaucacccucaagagcgcccuggucucccaguuccgcaaccgguucggcaucuacaaggugcgcgagaucaacgaguaccaccacgcgcacgacgccuaccugaacgggguggucgcccucgcccugcugaagaaguacccccagcucgccccggaguucguguacggcgaguaccugaaguucaacgcgcacaaggccaacaaggccacggugaagaaggaguucuacagcaacaucaugaaguucuucgaguccgacacccccgucugcgacgagaacggggagaucuucugggacaagagcaaguccaucgcccaggugaagaaggugaucaaccaccaccacaugaacaucgucaagaagaccgagauccagaagggcggcuucagcaaggagaccguggagcccaagaaggacuccagcaagcugcucccccggaagaacaacugggacccggcgaaguacgggggccuggggucccccaacguggccuacacggucgccuucaccuacgagaagggcaaggcccgcaagcggaccaacgcccuggaggggaucaccaucauggagcgcgaggcguucgagcagagccccgugcuguuccugaagaacaagggcuacgagcaggccgagaucgagaugaagcugccgaaguacgcccucuucgagcuggagaacggccggaagcgcaugguggccuccaacaaggaggcccagaaggcgaacagcuuccugcuccccgagcaccuggucacgcugcucuaccacgccaagcaguacgacgagaucucccacaaggagagcuucgacuacgugaacgagcaccacaaggaguucuccgagguguucgcccggguccuggaguucgccgggaaguacacccuggccgagaagaacaucgagaagcucgagaagaucuacaaggagaaccagaccgacgaccuggcgaagcuggccagcuccuucgugaaccucaugcaguucaacgccaugggcgcccccgcggacuucaaguucuucgacgugaccaucccccgcaagcgcuacacgagccugaccgagaucuggcaguccaccaucauccaccagagcaucaccgggcuguacgagacgcggauccgcaugggcaaguga

SEQ ID NO: 1823 - RNA, 4023 nt, Artificial Sequence
  Cas9 variant
augaagaccgacuacuucaugggccuggacauggggaccggcagccucgggugggccgugacggacuccagcuaccaccugugccgcgcccacggcaaggaccuguggggcguccggcuguucgagaccgcgcagaccgccgaggagcgccggguguuccgcugcaaccggcgccggcuggaccgccggaagcgccggauccagcugcuccaggacaucuucgcccccgagaucuacaagaucgacccgggguucuuccugcgccugaaggagucccgguaccuccccgaggacaagaagaaccuggagggcaagacccccgagcugcccuacgcccucuucguggacaagaaguacacggacaaggacuuccacaaggaguacccgaccaucuaccaccuccgccugcggcucaugcaggaccgcacccccgccgacguccggcugguguaccuggcgcuccaccaccugaucaagcaccgcgggcacuuccuguucgccggcaucgaggccgacaaggugaccgacuucagcgccgcguucuccgaguuccuccggaucguccaggagcaggagcuggacaucagcuucacgcccgacgaggaguccagccagaucaucaaggagacccugcagaacaccaacuucacccgcuccaagaaguccacggagcucaucaaggggcugaaggccagcaccggcugcgagaaggcccugcucaagcugaucagcgggugcaaggugaagcuguccgccguguucgacgaccccggcugcgacgccuacgagaagccgcaggucugcuucgcggagagcuccuacgaggacuacgccgccauccucgaggacgagcuggaggaccgguucaucgugaucgccgccgcgaaggcccuguacgacuggagcgugcucgucaacauccugggcgaggccuccaccgugagcgaggccaagguggggaucuacgagaagcaccgccgcgaccugaaguaccucaagcaccuggucaagaccaaccugacgcgggaggacuaccaggaccucuucgugaaggccggcgcgaagaagaacaacuacugcgccuacaucgggaugaccaagaagaacaacaagaaggugguccuggaggagaagcgcugcaccaaggaggacuucuacgccuaccugaagaaggagaucuacuccaaggugcaggagaaccccgaggccgaguaccuccuggaggagcuggagaagggcaccuuccucccccgccaggugagcaaggacaacggcgucauccccuaccagcugcaguuccuggagcuccagaagauccugaagaacgccguggaguaccugccguuccugaaggaggagagcgagaagauccagcagaucaugacguuccggauccccuacuacguggggccccucaacggcaagaaggaggggcagaacaccuucgcgugggccguccggaagaacaacgagcccguguacccguggaacuucgaggaggucaucgacaccgaggccuccgccgagcaguucauccgccggaugaccaacaagugcacguaccugcccggcgaggacgugcugcccaaggagagccuccuguacuccaaguucauggugcugaacgagcucaacaaccugcgcaucaacgggaccaagaucagcgucgagcugaagcaggagcucuacgagaagcuguuccagcgguaccgcaagguguccgcgaagaagcugcgggacuaccucgugcgcaacggcaucaccgagaaggacgccgagaucagcggcaucgacggggacuucaagggcacccugcgggccuaccacgacuucaaggagaagcugacgggggucgagcucaccgaggccgagaaggagaccaucauccugaacaucacccuguucggcgaggacaaggugcuccugaagaagcgcaugcagcggcugcuccccaaccugacggaggggcagaagaaggccaucgugacccugaacuacuccggcuggggccgccucagccgggaguuccuggaggagguccaggcgccgaaccccgaguccggggagauccugagcaucauccgcgcccucugggagaccaacgccaaccugaugcagcugcucuccaaccaguacggcuaccaggagauccuggagcagaugcgggccgacuggaccgggcacaagcuggacuaccagacgguggaggagcucuacgugagccccgccgucaagcgccagaucuggcagacccuccagguggugaaggagcugaagaaggucaugggcggggagcccaagcgcguguuccucgagguggcgcgggagaagauggaguccggccgcaccgucagccggaagaagcaccugaaggaccuguaccucuccugcaagagcgaggagcgcaacuggcuggccgagcuggaccggcacgaggagcacuccuaccgcagcgaccggcuguuccuguacuacacccagaagggccgcugcauguacugcgggaagccgaucgaccugggccaccucugggacgugaacauguacgacaucgaccacaucuacccccaguccaaggugauggacgacagcauccggaaccgcguccugaccugccggacgugcaacgccgagaagaccgaccacuacccccugaaggccgagauccgccagaagaugcggcccuucugggacagccucaaggccgggaacuucaucgaggaggagaaguggaagcgccugauccgguccgaggaguucaccagcaccgagcuggcgggcuucaucgagcgccagcucguggagacgcggcaguccaccaaggccguggccgacauccugaagcaggccaugccggagaccgagaucgucuacgugaaggcgaagaacgugagcgccuuccgccaggacuucaacuucgucaagaaccgggacgugaacgacuuccaccacgccaaggacgccuaccugaacaucguggucggcaacaccuacuucgugaaguucacgaagaacgccuccugguucaucgagcgcaaccccgggcggagcuacaaccucaagcgcauguucaccuccgacuacgacgugaugagcaacggcgagaucgcguggaaggccgggaacuccggcaccaucaccacgguccgcaagaugaugaagaagaacagcgugcuguucacccggcgcuccuucgaggugagcgggggccuguucgaccagcagcucaugaagaagggcaaggggcaggucuacgugaaguccggcgacgagcggcugcgcagcaucgagaaguacgggggcuacaacaaggccaccggggccuacuucaugcugguggaguccgagggcaagaagggcgucaagaagcggaccaucgaguucgugccccucuaccgcaaggccgagcuggaggcgagcgaggagaagaugcuggaguaccuccggacggagaucgggcugaaggagccgcacgugcugcuccacaagaucaagaccgacacccuguuccaggccgacggcuucaagaugcaccuguccgggcgcaccggcaagcagcucgucuucaagggggccaaccaguuccugguggccgaggacuacgagcggcugcucaagaaggugggcaaggucacggagcagcugaagaccaacaagaacuacaagaucaacgacuacgacggcaucaccgaggaggggcugaaggcccucuacagcgaguuccugagcaagcugcagaaggcgcccuacggcaaccgccucgggacccaggccgagacgcuggagaacggcaaggagaaguucgacaagcugucccucgagaacaagugccaggugcugagcgagauccugcaccucuuccagugcaacuccagcgccgccgaccuguccaagcucgggggccccggccacgggggcauccuggugcugagcaacgagaucaccaagugcaacaagaucuccaucauccaccagagccccgcggggaucuacgagcaggagaucgaccugaagacccucuga

SEQ ID NO: 1824 - RNA, 4023 nt, Artificial Sequence
  Cas9 variant
auggagcaggaguacuaccugggccucgacauggggaccggcagcguggggugggccgucaccgacuccgaguaccacgugcugcgcaagcacggcaaggcccuguggggcgugcgccucuucgagagcgcguccacggccgaggagcggcggauguuccgcaccagccggcgccggcuggaccgccggaacuggcgcaucgagauccugcaggagaucuucgccgaggagaucuccaagaaggaccccggguucuuccuccggaugaaggagagcaaguacuacccggaggacaagcgcgacaucaacggcaacugccccgagcugcccuacgcccuguucgucgacgacgacuucaccgacaaggacuaccacaagaaguuccccaccaucuaccaccuccggaagaugcugaugaacacggaggagaccccggacauccgccugguguaccucgccauccaccacaugaugaagcaccgggggcacuuccugcuguccggcgacaucaacgagaucaaggaguucgggaccaccuucagcaagcuccuggagaacaucaagaacgaggagcuggacuggaaccucgagcugggcaaggaggaguacgcgguggucgaguccauccugaaggacaacaugcucaaccgcagcacgaagaagacccggcugaucaaggcccugaaggccaaguccaucugcgagaaggccgugcucaaccugcuggccgggggcaccgugaagcucagcgacaucuucggccuggaggagcugaacgagaccgagcgccccaagaucuccuucgcggacaacggguacgacgacuacaucggcgaggucgagaacgagcucggggagcaguucuacaucaucgagacggccaaggccguguacgacugggccgugcuggucgagauccugggcaaguacaccagcaucuccgaggcgaagguggccaccuacgagaagcacaagagcgaccuccaguuccugaagaagaucgugcggaaguaccugaccaaggaggaguacaaggacaucuucgucuccacgagcgacaagcucaagaacuacuccgccuacaucggcaugaccaagaucaacgggaagaagguggaccugcagagcaagcgcugcagcaaggaggaguucuacgacuucaucaagaagaacgugcugaagaagcucgagggccagcccgaguacgaguaccugaaggaggagcuggagcgggagaccuuccuccccaagcaggucaaccgcgacaacggggugaucccguaccagauccaccuguacgagcugaagaagauccucggcaaccugcgcgacaagaucgaccugaucaaggagaacgaggacaagcucgugcagcuguucgaguuccggauccccuacuacgucgggccccugaacaagaucgacgacggcaaggagggcaaguucaccugggccgugcgcaaguccaacgagaagaucuaccccuggaacuucgagaacguggucgacaucgaggccagcgcggagaaguucauccggcgcaugacgaacaagugcaccuaccugaugggggaggacgugcucccgaaggacucccugcuguacagcaaguacaugguccucaacgagcugaacaacgugaagcuggacggcgagaagcucuccguggagcugaagcagcggcuguacaccgacgucuucugcaaguaccgcaaggugaccgugaagaagaucaagaacuaccucaagugcgaggggaucaucagcggcaacgucgagaucacggggaucgacggcgacuucaaggccucccugaccgccuaccacgacuucaaggagauccugaccggcaccgagcucgccaagaaggacaaggagaacaucaucacgaacaucgugcuguucggggacgacaagaagcugcucaagaagcggcugaaccgccuguacccccagaucacccccaaccagcucaagaagaucugcgcccugagcuacaccggcugggggcgguucuccaagaaguuccuggaggagaucaccgcgcccgacccggagacgggcgagguguggaacaucaucaccgcccucugggagagcaacaacaaccugaugcagcugcucuccaacgaguaccgcuucauggaggaggucgagaccuacaacauggggaagcagaccaagacgcugagcuacgagaccguggagaacauguacgugucccccagcgucaagcggcagaucuggcagacccugaagaucgugaaggagcucgagaaggugaugaaggagucccccaagcgcgucuucaucgagauggcccgggagaagcaggagagcaagcgcaccgagucccggaagaagcagcugaucgaccuguacaaggccugcaagaacgaggagaaggacugggugaaggagcucggcgaccaggaggagcagaagcugcgcagcgacaagcuguaccucuacuacacccagaagggccggugcauguacuccggggaggugaucgagcugaaggaccugugggacaacacgaaguacgacaucgaccacaucuacccccagagcaagaccauggacgacagccucaacaaccgcguccuggugaagaagaaguacaacgccaccaaguccgacaaguacccgcugaacgagaacauccggcacgagcgcaagggcuucuggaagucccuccuggacgggggcuucaucagcaaggagaaguacgagcgccugauccggaacaccgagcucagccccgaggagcuggcgggcuucaucgagcgccagaucguggagacgcggcaguccaccaaggccgucgccgagauccugaagcaggucuuccccgagagcgagaucguguacgugaaggccgggaccgugucccgcuuccggaaggacuucgagcuccugaaggugcgcgaggucaacgaccugcaccacgcgaaggacgccuaccucaacaucguggugggcaacagcuacuacgucaaguucaccaagaacgccuccugguucaucaaggagaaccccgggcggacguacaaccugaagaagauguucaccagcggcuggaacaucgagcgcaacggggagguggccugggaggugggcaagaagggcaccaucgucaccgugaagcagaucaugaacaagaacaacauccuggugacgcggcagguccacgaggccaagggcggccucuucgaccagcagaucaugaagaaggggaaggggcagaucgcgaucaaggagaccgacgagcgccuggccuccaucgagaaguacgggggcuacaacaaggccgccggcgccuacuucaugcugguggagagcaaggacaagaaggggaagaccauccggaccaucgaguucaucccgcucuaccugaagaacaagaucgaguccgacgagagcaucgcgcugaacuuccucgagaagggccgcgggcugaaggagcccaagauccugcucaagaagaucaagaucgacacgcuguucgacguggacggcuucaagauguggcuguccgggcggaccggcgaccgccuccuguucaagugcgccaaccagcugauccucgacgagaagaucaucgucaccaugaagaagaucgugaaguucauccagcggcgccaggagaaccgggagcugaagcugagcgacaaggacggcaucgacaacgaggugcucauggagaucuacaacaccuucgucgacaagcuggagaacacgguguaccgcauccggcuguccgagcaggccaagacccucaucgacaagcagaaggaguucgagcgccugagccuggaggacaagagcuccacccucuucgagauccugcacaucuuccagugccagagcuccgccgccaaccugaagaugaucgggggccccgggaaggcgggcauccucgugaugaacaacaacaucagcaagugcaacaagaucuccaucaucaaccagagccccaccgggaucuucgagaacgagaucgaccugcugaagaucuga

SEQ ID NO: 1825 - RNA, 4023 nt, Artificial Sequence
  Cas9 variant
augggcgaggaguacuuccuggggcucgacaugggcaccgggagccugggcugggccgugaccgacgacaaguaccagauccugcgccggcacgggaacgcccucuggggcguccgccuguucgagacggcgaacaccgccgaggagcggcgcauguuccggaccaaccgccggcgccuggaccggcagggcuggcgcaucaagauccuccaggagcuguucgccgaggagaucugccggguggaccccggguucuaccugcgcaugaaggaguccaaguacuacccggaggacaagcgggacgccaacggcgagugccccgcccuccccuacgcgcuguucgccgacgcccaguacaccgacaaggacuaccaccgcgaguuccccacgaucuaccaccuccggaagaugcugauggagaccgagaccaccccggacauccgccugguguaccuggccuuccaccacaugaugaagcaccgggggcacuuccuccugagcggcgacaucucccaggucacggaguuccgcaacaccuuccugcagaugaucgcgaacaucaagagcgaggagcucgacuucucccuggagaucgaggagacccagauggggcagaucgaggccgugcugaaggaccacaagcucacccggagcgagaagaagcgccggcugacgcagauccugaagcccgccaccgccugcgagaaggccaucuucacccuccuguccggcggcaccgugaagcugagcgacaucuucgggaaggcggagcucgacgagggcgagcgccccaagaucuccuucgccgacaacggguacgacgacuacagcgccuccgucgaggccgaccugggcgagcaguacuacaucaucgagagcgccaaggcgguguacgacugguccgugcugagcgacauccucggcgacuccgucagcaucuccgacgccaaggugaagcuguacgagaagcacaagaaggaccuggccuaccucaagaaggugguccgcgagaaccugccccgggagguguacaaccagguguucgucaacacggacgagaagcugugcaacuacugcgccuacaucgggauggccaagaagaacggccgcaagguggcgcucgaggggaagcggugcacccgcgaggaguucgagagcuuccugcggaagaagaucgugaacaagaucgaggacaaggagauccaggaguaccuguccgaggagaucgagaagggcaccuuccucccgcgccaggucaccaaggacaacggggugauccccuaccagauccaccuguacgagcugcggaagaucaucgacaaccucagcccccgcaugcccuucauccgggacaacggcgacaagaucauccagcuguucacguuccgcaucccguacuacgugggcccccuggggaagggcgaggggagcgagaaguucuccugggccguccggcgcaccgacgaggccaucuaccccuggaacuucaaggacgugaucgacguggaggccagcgccgagaaguucaucugccggaugaccaacaagugcaccuaccucuacggcgaggacguccugcccaaggacuccccgcuguacagcaaguucauggugcucaacgagcugaacaaccugaagcuggacgggcaguccgucagcguggagcucaagcagcgcaucuaccaggagcuguucugccacacgcggaaggugacccagaagaagcuggucuccuaccucgugcgcgagggcaucaccggcaagaacguggagaucagcgggaucgacggcgacuucaaggcgucccugaccgccuaccacgacuucaaggagaagcugacgggggucgagcucagccagcaggagcaggaggagaucgugcggaacaucgugcuguucggcgaggacaagaagcugcucaagcagcgccuggaggggcgguucccccagcugacccagaagcagaucuccgucaucgccacccucagcuacaagggcuggggccgccugucccgcgaguuccuggagaacaucaccgugcccgcccccgggacgggcgagguguggaacaucaucaccgcgcucugggagaccaacgacaaccugaugcagcugcucuacggggaguacggcuuccagaccgagaucgagugcuucaacgccaaggagaagaagaagucccugagcuacgagacgaucgaggagagcuacgucuccccgagcgugaagcggcagaucuggcagacccuccagguggucaaggagcugaagaaggugaugcgcggcgaccccaagcggguguucaucgagauggcccgcgagaaccaggaguccaagcggaccgagagccgcaagaagacccugcuggaccucuacaagaacugcaagaaggaggagcccgaguggaucgccgagcugaccgagcaccuggagaagcucgacgacagccagcugcggaaggacaagcuguuccucuacuacacgcagaaggggcgcugcauguacuccggcgagcggaucgagcuggaggaccugugggacaacacccgcuacgacaucgaccacaucuacccccagagcaagaccauggacgacuccgucgacaaccgggugcucgugaagaaggaguacaacgccaagaagaccgacgucuacccgaucgcggccgacauccgcgggaagaugagccccuucuggaagaagcugcuggacaacaagcucaucuccaagaagaaguacgaccggcuggugcgcacggaggagcugacccccgaggagcucgccggcuucaucgaccggcagcugguggagacccgccagagcaccaaggucguggccgagauccugaaggaggccuuccccgacacggagaucguguacgucaaggcggggaacguguccaacuuccggcacauguucgacaucgugaagguccgcgagcucaacgaccugcaccacgccaaggacgccuaccugaacaucguggugggcaacgccuacuacgucaaguucaacaagaacgccgcgugguucaucaaggagaacccgggccggagcuacaaccucaagcgcauguucgacuacgacauccggcgcaacaacgagguggccuggcuggccggguccaccggcaccaucagccaggugaagaacauggucuccaagaaccacauccuggugacccgcaagagcuacgaggugaccgggggccucuucgaccagcagcugaugaagaaggggaagggccagguccccgugaagacguccgacgagcggcugggcaacaucgagaaguacgggggcuacaacaaggccagcggggcguacuucaugcucgugaaguccaagaacaagaagggcgaggagcagcgcaccaucgaguacguccccaucuaccugaagcacuacaucgaggagagcaaggagaacgcccuggacuaccucaagaacgagcggaagcugaacgagccggagauccugcucgacaagaucaagaaggacacccuguuccgcgugaacggguucuacaugugccuguccaagcggacgggcaagcagcucgccuucaagggcgccaacgagcugcugcuccccgagcccgagacccugcugcucaagaagaucaccaaguacauccagcgccggaaggagaacaaggaccugaagcugaccaagcaggacaacaucacggagaaggagcuccuggagcuguacgacguguucaccgagaagcucaaccacagcgucuacgccgugugccuggggacccagggcaagacccuggugcagaagaagcccgcguucgucgcccucccgguggaggagaagugcaucgugcugagcgagauccugcaccucuuccagugccaguccgggagcgccaaccugaagcugaucggcgggcccgccuccgccggcauccucuaccugaacagcaacaucuccgacgcgggcgagauccugaucaucaaccagagccccuccgggaucuucgagaagcgcaucgaccuccugcggcuguga

SEQ ID NO: 1826 - RNA, 4023 nt, Artificial Sequence
  Cas9 variant
augaagaaggaguacaccaucggccuggacaucgggaccaacagcgugggcugguccguccucacggacgacuaccgccuggugagcaagaagaugaagguggccgggaacaccgagaaguccagcaccaagaagaacuucuggggcguccggcuguucgacgaggggcagaccgccgaggcgcgccgguccaagcgcacggcccggcgccggcucgcccgccggcgccagcggauccuggagcugcagaagaucuucgcccccgagauccucaagaucgacgagcacuucuucgcccgccugaacgagagcuuccuggugccggacgagaagaagcagucccggcaccccguguucgcgaccaucaagcaggagaaguccuaccaccagaccuaccccaccaucuaccaccuccgccaggcccuggccgacagcagcgagaaggccgacauccggcuggucuaccucgcgauggcccaccuccugaaguaccgcggccacuuccugaucgagggcgagcugaacacggagaacuccagcgugaccgagaccuuccggcaguuccuguccaccuacaaccagcaguucagcgaggccggggacaagcagacggagaagcucgacgaggccguggacugcuccuucgucuucaccgagaagaugagcaagaccaagaaggccgagacccugcugaaguacuucccccacgagaaguccaacggcuaccucagccaguucaucaagcugaugguggggaaccagggcaacuucaagaacguguucgggcuggaggaggaggcgaagcuccaguucuccaaggagacguacgaggaggaccuggaggagcugcucgagaagaucggcgacgacuacaucgaccuguucguccaggccaagaacguguacgacgccgugcugcucagcgagauccugagcgacuccaccaagaacacccgcgccaagcugagcgccggcaugauccggcgcuacgacgcgcacaaggaggaccucguccugcugaagcgguucgugaaggagaaccucccgaagaaguaccgcgccuucuucggggacaacuccgugaacggcuacgccggguacaucgagggccacgccacccaggaggccuucuacaaguucgucaagaaggagcugacgggcauccgcgggagcgagguguuccugaccaagaucgagcaggagaacuuccuccggaagcagcgcaccuucgacaacggcgugaucccccaccagauccaccuguccgagcugcgggcgaucaucgccaaccagaagaagcacuaccccuuccucaaggaggagcaggagaagcuggagagccugcucaccuucaagauccccuacuacgucgggccgcuggccaagaagcaggagaacucccccuucgccuggcugauccgcaagagcgaggagaagaucaagcccuggaaccuccccgagaucguggacauggagggcuccgccgugcgguucaucgagcgcaugaucaacacggacauguacaugccgcacaacaagguccugcccaagaacagccugcuguaccagaaguucuccaucuacaacgagcucaccaaggugcgguaccaggacgagcgcgggcagaugaacuacuucagcuccaucgagaagaaggagaucuuccacgagcuguucgagaagaaccggaaggucaccaagaaggaccugcaggaguuccucuaccugaaguacgacaucaagcacgcggagcugagcggcaucgagaaggccuucaacgccuccuacaccacguaccacgacuuccucaccaugagcgagaacaagcgcgagaugaagcaguggcuggaggaccccgagcuggccuccauguucgaggagaucaucaagacccucaccguguucgaggaccgggagaugaucaagacgcgccugagccaccacgaggcgacccugggcaagcacaucaucaagaagcucaccaagaagcacuacaccggguggggccggcuguccaaggagcugauccaggggauccgcgacaagcagagcaacaagacgauccucgacuaccugaucaacgacgacgacuucccccaccaccggaaccgcaacuucaugcagcugaucaacgacgacagccucuccuucaagaaggagaucaagaaggcccagaugaucaccgacaccgagaaccuggaggagaucgugaaggagcugaccggcagcccggccaucaagaaggggauccuccagucccugaagaucgucgacgagaucgugggcaucaugggcuacgagcccgccaacaucguggucgagauggcccgggagaaccagaccacggggcgcggccucaagagcucccggccccgccugaaggcgcuggaggagagccugaaggacuucgggucccagcuccugaaggaguaccccaccgacaacagcucccugcagaaggaccgccucuaccuguacuaccugcagaacggccgggacauguacaccggggccccgcucgacauccaccgccugagcgacuacgacaucgaccacaucaucccccgguccuucaccacggacaacagcaucgacaacaaggugcugguguccagcaaggagaaccgccucaagaaggacgacguccccuccgagaagguggugaagaagaugcggagcuucugguacgaccuguacuccagcaagcugaucagcaagcgcaagcucgacaaccugaccaagaucaagcugaccgaggaggacaaggccggcuucaucaagcggcagcucgucgagacccgccagaucacgaagcacguggccggcauccugcaccaccgguucaacaaggccgaggacaccaacgaccccauccgcaaggugcggaucaucacccugaaguccgcgcucgucagccaguuccgcaaccgguucgggaucuacaaggugcgcgagaucaacgaguaccaccacgcccacgacgccuaccugaacggcguggucgcccuggcccuccugaagaaguacccgcagcuggcgcccgaguucguguacggggaguaccucaaguucaacgcccacaaggccaacaaggccaccgugaagaaggaguucuacuccaacaucaugaaguucuucgagagcgacacgcccgucugcgacgagaacggcgagaucuucugggacaaguccaagagcaucgcccaggugaagaaggugaucaaccaccaccacaugaacaucgucaagaagaccgagauccagaagggcggguucuccaaggagaccguggagcccaagaaggacagcuccaagcugcugccgcggaagaacaacugggaccccgcgaaguacggcgggcucggcagccccaacguggccuacaccgucgccuucacguacgagaaggggaaggcccgcaagcggaccaacgcgcuggagggcaucaccaucauggagcgcgaggccuucgagcaguccccggugcuguuccucaagaacaagggcuacgagcaggccgagaucgagaugaagcugcccaaguacgcccuguucgagcucgagaacgggcggaagcgcaugguggccagcaacaaggaggcgcagaaggccaacuccuuccugcugcccgagcaccucgucacccugcuguaccacgccaagcaguacgacgagaucagccacaaggaguccuucgacuacgugaacgagcaccacaaggaguucagcgagguguucgcccggguccucgaguucgccggcaaguacacgcuggcggagaagaacaucgagaagcuggagaagaucuacaaggagaaccagaccgacgaccucgccaagcuggccuccagcuucgugaaccugaugcaguucaacgccaugggggcgcccgccgacuucaaguucuucgacgugaccaucccgcgcaagcgcuacaccucccucacggagaucuggcagagcaccaucauccaccagagcaucaccggccuguacgagacccggauccgcauggggaaguga

SEQ ID NO: 1827 - RNA, 4023 nt, Artificial Sequence
  Cas9 variant
auggagcaggaguacuaccugggccucgacauggggaccggcagcguggggugggccgucaccgacuccgaguaccacgugcugcgcaagcacggcaaggcccuguggggcgugcgccucuucgagagcgcguccacggccgaggagcggcggauguuccgcaccagccggcgccggcuggaccgccggaacuggcgcaucgagauccugcaggagaucuucgccgaggagaucuccaagaaggaccccggguucuuccuccggaugaaggagagcaaguacuacccggaggacaagcgcgacaucaacggcaacugccccgagcugcccuacgcccuguucgucgacgacgacuucaccgacaaggacuaccacaagaaguuccccaccaucuaccaccuccggaagaugcugaugaacacggaggagaccccggacauccgccugguguaccucgccauccaccacaugaugaagcaccgggggcacuuccugcuguccggcgacaucaacgagaucaaggaguucgggaccaccuucagcaagcuccuggagaacaucaagaacgaggagcuggacuggaaccucgagcugggcaaggaggaguacgcgguggucgaguccauccugaaggacaacaugcucaaccgcagcacgaagaagacccggcugaucaaggcccugaaggccaaguccaucugcgagaaggccgugcucaaccugcuggccgggggcaccgugaagcucagcgacaucuucggccuggaggagcugaacgagaccgagcgccccaagaucuccuucgcggacaacggguacgacgacuacaucggcgaggucgagaacgagcucggggagcaguucuacaucaucgagacggccaaggccguguacgacugggccgugcuggucgagauccugggcaaguacaccagcaucuccgaggcgaagguggccaccuacgagaagcacaagagcgaccuccaguuccugaagaagaucgugcggaaguaccugaccaaggaggaguacaaggacaucuucgucuccacgagcgacaagcucaagaacuacuccgccuacaucggcaugaccaagaucaacgggaagaagguggaccugcagagcaagcgcugcagcaaggaggaguucuacgacuucaucaagaagaacgugcugaagaagcucgagggccagcccgaguacgaguaccugaaggaggagcuggagcgggagaccuuccuccccaagcaggucaaccgcgacaacggggugaucccguaccagauccaccuguacgagcugaagaagauccucggcaaccugcgcgacaagaucgaccugaucaaggagaacgaggacaagcucgugcagcuguucgaguuccggauccccuacuacgucgggccccugaacaagaucgacgacggcaaggagggcaaguucaccugggccgugcgcaaguccaacgagaagaucuaccccuggaacuucgagaacguggucgacaucgaggccagcgcggagaaguucauccggcgcaugacgaacaagugcaccuaccugaugggggaggacgugcucccgaaggacucccugcuguacagcaaguacaugguccucaacgagcugaacaacgugaagcuggacggcgagaagcucuccguggagcugaagcagcggcuguacaccgacgucuucugcaaguaccgcaaggugaccgugaagaagaucaagaacuaccucaagugcgaggggaucaucagcggcaacgucgagaucacggggaucgacggcgacuucaaggccucccugaccgccuaccacgacuucaaggagauccugaccggcaccgagcucgccaagaaggacaaggagaacaucaucacgaacaucgugcuguucggggacgacaagaagcugcucaagaagcggcugaaccgccuguacccccagaucacccccaaccagcucaagaagaucugcgcccugagcuacaccggcugggggcgguucuccaagaaguuccuggaggagaucaccgcgcccgacccggagacgggcgagguguggaacaucaucaccgcccucugggagagcaacaacaaccugaugcagcugcucuccaacgaguaccgcuucauggaggaggucgagaccuacaacauggggaagcagaccaagacgcugagcuacgagaccguggagaacauguacgugucccccagcgucaagcggcagaucuggcagacccugaagaucgugaaggagcucgagaaggugaugaaggagucccccaagcgcgucuucaucgagauggcccgggagaagcaggagagcaagcgcaccgagucccggaagaagcagcugaucgaccuguacaaggccugcaagaacgaggagaaggacugggugaaggagcucggcgaccaggaggagcagaagcugcgcagcgacaagcuguaccucuacuacacccagaagggccggugcauguacuccggggaggugaucgagcugaaggaccugugggacaacacgaaguacgacaucgaccacaucuacccccagagcaagaccauggacgacagccucaacaaccgcguccuggugaagaagaaguacaacgccaucaaguccgacaaguacccgcugaacgagaacauccggcacgagcgcaagggcuucuggaagucccuccuggacgggggcuucaucagcaaggagaaguacgagcgccugauccggaacaccgagcucagccccgaggagcuggcgggcuucaucgagcgccagaucguggagacccggcaguccacgaaggccgucgccgagauccugaagcaggucuuccccgagagcgagaucguguacgugaaggccgggaccgugucccgcuuccggaaggacuucgagcuccugaaggugcgcgaggucaacgaccugcaccacgcgaaggacgccuaccucaacaucguggugggcaacagcuacuacgucaaguucaccaagaacgccuccugguucaucaaggagaaccccgggcggaccuacaaccugaagaagauguucacgagcggcuggaacaucgagcgcaacggggagguggccugggaggugggcaagaagggcaccaucgucaccgugaagcagaucaugaacaagaacaacauccuggugacccggcagguccacgaggccaagggcggccucuucgaccagcagaucaugaagaaggggaaggggcagaucgcgaucaaggagacggacgagcgccuggccuccaucgagaaguacgggggcuacaacaaggccgccggcgccuacuucaugcugguggagagcaaggacaagaaggggaagaccauccggaccaucgaguucaucccgcucuaccugaagaacaagaucgaguccgacgagagcaucgcgcugaacuuccucgagaagggccgcgggcugaaggagcccaagauccugcucaagaagaucaagaucgacacccuguucgacguggacggcuucaagauguggcuguccgggcggacgggcgaccgccuccuguucaagugcgccaaccagcugauccucgacgagaagaucaucgucaccaugaagaagaucgugaaguucauccagcggcgccaggagaaccgggagcugaagcugagcgacaaggacggcaucgacaacgaggugcucauggagaucuacaacaccuucgucgacaagcuggagaacaccguguaccgcauccggcuguccgagcaggccaagacgcucaucgaccgccagaaggaguucgagcggcugagccuggaggacaagagcuccacccucuucgagauccugcacaucuuccagugccagagcuccgccgccaaccugaagaugaucgggggccccgggaaggcgggcauccucgugaugaacaacaacaucagcaagugcaacaagaucuccaucaucaaccagagccccaccgggaucuucgagaacgagaucgaccugcugaagaucuga

SEQ ID NO: 1828 - RNA, 4026 nt, Artificial Sequence
  Cas9 variant
augcgcuuccagaacaagaagaccggcgacuacuucguggggcuggacaucggcaccaacagcgucgggugggccgugacgaacgagaaguacgagauccuccgggccaagaaccaccgcauguggggcucccggcuguucgaggaggggaagaccgcggaggagcgccgggugcaccgcgccggccggcgccggcugaaccgccggaacgaccgccucaugauccuggaggaccuguucgccgaggagaucagcaaggucgacaaggccuucuaccagcggcuccacgagucccaguaccgccaggagcacaagaccgugagcggccccuacuuccuguucaacgacaaggaguucaccgacgaggacuaccacaucgacuacccgacgaucuaccaccuccggguggcccugaugaaggcgcccgccaaggacguccgccugcuguuccucgccauccaccacaucaucaaguaccgggggaacuuccugcacgagggcgagaccuucaagaccaccgggggccugacggacauccuccagcgcgugcuggccugcaacgaguucuccgggcugaagcagcacaucgacgacaccgcgcucgugaagcugcugaccaacaagggcaucacccggagcgacaucgccaagcagaucuccgagcucgccacggacaagcuguaccgcaagcaggccaaggccuucgcgagccugguccucggccugaaggccaaccuggacgaccucuucaacgagcccgaguacaaggagcuggacuccgagauccggaccguggaguucagcgggaaggaguacugggaggagcgcgacaaguacgagcccuaccugggcgagucccucuucgcccuggacgggugcaagacccuguacgacacccuccugcugagcaacaucaagccggacggcaaguaccucuccgaggccaagguggagacguucgagaagcaccacgagcaccuggagagccugaaggaccuccugaaguccaacaaggcccuguacaaccgcguccuccgggacgacgagaagaaccugaacaacuacaucaccuacaucggcaagagcgaguucaacaagcgcugcucccgggacgaguucuacaaguuccugaagcagaccaucaaggacaucagcgacaacgagaacaaggcggagaucgugcagcucauggagcuggacuccuuccugccccuccugcgcgugcgggagaacggggucauccccuaccagauccacgaggaggagcuggagcagauccugaacgugagcagcgagaaguaccccuuccucaacaaggccgacggcuccggguucaccaucgcccagaagauccugaagcugcucacguuccgcaucccguacuucgugggcccccugaaccccgcccacaaggaccgggacaacggguucgccugggucgugcgcaaggcgcccggcaagguguacccguggaacuucgaggacaaggucgacaucagcgccuccgccaccgccuucaucgagaaccugaccaacaagugcaccuaccucaucggcgaggacgugcugcccaaguacagccuggccuacuccaaguucagccuccugaacgagcugaacaaccuccgguacgacgggaagccccuguccuacgagacgaagcagagcuucaucaaggacugcuucgagaaggagcaccgcaagaugaccgagaagcggauccgcgaguuccugaagcaccucggcgggaccgacggcaagggggcgcugaccggccuggacguggacaucaaguccgaccucaagagcuaccgggacaugguccgcauccugggcgacggguucgacgagacgauggccgagcggaucauccgcuacgugacccuguucggcgaggccaagaagguccuccuguccacccuggagaucgaguucggggacgaccucagcgacacccagaagaagcagauccugaagcugcaguaccgggacuggggccgccucuccgccacgcugcugaaggggaucaagggcguggcgggcgacaaccccgagugcagcauccucgagugcauggagcagcagccgcugaaccugauggaggugcucuccagccacaacaccuaccuggccgccaucgaggaguucaacaaggagcggaccgagcccaccgacaucgucgacuacaagcugguggacgaccucuacaucucccccgccgugaagcgcagcgucuggcagacgcugcgcauccuggacgagaucaccaagcuccggggguccgugcccaagaagguguucgucgagguggcccgcaccaaccgggcggagaagaagaagaccgacagccgcaaggagcggcugcugcagcucuacaagaccaucaaggacgagggccgcaacuggacggaggagaucaagcagcgggacgccggggacuucaacagcaagaagcuguuccuguacuacacccagcagggccgcugcauguacuccggcgagaagaucaccagcaucggggaccucuucaccuccaaguacgacaucgaccacaucuacccgcggagcgugacgaaggacaacuccugggacaaccugguccuggugaaggccgagcucaaccgcgagaagaaggacaucuaccccaucgagaaggacacccaggaccggugcaucagccuguggaagcagcugcucgagcagggccugaucuccgagcgcaaguacgagcggcuggugcgcaccacgccccucaccgccgacgagcuggccgacuucgucaaccggcagcugguggagaccaaccagagcgugaaggcggucaccaaccuccugaagcgccuguaccccgacaccacgaucugcuacgugaaggccgagaacguguccgacuuccggcaggagcgcgaguucgucaagcuccggagccugaacgcccaccaccacgccaaggacgccuaccugaacaucgugguggggaacgucuaccacgagaaguucaccaacaacccgcgcaacuucaucaagaacgcgcgguccgacaagaagcgccccuacagccucaaccacauguucgacuaccugcuccaggugggcaacaaggagaucuggaaccccaagaccgacaacaaccuggugaagaagaugaugcgcaacaacgacguccaggugacccggaugcugguggagcagacgggggcccuguacgacgccaccaucuacaaggccuccgucaccaagagcgaguccuacgugccccucaagagcuccgacgcgauccugagcgacgugaagaaguacggcggcuucaccagcaucaagaucgccuacuacuccaucuuccgcuucuacaagaagaacagcgaggaguucgagacgcacaucaucuccaucccgguccugaaggccgggacccucaacagcaaggaggacuacguggccuacggcgaggagaucaugaacaagcagaaguucgaccggguggagcuggucuacaagaagcugugcaugaacucccucgugcgcaucaacggggugauguacuaccugggcgggaagaccaacaacagccuguacaucgacuccgccaucagccucguccugcccgacaacaucgcgaagaagaucaaggccguggagaaguacaucgcccggguggccgagaacggcaacuacaagccccagccggaccaggucucccccgaguucaacaugaucaucuacaaggcccugaccgagaagaugaagcagcccgcguucgugggccucaagacgaaccgcgagaacgagcuggagaaggagaccaccaucaccgccuucaucgccaugacgcugaucgagcagugcaagaugcucauggagauccugaaccugcucacccagcagaagaccaccuacgcccugaagcccaucggggugagcgccucccggagcacgcugggcaugaacaucaccgggcucuccgaguucaccaucaucacccagagcgucacgggccugcaggagaaggagauccgcaucaucuga

SEQ ID NO: 1829 - RNA, 4026 nt, Artificial Sequence
  Cas9 variant
auguggggcagccgccuguucgaggaggccuccaccgcccaggaccggcgcgagcaccggagcaaccgccggcgccucgagcggcgcaaguaccggcuggaccugcucgaggagcuguucguggaggagaucaacaagaucgaccccgaguucuucauccgccugcgggaguccaaguuccacuucgaggaccgcagccucaagaacaccuucauccuguucaacgacaagauggagggcggguacaacgacaaggucuucuucuccaaguacccgacgaucuaccaccuccggagcgcgcucaucaacgggaacaaggaggacgugcgcgccguguuccuggccauccacaacauccugaagaaccggggccacuuccuccuggccgggaacgacaucaacaucucccugagccucaacgacacccugaccgaccuguucgaguaccucaagauccaccugggcaucgaggucgaguucgagaacaagcugaaggacaucgagaagaucgcccucgacaagaaccuguccaagagcgacaagcagaagaagaucgugcagcugcucgagaccgacuacaagaagcagcuggcggacguguucaagcugucccucggccugacggccaacauggagaacaucuucgggaaggagaacgagcagggccuggaguucaucaacgccgagaacaagaucaagaagauccaguucgacagcuccuacgaggagaacaucgccgaguucgaccaguucuacggggaguacuucgagaucaucgacaucugcaagaagaucuacgacgcgaucagccucucccagauccuggucgacggcaaggggcugagcgaguccaaggugcucagcuacgagaagcacaaggaggaccugaagcugcucaagaaggugcugaagaacaucgacaaggccuacgacaacaagggcgaggaccgccuggucuacaaggugcucaaggaggacaaggacaagggcaccaacuacgugaacuacuccaagcugagcaacaacgggaccgccaccacgaaggaggaguucuacaaguuccugagcaagaaccucgaccugaagaaguucggcaagcugaacaaggaggacaucgagacccucgacuacaucaacuccgagauccugcuggggcgguuccucccccugcagaaggagaagaucaacggcgucauccccuaccagcugcagaugaaggagcugacccagauccucaacaacgccagcaaguaccugcccuuccugaacaagaucgaggacggcaugaccgugaaggacaagaucaucucccucaucaaguuccgcaucccguacuacguggggccccugaacgaguacaaccggaucgagaacggcaacggguucgccuggaucgagaagaagaagaacgagaagaucuuccccuggaacuucaacgacgucguggacaucgagaaguccgcggagaaguucaucaacaaccugacgaacaagugcaccuacaucaaggaggagaccgugcuccccaagaacagcaucaucuacagcaaguucaugguccugaacgagcugaacaaccuccaguacggcaacaagaagcuggacaucgagcugaagaugaagauguacaccgaccucuuccuggagaagaaggacaaccgcaaggugacggagaagcggauccuggaguacuuccgcaucaacgggaucaacgacggcaaggagaagcucaccggccugaacaacgagauccacgccgacaugaaguccuaccgcgacaugugcgagaucaugggggagaacuucaacaucaacguggccgagaacaucaucaacuggaucaccgucuuccacggcgagaagaagauccugaucaacaagaucaagaacguguacgggaagauguucaacgacgagcagaucagcaagcucuccaagcugaacuacagcgacuggggccggcuguccaagaagcuccugaccgacaucaagugcuacaucgacgccgacgggaucaacuucccggugagcauccuggaggccauggaggucuccaacaagaaccucauggagcugcugagcaacaaguacgaguucaucuccugcaucgacgacaucaacaacaaguacuucggcgaccgcgacaucagcgcguccgagcucaucgacgagcuguacgugagccccgccgucaagcggggcaucuggcaguccgugcgcauccuggaggagaucgugagcaucaucgggcacaaccccaagaagaucuucaucgagaugacgcggcacaacgaggagaagguccagaaguccagccgccggcacaaccucgaggagcuguacaaggccauccgcaaggaccccgaguacguggagcugaucaaggaguucgacagcaccaccgacaccgacuccuucaagaucaagaagcucuaccuguacuucaugcagcugggcaagugcgccuacagcaaggagaagaucgacuucgacaagcuguucacggacuccuacgacaucgaccacaucuacccgcggagcaagaccaaggacgacuccauccacaacaaccuggugcuggucaaggccaaguacaaccgcgagaagaccgacguguaccccaucgacaucaacauccagaagaacaugaacagcuucuggaacuuccucuacaccaagaaguucaucacggaggagaaguacaagcggcugauccgcaccuccgaccugaccgacgaggagcucgcgaaguucaucagccggcagcugguggagaccucccagagcacgaaggccaccgccgagguccugaagcagaucuacggggacuccgacaucugcuacgugaaggccgagaacgugagcgacuuccgcuacggcuccagccggcagaaggacaagaacgacauccagaagcuguucgucaagugccgcgaggugaaccacuuccaccacgccaaggacgcguaccugaacaucguggucgggaacguguacgacgugaaguucaccaagaaccccgucaacuucaucaagaagaacaagaugggcaacaaguccaacuacagccugaaccacauguucugcuucgacguggagcggaacggcuacaaggccugggacagcuccgagaccaucaagacgguggggcgcaugaugaaguccaacgacguccggaucaccaagcacgugcaccccacccgcggcgagcucuacgacgccaccaucuacaaggccaagaucgcgaagaccgggagcuacaugccgcucaagagcuccaagaacacgccccugagcgacgugaccaaguacggcggcuacaccaagaucaagaucgccuacuacuccgucuacaaguacaaguucagcgacaagaaccucaucaagaccgagauccgccugauccccauccccaucuaccuguccaagaacgacgacgacaucaaggaguacgugaagaacuaccucaacgaccgggugaacagcaagcugaucgacuucacgaagaucuacgacaagcuguacgucaacucccucaucaagaucaacggguaccuguacuaccugggcgggaagaccaacgaccgcguguggaucgacaacgccgugagcaucguccucgacgacaagaucgaguaccugaucaagcggaucuccaacgacaucaaguacggcuacgagaucaacgugagcgacgacgagcugauggacaucuacgagucccucgccgagaaggccaacaagaagaucuucuacaaccgccugagcgacuucgagaagaucuucuccaacauggacgugaagaagaaguucgucaagcuggagaagaacgacaagugccgggugcuccugcagcugcucaacgugcugaccgacagccagaccacguacaagcuggagauggucgggcucaagcacucccgcagcaacaucggcaugaagaucagcaaccuggaggaguucaaggugaucaacuccagcaucaccggccuguacuccaacgagaucgacauccucaacaucuga

SEQ ID NO: 1830 - RNA, 4026 nt, Artificial Sequence
  Cas9 variant
auggagaaggacuacuaccugggccucgacauggggagcggcuccgccgggugggccgugaccgacgaccaguaccacgugcugcgcgcgcacggcaaggccaugugggggacccggcuguucgagagcgccaacacggccgaggagcgccggaucaaccgcaccgcccggcgccggcucaagcgccggaaccagcgcaucgaguggcugcaggagaucuucgcggaggagaucaacaccaaggacuccggcuucuuccggcgcaugaaggagagccgguacugggccgaggacaagcgcgacgagaacggcuccugccccgagaugccguacagccuguucaucgacgaggacuucaccgacaaggaguaccacgagaaguuccccacgaucuaccaccuccggaaguaccugaugaccaccgaggagacccccgggauccgccugguguaccucgccuuccaccacaugaugaagcaccggggccacuuccugcugaacgggaacaucgaggagauccgcaaguuccggaagacguucgaccaguuccucgaggugguccgcaacgaggagaugggcuucgccggggagaucgaggaggagaccuacaagaagaucgagaugacccugaaggacgugaaccugacccgguccgcgaagaagacgacccucaucaagagccugaaggugacccgcgucgaggagaaggagcugcucgcccugaucuccggcugcaccgugaagcugagcaacaucuucaacgacaagucccucgacgagacggagcgccccaagaucagcuucgccgacgccggcuucgacgacuacgaggccgagauccaguccaaccugaacgagaaguacuacaucaucgagagcgcgaaggccguguacgacugggccgcccuggccgacauccucggggaguacuccugcaucagcgaggcgaaggucgcccuguacgagaagcaccacaaggaccugaagcggcucaaggaccuggugcgcaacaacaucuccagcgagguguacaaggagaucuucgucgacguguccggcaaguacaagaacuacugcgccuacaucgggaccaccaacaucaacggcaagaagaaggacuucgagggcaagaagugcaccaaggaggacuucuacgccuaccugaagaaguccgugaucgagugcaucaacgacagcgagaagacggacuggcucaagcuggagcuggagaaggggaacuuccucccgaagcagcugaccggcgagaacagcgucauccccuaccaggugcaccuguacgagcucaacgccaucaucaccaaccugcaggagcggaucccccugcucaagcgcgacggggagaagauccggcagaucuucaccuuccgcgugcccuacuacgucggcccgcugaacgggaucagcaucgacggcaagaagacgaacugggugaagcggaaggagggcgugaucuaccccuggaacuucuccgacaucgucgacgaggagagcuccgcggagagcuucauccgccggaugaccaacaagugcaccuaccugauccacgaggacgugcuccccaaguacucccugcuguacagccgcuucgaggugcucaacgagcugaacaacguccggcugaacggggagcuccuguccguggagcugaagcagaagaucuacgaggacgucuuccagcgcuaccggaaggugacccagaagcgccugaagcgguaccuccugacggagggcaucaucgacgagaacaccgugaucaccgggcuggacggcgacuucaaggggagccucaccgccuaccacgacuucaaggagaagcugacgggccugaaccucaccgagcgcgagaaggaggagaucauccugaacaucacccuguucggcgacgcccggucccuccugcgcaagcggaucgggaagaucugcagccagcuguccgacaagcagaaggagaaccucagcaagcuguccuaccagggcugggggcgccugagcaagaaguuccucaacggcaucgccaucuccguccagggggaggaggaguggaccaucaucaaggcccugugggagacgcaggacaaccugagccagcucaugggcgcgaaguacaccuuccgcaacgccguggagaaggagaacggcgagcuggagaaccgggagaucuccuacgagaccgugaaggaccugagcaucagccccuccgucaagcgccagguguggcagagccuccugaucgugaaggagaucugcaagauccagaagaagccgccccggaaggucuucguggagguggccaaggagaagaccaacuccgggcgcaccgagagccggaagaagcgccugcaggacuucuacaaguacugcuccaaguacgagaaggagcucuacgacgagagcauccagaacaagcuggagaagugcuccgagagcgaccugcgguccgacaagcuguuccuguacuacaugcagaugggccgcugcauguacacggggcagcccaucgacuucgacgagcuguggaacaaccagaaguacgacaucgaccacaucuacccccagagcaagaccauggacgacuccaucgacaaccggguccucgugaagcgcaucagcaaccaggagaagaccgacguguacccgauccgggccgacauccgcgagaagcggcgcggcuucuggaaggagcugaagaacgucggccugaucuccgaggagaaguacaagcggcucacccgcgcgacggaguucgagcccgccgagcuggccggguucaucagccggcagcugguggagaaccgccagaccaccaagguggucgccuccauccucaagcaggccaugcccgacaccgagaucguguacgugaaggcgcggacggucagcgaguuccgccacaaguucaacuucaucaaggugcgggagaugaacgacuuccaccacgccaaggacgccuaccugaacguggucgugggcaacaccuaccuggugaaguucaccaagucccccgucaacuucaucgagaaccacagcaaccgcagcuacaaccucaagaagauguucaccgacgggcgcguggagcggaacggcgagaucgccuggaucuccggggagaacggcacgaucggcaccgugcgcaacaucaugaagaagaacaacauccuggucacccggcgcgcccacgaggcgaccgggggcuucuucgaccagcagcugaugaagaaggggaagggccaggugccggugaaggggagcgacgagcggcuccuggacaucgagaaguacggcggcuacaacaaggagacgggggccuacuucguccugguggaguccgacgagaagaagggcaagaagaagcgcaccaucgaguacgugcccauccggcucaagaagcagcuggagaacaaccgcaaggcccuggagaacuaccucugcgagcagcgggggcugaccaaccccgucgugcugaucgacaagaucaagauggacagccucuuccgcguggacggcuucuucauguggcuguccgggcggaccggcaaccagcuccucuucaagugcgccaaccagcugguccugagcacggaggacgaggccacccucaagaagaucgugaaguucgugaaccgccggaaggagaacaaggagaucaagaucuacgaguccgacaagcugaacgaggagaugcugaaccgccucuacaacaccuuccuguacaagcugcagaacagcaucuacggcaaccggcucggggagcaggcgaagacccuguccagcaagaaggagaacuucgacaagcugcagaucgaggagaagugccucguccuguacgagauccugcacauguuccagugccaguccgccacgagcgaccuccagcugaucgagggccccgggaaggccggcacccugcgccucaacuccaacaucaccaaguacaagaacaucaacaucaucaaccagagcccgaccgggaucuacgagcaggucaucgaccugcagaagaucuga

SEQ ID NO: 1831 - RNA, 4026 nt, Artificial Sequence
  Cas9 variant
augggcaagggguacuacgugggccuggacauggggaccggcagcgucgggugggccgugaccgacgaguccuaccagauccuccgccggcacggcaaggccauguggggcgugcgccuguucgagagcgcgaagacggccgaggagcggcgcauguuccggaccgggcgccggcgccuggaccggcgcggcuggcggaucgagauccuccaggagaucuucgccgaggagaucucccgcgucgaccccggguucuuccugcggaugaaggagagcaaguacuacccggaggacaagcgcgacauccagggcaacugccccgagcugcccuacacccucuucguggacaagaccuucacggacaaggacuuccacaagaaguaccccaccaucuaccaccuccggaagaugcugauggagaccgaggacaccccggacaugcgccucguguaccuggcccugcaccacaugaugaagcaccgggggcacuuccuccuguccggcgacaucagccaggucacggaguucaagaacaccuucaaccaguucaucgagaacauccgcaacgaggagauggacuucgagaucgagcuggacgaguccgccgugcagaugaucgaggagacccucaaggacaagaaccugacccggagcgcgaagaaguccaagcuggugaagggccucaacgccaagaacguccgcgacaaggccuuccugacgcugcucagcgggggcaccgugaagcuguccgaccuguucgggauggaggagcucaacgagggcgagcggcccaagaucagcuucgccgacaacggcuacgaggaguacgcggccguggucgagauggagcugggggagcuguacuacaucguggaguccgccaaggccguguacgacugggccauccucagcgacauccugggcggguccaccagcgucuccgacgcgaaggugcgcgccuacgagaagcacaaggccgaccugaaguaccucaaggccguggucaaggaguacuuccccaaggagguguacaacgccguguucgucgagagcuccgacaagcugaacaacuaccccgcguacaucggcaugaccaagaagaacgggaagaaggugagccuggagggcaagcgcugcagccgggaggaguucauggacuuccucaagaagaacaucguggucaagcugccggacgaggaggccaagauguaccugcaguccgagcucgagaaggacagcuuccugcccaagcaggucaacaaggacaacggcgugauccccuaccaggugcacaaguacgagcugaagaagauccucgacaaccugggggacaagauccccuuccugaaggagaacgccgagaagaucgagaagcuguucuccuuccgcaucccguacuacgugggcccccugcggacggggaacggcgagaacagcaaguucgccugggccgagcgcaaguccaccgagaagaucuaccccuggaacuucgagaacgucaucgacguggagcagagcgcggagaacuucauccggcgcaugaccaacaagugcaccuaccugaucggggaggacgugcuccccaaggacucccugcuguacagcaaguucaugguccucaacgagcugaacaaccugcggcuggacggccagaagaucuccguggagcucaagcagaagaucuaccgcgacguguucugccggagccgcaaggucacgcagaagaagcugaaguccuaccugauccgggagggcaucgccgggaagaacguggagcucaccggcaucgacggggacuucaagggcagccugaccgccuaccacgacuucaaggagaagcugaucgacguggagcucacccagaaggagaaggaggagaucauccugaacaucguccuguucggggacgacaagaagcuccugaagcagcgccugaagaagaaguucccgcagcucacggagaagcagaucaacaccgugaccgcccuguccuacaagggcuggggccggcugagcaagaagcuccuggaggaggugaccguccccgcccccgagacgggggagguguggaacaucaucaccgcgcugugggagaccaacgacaacuucaugcagcuccuguccaaggaguaccaguucagcgaccgcaucgaggaguucaacgaggagaaggccgaccccgagguguccuaccagaccaucgaggaccuguacgucagcccggccgugaagcggcagaucuggcagacgcuccagaucauccaggagaucgagaaggugaugggcgagaagcccaagcgcgucuucguggagauggcccgggagaagcaggagaacaagcgcaccgagucccggaagaagacccugagcgaccuguacaccaagugcaagaaggaggagcccgaguggaucgaggcgcucugcacgagccuggagaagcacgaggagcaccagcugcgcuccgacaagcucuaccuguacuacacccagaaggggcgcugcauguacagcggcgagcccaucgaccuggaggaccucugggacaacaccaaguacgacaucgaccacaucuacccgcaguccaagaccauggacgacagccugaagaaccgggugcuggucaagaaggaguacaacgccaagaaguccgacaccuaccccaucgccgccgacauccagaagaagaugaugcccuucuggaagucccuccugacgggcggguucauccccaaggagaaguacgaccgccuggugcggaacaacccgcucgacgccaacgagcuggcgggcuucaucgagcgccagaucguggagacccggcagagcaccaaggccgucgccgagauccugaagaagauccuccccgacaccgagaucguguacgugaaggccaagacggucagcaaguuccgccaggacuucgacuucaucaaggugcgggacaugaacgaccugcaccacgccaaggacgcguaccugaacaucguggucgggaacguguacuucgugaaguucaccaagaacgccgccugguucgucaaggagaaccccggccgcaccuacaaccucgagaagauguucaucugggacguggcccgggacggggagaucgccuggaaggcgggcaaguccggcagcaucgugcagguccgcgccaugauggagaagaaccacauccuggugacccggcgcuccuacgaggugaagggcgggcuguucgaccagcagauccucaagaaggggaagggccaggucccggugaaggagagcgacgagcggcugcgcgacaucgggaaguacggcggcuacaacaaggccgccgggguguacuucaugcuggucuccagcaaggacaagaagggcaaggagcagcggacgaucgaguucgugcccaucuaccucaaggaccgcguggagaaggacauggaguccgcgcggaacuaccugauggaggagcgcgggcugcgggagcccaagauccucaucaagaagaucaagaucgacacccuguucaaggucgacggcuucuacauguggcugagcgggcgcaccuccaaccagcucaucuucaagggcgccaaccagcugauccugagcaaggaggacaugaagacccucaagaagguggugaaguacauccagcggcagaaggaggacaagaacgucaagaucagcaugcgcgacggcaucacggaggaggagcugcugaagcucuacgagaccuuccuggacaagauccgccacuccaucuacggggcccggcugagcucccaggagaagacccucgugaacggcaaggagaaguucaucgaccugagcgucgaggccaagugccaggugcuguacgagauccuccaccuguuccagugccaguccggggccgcgaaccugaagaugaucggcgggcccgccagcgccggcauccucgugaugaacaacaacaucuccaagugcaagaacaucagcaucgucaaccaguccccgaccggcaucuacgagaaggagaucgaccugcugcgcguguga

SEQ ID NO: 1832 - RNA, 4026 nt, Artificial Sequence
  Cas9 variant
augacccagaaggugauccccuacaacaucggccuggacaucgggaccaacagcgucggcugggccgugacggacaacgagaacaagcuccugcacaucaaggggcacaacggcaucggggugcgccuguucaaggagggccaguccgccgcggagcggugcggcuuccgcaccacccggcgccggcucagccgccggaaguggcgccugcggcugcucaacgagaucuucgccgacaagaucgccaaggucgacccguccuucuucgcccgccugaagcagagcaacgugucccccaaggaccccaacaagaccauguucgggaacauccuguucgacaacggcaaccucaacgacaagagcuuccacgacgaguacaagacgaucuaccaccuccggcaguccaucaucgaccaccccgagaagaaguucgacauccgccugaucuaccuggccaugcaccacaucaucaaguaccgggggcacuuccugaaccaggcgaacgugcaggacuucaagggcgggaagaucgaccuggaggagagcuucaaggaccucaacuccaucuucgagaaccagggccgcgaccugcggcuggucaccgaggacgccaacaaguacgugaaggagcucagcgacaacuccaagacccgcaacgaccggcagaaggagcugagcaaggugcuguacaucccgaucgacaagaacuccgacaagaacaacaagaaggucaccacggagaucaucaaggccauccucggcaugaaggccaaguucgacgugaucuucgggaucgacgcggagaacgccaaggaguggagccugaccuucaacuccgacgacuucgacgacaagaucgagggccugagcgcccagaugaccgacgaggccggggagauccuccugauccugaaggagcucuacuucgcccugaaccuguccgacauccucaacaacagcgugaccgacaagaacgcgaagacgcuguccgaggccaugaucaaccgcuacgacgaccacaaggagcagcugaccaugcucaagcaggucaucgacaacagcgacaagaagcacgccaaggcccugaaggccgcguacagcgccuacaucgacggcgagaacaacaagaagaucuccuucgaggaccugcggaagcgcauccagaagaaccucgacaacagcgagaccuccaagaagaucaacgaccugcuggagcacgacuacuuccuccccaagcagcggagcaaggagaacggcgccaucccccaccagcugcagcagcaggagcuggacaagaucaucgagucccagaagcacuacuaccccuuccucgccgagcugaacccgaacgagaagcgcagccgccaggccaaguacaagcuggacgagcucguggcguuccgggugcccuacuacgucgggcccauggugaaggccaccgagaacaaccaguccaacaacggcaaguucgccuggaugaucaagaacgacaacaucagcgacaagcugaagaaggaggagaucacgcccuggaacuucgacaagaagguggaccgcaccgagaccgccaccaaguucaucacgcggaugaccaccaccgacacguaccugaucggggagccgguccuccccaagaacucccugcuguaccagaaguucguggugcugaacgagcucaacaaccugaagaucaacaagcagcccaucacccccgagcagaagcaguacgucuacgagcacgugaugaagcagaccaagcgcgugagccugaagaagaucgccgacgcgcucgucaucaagggcgacuacccguacgcccccgagaucaccgggacgaccgaccagaagaacaugaacaacggccuguccaccuacaucgaccuggccaagaucuucggcgacgagcucgacgacaucgaccggaaggaggacuucgagaagaucaucgaguggagcaccaucuucgaggaccagcacaucuucgcccugaagcugaaggagaucaaguggcucacggaggaccagcgcaagcaggucgugaagcugcgguaccagggguggggcaagcuguccaagaagcuccuggcggaccugguggacgacaacgggcagcgcaucaucgaccuccugugggacagcaagcaggacuucaugcagaucgugaaccagaacuccuucaagcaggccaucgccgagcacaacggcgcccaccuggaggagaaggaccucaaggacaucaucaacaaccuguacaccagcccccagaacaagaaggccauccggcaggucauccuggugguggacgacaucauccgcgcggucggguacgagcccgugaacaucaugauggaguucgcccgggaggacuccaaggaccaccgccucaccaacagccggucccgccagcuggagaagguguacaaggacaucaccaacagcugguucgacgacgacaacgucaaggacgagcugaaggacaagaucaaggacaaggccaaguucacggaccggcucuaccuguacuucacccagggcggcaaggaccuguacaccggggagccgcucgacaucgacaaccugagcaacuaccagaucgaccacauccugccccaguccuucauccucgacaacagccuggacaaccgcgugcugaccuccaagaucaacaaccagaucaagaaggacaaccuccccggcgaguucuucgggagcaagaugcacaacuucuggaagcaccugaaggagcugcaccucaucuccaacaagaaguacuacaaccugacccugacgcccaacagcaucuccaaguucaacaaccagggccgguucaucaaccgccagcucguggagacccggcaggucaucaagcuggccgccgagauccugcacaaccgcuacagcgaggagaacgggaccaacaucgugaccgugaaggcgaaccucacgcaccacaugcgcgagaaguucaacuucuacaagaaccggaacgucaacgacuaccaccacgccuucgacgccuaccuggccgccuucgugggcaacuggcugcuccagcaguacccgaagcugaagcccuacuucguguacggcgacuucgcgaagaccgagaucgacaaccugaaguccuucaaccucaucuacaaguucgagcaggcccaccagcugaacgaggaggacgggaagaucgccaaggacaccgacgcccugcucggcuacaugaagaacgucuaccacuucaagaagaugcuggugaccaaggagcuggagacgaaccacgggaaccucuucaagcagacccuguaccccagccacggcaagaugaagaaccugaucaaccccaaggagaaccgcuccagcgacaucuacggcggguacuccagcgagaccggcgcguacgugucccucaucaaggucuucaagaagaacaagaucgagaacaagaucaucaagaucccgcugcuguacaucgacaagcucaaccggcaggccaacgccaagcaguucauccgcaacuucaucaucaaggacgacagcaacaaguucgacauccuguccgagaagaucuuccugaaccagcucgugaucgacggggacgagcuguucaccaucagcggcagcggggaccggcagaacgcccagcagcugauccucuccgacaagagccugaagauccuguccaagaacaucaacgugaucagcaagaacgaccucaucaucaucuucaacgagaucaucgacgacaucugcaaguacaugaagauguacgaggucgagaacuccgacgagacgaaggccaaguucgaggagaucaacgacaaggaccgcaugcugaagaucaucaacgaccugcuccugggccugcacgcgaacgccagccgguccaaccucagcuccaucggccugagccccuccuucgggcgcuucuucagcggcaacgccgggaucaagcuguccgagaacgccaaguucaucuaccagagccccaccggccucuucucccggaaggugaagaucagcgaccuguga

SEQ ID NO: 1833 - RNA, 4032 nt, Artificial Sequence
  Cas9 variant
augaccuacuaccugggccucgacauggggaccagcuccgugggcugggccgugacggacgagaacuacaaccugauccaccgccaccggaaggaccugugggggauccgcgaguucgaggaggccaagaccgcgguggagcggcgcacccagcggaucagccgccggcgccggcagcgcgagguggcccggaucggccuccugaaggacuacuuccacgacgagauccagaaggucgaccccaacuucuaccagcgccuggacaacuccaaguacuucccggaggacaaggaggagguggugaaggggaagaacggcaucuucgccgacgagaacuacaccgaccgggacuacuucgccgaguaccccacgaucuuccaccuccgccgggagcugcugaacagcaaggagccccacgacguccgccuccuguaccuggcccuccugaacauguacaagcaccggggccacuuccugaacaccacccucgggaccgacggcgagaaccgcaagcuguccgacguguaccgggacuucguggucaagacggaggaggugcuggggcucaccuucccccaggagaccgacaacggcaagaugcaggagaucaugugcagccgcgaguucucccggaagcgcaaggcggagcugcugugcgcccuccuggagaucgacaagaagcagaagcagcaggucgcccugaucgagugcgugcucgggcuggacaagagcgugaagcagauguacggcaccgccgugccggacgacuucgacaaguccgucaaggugaacuucagcgacuccagcuucgaggagaagguguccgaggucgaggagcugcucgacgaggagaaguacgagcugauccugugcaugaaggagcucuacgacacggcggugcugaaccagaucaugggcgacugcaacuaccugagcgaggcccgcgugcaggaguacgagaagcacaaggaggaccucaagcugcugaagcggaccgucaagaaguacgggaccgccgaggaguaccaguuccucuuccgcuccagcgagaaggccuccuacaacgccuacgugcacagcgugaacuccggcgagaagauccggcgcaacauggacgggcggagccgcgacgaccuguacaccguccugaagaagaugcucaagaacuacccccaggaggacgcggacugcaaguacauccuggaggagaucgagaaggagcaguuccugcccaagcagcucgugagcgacaacggcgucauccccaaccagauccacuacaaggagaugaagaagauccuggagaacgccgagcaguaccugcacuuccuccgggagaaggacgaguccggcuacacgguggccgagcgcauccugaagcuguucgccuuccagaucccguacuacaucgggcccaccagcgagaaguccggcaagaacgggggcaacgggugggugguccggaaggagcagggccaggugcuccccuggaacaucgaggagaagaucgacaugaaggccaccagcgagaccuucaucucccgcauggugcggcgcugcacguaccugagcgacgagaugguccugcccaaggcgucccuggaguacgagagcuucugcgugcucaacgagcugaacaaccugcggauccgcggcgugaagcucccgaucaccgucaagcaggacaucuacaaggaccuguucgagcgggggaagcgcgugacccggaagcagaucgugaacuaccugaagggcgucgggauccuccaggagggcgaggaggacgagcugaccgggaugauggacacguucaacuccagccuggccuccuacggcaaguucaagagcauccucggcgagaagauccaggaggacuccugcaagcgcaugguggagcagaucaucuucuggugcaccaucuacggggacgccaagaaguuccugaaggagcagcuggaggagaaguacggcgacgugcucacccgggagcagaucaagcgcauccugggguucaagcugaaggacuggggcaaccucagcaagaaguuccuggagcugaacgggugcgaccgcaacaccggcgaggucaugucccucauccggaugcugugggagagcgacgacaaccugauggagcuccugaaggacuccagcuacacguaccgcgccgagcuggaggagcagcaggagaagcucaccaagacccugaccgagaucugccccgaggaccuggagggcuacuacuucuccgcccccgugaagcggaugaucuggcagacgcuccugauccugaaggagguggagaaggucaugggggagcccccgaagcgcguguucguggagaugacccgggagcacgacgagcgccgggagaugaaggacagccgcggcaagaaguuccaggagcucuacaagaacaucaaggacgaggagcacaacuggaaggcggagaucgaggacgccgagaaggacgggcggauccgcagcaagaagauguaccuguaccugacccagcggggccgcugcauguacaccggcaaccccaucgaccucgaggagcuguucacgaccaaguacgacaucgaccacaucuacccccggcacuucgucaaggacgacaaccuggacaacaaccucgugcugguggagaaggagaagaacgcccacaaguccgaccaguacccccugggggacgacaucuacaccggccgccucagcugguggaaggagcugcaccgggagaagcugaucaacgacgagaaguacaagcgccucaccgggcgggccccguucuccgacgagcagaaggccggcuucaucgcgcgccagcuggucgagaccagccaggggacgaagggcguggccuccauccugaaggaggugcuccccgagaccaccaccaucgucuacgccaaggcccggaacgugagcgacuuccgcaacacgaacgagcugcugaaggcgcgguccgugaacgacuuccaccacgcccaggacgccuaccucaacaucgucgugggcaacguguacuacgucaaguucaccaacaacccccugaacuucgugcgcagcggggagggcuacaaccuggacgggguguuccgcaagaacgucauccggggccaggagaacgccuggaucgugaagcccgagaagggggagaagaugacccucgagaccgugaagcgcgucauggccaagaacacgccgcugcugacccggcucuccuucgagggccgcggcgggcuggcgaaccagacccuguacagcgccaaggaggccgccggcgagggguacgugccccucaaguccagcgacucccggcugcaggacgugaccaaguacggcggguucacgagcgucaccaccgccuacuucauccugguggagcacgacaugaagaagaagcgcgugcggaccaucgaguccguccccauccucuggaaggagcgcaucgagaaggagagcggccagcuggagaucuacugccgggaggcgcugggccucgugaaccccgacauccgcgugcggaagauccugauccagucccuggucaagaaggacggguucuacaugcaccucagcggcaagacggggaaccgcuucaucaugcggaacgccguggagcugugccugaagcaggaguggaucaacuacagcaagaagcucgagaaggagggcugcgacgaguccaucaccaaggagaagaacgaggagcuguacgagauccugaaggagaagcacaucaacgggaucuaccgcaagcggccgaaccccaugggcgagaagcuccacauccgccaggagaccuuccggaugcugacccuggaggagcagaagaaggugcuccugagccugcucaaccugacgaagaucggccccgucgaggccaaccuggagcucaucggggaguccgcccacaccggcaagaugcugaucagcaagaacaucaccgaggugaaggaguucuaccugauccaccaguccgucaccgggaucuacgagaagcaggucaaccuccugacgguguga

SEQ ID NO: 1834 - RNA, 4032 nt, Artificial Sequence
  Cas9 variant
auggccaccaagaaggaguacaacaucggccuggacaucgggaccacgagcgugggcugguccgucguggagaccgacaaccagaaggugaugcgcaaggggaacaaggcccucuggggcguccggcuguucgaggaggcgaccaccgccgagagccgccggaugcagcgcuccacgcggcgccgguacgaccgccggcgcgagcggaucaagcugcuccaggaggaguucagcgaggagaucaacaagguggacaagaacuucuuccagaagcugaaggaguccaaguacguggagaacgacaagaucaacaagaagaucguccugaccaaggaggagaagcaggagcucaaggacuaccagaacaaguacaagaccaucuaccaccuccgcgacgagcugaucaacaaccccgagaagaaggacauccggcugguguaccuggccauccaccacaucaucaaguaccgcgggaacuuccuguaccagaacgccaacuucaacaucgacaaccucgacaucaaggacaagcugaacgagcuguucagcauccucuccaacaacauccaggagcuggagaucccggaggacuacaucaacaucaucgacuucgacgagcuggaggccgaccuccugaaggacaccaagaacgacgugaaggcgcugcucaucgacaaccugacggagcugaccaacaagagcuccgccaccgaguucggcaagcucauggucggcaacaaggggaacaucaacaagcugcugaugcucgagaccgacaacaagaucgagaucagcuucuccggcacggacuacgacgacaaguacgaggaguaccaggaggcccugggggagaacaucgagauccuggacauccucaagcagaucuacgacugcaucuuccugaagaagaucuucaagggcaacaagaacaccagcaucuccagccugauggugaaguccuucgagcagcacaagaaggaccucaacuuccugaaggagcuguucaaggacaaccgggagcucuacaacgagaucuuccgcaccaagaaggaccugugccuguacgagaaguacaucaccaacaagaucgacugcgacgaguuccggaaggagaucaacaagcuccuggagagccuguucuccgacgagaacaucaagcagaaccuccuggacgaguacaaccuggaggugaaggagcgcaucgagaacgggacguuccucccccggaucaccaccaccgacaacggcaaguaccccuaccagcugaacaagagcgagcugaucaagaucaucgagaaccagggcaaguacuaccccuuccuccugaacaagcugaacgacaacaagacguacaagaucgucaagcugcucgaguuccgcaucccguacuacguggggccccugguguccgagaagcggagcgagaacagcuggcuggagcgcaagaucaacaacgucaagaucacccccuacaacuucgacgacgugguggacaaggagaagaccgccgagaaguucaucaagcgcaugaucucccacugcaccuaccuccuggacgaguacgcgcuggccaacaacagcauccucuacuccgaguucaaggucaugaacgagcugaagcagauccgggugaacgaccgcaagcuggagcucaaguuccagcagcagauccuggaggacuucuucaagaagacgagcggcaccaucaccgagcggaaguucaagaacuaccugaucuccaccggggaguacagcauggagggcggcaacuuccgcaucacgggguacuccgccgacggcaaguucgccaacaacaugcagagcuacguggacuucuucggggagaacggcaucuucgccgacaccgacuacaaccucgagaacgcggaggagaucaucgaguggaucaccaucuucgaggacaaggacauccuggagaagaagguccgggacaacuacuccaagcugaacgagaaccagaucaagaaggugcucgccaagaaguacagcggguggggcucccugagcaagaagcugcucaagaccaaguacuacaaggacaaggccacggagcuguacaaguccauccuggaccucauguacgagaccgacaagaacuucaugcagaucaucaacgacgacaaguacaacuuccaggagaugaucaagaaguucaacaacaaggaggagaacaagaagcugaacuacagcaucguggaggagcuggccaccucccccgccaccaagcgcggcaucuaccaggcgcucaaggucguggaggagcuggucgacuacaucggguacgagccgaagaacaucagcaucgagauggcccgguccgaggaggagaaggugcgcaaggacagccggaaggacuacaucaacaaccuguacaagggcugcaaggacuccaucgagaacuacaagaagcucaagcacgagcuggacagccacgagaucacgagccagcgccuguuccucuacuucauccaggaggggaagugccuguacaccggcacgccccugaacaucgaggacaucgagaaccagucccucuacgagaucgaccacaucaucccccggagccugaucaaggacgacuccaucgacaacaaggcccuggugcucaaggagugcaaccaggacaagaaggccagcuacguccugcccuccaaguuccgcaacagcaagcagaagaccugguggaagcaccugaaggacaacgggcucauguccgccaagaaguuccacaaccugauccgggagaaguacaacgaggaggacaucaacggcuucaucaaccgccagcugguggagacccggcagaucaccaagcacguggcgaacauccucaacaaccuguacaaggacaccaacgucaucuaccugaaggccgaccucagccacaacuaccgcgagaaguacgaccuguucaaguuccgggacaucaacgacuaccaccacgcccacgacgccuaccuggccgcggugcucggcgaguacaaggagcgcuucaugaagcggaagaucaacuucgacauggugaaggagcugaacuccaagaucgucgagauggacgaggggaagcgccgcaaccugcgguucggcuacgugaucaacagccucgacgagaaccugaacgacaucgugcugaagaucuccgagaaccucgucgacaacgagaccggggaggugcuguucgacgcccacgaguucaacaagcgcguggaggacacccuguaccggaacgacauccucaucagccgcaagacggagauccggaccggccaguucuacaaggagaccaucuacaagaaggggaagggcaccaucccgaucaaguucggcaugcccacggacaucuacgggggcuacuccaacaccaacgcccgcaagcugaugcugaucgaguacaacgagagcaagaugaagaucaucgggcuccccauggcccuggcgguccggaacaacgacgccgagaucaacgacuacaucaagacccagaucaaccugaagaagaacuccaccuucaagaucaagaagugcagcauccccuucgagacggagaucaucuacaacaaccagaacguguucaucaagggcuacuccaucggccacaagaacugcgagaucagcaacgccauccagcucaagaucgccaaggacaagaugaagcacuggaaguacgcccugcaguaccugcucaacgacaagaagcaguacaucgacuucgcggagaaguacgugaacgagaucuacgacuuccugaucaaccuggaccucuucccgcuguucaacaaggagcuggacaagaucaagaacaaggucaacuucgaggaccucgcccuggaccagcagaagaagaucaccaaggagcuguucaagaugcuccacugcaacagcgugaacgccaaccuguccgaguucgggcugggcgaccgcauggggcggcucagcggcuacaacaucaccgacgggaucaucaucuccaagagcgugaccggcauccgcgagucccgguacgaguucuga

SEQ ID NO: 1835 - RNA, 4035 nt, Artificial Sequence
  Cas9 variant
augagccagaacaacaacaagaucuacaacaucggccuggacaucggggacgccuccgugggcugggccgucguggacgagcacuacaaccuccugaagcgccacgggaagcacauguggggcagccggcuguucacccaggcgaacaccgccguggagcgccgguccagccgcuccacgcggcgccgguacaacaagcgccgggagcgcauccggcuccugcgcgagaucauggaggacaugguccuggacguggaccccaccuucuucauccggcucgccaacgugagcuuccuggaccaggaggacaagaaggacuaccugaaggagaacuaccacuccaacuacaaccucuucaucgacaaggacuucaacgacaagaccuacuacgacaaguacccgaccaucuaccaccuccgcaagcaccugugcgagagcaaggagaaggaggacccccggcucaucuaccuggcccugcaccacaucgucaaguaccgcgggaacuuccucuacgagggccagaaguucuccauggacgugagcaacaucgaggacaagaugaucgacgugcugcggcaguucaacgagaucaaccuguucgaguacgucgaggaccgcaagaagaucgacgaggugcucaacgugcugaaggagccccuguccaagaagcacaaggccgagaaggcguucgcccucuucgacacgaccaaggacaacaaggccgccuacaaggagcugugcgcggcccuggccggcaacaaguucaacgucaccaagaugcucaaggaggccgagcugcacgacgaggacgagaaggacaucagcuucaaguucuccgacgccaccuucgacgacgcguucguggagaagcagccccugcucggggacugcguggaguucaucgaccugcugcacgacaucuacagcugggucgagcuccagaacauccugggcuccgcccacacgagcgagccguccaucagcgccgccaugauccagcgguacgaggaccacaagaacgaccugaagcuccugaaggacgugauccgcaaguaccugcccaagaaguacuucgagguguuccgggacgagaaguccaagaagaacaacuacugcaacuacaucaaccaccccagcaagacccccgucgacgaguucuacaaguacaucaagaagcucaucgagaagaucgacgacccggacgugaagaccauccugaacaagaucgagcuggagagcuucaugcucaagcagaacucccgcaccaacggggccgugcccuaccagaugcagcuggacgagcugaacaagauccucgagaaccagagcgucuacuacuccgaccugaaggacaacgaggacaagauccgcagcauccugacguuccggauccccuacuacuucggcccccucaacaucaccaaggaccgccaguucgacuggaucaucaagaaggaggggaaggagaacgagcggauccugccguggaacgcgaacgagaucguggacguggacaagaccgccgacgaguucaucaagcgcaugcggaacuucugcaccuacuuccccgacgagcccgucauggccaagaacucccugacggugagcaaguacgagguccucaacgagaucaacaagcugcgcaucaacgaccaccugaucaagcgggacaugaaggacaagaugcugcacacccucuucauggaccacaaguccaucagcgccaacgccaugaagaaguggcuggugaagaaccaguacuucuccaacaccgacgacaucaagaucgagggcuuccagaaggagaacgcgugcagcaccucccugacgcccuggaucgacuucaccaagaucuucggcaagaucaacgagagcaacuacgacuucaucgagaagaucaucuacgacgugaccgucuucgaggacaagaagauccuccgccggcgccugaagaaggaguacgaccuggacgaggagaagaucaagaagauccucaagcugaaguacuccggguggagccggcuguccaagaagcuccugagcggcaucaagaccaaguacaaggacuccacgcgcaccccggagaccgugcuggaggugauggagcggaccaacaugaaccucaugcaggucaucaacgacgagaagcugggguucaagaagacgaucgacgacgccaacagcaccuccgugagcggcaaguucagcuacgccgaggugcaggagcuggccggcucccccgccaucaagcgcgggaucuggcaggcgcuccugaucgucgacgagaucaagaagaucaugaagcacgagcccgcccacguguacaucgaguucgcccggaacgaggacgagaaggagcgcaaggacagcuucgugaaccagaugcugaagcucuacaaggacuacgacuucgaggacgagaccgagaaggaggccaacaagcaccugaagggcgaggacgcgaaguccaagauccggagcgagcgccugaagcucuacuacacccagauggggaagugcauguacacgggcaagucccuggacaucgaccggcuggacaccuaccaggucgaccacaucgugccccagagccuccugaaggacgacuccaucgacaacaaggugcugguccucagcuccgagaaccagcgcaagcuggacgaccuggugaucccgagcuccauccgcaacaagauguacggguucugggagaagcuguucaacaacaagaucaucagccccaagaaguucuacucccugaucaagaccgaguucaacgagaaggaccaggagcgguucaucaaccgccagaucguggagacccggcagaucacgaagcacgucgcccagaucaucgacaaccacuacgagaacaccaagguggugaccguccgcgccgaccugagccaccaguuccgggagcgcuaccacaucuacaagaaccgggacaucaacgacuuccaccacgcccacgacgccuacaucgcgaccauccucggcaccuacaucggccaccgcuucgagucccuggacgccaaguacaucuacggggaguacaagcggaucuuccgcaaccagaagaacaagggcaaggagaugaagaagaacaacgacggguucauccugaacagcaugcggaacaucuacgccgacaaggacacgggcgagaucgugugggaccccaacuacaucgaccgcaucaagaagugcuucuacuacaaggacugcuucgugaccaagaagcucgaggagaacaacgggaccuucuucaacgucaccgugcugcccaacgacacgaacuccgacaaggacaacacccuggccaccgugccggucaacaaguaccggagcaacgugaacaaguacggcggcuucagcggggugaacuccuucaucgucgccaucaagggcaagaagaagaaggggaagaaggugaucgaggugaacaagcucaccggcaucccccugauguacaagaacgcggacgaggagaucaagaucaacuaccugaagcaggccgaggaccucgaggagguccagaucgggaaggagauccugaagaaccagcugaucgagaaggacggcggccucuacuacaucguggcccccacggagaucaucaacgccaagcagcugauccugaacgagagccagaccaagcucgugugcgagaucuacaaggccaugaaguacaagaacuacgacaaccuggacuccgagaagaucaucgaccuguaccgccuccugaucaacaagauggagcuguacuaccccgaguaccggaagcagcucgucaagaaguucgaggaccgcuacgagcagcugaaggugaucagcaucgaggagaagugcaacaucaucaagcagauccuggcgacccuccacugcaacuccagcaucgggaagaucauguacuccgacuucaagaucagcaccacgaucggccggcugaacgggcgcaccaucucccuggacgacaucagcuucaucgccgaguccccgaccggcauguacagcaagaaguacaagcucuga

SEQ ID NO: 1836 - RNA, 4035 nt, Artificial Sequence
  Cas9 variant
augaagaagaccaaccccuacauccugagccucgacaucggcaccgccuccaucggguacgccugcauggaccuggacuucaacauccugaaguaccacgacaaggacgcgaucggcgugcucacguucgagggggccgacaccgccgccgagcgccggggcuuccgcaccagccggcgccggaagaaccgccggaucaagcgccuggggcugcuccaggagguccuggccccgcuggugaagaaccccaacuacuaccagcuccugaaccugcacaaguggaagaacuccaacgaggacuucaagcaccggagccucuccgaggugcugaagauccugggcaagaaccccaagaccuaccccacgaucuaccaccuccagcaggacauccagaaccacccggagaagaaguucgagcccgagcugaucuuccuggcgcucuaccaccuggucaaguaccgcggccacuuccuguucaacaaccucagcuucgacaaggggaagaccguggacaacgaggcccagcuguccgagcugcucgagcaguaccagagcaucaaccccuacgaggacuccaucagcaacaaggacaucaacgugaucgucgacacccugaaggacgaccagcugacccggaacgacaaguccaaggagcucaagcgcaacgugagcaagacgcacgccgagcuguucaagaugcuggugggccucaaguucaagcaguccauccuguucgagaacauggagaacgccgaggacaucaaggagagcgcgaccggguccgacgccaucagccuguccgacgacuacuacgagaaccucagcgaguuccugaccgacgagcagcugaacuucaucgaguccgccaacaccuucuucaugggcaucaugcucgaccggauccugaagggggccacgagcaucagcgccgcgaagguccgcgacuacaagaucuucaagaaccagcugaagaucaucaaggacaucguguaccagaacaaguacgacaaguaccacgaguucuucgugaccuccaaggaggacaugcgggccuaccaggagaaccccgacgccaagaccuucggcaagcucagcaaguucgaccaguaccugauccacccgaaggaccaguacgccaagcugaugaaggaccucaagggcaucguccccaagaaguacaccgaggugcugaaccugaucgacgagcagaaguuccucgugguccagaacacgaccgacaacgccuccauccccuaccagaacaacguguucgaggcggagaacauccugcgcaaccagcagaaguacuaccccgagaucaccgaggagaugaucgggaaggugaucaaccugaucagcuuccggaucccguacuacgucggcccccucaccaacaagaacgggcaguccgacuucgccuggaugauccgcaagagcgacgagcagacgcugcccuggaacuucgacaaggugaucgacaaguccaagagcgccgagaaguucauccggcgcaugaccuccaagugcaccuaccugcuggaggaggacgugcuccccaagcacagccugcuguaccaggagauggagguccucaacgagcugaacaacgugcagcugcggggcgagaacgagccgaagcaccgcauccaccgccucgaccccaaggugaagcaguucaucuaccacaaccuguuccagaagaagaagaacgucacccacaaggaccugaucacgcuccugcagaacuccgagcaccggaacacccugaacaagaccagcggccagaagcucaagguguucgggacccagaacgacuccaaguucgccagcaagcuguccacguacaacgacaugaaggccaucuucggcagcgucgagaacaagcgccagaugaucgaggagcuggugcucuggaucaccaucuucgaggacaaggcgauccugaagcagaagaucggggagaaguaccccaacaucaccgagaagcagcugaaccagaucgugaagcucaacuacuccggcugggggcggcugagcgagaagcugcucaccaaggaggucaacggccgcucccugaucgaccugauguacagcacggagaacaacuucauggagaucaucaccgacaagacccucggcuucgacugcuucaucaagaacagcaacaaggugaagaacgccaagaucuccuacaaggacguggccgagcugcggaccagccccgcccugaagaaggggaucuggaacgccaucaagaugguccgcgagaucuccgaccucuucggcgcgccggagaagaucaucaucgaguucgccacggaggaccaggugaaggggaagcggcagaagucccgcagcgagcugugggacgaccuggugaagaagaacaaccucaagcggaacaagaaguucaagggccuguucgaggagcugaaggccuaccccgaccucgacuucagcaaccccaagcuguggcuguacauccaccagaacgggaagugcauguacaccaagaagcccaucgaccucgagcgccugauguccgacaccaacaaccagcuguacgagaucgaccacauccucccgcggaccuucgucaaggacgacagcaucaacaacaaggugcuggugauccaguccgccaaccagaagaaguccggcgacaagaugccccuggagaucuucgacaaccacguccucgugcccuucuggaagaugcuguacgagaacgaccugaucagcagcuccaagcucagcaagcugaugaagaaggaguucaacgaccuggacaaggagggcuucauccagcgccagcucguggagacccggcagaucaucucccacgucagcgacuuccugacggaggaguaccccuccaccaccguggugccgaugaaggcgaacgucgugagcgagcugcgccggaaguucgacauccccaagauccgccagcucaacgacuggcaccacgccguggacgccuaccugaacggguucgucuaccaggccgcccggguguucuaccccaaggugaaccuguucgaguucaacuucaagugggagaagguccgcgagaaguggcggcagcucggcgaguucaccgagaacaacaagaagcgcgaguucuuccuguucaagcgcauggagaacuacgugaacgagcacggggagggcaugaucagcaagcugaucuucgaccucgacaacuucaaguucaacuacucccggaagguggagagcacggaguccgcguucuacaagcagagcgccuucuccccgaagaacaccaccgcccaguacgacagcgacaagaacaagaccgccaucuacaaggagaugaagaacaagcgcgggaucgucguguccuacacguacgugaagaaggaccaggagcugaucggcuacggcgucuucaacgagaccguguucgaguacgugaacaacgccgacgucgacaugaacacccgggcgcugaagaucgugcgcaaggccuuccccaagcucgacaucaagaaggcccaguaccuguucagcaucaacaagggggacgcccugcucgugaacggccaccccuuccuguucgucuccgccaaggagcggaucaacgggaagcagcuggaguucgacaucaacaugcagcgccggcucaagaaggcgcugcgccccuacaacaagaugaccgagcaggagaaggugggcguguacaaccaguucgccgagaaggucgugcaggaguacgagaacagccugggcgccaagacgcggaacgagaagcucgagcugauccgcaaccaguucaacgaguccgacaagagcaacgaggcccugauccagugcauccucgaggugcugaagaugaccaaggucuccgcggagcggagcgugaagcugaagauccgcugggggucccagaccccgaacacccucaucgacaucaacaacaaggccaagaucauguacaacagcaucacgggccugaagcagacccggcugaaguccaucuacaagcucgccgagagcaagaacgagcuguga

SEQ ID NO: 1837 - RNA, 4035 nt, Artificial Sequence
  Cas9 variant
augaacaagaacuacuacaucggccuggacauggggaccaacagcgugggcugggccgucaccgaccaggaguacaaccucaucaagcugaaggggacgcacgccuggggcgcgcgcaucuuccaggaggccaaggacaagaaggggacccgggccauccgcuccagccggcgccggauggaccgccggaaguaccgcauccaccuccucaaccagcuguucgcccaggagauccaggccaucgacuccaccuucuucauccggcuggcguacagcgccuacugggagguggacaagaaggacaagggcaucggccgcaacauccucuucaagaccaagcaggaggagucccaguucuacaagaaguaccccacgaucuggcaccuccgcaagagccugcuggagaaccagccggacgccuucuccgaccugcgguacguguaccuggccuuccaccacaucaugaaguaccgggggaacuuccuccacgagggcgagaucaagaccaacgagcugcagguccagcagaucgagcagcugaaccaguuccucaucaacaaguacaaggagaucuacgacaacgacguggaggagcgcaccuucaucgcgaaccaccagaucgacgcccugaaggagauccugcucaacaagaacaccaacaagacgaccaaggagaaggagaucaagaagcuguucgacuacgccgacugcgagagccuggagcccuacaucuccugcuucagcaagcucgccgucgggggcaaguucgaccuguccaagcugggguacgagggcaacauccaguucagcgaccccuccuucgaggagaaggccagcauccuccaggacgacuuccggcugaucgcgaucgccaaggagauguacgacuucgugauccugaacgaccuccugaaggaccagcccaaccuguccaccgccauggugcacguguacgagacccaccgccaggaccucaagaagcugaaggacaucaucaucgacaucgacgccaacaagggccugcagaacaacgaccggugguacuucaagcuguucaaggacaagaacgccccgaagaacuacagcgcguucauccacaagaacuccaaccagaagcgccccagcaucgacgaguucaacgacgagaucaagaagauccugaucgagcaccggaacgacgucucccuggagaagcaggacgaccucaagaugcuguucgagaagguggagaacaagacgcugcucaagaccaucgccauccagagcaccagcgugaucccccaccagcugcaccuggacgagcucgagaagaucaucgacaacgccuccaccaaguaccccuuccugagcaacauccgcgacaagcugguccuccuguucacguuccgggugccguacuacuacgggccccugaacgacaagucccccuacagcaacguggagcgcaagcaguucgccaccgucacccccuggaacuucgacgagaucuucgacgagaacaagacccgcgagaaguucaugaagaagcucacgaacaacugcaccuaccuguccggcgagaccgugaugccgaagaaggcccuggcguacgaggacuaccugaucuacgaccggcucaacgugcugcuggucaacggggaguaccucagccugcaggagaaggagaagaucuaccacuaccugaucucccgccccaagaccacgcucgaccagcugaagaaggagcuggccaaguggcacaaccagagccccaucgacaucaucuucuccaacauccacgaggagauccccuucgaggccagcucccacgcccaccucaugaaguccuucgaccuggagaagcagaaggaggagcuggagcgguacaucacccucgccaccaucuacgcggacgacaagaagucccugaaggagcugcucaagaacgagagccugcuggacgagaaccagaagaacgugauccucacccugccgacgaagaagugggcgccccugagcuacaagcuccugcagaacaucguguacaccgacgacuacggcgucgugcacagcauccuggacaucaugaaggagaccaaccagaacuuccagauggugcuccacaacgagcaguaccacuucaaggagcugaucgagcaggagaaccagaaguucacccaggagaagacgaucgaggaccugaucgaggagaagcucgaguccauccccagccugacccagcgcuccauccggcagacccugcucaucaucgacgacaucaucaaggccagccaccagaagguccccgagaagaucuucaucgaggugacccgcaacaacgacgacaagcggaagggccaggacgggaaccagcuggcccgcgacaaggagcugaaccgguuccucacgaaccugcugaaggacgagaaggccaaccaguucugcgacgucagccagcuccugaaggaccuggaggagguggacaaggugaagcucaagggcaagcacaucuaccuguacuucaagcagcuggggaucgaccucuacaccggcaagaagaucguccugaaccagcugcucaccuccaccaaguacgacaccgaccacaucaucccgcagagccugaucaaggacgacucccuggacaaccucgugcugguggagcgcgaggucaaccugaaggugaaggggaaccacuaccccgugcccagccggauccaggacgagcagaagaagcucuggcacuuccugcugcagaagaaggccaucuccgagaagaaguacggcaaccucacgcgcaccagcaagaucaagcuggaggaggucgaggacuucguggcccggcagaucaacgugaucaacuacuccaacgucaucauccgcgacauccugaagcucaaguacccccacaccgacaucaucuucagcaagucccaguacccgagcuucauccggaagcaccugaagaucgugaagaaccgcgacgugaacgacgcccaccacgccgucgacgcguaccugaacgugguguccggcaaccuccugagcaccacguucuccaaggccuacauccggaagaaguacauccagauccaggacggggagaaggagaccuucaacauggagaccauccuggagaacuacuucaagaacaacgagaaccagcucaagaucaagaccaacugccugcgccgggacgcccugaucacguucaaggucgacuacuucagcggcgaguucuacgggcagacccgccuccccaagggcaacgagaaccugauccccaucacccugaacgaggacaaccccauguccgacaccagcaaguacgggggcuacacgaaccucgcccaggccuaccuguucgcgguguccuaccaggaggacggcgagaugaagaaggccauccugcgcgugccguaccucuacgacacccuguacaagaacgacagcgacaagcugcucagcaagguccuggacaaccccaaggccaccaacauccagauccugcggaagauccaccucaaccagaagauccgcuucaacgacgggaucuaccugcuguacaccaacgagaaggaccggaacaaguacaagauggccuaccagaacuacaucgacaacgacuaccucuacuaccugcacugggccaacaagcaccuggaggagcuccuggacaaccaggagaagcagacguucaucuacaacuccaagaacgaccaguucgaggugagcaaggcgaagaacaaggagaucuuccaguaccugcuccagaagaccaaggccaagguguacgacacgugcaacuacaucgucaaggcccgcgagaccaacaucgagaucuucgagcagcugacccugaaggagcagaucaccaugaucaaccaguggaucaagaugaugucccgggacugcgagaaggugaaguucgacgcccgcuucaccaacuucagcaacugccuccugcggcuguccaacaacaucaaccccaaggacagcaucaccaucaucuacgaguccccgacgggccucuucaagcacgaggugaagaucuga

SEQ ID NO: 1838 - RNA, 4035 nt, Artificial Sequence
  Cas9 variant
augaagaagaccaaccccuacauccugagccucgacaucggcaccgccuccaucggguacgccugcauggaccuggacuucaacauccugaaguaccacgacaaggacgcgaucggcgugcucacguucgagggggccgacaccgccgccgagcgccggggcuuccgcaccagccggcgccggaagaaccgccggaucaagcgccuggggcugcuccaggagguccuggccccgcuggugaagaaccccaacuacuaccagcuccugaaccugcacaaguggaagaacuccaacgaggacuucaagcaccggagccucuccgaggugcugaagacccugggcaagaaccccaagacguaccccaccaucuaccaccuccagcaggacauccagaaccacccggagaagaaguucgagcccgagcugaucuuccuggcgcucuaccaccuggucaaguaccgcggccacuuccuguucaacaaccucagcuucgacaaggggaagaccguggacaacgaggcccagcuguccgagcugcucgagcaguaccagagcaucaaccccuacgagggcuccaucuucaacaaggacaucaaggugaucgucgacacccugaaggacgaccagcugacgcggaacgacaagagcaaggagcucaagcgcaacguguccaagacccacgccgagcuguucaagaugcugguggggcucaaguucaagcagagcauccuguucgagaacauggagaacgucgaggacaucaaggaguccgccaccggcagcgacgcgaucucccugagcgacgacuacuacgagaaccucuccgaguuccugaccgacgagcagcugaacuucaucgagagcgccaacacguucuucauggggaucaugcucgaccggauccugaagggcgccaccuccaucagcgccgccaaggugcgcgacuacaagaucuucaagaaccagcugaagcucaucaaggacaucguguaccagaacaaguacgacaaguaccacgaguucuucgucaccagcaaggaggacaugcgggcguaccaggagaaccccgacgccaagaccuucggcaagcuguccaaguucgaccaguaccugauccacccgaaggaccaguacgccaagcucaugaaggaccugaaggggaucgugcccaagaaguacacggaggugcugaaccucaucgacgagcagaaguuccuggucgugcagaacaccaccgacaacgccagcauccccuaccagaacaacguguucgaggccgagaacauccugcgcaaccagcagaaguacuaccccgagaucaccgaggagaugaucggcaaggucaucaaccucaucuccuuccggaucccguacuacguggggccccugacgaacaagaacggccagagcgacuucgcguggaugauccgcaaguccgacgagcaggcccugcccuggaacuucgacaaggugaucgacaagagcaaguccgccgagaaguucauccggcgcaugaccagcaagugcaccuaccugcucgaggaggacguccugcccaagcacucccugcucuaccaggagauggaggugcugaacgagcugaacaacgugcagcuccggggcgagaacgagccgaagcaccgcauccaccgccuggaccccaaggucaagcaguucaucuaccacaaccuguuccagaagaagaagaacgugacccacaaggaccucaucacgcugcugcagaacagcgagcaccggaacacccucaacaagaccuccgggcagaagcugaaggucuucggcacccagaacgacagcaaguucgccuccaagcugagcacguacaacgacaugaaggccaucuucggguccguggagaacaagcgccagaugaucgaggagcucgugcugugggucaccaucuucgaggacaaggcgauccugaagcagaagaucggcgagaaguaccccaacaucaccgagaagcagcucaaccagaucgugaagcugaacuacagcggguggggccggcuguccgagaagcuccugaccaaggaggugaacggccgcagccugaucgaccucauguacuccacggagaacaacuucauggagaucaucaccgacaagacccugggguucgacugcuucaucaagaacagcaacaaggucaagaacgccaagaucagcuacaaggacguggccgagcugcggaccucccccgcccucaagaagggcaucuggaacgccaucaagauggugcgcgagaucagcaaccuguucggggcgccggagaagaucaucaucgaguucgccacggaggaccaggucaagggcaagcggcagaagucccgcagcgagcugugggacgaccucgugaagaagaacaaccugaagcggaacaaggaguucaaggggcuguucgaggagaucaaggccuaccccgaccucgacuucuccaaccccaagcuguggcuguacauccaccagaacggcaagugcauguacaccaagaagcccaucgaccucgagcgccugcugagcgacaccaacaaccagcucuacgagaucgaccacauccugccgcggaccuucgugaaggacgacuccaucaacaacaagguccuggugauccagagcgccaaccagaagaaguccggcgacaagaugccccucgagaucuucgacaaccacgugcugguccccuucuggaagaugcuguacgagaacgaccucaucagcuccagcaagcuguccaagcugaugaagaaggaguucaacgaccucgacaaggagggguucauccagcgccagcugguggagacccggcagaucaucagccacguguccgacuuccugacggaggaguaccccagcaccaccgucgugccgaugaaggcgaacguggucuccgagcuccgccggaaguucgacauccccaagauccgccagcugaacgacuggcaccacgccguggacgccuaccugaacggcuucguguaccaggccgcccgggucuucuaccccaaggugaaccucuucgaguucaacuucaagugggagaaggugcgcgagaaguggcggcagcugggggaguucaccgagaacaacaagaagcgcgaguucuuccuguucaagcgcauggagaacuacgucaacgagcacggcgaggggaugaucagcaagcucaucuucgaccuggacaacuucaaguucaacuacagccggaagguggaguccacggagagcgcguucuacaagcaguccgccuucagcccgaagaacaccaccgcccaguacgacuccgacaagaacaagaccgccaucuacaaggagaugaagaacaagcgcggcaucguggucagcuacacguacgugaagaaggaccaggagcugaucggcuacgggguguucaacgagaccgucuucgaguacgugaacaacgccgacguggacaugaacacccgggcgcucaagaucguccgcaaggccuuccccaagcuggacaucaagaaggugcaguaccuguucuccaucaacaagggcgacacccuccuggugaacgggcaccccuuccuguucgucagcgccuacgagcggaucaacggcaagcagcucgaguucgacaucgccaugcagcgcaagaucaagcaggcccugucccccuacaacaacaugacggagcaggagaagguggaguucuacaaccaguucgcggagaaggugaucgaggaguuccggaacagcaucggccugcagucccgcgaccggaaggucaaccucaucaagaaccuguucaacaacaccgagaaguccaacgacagcaugacccagagcauccuggaggugcucaagaugaccaagguguccgccgagcgcagcaaggagcugaagauccgguggaacgggcagacgccgaacaccuucaucgacaccaagaacaacgccgagauccaguacaaguccaucaccggccugaagacgaccaagcccaagagcaucuucaagcucgccgaguccaagaacgagcuguga

SEQ ID NO: 1839 - RNA, 4038 nt, Artificial Sequence
  Cas9 variant
augaagaagcccuacagcaucggccuggacaucgggaccaacuccgugggcugggccgucgugaccgacgacuacaaggugccggccaagaagaugaagguccucgggaacacggacaagagccacaucaagaagaaccugcugggcgcgcuccuguucgacuccgggaacaccgccgaggaccgccggcugaagcgcaccgcccggcgccgguacacccgccggcgcaaccggauccucuaccugcaggagaucuucagcgaggagaugggcaagguggacgacuccuucuuccaccgccuggaggacagcuuccucgugacggaggacaagcggggcgagcgccaccccaucuucgggaaccuggaggaggaggucaaguaccacgagaacuuccccaccaucuaccaccuccggcaguaccuggccgacaaccccgagaagaccgaccugcgccugguguaccucgcccuggcgcacaucaucaaguucggcgggcacuuccugaucgagggcaaguucgacacccggaacaacgacgugcagcgccucuuccaggaguuccuggccgucuacgacaacacguucgagaacuccagccugcaggagcagaacguccagguggaggagauccucaccgacaagaucuccaagagcgccaagaaggaccgggugcugaagcuguucccgaacgagaaguccaacgggcgcuucgccgaguuccucaagcugaucgugggcaaccaggcggacuucaagaagcacuucgagcuggaggagaaggcgccccuccaguucagcaaggacaucuacgaggaggagcuggaggugcugcucgcccagaucggcgacaacuacgccgagcuguuccuguccgccaagaagcucuacgacagcauccugcuguccgggauccucaccgucaccgacgugagcacgaaggcgccccuguccgccagcaugauccagcgguacaacgagcaccagauggaccuggcccagcucaagcaguucauccgccagaagcuguccgacaaguacaacgagguguucagcgacgucagcaaggacggcuacgccggguacaucgacggcaagaccaaccaggaggccuucuacaaguaccugaagggccuccugaacaagaucgagggguccggcuacuuccuggacaagaucgagcgggaggacuuccuccgcaagcagcgcaccuucgacaacgggagcaucccccaccagauccaccuccaggagaugcgggcgaucauccgccggcaggccgaguucuacccguuccuggccgacaaccaggaccgcaucgagaagauccugaccuuccggauccccuacuacgugggcccccuggcccgcgggaaguccgacuucgccuggcugagccggaaguccgcggacaagaucacgcccuggaacuucgacgagaucguggacaaggagagcuccgucgaggccuucaucaaccgcaugaccaacuacgaccuguaccucccgaaccagaaggugcugcccaagcacagccugcucuacgagaaguucaccguguacaacgagcugaccaaggucaaguacaagacggagcagggcaagaccgccuucuucgacgccaacaugaagcaggagaucuucgacggcguguucaaggucuaccggaaggugaccaaggacaagcugauggacuuccucgagaaggaguucgacgaguuccgcaucguggaccugaccgggcuggacaaggagaacaaggccuucaacgcguccuacggcacguaccacgaccuccggaagauccuggacaaggacuuccuggacaacagcaagaacgagaagauccucgaggacaucguccugacccugacccucuucgaggaccgcgagaugauccggaagcgccugaagaacuacuccgaccugcucaccaaggagcagcugaagaagcuggagcggcgccacuacacgggguggggccggcucagcgccgagcugauccacgggauccgcaacaaggagucccggaagaccauccuggacuaccucaucgacgacggcaacagcaaccgcaacuucaugcagcugaucaacgacgacgcccuguccuucaaggaggagaucgccaaggcccaggugaucggcgagaccgacaaccucaaccagguggucagcgacaucgccgggucccccgccaucaagaagggcauccugcagagccugaagaucguggacgagcucgugaagaucauggggcaccagcccgagaacaucgucguggagauggcccgcgagaaccaguucaccaaccagggccggcgcaacucccagcagcggcugaaggggcugacggacagcaucaaggaguucggcagccagauccucaaggagcacccgguggagaacucccagcugcagaacgaccgccuguuccucuacuaccugcagaacggccgggacauguacaccggggaggagcuggacaucgacuaccucagccaguacgacaucgaccacaucaucccccaggccuucaucaaggacaacuccaucgacaaccgcguccugaccagcuccaaggagaaccggggcaagagcgacgacgugcccuccaagaacgugguccgcaagaugaaguccuacuggagcaagcugcucagcgcgaagcugaucacccagcggaaguucgacaaccugacgaaggccgagcgcgggggccucaccgacgacgacaaggccggcuucaucaagcggcagcugguggagacccgccagaucaccaagcacguggcccggauccuggacgagcgcuuccacaccgagacggacgagaacaacaagaagauccggcaggucaagaucgugacccucaaguccaaccuggugagcaacuuccgcaaggaguucgagcuguacaagguccgggagaucaacgacuaccaccacgcccacgacgcguaccucaacgccgugaucgggaaggcccugcugggcguguacccccagcucgagccggaguucgucuacggggacuacccccacuuccacggccacaaggagaacaaggccaccgccaagaaguucuucuacuccaacaucaugaacuucuucaagaaggacgacgugcgcaccgacaagaacggggagaucaucuggaagaaggacgagcacaucagcaacaucaagaaggugcuguccuacccccaggucaacaucgugaagaagguggaggagcagacgggcggcuucagcaaggaguccauccugcccaaggggaacagcgacaagcucaucccgcggaagaccaagaaguucuacugggacaccaagaaguacggcggguucgacagccccaucgucgcguacuccauccuggugaucgccgacaucgagaagggcaagagcaagaagcugaagaccgugaaggcccucgucggggugacgaucauggagaagaugaccuucgagcgcgaccccguggccuuccuggagcggaagggcuaccgcaacguccaggaggagaacaucaucaagcugcccaaguacucccucuucaagcuggagaacggccgcaagcggcugcucgcgagcgcccgcgagcugcagaaggggaacgagaucgugcugccgaaccaccucggcacccugcuguaccacgccaagaacauccacaagguggacgagcccaagcaccucgacuacgucgacaagcacaaggacgaguucaaggagcugcuggacgugguguccaacuucagcaagaaguacacccucgccgaggggaaccuggagaagaucaaggagcuguacgcccagaacaacggcgaggaccucaaggagcuggcguccagcuucaucaaccugcucacguucaccgccaucggggcccccgccaccuucaaguucuucgacaagaacaucgaccggaagcgcuacaccuccacgaccgagauccugaacgccacccugauccaccagagcaucaccggccucuacgagacgcggaucgaccuguccaagcugggcggggacuga

SEQ ID NO: 1840 - RNA, 4038 nt, Artificial Sequence
  Cas9 variant
auggagaacuacaacaucggccuggacaucgggaccaccagcgugggcugggccgucgugaacgacgccacgaacaaggugaugcgcaagggcgggaaggcgcucuggggcguccggcuguucgaccccgccgugaccgccgaggaccgccgggccaagcgcgggacccggcgccgguacgaccgccggcgcgagcggaucaagcugcuccaggacgaguucaaggacgagaucaacaagguggacuccaacuucuuccugaagcuggaggagagcaaguacaccuccaaggacaucaagaacaagacgguccucaucagcauggaggaggagaaggccaucaagaaguacaaccaggaguacccgaccaucuaccaccuccgccagaagcugaugaacuccaacgagcagauggacauccggcucguguaccuggcgauccaccacaucaucaaguaccgcggcaacuucaucuacgaggggaacagcuucuccgugaacaaccugaacaucgacaacaagcucaaggagaucuuccugagccuguccgaggacgucgacgagcucgacaucagcgaggagugcaucaacaacaucaacuacaagcagcuggccaacaucuucaacgagcaguccaagaacgaccugaaggugaagcucaccagcgagcugaccuccuacagccugaacaagaacuucaucuccgaguucugcaagcucaucaucggcaacaaguucagcgccaagaagcuguucaaccuggagacggacaacgacgugucccucagcuucgacgggaccgacuucgaggacaaggccggcgaccuggagucccugcucaacgacuaccuggagguccuggagcagcucaaggagcuguacgacaugguguuccugaagaagaucuucgggggcagcaaggagaccaccaucagcggccucaugguggagcgguacaaccagcacaagaaggaccugaagcugcucaaggacacguucuccagcgaccgcaagaucuacaacaagaucuuccgguccaagaaggacaucaaggacgacaaggacaugugccuguacgaccuguacauccacaacaagcucgagaccaccgacuuccugaaggagaucaagaaguacgucaacaccgacaacuucaucaucacggacgaggacuuccugaagcgccucgagaacaacgaggugcugccccggaucaccagcaaggagaacgggaaguaccccuaccagcugaacaaggacgagcucguguccaucaucgagcaccagggcaagcacuaccccuuccugcugaacaagaccgacgacgggaucuacaagcucguccgccugcuggaguuccggaucccguacuucgugggcccccuggugagcaaggacauguccgagaacgcguggaugcuccgcaacgagggcaugcaggggguccacaucacccccuacaacuucaagaaggugaucaaccuggacaagacggccgagaucuucaucaagcgcaugaucagccacugcaccuaccugcucgacgaggaggcccugcccaacaacuccauccuguacagcgaguucaaggugcucaacgagcugaagcagaucaaggucaacggcgagcaccugaccaaggacgagcagcacaagaucaucgaggagcuguucaugaagaccuccgggacgaucaccgagaacaaguuccgggaguuccugcugaacacccucgacuacaacuucuacgagaacgagcugaagaucaccggcuacagcgccgacugcaaguucgccaacaacaugcaguccuacaucgacuucuucggggagaacggcaucuucgagggcacgagcuacaacaccaacgacgcggagaagaucaucgaguggaucaccaucuucgacgacaaggacauccugaagcgcaagguggagaacgaguacccggagcucaaguccaaccaggucaagaacauccugaacaagaaguacagcggguggggccggcugucccgcaagcuccugcuggaccuccgggugcuggacaaggagaccgacauccccaagagcaucauggaccugauguacgagacggacgagaacuucaugcagaucaucaacaacgacaaguacaacuuccagaagcucaucgccaaggagaacaagaucgagaacaccuccaacgaccugagcuacgacguggucgagaaccuggccaccagccccgccaccaagcgcgggaucuaccaggcccucaagguggugaaggagaucacgaccuacaugggcuacgagcccaagaacaucauggucgagauggcgcgcggggacgagaagaagauccggaaggacgaccggaagaaguaccugcagaagcuguacgacaacaucaaggacgagguggacuccaacuacaagaaccucaagaaggagcuggccaaggaggagaagaucgacaccgacaagcuguaccucuacuaccugcaggagggcaagugccuguacugcggcaagccgaucaacguggacgaccucaacaccaagaacagccuguacgagaucgaccacauccugccccgcacccucaucaaggacaacuccugggacaaccggguccuggugugccgcgggugcaaccagaagaaggccgccagccuggugcuccccaaggaguuccggaacgacuacacgaaguccaucuggauccgccugaagaacaacaagcugaugagcaacaagaaguucuacaaccucacccggaaguccuacagcgaggaggacaucaagggcuucaucaaccgccagcuggucgagacccggcagaucaccaagcacguggccaacauccugaacugcuucuaccccaagacgaagaucguguaccucaaggcgaacaucucccacagcuaccgcgacaaguacgaccuguucaaguuccgggacaucaacgacuaccaccacgcccacgacgccuaccuggccgccacccucggguccuaccaggagaaguaccugcacuacgaccuggacuacaacaagaucaacgaguucaacgagaagcucaucaagaacgaggacuacaagcgccugcacuacggcaucgucgugaacagccuggacgaggaguuccaguccgcguucgccgagaucgccccgcgccucaucaacgaggagaccggggagcugcuguucaacgccaagaaguucaacgaccucguggaggacacccuguaccggaacgacauccugaucagccgcaagacggagauccggaccggcaagcucuacaaggagaccaucuacaagcgcggcaaggggaacaucaagaucaaggagaacaugcccaccgagacguacggcggguacuccaacauggagaccagcuaccugacccuggucaaguacggcaacaagaccaagcucaucggcauccccauguccaucgcgaacaacaaggacgugaaggugaagcuggacuucaucaaggagcaccuggaccucaagagccuggacaacaucgucauccugaaggacaacauccccuacgacgugagcaucaacuacaagaaccaggacguguacgucaagggguacuccacggccaacaagaacugcgagcucagcaacgcccaccagcugaagaucaagaaggacaugaugaagaagugcaaguacgugcugaacaagguguacaagaacaaguacgacgacaucaccaacauggacaucgagaacgccaucaccuucaucaacuaccucuucgagaucaagaucgaguucccgcuguucuccaaggagaucaccaagauccaggacaacaucaaccugacggagugcagcuucgagcagcucgccaacaucaucaagcagcugcugaucaucuaccacugcaacuccaagaacggcaaccucaaggaguucgggcugagcgaccggaucggccgccuguccggggcgaacgucaccggcggcgacuucaucuucaccagcgugaccgggcucaaggagaagacggccuccuacgacggcgaguga

SEQ ID NO: 1841 - RNA, 4038 nt, Artificial Sequence
  Cas9 variant
augguggagaaguacggcaucgggcuggacaucggcaccagcacccucggguggacguccgucgacgagaacggcaagauccagcgccugaaggggcagaccgcccugggcacccggcuguucaacgagggccagaccgccgaggagcgccggggguuccgcacgacccggcgccggauccagcgccggcgcuggcggcugcgccugcuccgggagaucuucgacgagcccaucggcagcguggacgcgggguucuucgcccgccagaagauguccagccuguccccgcaggacgaccgguucgaggacaccuaccgccuguucaacaaccagaccgacaaggccuuccacgacgaguaccccacgaccuaccaccuccggcaggcccugaugaacagcgaccgccaguucgacauccgggagaucuaccuggccauccaccacaucgugaaguaccgcggcaacuuccuccgguccgggaagcccgcggacuucaagaccggcaagcuggaccugaaggagaaguucgaggagaucaacgccgacuggcagacccucaucagcgaggacgcgccccagcugccggucgacgaccugacgaccaucaaggccgugcucguggacggcucccgcagccgcuccgaccggcagcgcgggcuggucaagcuguggauggccaacgagaccguggagaagaacuggaagcccgugaugaccgagcucgccaaggccauccugggccugaagacgaagcucuaccugcugaccgggcucgaccugcccaaggaggaccagaaggccuggaccuucagccuggacacccucgaggaccaccagggcgacaucgacuccuucuucgacgaccacgcccagcagcugaucgaccggcuggcggagcuccgcgccaugauccagcugacggagaucauccccagcggccugaacuucucccagagcaugguccagcgguacgaggcccaccgcucccaccucgagauguacaagcaguacgcccuggaccagaccgacccgaagcggaccaaggcccugcgcgcggccuacaacgccuacaucgaccagcacgagaucgccgacgacuucuacaccgccgugaagcgggugacgaaggacgaccagagcgagaccgcggaggagaucaaccgccucaucgggcuggagcaguucaugcccaagcagcggaccaaggagaacggcgucauccccuaccaggugcaccagcaggagcuggaccagaucaucgcccaccagaagaaguacuaccccuuccucgggaccgagaacccggugaucgaccaccgcgagucccagcccuacaugcuggacgagcuggucagcuuccgggugcccuacuacgugggccccauggucgccgccaacccggagcucaagacgaccgagaaccccuucgccuggaugauccgcaaggcgcagggggagaucacccccuggaacuucgacgagaagguggaccggaagggcagcgccaccgccuucaucgagcgcaugaagacgaccgacaccuaccugcugggcgaggacgugcucccccagcagucccugcuguaccagcgguucaugguccugaacgagcucaacaacauccgcaucgacgacgagcugcugaccacgaaccagaagcaguggguguucgaccggguguucaaggggaagggcaccaucagcgccaagcaccuccaggacgcgcugaagcaccacggggagaccgacggccugccgaagaucuccgggcucgccgaccccaccaaguucaacagcgcccugaccuccuaccgcgacuuccagaaguggcugcccaacgacaucgaccgcaaggaccggacggccgacaucgagaccaucaucaacuggagcaccgucuucgaggacacccacaucuucguggagaagcucaaggagaucgaguggcugacggccgaccagcgccggcgcaucgcguccaaccgguaccgcggcuggggccggcugagcaagcaccuccugaccgagaucaaggacgagcaggggcuguccaucauggaccagcucuggcgcacccagcacaacuucaugcagaucguccacgagcccgacuacgccaagcagaucgaggccgccaacaccgugggcauggccaagcaggacaucgggacggugaucaacgaccuguacaccagcccgcagaacaagaaggcgauccggcagguccuggccguggugaaggacauccagaacgcccaccacggcgucgcccccuccuggaucuucauggaggccgcgcgcggggccgaccagaacccccagcggagccgccagcggcagcgccagcuccaggaccuguacgccaagaccgccgcggaccugguggacaccgaggugcagcaggagcucacggacaagaucaaggacaaggccaacuucaccgaccggcugaugcuguacuuccuccagaacggccaggacauguacuccaaggagaagcugaacaucgaccgccugagcgaguacgacaucgaccacauccucccccaggcccugaucaaggacgacucccuggacaaccggguccucgugcaccagagcaucaaccgcaacaaguccgacaccuucgccagcgagaaguacggcgccaagaugcagggggcguggcaccaguggcgggccgccggccugaucuccgcccgcaagcugcggaaccucgagaugcgcccggacgagaucagcaaguacgccaccggguucauccgccggcagcugguggagacgcgccaggucaucaagcuggugaccgagauccucagccaccaguacaaccccgaggagaccaagcugguguccgucaaggcgggccugagccacgagcuccggcgcgaggccggccugcccaagcugcgggaccucaacgacuaccaccacgccaucgacgccuaccuggccgcgcgcaucgggaccuaccugcucaagcgguacccgcgccuggagcgguucuucguguacggccaguuccagacgucccgccuggaccuccggcgcuucaacuucauccacgaccuggucaagagcaagcagggggugaucguggacuccgacaccggcgagauccugugggaccggcagaaggacaucgacuacaucaagcaccucauggggcugaagcaccuccucgugacccacgaggucuacgacagcgccgccgagauguacgcccagaccaucuucaaggcguccgacaacgacagcaaggugcugauccccacgaagaacgaccgccccaccgccaucuacggcggcuacaccaagcggcgcaacggguaccuggccauccucaagaucaccgagaagaaggccgagacguaccggguggucggcgugcccacccuguacaugucccagcuggccaccgcgcgcagccacuccguggaggccgagaaggcccuccucaagagccugauggccccggagauccuguccgagagcaaggucguguccuucgagguggucgugagccacgugcaccugaaccagcugguccgggacaccguguucgggcccgcccacuacuucggccucgggcccuuccgcuacgugcgcaacuuccaccagcugguccugcccuucaaggaccaggagauccucgugaagcggacgccgaccgacgaggagcugaacaccguguucgaggacaucugcuggcaggucgagaacuacuucgcgguguucgacaucaacggcuuccgcaacgcccugaagaaguccaucgacaaguucgagcagcuccccaucgagaacguguucaaggacaagaagcuggucacccagggcaagaaggaggugcuggccuucgugaugcaggggcuccacgccaacgccagcuaccggaaccugaaggucagccugggcaucaagacgccccucgggcagcugcagcugaccaaguucaugcucucccgcgacgcggagcugaucgacgagagccccaccggccuguuccggcgcauccggcgccucaaggaccuguga

SEQ ID NO: 1842 - RNA, 4038 nt, Artificial Sequence
  Cas9 variant
augggcaacaagcugcgcaacguggacgacuacuaccucgggcuggacaucggcaccgagagcgucgggugggccgugaccgacaaguacuacgugauccccaaguucaagggcaacgccauguggggcguccaccuguucgacgagggggagacguccgugaagcggcgcggcuuccggagcgcgcgccggcgcacccagcggaagcgcgagcggcucgcccugcuggaggcccucuucgacgaggagaucugcaagaaggacugcaccuucuuccgccggcugcacgaguccgaccuguggccggaggacaagagcggggacgacaaguacgccguguucgccgacgagaacuacaccgacaaggacuuccacaaggaguaccccacgaucuaccaccuccgcuacgagcugaucaagaacaaggagccccacgacgucaagcugguguuccucgcgcugcaccacaucaucaagaaccggggccacuuccuguucgacucccucagcuccgccgaggacuucaacagcgccuacgagaccaugugcuccuaccugagcgacaacgagauccagcugaacugcuccgacaucgagcaguucaaggccauccucaaggaccgccggcaggggaagaucgagaagaccaagaaccuggcgagccuguucggcaucaccaagaaguccgaccccgugagcuacgccgucauggccgugcucuccgggagcacggugaagaugugcgaccuguucggcgacgacgagcugaagaccgucgagaagaacaacaucuccuucgccagcggcuacgaggagaacgaggagaucuacgccuccgugcucggggaccgcuucgagcuggugaagauccugaaggcggucuacgacugggccgugcucgccgacauccuggacggcaagaaguacaucagcgaggccaagguggccgucuacgagaagcacaagaacgaccugaagacccucaagaaguacgugaagaccuaccugccggagaaguacaacgagaucuucaagaucagcgacgggaagaaggacaacuacguggcguacuccggccacaucaaggagagcggcaagacgggggagcugaagaagaccugcaacuccgagaacuucugcgccuaccucaagaagacccugggcaagaacgccgaccugagcuacaaggagauguucgacgagaucgagaacaagaccuucaugcccaagcaggucacgaaguccaacgggguggugcccaugcaggucaacgaggaggagcucaaggccauccuggacaacgccaaggacuaccugagcuuccucaacuccugcgacgagaacggcgugagcgucuacgacaagaucaucaagaucuucgaguaccggauccccuacuacguggggccgcugaacacccacaccgagaacuccuggcugaagcgcaaggacggcgugaagaucuaccccuggaacuucgacgacgucguggacaucgacagcuccgcggagaaguucaucaacaaccucaccagcaagugcacguaccugcccgagugcgacgugauccccaagugcucccugcucuacagcaaguucaccguccugaacgagaucaacaaccugaagcucaacggcgaggacaucccgguggagcugaagcaggggaucuacaaggaccuguucaugacccggcgcaaggugaccgucaagcagaucaaggacuaccugaaggcccggggcugcuacgacaacaacgacgugcucuccgggaucgacacgaccgucaagagcucccucaagagcuacuucgacuucaagggcuucgagucccugaccuucgacgacaaggagagcaucaucgccagcuccgugaucuucggggacgacaagaagcuccugaagaagcgccugaagaagcuguuccccgagaagcugaccgacgaggacaucaagaagaucugcaagcugaaguacacgggcuggagccgccucuccaaggaguuccugugcgacguggaguucaccuacaagaagaccggcgaggugaugaacgucaucaccgcccugugggagacgaacuacaaccucaugcagauccuguacagcgaggacuucugcugcgacggggacgagaagaagaaccugaacgacaagcucgacgagcuguccuacaccggcgaccagcacagccugcggaaggccguggacgcgcucuacgugucccccaaggucaagcgccccauccugcgggcccugcucaucgccaaggagaucgagaagauccaggagcgcccgcccaagaagaucuucguggagguggcccgggggaucgacaaccgcgaggagcggcaccgcgacagccggaagaaccgccugauggagcuguacaagaacugcaagaaggaggcggagaaguucugccccuacuucgacgcccucuccaagaagcugagcgacgaggacgaguccaagcugcggcgcgacaagcucuacuucuacuacauccagcugggcaagugcauguacaccggggaggagaucagccugggcgagcucaugaacggcaacgggcgguucgacaucgaccacaucuacccccgcuccaagaucaaggacgacagccugaccaacaagguccuggugaacaagacggugaacaacaacaagaccaacgucuacccgaucgacgccgccauccaguccaagaugagccccuacuggcagaugcuccgguccagcggccugaucagcgaggagaccuacaagcgccugacccggaagacgccccucaccgacgacgagcuguccgccuucgugagccgccagcugaccgagacccagcaguccaccaaggcgguggcccacauccucgagcagcuguaccccaagccgaagacggagaucgucuacgugaaggccgcccuggugcacgccuuccggcagagcaacgacaugcucaagugccgcgaggucaacgaccugcaccacgcgaaggacgccuaccugaacaucgugguggggaacgccuacaacgucaaggugacccacaacaaggugaacuucaucaagggccuccagaacaacgacaagggcuacaccgucaaccccgagaaguucuucucccacgacauccccggggccuggagcgugaaggacuccaugaacaccgugcgccgguucaugaacaagaacaacauccgcuacacgcgguucccccgcaagaagcagggcgggcuguucaagaucaacccgcugaagaagggcaacgggcaggucccccucaaggccagcggcgcgcgguccugcaucgagaaguacggcggguacgacaaggccaccagcgccuacuucuccuacguggaguacaccgacaagaagggcaaggccgugcgccagauguuccccgucaaccuguacgaggugaaggaguacgaggcggacaugcagggguucgugaccagccggaucgccgaggccuccaacgucaagauccugaucccgugcgugaaguacgacgccugcaucagcuucgacggcugccgcauguucaucacgaagaagaccgggaaccggaucggcuacaagcccggcaugcagcucgugcugggguacaaguacgagaaguacauccgcaacaucgagaacuaccugaccaagcacaaggaccgggagaucaucccccgcgacaacaucuccgccgaggagaacaucgagcucuacgacauccugaccggcaagaugcugaacacgguccucagcgugaaguucuccgggaucggcaagaagcuggagaagcggcgcgagaaguucgugcugugcagccccgaggagcagugcugcguccucaacgagauccugaagauccugcacgcgaacgugcucuccggggaccugagccugaucggcgagagcccgaacaccggcaccaugaagaccaacgccaaguucuccgagaucaaggacguccacagcaucaagcucaucaaccaguccgugacggggcuguucgagcaggagaucgaccugcucaaguga

SEQ ID NO: 1843 - RNA, 4038 nt, Artificial Sequence
  Cas9 variant
augggcaagcccuacagcaucgggcuggacaucggcaccaacuccguggggugggccgucgugaccgacgacuacaaggugccggccaagaagaugaagguccucggcaacacggacaagcagagcaucaagaagaaccugcugggggcgcuccuguucgacuccggcgagaccgccgaggccacccgccugaagcggaccgcccgccggcgcuacacgcggcgcaagaaccggcuccgcuaccugcaggagaucuucaccggcgagaugaacaagguggacgagaacuucuuccagcggcuggacgacagcuuccucguggacgaggacaagcgcggggagcaccaccccaucuucggcaacaucgccgcggaggucaaguaccacgacgacuuccccaccaucuaccaccuccggcgccaccuggccgacaccuccaagaaggccgaccugcggcugguguaccuggcccucgcgcacaugaucaaguuccgcgggcacuuccuguacgagggcgaccugaaggccgagaacacggacgugcaggcccucuucaaggacuucgucgaggaguacgacaagaccaucgaggagagccaccuguccgagaucaccguggacgcccugagcauccucaccgagaagguguccaagagcucccggcuggagaaccugaucgcccacuaccccacggagaagaagaacacccucuucgggaaccugaucgcgcugagccucgaccugcacccgaacuucaagaccaacuuccagcuguccgaggacgccaagcuccaguucagcaaggacaccuacgaggaggaccuggagggcuuccugggcgaggucggggacgaguacgccgaccucuucgccuccgccaagaaccuguacgacgcgauccugcucagcggcauccugacgguggacgacaacuccaccaaggccccgcugagcgccuccauggugaagcgcuacgaggagcaccagaaggaccucaagaagcugaaggacuucaucaaggucaacgcccccgaccaguacaacgccaucuucaaggacaagaacaagaagggguacgcgagcuacaucgagagcggcgugaagcaggacgaguucuacaaguaccugaagggcauccuccugaagaucaacggguccggcgacuuccuggacaagaucgaccgggaggacuuccuccgcaagcagcggaccuucgacaacgggagcaucccccaccagauccaccuccaggagaugcacgccauccugcgccggcagggcgagcacuacccguuccugaaggagaaccaggacaagaucgagaagauccugaccuuccgcauccccuacuacguggggccccuggcccgcaagggcucccgguucgccugggccgaguacaaggcggacgagaagaucacgcccuggaacuucgacgacauccuggacaaggagaaguccgccgagaaguucaucacccgcaugacccucaacgaccuguaccugccggaggagaagguccuccccaagcacagcccccuguacgaggccuucaccguguacaacgagcugacgaaggugaaguacgucaacgagcagggcgaggccaaguucuucgacaccaacaugaagcaggagaucuucgaccacguguucaaggagaaccggaaggugaccaaggacaagcuccugaacuaccugaacaaggaguucgaggaguuccgcaucgucaaccucaccgggcuggacaaggagaacaaggcguucaacagcucccugggcacguaccacgaccuccggaagauccuggacaagagcuuccuggacgacaaggccaacgagaagaccaucgaggacaucauccagacccucacccuguucgaggaccgcgagaugauccggcagcgccugcagaaguacuccgacaucuucacgaaggcccagcucaagaagcuggagcggcgccacuacaccggguggggccggcugagcuacaagcucaucaacgggauccgcaacaaggagaacaagaagaccauccuggacuaccugaucgacgacggcuacgccaaccggaacuucaugcagcucaucaacgacgacgcccuguccuucaaggaggagaucgcgcgcgcccagaucaucgacgacguggacgacaucgccaacgucgugcacgaccugcccggcagcccggccaucaagaaggggauccuccaguccgugaagaucgucgacgagcuggugaaggugaugggccacaaccccgccaacaucaucaucgagauggcgcgggagaaccagaccacggacaaggggcgccggaacagccagcagcgccugaagcuccugcaggacucccugaagaaccucgacaaccccgucaacaucaagaacguggagaaccagcagcugcagaacgaccggcuguuccucuacuacauccagaacggcaaggacauguacaccggggagacccuggacaucaacaaccugagccaguacgacaucgaccacaucaucccccaggccuucaucaaggacaacucccucgacaaccgcgugcugacccgcagcgacaagaaccggggcaaguccgacgacgucccgagcaucgagguggugcacgagaugaaguccuucuggagcaagcugcucagcgucaagcugaucacccagcgcaaguucgacaaccugacgaaggccgagcggggcgggcucaccgaggaggacaaggccggcuucaucaagcgccagcugguggagacccggcagaucaccaagcacguggcccagauccuggacgagcgcuucaacacggaguucgacgggaacaagcggcgcauccggaacgucaagaucaucacccucaaguccaaccuggugagcaacuuccgcaaggaguucgagcuguacaaggugcgggagaucaacgacuaccaccacgcgcacgacgccuaccucaacgccgucgugggcaacgcccugcugcucaaguacccccagcuggagcccgaguucguguacggcgaguaccccaaguacaacuccuaccgcagccggaaguccgcgaccgagaaguuccuguucuacagcaacauccuccgcuucuucaagaaggaggacauccagaccaacgaggacggggagaucgccuggaacaaggagaagcacaucaagauccugcggaagguccuguccuacccccaggugaacaucgugaagaagacggaggagcagaccggcggguucagcaaggaguccauccuccccaagggcgagagcgacaagcugaucccccgcaagaccaagaacuccuacugggaccccaagaaguacgggggcuucgacagcccggucguggccuacuccauccugguguucgccgacgucgagaagggcaagagcaagaagcuccggaaggugcaggacaugguggggaucaccaucauggagaagaagcgcuucgagaagaaccccgucgacuuccuggagcagcggggcuaccgcaacgugcggcuggagaagaucaucaagcuccccaaguacucccuguucgagcuggagaacaagcgccgccggcuccuggccagcgcgaaggagcugcagaaggggaacgagcucgugaucccgcagcgcuucacgacccugcuguaccacagcuaccggaucgagaaggacuacgagcccgagcaccgcgaguacgucgagaagcacaaggacgaguucaaggagcuccuggaguacaucuccguguucagccggaaguacgugcuggccgacaacaaccucaccaagaucgagaugcuguucuccaagaacaaggacgccgaggucagcucccuggccaagagcuucaucucccuccugaccuucacggccuucggcgcgcccgccgccuucaacuucuucggggagaacaucgaccgcaagcgguacaccagcgugaccgagugccugaacgccacccucauccaccaguccaucacgggccuguacgagacccgcaucgaccugagcaagcucggcgaggacuga

SEQ ID NO: 1844 - RNA, 4038 nt, Artificial Sequence
  Cas9 variant
auggaccagaaguacagcaucggccuggacaucgggaccaacuccgugggcugggccgucgugaccgacgacuacaaggugcccgccaagaagaugaagguccucgggaacacggacaagcagagcaucaagaagaaccugcugggcgcgcuccuguucgacuccggggagaccgccgaggccacccgccugaagcggaccgcccgccggcgcuacacgcggcgccggaaccgccuccgguaccugcaggagaucuucgccgaggagaugaacaagguggacgagaacuucuuccagcgccuggacgacagcuuccucguggacgaggacaagcggggcgagcgccacccgaucuucggcaacaucgcggccgaggucaaguaccacgacgacuuccccaccaucuaccaccuccggaagcaccuggccgacaucucccagaaggccgaccuccgccugguguaccuggcgcucgcccacaugaucaaguuccgggggcacuuccugaucgagggccagcugaaggccgagaacaccaacgugcaggcccucuucaaggacuucgucgagguguacgacaagaccguggaggagagccaccuguccgagaugacggucgacgcccugagcauccucaccgagaagguguccaagagccgccggcuggagaaccugaucgcgcacuaccccgccgagaagaagaacacccucuucgggaaccugaucgcccugucccucggccugcagcccaacuucaagaccaacuuccagcugagcgaggacgccaagcuccaguucuccaaggacacguacgaggaggaccuggaggggcugcucggcgagaucggcgacgaguacgccgaccuguucgcgagcgccaagaaccuguacgacgccauccuccuguccgggauccugaccguggacgacaacagcaccaaggccccgcucuccgccagcauggucaagcgcuacgaggagcaccagaaggaccugaagaagcugaaggacuucaucaaggugaacgcgcccgaccaguacaacgccaucuucaaggacaagaacaagaagggcuacgccggguacaucgagaacggcgugaagcaggacgaguucuacaaguaccucaagggcauccugcugcagaucaacggguccggcgacuuccucgacaagaucgaccgggaggacuuccugcgcaagcagcggaccuucgacaacgggagcaucccccaccagauccaccuccaggagaugcacgccauccuccgccgccaggaggagcacuaccccuuccugaaggagaaccaggacaagaucgagaagauccugacguuccggaucccguacuacgucggcccccuggcccgcaaggggagccgguucgcgugggccgaguacaaggccgacgagaagaucacccccuggaacuucgacgacauccucgacaaggagaaguccgccgagaaguucaucacccgcaugacccugaacgaccuguaccuccccgaggagaaggugcugccgaagcacagccugcucuacgagacguucaccguguacaacgagcugaccaaggucaaguacgugaacgagcagggcgaggcgaaguucuucgacgccaacaugaagcaggagaucuucgaccacguguucaaggagaaccggaaggucaccaaggacaagcugcucaacuaccugaacaaggaguucgaggaguuccgcaucgugaaccugacgggccucgacaaggagaacaaggccuucaacuccagccuggggaccuaccacgaccugcggaagauccucgacaaguccuuccuggacgacaaggccaacgagaagaccaucgaggacaucauccagacccugacgcuguucgaggaccgcgagaugauccggcagcgccugcagaaguacagcgacaucuucaccaaggcccagcugaagaagcucgagcggcgccacuacaccggcugggggcggcuguccuacaagcugaucaacggcauccgcaacaaggagaacaagaagaccauccucgacuaccugaucgacgacggguacgcgaaccggaacuucaugcagcugaucaacgacgacgcccucagcuucaaggaggagaucgcccgcgcccagaucaucggcgacgucgacgacaucgccaacguggugcacgaccugcccggcucccccgcgaucaagaaggggauccugcagagcgucaagaucguggacgagcucgugaaggucaugggccacaaccccgccaacaucaucaucgagauggcccgggagaaccagaugacggacaaggggcgccggaacucccagcagcgccugaagcugcuccaggacagccugaagaaccuggacaacccggugaacaucaagaacguggagaaccagcagcuccagaacgaccgccuguuccuguacuacauccagaacggcaaggacauguacaccggggagacccucgacaucaacaaccugucccaguacgacaucgaccacaucaucccccaggccuucaucaaggacaacagccuggacaaccggguccucacccgcuccgacaagaaccggggcaagagcgacgacgugcccuccaucgaggugguccacgagaugaaguccuucuggagcaagcugcugagcgugaagcucaucacgcagcgcaaguucgacaaccugaccaaggccgagcggggcgggcugaccgaggaggacaaggcgggcuucaucaagcgccagcucguggagacccggcagaucaccaagcacgucgcccagauccuggacgagcgcuucaacacggaguucgacgggaacaagcggcgcauccggaacgugaagaucaucacccucaagagcaaccugguguccaacuuccgcaaggaguucgagcuguacaagguccgggagaucaacgacuaccaccacgcccacgacgccuaccugaacgcgguggugggcaacgcccuccugcugaaguacccccagcucgagccggaguucgucuacggcgaguaccccaaguacaacagcuaccgcucccgcaagagcgccaccgagaaguuccuguucuacuccaacauccugcgguucuucaagaaggaggacauccagaccaacgaggacggggagaucgccuggaacaaggagaagcacaucaagauccuccggaaggugcugagcuacccccaggugaacaucgucaagaagacggaggagcagaccggcggguucuccaaggagagcauccugcccaagggcgaguccgacaagcucaucccgcgcaagaccaagaacagcuacuggaaccccaagaaguacgggggcuucgacucccccgugguggccuacagcauccuggucuucgcggacguggagaagggcaaguccaagaagcugcggaaggugcaggacauggucgggaucaccaucauggagaagaagcgcuucgagaagcaccccguggacuuccucgagcagcggggcuaccgcaacgugcgccuggagaagaucaucaagcugccgaaguacagccucuucgagcuggagaacaagcggcgccggcugcucgccuccgcccgcgagcugcagaaggggaacgagcuggucaucccccagcgguucacgacccuccuguaccacagcuaccagaucgagaagaacuacgagcccgagcaccgcgaguacguggagaagcacaaggacgaguucaaggagcugcucgaguacaucuccguguucagccggaaguacguccuggccgacaacaaccugaccaagaucgagaugcuguucagcaagaacaaggacgccgagguguccagccuggcgaaguccuucaucagccugcucaccuucacggccuucggcgccccggccgccuucaacuucuucggggagaacaucgaccgcaagcgguacaccuccgugaccgagugccugaacgcgacccugauccaccagagcaucacgggccucuacgagacccgcaucgaccuguccaagcugggcgaggacuga

SEQ ID NO: 1845 - RNA, 4038 nt, Artificial Sequence
  Cas9 variant
augaagaaggaguacagcaucggccuggacaucgggaccaacuccgugggcugggccgucaucaccgacgacuacaaggugcccgccaagaagaugaaggugcucgggaacacggacaagcagagcaucaagaagaaccugcugggcgcgcuccuguucgacuccggggagaccgccgaggccacccgccugaagcggaccgcccgccggcgcuacacgcggcgcaagaaccggcuccgcuaccugcaggagaucuucaccgaggagaugaacaaggucgacgagaacuucuuccagcggcuggacgacagcuuccucguggaggaggacaagcagggcuccaaguacccgaucuucggcacccugaaggaggagaaggaguaccacaagaaguucaagaccaucuaccaccuccgcgaggagcucgccaacagcaaggagaaggcggaccugcggcugguguaccucgcccuggcccacaugaucaaguuccgcgggcacuuccuguacgagggcgaccucaaggccgagaacacggacguccaggcgcuguucaaggacuucguggaggaguacgacaagaccaucgaggagucccaccugagcgagaucaccguggacgcccucuccauccugaccgagaaggucagcaaguccagccggcuggagaaccucaucgcccacuaccccacggagaagaagaacacccuguucgggaaccugaucgcccucucccugggccugcagcccaacuucaagaccaacuuccagcucagcgaggacgccaagcugcaguucuccaaggacaccuacgaggaggaccuggaggagcuccugggggagaucggcgacgaguacgcggaccuguucgccagcgccaagaaccucuacgacgccauccugcuguccggcauccucgccguggacgacaacacgaccaaggcgccccugagcgccuccauggugaagcgcuacgaggagcaccagaaggaccugaagaagcucaaggacuucaucaaggucaacgccccggaccaguacaacgccaucuucaaggacaagaacaagaagggguacgccggcuacaucgagagcgggguggagcaggacgaguucuacaaguaccugaagggcauccugcucaagaucaacggcagcggggacuuccuggacaagaucgacugcgaggacuuccugcggaagcagcgcaccuucgacaacggcuccaucccccaccagauccaccuccaggagaugcacgcgauccugcggcgccagggggagcacuaccccuuccugaaggagaaccaggacaagaucgagaagauccugaccuuccggauccccuacuacgugggcccgcucgcccgcaaggggagccgguucgccugggccgaguacaaggccgacgagaagaucacgcccuggaacuucgacgacauccuggacaaggagaaguccgcggagaaguucaucacccgcaugacccugaacgaccucuaccugcccgaggagaagguccugcccaagcacagcccgcucuacgagaccuucacgguguacaacgagcugaccaaggugaaguacgucaacgagcagggcgaggccaaguucuucgacaccaacaugaagcaggagaucuucgaccacguguucaaggagaaccgcaaggugaccaaggacaagcugcucaacuaccugaacaaggaguucgaggaguuccggaucgucaaccugacgggccucgacaaggagaacaaggccuucaacuccagccuggggaccuaccacgaccugcgcaagauccucgacaaguccuuccuggacgacaaggccaacgagaagaccaucgaggacaucauccagacccugacgcuguucgaggaccgggagaugauccgccagcggcugcagaaguacagcgacaucuucaccaaggcgcagcugaagaagcucgagcgccggcacuacaccggcugggggcgccuguccuacaagcugaucaacggcauccggaacaaggagaacaagaagaccauccucgacuaccugaucgacgacggguacgccaaccgcaacuucaugcagcugaucaacgacgacgcccucagcuucaaggaggagaucgcccgggcccagaucaucggcgacguggacgacaucgcgaacgugguccacgaccugcccggcucccccgccaucaagaaggggauccugcagagcgugaagaucgucgacgagcucgugaaggugaugggccacaaccccgccaacaucaucaucgagauggcccgcgagaaccagacgaccgacaaggggcggcgcaacucccagcagcggcugaagcugcuccaggacagccugaagaaccuggacaacccggucaacaucaagaacguggagaaccagcagcuccagaacgaccgccuguuccuguacuacauccagaacggcaaggacauguacaccggggagacccucgacaucaacaaccugucccaguacgacaucgaccacaucaucccccaggccuucaucaaggacaacagccuggacaaccgggugcucacccgcuccgacaagaaccggggcaagagcgacgacguccccuccaucgagguggugcacgagaugaaguccuucuggagcaagcugcugagcgucaagcucaucacgcagcgcaaguucgacaaccugaccaaggcggagcgcggcgggcugaccgaggaggacaaggccggcuucaucaagcggcagcucguggagacccgccagaucacgaagcacguggcccagauccuggacgagcgguucaacaccgaguucgacggggcccagcgccggauccgcaacgucaagaucaucacccucaagagcaaccucguguccaacuuccggaaggaguucgagcuguacaaggugcgcgagaucaacgacuaccaccacgcccacgacgcguaccugaacgccgucgugggcaacgcccuccugcugaaguacccccagcucgagccggaguucguguacggcgaguaccccaaguacaacagcuaccggucccgcaagagcgccaccgagaaguuccuguucuacuccaacauccugcgguucuucaagaaggaggacauccagacgaacgaggacggggagaucgcguggaacaaggagaagcacaucaagauccuccgcaagguccugagcuacccccaggugaacaucgugaagaagaccgaggagcagaccggcggguucuccaaggagagcauccugcccaagggcgaguccgacaagcucaucccgcggaagaccaagaacagcuacuggaaccccaagaaguacgggggcuucgacucccccgucguggccuacagcauccugguguucgccgacgucgagaagggcaaguccaagaagcugcgcaaggugcaggacaugguggggaucacgaucauggagaagaagcgguucgagaagaaccccgucgacuuccucgagcagcgcggcuaccggaacgugcgccuggagaagaucaucaagcugccgaaguacagccucuucgagcuggagaacaagcggcgccggcugcucgccuccgcccgcgagcugcagaaggggaacgagcuggugaucccccagcgcuucaccacccuccuguaccacagcuaccagaucgagaagaacuacgagcccgagcaccgggaguacgucgagaagcacaaggacgaguucaaggagcugcucgaguacaucagcguguucucccgcaaguacgugcuggcggacaacaaccugaccaagaucgagaugcuguucagcaagaacaaggacgccgaggucuccagccuggccaaguccuucaucagccugcucacguucaccgccuucggcgccccggcggccuucaacuucuucggggagaacaucgaccggaagcgcuacaccuccgugaccgagugccugaacgccacgcugauccaccagagcaucaccggccucuacgagacccggaucgaccuguccaagcugggcgaggacuga

SEQ ID NO: 1846 - RNA, 4041 nt, Artificial Sequence
  Cas9 variant
augaaccagaccaagaacuacgacaucggccuggacaucggggugggcagcgucggguggaccaucacggacucccagagccagaaggugcucaaggugaagggcaagcaggggaucggcguccaccuguucaacgagggccagaccgccgaggagcgccggcaguuccgcaccaaccggcgccggcugaagcgccggaaguggcgccuccggcugcugcgcgagcuguucgacgagcccaucuccagcaucgacccggaguucuucgcccggcugaaguacuucaacgaguccagcaaggaccccaagaacaagggguaccagccccagcugcacgacgaccucaaggacguggacuucuaccgccaguaccccaccaucuaccaccuccggcacgcgcugaugacgcagaaggagaaguucgacauccgcgacaucuaccucgccauccaccacaucgugaaguaccggggccacuuccugaugaacgggcacuccagcuccuucagcgucgcccagaccgacuggaaggccgaccugaccaagcuguucgagcugauccaggagacccgcacgaaccuggacuucuccuucgaccucaccgagaucgacaccaucaagagccugcuguucgacaagaaccucucccggaacgaccgccagaaggagaucgugggccugaucaacaacaacagccagcuggacaagaaggacaaggcccucaccaagcagcugguggaguccgucgugaaggggaucgugggcaugaagacgcggaccgacauccugcucggcuacgaggucgacaacaaggagcagagcaaggcguggaacuucuccaucgacgagcuggacgaccagauggccaccaucgacccggcccugagccagaacucccaggcccacgacaucaucacccucauccagaagcuguacaugacggugcagcuggcgcagaucgugcccgaggggcagagcgucagcgagaugaugaucaaccgcuacaaccucuacgccgagcagcugcagcagcugaaggacuacaagaagaucaaccucgagaccggccugcugcuccgggaggccuacgacgagcugaugaccaaggcccugaccgccgcgcccgggaagacgauccacgacaccuucuacaacaaggugaagaagauccucaaggaccaggacaacaagcaggcccuguccaucaagcaggccaucgaggacagcaacuaccugaucccccuccgcaucaaguccaacggcgugaucccguaccagcugcaccagcgcgagcuggacgccaucaucgagaaccagaaggaguucuaccccuuccucgccacccccaaccccgucgacggccaccaggaggcgcugccguacaagcuggacgagcugaucggguucaaggugcccuacuacgugggccccauggucgaccccgagguggacagcgaccagaacuucgccuggauggugcggaaggagaagggggagaucaccccguggaacuuccacaacaaggucgacaucacgcaguccgccgacaacuucaucaagcgcaugaagaccaccgacaccuaccucaucggcaaggacgugcugccccagaacagccugcucuaccagcgguacacgguccugaacgagcugaacgggaucaagguggccaacaagaagcucaccaucgagcagaagcagcgccuguacgaccagcuguucaagaagaagaagaccgugaagaagcaggacauccucaacaaccuggucgccgcgggcgagauccacgaggacgacaaccugaccggccucuccaacgggacgaccuucaacaacaaccugggcagcuacaucgacuacugcaagaucaucgggcaggacaagcuggaggacgccuccaagcaggccgacaucgagcggaucaucgaguggagcaccaccuucgaggacgccaacaucuuccucacgaagcuggccgagaucaacuggcugaccgaggaccagcgccagaagcucucccagauccgguaccgcggcugggggcaguucagcaagacccugcugaccgacaucaaggacaacaaggacaacuccaucaucgacaaccucaugagcaccaagaagguguucaugcagaucaucaacgacacgaccaucaagcagaagaucgacgacuacaaccaguaccaccugaaccacgcggaccugaaggacaccaucgccaaccucuucaccagcccccagaacaagcgggccaucaaccagacgcugcuggugaucgaggacaucaucaacgccgucggccacaagcccaaccgcaucuucaucgagagcgcgaaggacaaccggaacgccaagaaccagcucacccagucccgccugaagcggaucgugaagcaguucgaggacaacaagcagcacguggaccagagcgucuacgaggagcugaagcagcucgacgacggcucccacgccagcaucgacgaccgccugcugcucuacuuccugcagaacgggaaggacauguacaccggccagccgaucgacaucagccagcuguccaccagccaguaccacaucgaccacauccucccccaggccaaggugauggacaacgcccuggacaaccgggugcuggucuccagcaaggcgaacacggagaaguccgaccgcuuccucagcgagaucccccaguuccagcagcggucccugugggccgagcuggagcgcaugggguuccucaccaaggccaagaaggagcggcugcugaugaccagcgacgaguucaagcagaacuccgugcgcuucaucgcccgccagcucguggagacccggcagaucaucaagcuggucaaccagcugaucauccaggagcaccccgaggugaagcucgugaacaucaaggccgaccugacgaacgcguuccgcaagaaguucaacuucgucaagaaccggaacgccaacgacuaccaccacgccuucgacgccuaccugaccagccucaucggcucccaccuccugaagucccacccgaagugggagccccucuucguguacuccgacuacgacaagaucaaguucgacaacgcgccccagggggugaacaucaugaaggaguucgagcagagcaagcuggccgacgagaacggcgagaucaucuggaacaaggacgagaugauggccuaccuggagcgccucuacaacucccggcagauccugaucaccaagaaggucuacgcccgccacggcaaccuguucaagcagaccaucuucaaggccggggagagcgacaaccucauccccgugaagaacaaccgguccgacaucgcgaucuacggcggguacaagagcaagcaggucagcuacuacgcccugaucucccugcacaacaagaagcgccagaagcggcucguggccguguaccugaucgacauccagaagcugcagaaccucaacgagagcgacuacuucaagacgcugcacaccaucaucaaggagcgccacaacaucaagccggaguucgacauccuggccgacaagaucuaccagaaccagcucaucaucgacaacaagaacggcuccaaccggcccuuccgcaucgagggcgacuucaagaacgaccggcagcuguaccugccccuccaguaccagcgcuggcuggccagcaaggagccgaccgacgagaagcugaaccggaucuucgaccacaucugcgagcagcucgcggacuacuucccccuguucgccgggaacgccugcgacaagcugcucgacaaccgcgacaaguucuaccagcuguccaucaagagcgaguucaacgacaagggcaagcugaucgccgaggggaagcucuccgugaucgacaagcugcuggucgccaugcacgcggacagccggaacuccaaccucgccgugaucggccugagcuccagcugggggcgcuucaagcugcacggcggcaacgaggccaucgggaccuccgugcagcucauccaccagagccccacgggccuguucaagcggauccagcgcuucaacuga

SEQ ID NO: 1847 - RNA, 4041 nt, Artificial Sequence
  Cas9 variant
augcugagcgccggcgugaugcucggggacgucuccgcccucaagagcucccgcaacagccuguuccagaaguccaagaagcugaucgagaacagcuccagcgaccugaccaagguggacuacuccaagaugcgggagauccugcucagcauccgcaacaucgcgauccgguucuucaacaacgaggacuucaaggaguccgacuacuacaaggaguuccccaccaucuggcaccuccgcaagaaccugauggagagcgacaagaaggccgacauccggcugguguaccuggcccugcacaacaucgucaaguaccgcggcaacuuccuccaggagaacaacaaggaccugcgggccgccaacgcgaacgccggggccgccgcgaucgaccuguccaacgcccucgaggaguacuucagccugcacgaggacgaguccgcccugacgugcgugccgaacguggccgaccuccagaugacccuggagcagcccggccugcgcaacggggagcggcucgaccgcaucgucgccgcgcugaacaugcccgaccgggcccgcgccaagcuguucgccaaggccugcaucggccagaagguggaguucagcaagcucgcgcugggcauggagaagcaggaggggaccaacgccuacaucugggacgacgacaaguacgacgagcugguggcccucugccccgaggacuucuucccgguccuggagacccugaagaacgccuacuccgccuacgugcucagcgaccugcuggcgggcaagcucuccaucagcgccagccugaucgacuccuacgagcagcaccagaacgaccugaagaucgugaaggagcucguccgggaguaccuggggcagaaggaguacggccgccuguuccgggggcccaaguucgccaacggcgacuacaacuucaacaagguggccaagcccagcuacacguccuacauccucggcgagagccugugcaacaagcaggggaccacccgcgaggagcuggugaaggagcucaagcgggucuucgacgacugcuccgccauccaggcggacaagcgcuaccagaagaucaagcagcggcuggaggacgaccccaaguuccugaucaagcagaagacccgcgccaacggcgccaucccguaccagcuccaccuggaggagaugcaccagaucaucgagaagcaggggaaguacuaccccuuccugguggagcagcaggaccucaucgagaagcuggugagcucccggauccccuacuacgucggcccccugaacggcgggcacgacccgaaccaccccuaccccacgaaccccaucgacccgaagcgcaaguucgccuggagcgugcgcaagcccggcauggagcacgagaaggcguaccccuggaacguggacgaggucaucgacuccgaggagaccgccgagcgguucauccgccggaugaccgggaccugcacguaccuguacggcgagcccguggugccgcgcugcagccuccuguacgaggaguucugcguccugaacgagcucaacggggcccgguggggcgagggcaacggggacacccaccgcuucgacuccagcgaccggaccgagauccuggagcagcuguucaagaagcgcaagcgggugacccacaaggccaucgccacguggcucgagaucaaccacggcgucaccaacgugaagaucuccgggacccaggcggagaacgccuucgagagcaagcuguccagcuacaacgacuucugcaaccugcucggcguggacgggcuggaggacgucugcccccugaccaaggacgacaucgagcagaucauccucugggugacgguguucgaggacaagaagcugcugcuccagaagcugcagcgcgccuucggcgacaagcuguccgagaagcagaucgccagcaucaugcggaagcccuacgccggcugggggcgccucuccagcaagcugcugaccggcaucaagcgggagacccccuucgggcgcaucagcauccucgacgucaugcgggacggcgacccgcgccccgggcaccaccuggacgcgaugaacuucauggagauccugcgggagaaggacuucggcuuccaggaccgcaucgacgagaucaacaaggagcggaccaaggaguccggccuccugcugagcguggaggaccuccccgggucccccgcccugcgccgcagcgugaaccaggccaugcacauccugaaggagaucgucuccaucgccggcaaggagccgagccggaucgugaucgaggugacgcgcgaccccgacgaggagaagcgggggcaccgcaccgacacccgguacaagcagcucuccgaggcccuggcggccaucaagaccgacaucguccaguucgacagcucccugcucgccgagcugaaggagcgcaaggacagccuggacuccgagcggcucaugcuguacuuccagcagugcggcaagagccuguacuccggcaagccccucgacaucaaccgccugagcgaguaccagguggaccacaucaucccgcagugcuacaucaaggacgacucccuggacaacaaggcccucguguucgcgagcgagaaccagaucaagcuggacucccugcuccuggacaagagcaucauccggagccagaaggggcgcuggcaggagcugcaccgggccggccucaucuccaacaagaaguuccgcaaccugacgugcaccgagaucagcgaccggaugaugaagggguucaucaaccgccagcuggucgagaccucccagaucgugaaguucgugcggcagaugugcgagcagcgcuacgagagcuccgaggucaucagccuccgggccucccugagccacaaccugcgcgaccggugcggcuucaucaagugccgcgagcucaacgacuaccaccacgcccacgacgccuaccuggcgugccagaucgcccgguucaucgggauccgcuacccccgcuggcaggacggcaucucccgggaguucaucaacaaguacaucaagcagcuggugaagaagggcaagagcuccgggaaguucuucgccggcaagagcggguucaucaucgacuccuucaugcacgacggcuucgaccgcgagaccggggagaucuuccgggacggcugggacgccacguucgagaucacccgcaugcggcgcgugcucggcuacaaggacugcuucaucacccggaugcccgaggagcagaccggggccuacugggaggagacgaucuacagcccccuggacgcgaagaacggcaagaaccugcagaucccgcucaagcaguccgggaaggagggcuaccuggaccccaagaaguacgggggcaccaacaccgccuucaacgccuacuucuucgccuucgucgccaaggacgcgcgcggccgggacaaguacuucuucgagggggugcccguguaccuggccaagcagcucaacgagcagccccagauccuggucgacuucgccaacagcaucgccgcgaccaagaagugcuccaccgccaagauccugcgcagcaaggugccgcuccggcagaaguuccugcuggacggcacguccuucuaccucgggggccgcaccgggaacaagaacgugauccugagcggcgucgaguucgccugcggcaucgacauggccaagaugaucgacaccgccaucaagcaccccgaggagcugagccagaaggagcucaucuccaucauccagaugcuggcggacaccaucgagcggaacagcgaccgccaggccucccugaucaacuuccggcgcuucgacgacaagcuccggaacaucgacgccaucgccgccagccgcaucaucaagaaccugcugaacuccaugaacggggugaagcagagcugcgaccucuccgaccugggcgggagcaagcaguccggcuucaugcagagcaacaucgcgacgcuguucgagcggaucaccuggugcuacuccagcaucaccggcauguucgagcagcgcguguccuucgaggaccucaagaacgggaucuga

SEQ ID NO: 1848 - RNA, 4041 nt, Artificial Sequence
  Cas9 variant
augaagaagcgcaaccgggaggaguacuacgugggccuggacaucgggaccagcuccgucggcugggccguggccacccccgacuaccgcaucccgaaguuccgggggcacaagauguggggcagccgccucuucgcggaggggaagcgggccgccgagcgccggcaguuccgcacgaaccggcgccggcuggcccgccggcgcgaccggcugcagauccucgaggagcuguucgccgaggagauggcgaagguggacaacaccuucuucaugcgccugaaggaguccaaguucuuccucgaggacaagaccgucaaggagaagcacauccuguucagcaccgacaaguucgacgccgaccgguucuacaaggacaaccccacgaucuaccacgugcgcaagcggcugauggaggaggagccccaggacauccgcgagcuguuccucgccgugcaccacauccugaaguaccggggccacuuccucuucgccggcucccuggagcagaacggggacagcaucgaggagcugguccgcacccucuucggcaagcaggggcuggcgauccuggacgacaccaucgacuccaacgagauggugaacauccucaagaacaacgagaagaccaagagcgaccgcaagaaggccgugcaggagcuguggaacccccugaaggacaaggucaagaaggcccaggccgccgagauggcgggcguggugcucgggcugaacuccgacaucagcaagcuguucgacaacuccgacuacaaggaccucaagaucaacuucagcuccggcgacuacgacgagaagcgggacgacuacgccaacagcaucggcgacgacaucguccugcuggacacgaugaaggcccucuacgacacccugauccugucccagauccuccaggggaagcagagcaucuccgaggccaagguggaggacuacaacacccacaaggagcagcugcgcgcccugaaggcgauccucaagccgcacaagcggcuguacaacgagauguuccgcgagaacaacaagaaggaccugagcaacuacguggccuacaucuccagcuacagcgagggcaagcgggucaaccgcgagggguucuacaaguacgugcaggccgugcucaagcaggucgacgacuccgacagcaagcaggccauccuggaggccauccggcuggagaccuuccucccccugcugcgcgugaaggacaacgcggugaucccccaccagauccaccaggccgagcucgaggccauccuggagacggcccggaagaaguacaaguuccugaacgacgucuccgagggcgugagcgugaaggacaagaucauccagcuguucaccuuccgcauccccuacuacgucggcccgcucaacccccacuccggggagaccguggccgaccggaagcagggcaccgggugggucgugcgcaagcagcggggcaagguguaccccuggaacuucgcggacauggucgacgugaaggccagcgccgaggccuucaucacgaaccugaccaacaagugcaccuaccucaucggggaggacgugcugcccaagcgcucccugcuguacagcgaguucaugcuccugaacgagcugaacaugaucaaguacgacggccacgagcucccggucgagaucaagcggcuguacaucgagcaggucuucaagcaggagcacaagaagcagaccaagggccgcgugcuggacuuccucaagcggaacgggcugaucacgggcuccgcgaccgccgugaucaccgggauggacgacagcaucaagggcgaccugcaguccuaccgcgacauggugcggaucuucgggaccggcuucgaccacagcauggccgagcgcaucauccgcugggugacccucuucggcgaggccaaggacauccuggagaacaagauccgggaggucuacgggaacuccaucagcgacucccagaugcgcgccaucaagaagcugaaguacgcggacuggggccggcucagccaggccuucuucaucaagaucaucgggugcgacaaguccggcguggagcgcaacaucaucacgugccugcgggagagcucccagaaccugauggagauccucagcgaccaggggaccuacaucaagcagaucaaggccuggaaccaccagcacaccacgaacaugauggacacccuggacuaccagcugguggacgaccucuacgucgcccccagcgugaagcgcuccaucuggcagagccugugcaucguggaggagcuggucaagaucaugggccaggcccccaagaagaucuucguggaggugacccggaccaaccaggcggagaagacgaagaaggacucccgcaagaagcggcucgucgagcuguacaccgccaucggcaaggagggggccgccuggaagaaggagaucgagaagcaccaggccggcgacuuccgccggaagaagcuguaccucuacuacacccagauggggcgcugcauguacagccacgagcccaucgcgauggacgcccuguucaccuccgaguacgacaucgaccacaucuacccgcagagccugacgaaggacgacuccugggacaaccucgugcuggucaagagccagcugaacaaggagaaguccgaccaguacccccuccggcccgccauccgcgagaagaacaaggccuacuggcaguaccugugccgggcgggcuucaucagcgagaagaaguacgagcgccugaugcggaccaccgagcucaccgccgaggagcuguccggcuucaucgcccgccagcugguggagaccagccaggccacgaaggccgugaucgggcuccuggagcggaucuacaagcacaccgacaucugcuucgugaaggcggagaccgucucccaguuccgccaccagcacaacuucaucaagauccgggagcugaacaacuaccaccacgccaaggacgccuaccucaacaucguggugggcaacgucuaccacgagaaguucaccaagaacccccgcgaguucaucgcccgcagcacggagcggcgcccguacaaccugaaccggauguacgacuucgaccugcucaagcaggggcgcgugaucuggcagguccccaagucccuggagaccgugcaggccaugaugaaguccaacgacgugcggaucaccaagaagcugcucgugcagaagggcgagcuguacgacgcgaccaucacgaaggcccacaagaccaaggaggggauguacuucccccugaagggcgccgacgcccgccuccgggacguccaccgcuacggcggguacgagaagaucaagaucgccuacuacagcguguucagcugcugcgagaaggcgagcgacaccauccacacccugaucauccccaucccgguguacgccgccggccugcuccagacggaggccgaccugaccgcguacgccuggcagaccaagcagaagaccaagcccaucaaggacaucuacuccaugaucacgcccaucuacaagaagcugugcaucaacaccgucgugaagaucgacggguucaaguacuuccucggcgggcggaccgaggacuacaucugccuguaccccgccaucccggugguccuggacgagcaggccgccgcguaccucaaggccgugagcaaggugggccgcgccgacgacgucgagaacaccgcccaggccaucgaccugaucacggcggaggccaacgaggccuucuacgacgugcugcucaagaagauggaggccaagaucuucgugaaggccuaccaggagcgggucgagaagcuggcguccgagaccgcccgcgagcgguuccgcaagcugagcaucggcgcccagugcuccugccuccuggagauccugaaccuccuggccaacaacaagaccaccagcaaccugaagaaguggcucggggugacgaugucccggcgcaagcagcccauggaccugaccaagcuggaggagugcaucguguacgagaccagcaucaccggccucuacgagaaggccgucucccugcuguga

SEQ ID NO: 1849 - RNA, 4041 nt, Artificial Sequence
  Cas9 variant
augguggagcacuacgccaucggcuucgacaucgggaccggcagcaccggguucgccggcgucgaccccaacgggaagcuggugcgcaugcggggcaagaacguguacggcgucuaccgcuucaagggcggggaggcggccgccgaccggcgcggguuccggacgacccgccggcgcaucaagcggcgcaaguggcggcuccgcuuccugaaguccuucuucgagccguacaucgcccccaucgaccccgaguucuuccugcggcagaaguacagcgccgacagcccccucgacccgaagggcauccgcgcggacaaggggcugcuguccgacauguccgaccaggaguuccacgccaaguaccccaccaucuaccaccuccgguaccagcugaugcacgagaagcgccaguucgacgugcgggagaucuaccuggccaugcaccacaucaucaaguaccgcggccacuuccucaucgaggacggcgccgacaacuucgacgcgaagcagaucgacuucuucgaccaguuccagcggauggccgccgugaccgccgggcugcccgagcuggagacgcucgucgugcccgacgagacccagagcgacgccuucaagcgcgugcuguucgacgagucccagaccaagagcgaccggcagaagguccuggcgucccagcuccuggacauccaggacaaccagagcaaggccaucaaggacuucaucgccgcccugaccaaggccguggugggcaugaaggcgaaccucgccacgcugaccuccaccgccaucgagagcaccgacaagaacgacuggacgaagccgcuggggcagcucgacgacuuccugcugaagcacgaggaggaccucgacgaggacggcuacgcccugaucgacgccgcgaaccagauguacuccgccgccguccuggccgcccucgugcccgagggcaugggguucagcgaggcgaugauggcccgcuacgcccagcacaagaagcagcuggcccuguacaagcaggucaucgcgucccuccccgacaagacccagcgccacgagcugaaggacgccuacgccgacuacaucgagcacgccgcccagaacccccgggacgcguucuacaagcgcgugaccaaggugcuggagggcguggacagcgccgacgcccggaccgucaugacggccaucucccacgacgaguuccuccugaagcagcgcacccugagcaacgggaagaucccguaccagaugcagcagcacgaguucgacgccaucaucgagaaccagaaggcguacuaccccuggcucgccacccccaaccccguggaggccgacgccaagcggcugccguacuaccuggacgagcucaucggcuuccgcgugcccuacuacgucgggcccauggugaccgagaagcagucccaguucgccuggaugauccggaaggcggacggcgagcugacgcccuggaacuucuucgacguggucgaccgcgagaagaccgccaaccgguucauccagcgcaugcagaccaccgacaaguacauccugggcgaggacgugcucccgaagcacagcauccuguaccagcaguucgagguccugaacgagcucaacaacauccggguggagaagcacccccugacgaccgagcagaagcaguucaucuaccagcgccuguucguggaccagcagcggaagaccaucaccaagaagaaccuccaggacacgcuggucgccaugggggaguucgacaaggcccccgacaucggcgggcuggcgaaggaggacgugaugaugagcucccuggccaccuucgccgacuacagcaagauccuccccgaggccaucuccgacccgacccgccagaacgacaucgaggacaucaucgccuggagcaccaucuucgaggacacgcagaucuucuucgacaagcugaagaccguggacuggcugaccacccagcagcggaagcgccucgcguccauccgguacacgggcugggggaagcugagcaagcgccugcuccagcagauccccaccuccaagcacaccaacgucauggccgcccugugggccaccagcgacaacuucaugcagauccugcaggacgagcaguuccaggagggccucuacgacgccaaccggcugcccgaggagacccugacgcccgacgagcaggucgagaagauccucgacgaggcguaccuguccccggccgacaagaagggcgcccgcaaggugaucaaggugaugaacgacaucgugcgcgccaaccacggggugcugcccgagcaggucuuccucgagagcgccgacgacccccagaagaacaagcggcgcuccgugagccgguccaagcagcuggaggagaaguaccgccaggcggcccagagcuucaucgacgaggccgugaaggaggagcugaacgcccagaucgucaacuccgcggaguucaacgaccggcucgugcuguacuucacccagaacggccgcgacauguacaccgggaagcggcuggacaucgagaaccucggcagcuaccagaucgaccacauccugccgcagucccuggugaaggacgacagccucgacaaccgcgcccugaccgcccgggacaucaacgccgagauguccaaccaguucgucagcgagcgcuucgggcugggcccccgggccuucuggcagcagcucaagaacaacggccugaucagcgggcgcaaguuccggaaccuggugaugcagcgcgacgagaucgacaaguacgcgcccggcuucaucaaccggcagcucguggagacgcgccagaucaucaagaccgucgagcagaucauccaccggcuguggcccgacauccagaucgugaccaucaaggccaaccugacccaccaggugcgcuccgagcucggguucccgaagguccgggagcugaacgacuaccaccacgccuucgacgcccugcucgccgcgcgcaucggccaguaccugcuggagcacuacgccggccucaagcccuucuucacguacggggaguucaagcggggcgacaccaagaaguacgggaccaccaacuuccugcgccgccugacgaaggacaacaaggacaagaagggcgagcuccugcccgaggugagcgacuggaucgacuccaucgacagcaucuacaacuacaagaagauccccguggucugggagaacaccaccaacauguccgcccuguucgaccagaccaucuacccgcggcccgaccgcgacacgaccaagcggaagcucauccccaccaagcuggacaagcccaccgacaucuacgggggcuacagcuccgccaagacggccuacauggcggugaugcgcgugcagaccaagaagggcaccgaguacccggucuucaacauccccgugagcaucgccucccagcugaaccggaucaccgaccagacgaugcucaagcagcaggucaagcaguucaucaucaacgccgagcagagcgccuccaagaagaagcuguacgagagcggggacgugauccugucccgcguggcccucggccagcgguucaccgacaagaacuacggggagguguuccugaucagcaacauggagguccagaacccccagucccuguggcucggccgcgcgagccagcagcggcugacccgcgagcccgaggggaacgagaagccggagaccucccuggccgacaucuaccagcagauccucaagcaggucgaccgguacuuccuggccuucaacauccgccagcagcggcagaagcugcucggcacgcuggaccaguucaccagccugcccgugggccgcgugaacgagcagacccggaccgaccagaaccagcgcagcaucaucgcccgggugaugaucgugcucgggaagggcucccgcgaggagaaguuccccgaguucgggcugagcgcgcugggccggcucguccgcaccgggggcaucacgcuguccgaggacgcccagaucaucuaccagagccccaccggccuguucgagcgccggguggcccucaaggaccuguga

SEQ ID NO: 1850 - RNA, 4041 nt, Artificial Sequence
  Cas9 variant
auggccaagauccugggccucgaccuggggaccaacagcaucggcugggccguggucgacaucgagaacaacaacgaguucacccugaucgagaagggggugcgcaucuuccaggagggcgugaagaucgagaaggggaucgagggcuccaaggcggccgagcggacgaccuaccgcagcgcccggcgcaucaaguaccggcgcaagcuccggaagauccagcugcugggcguccucuccgagaacggguacugccccuuccugagcaaggacgagcuggacuccuggcgcuacaagaagguguacccgaccaacaagagcuuccucaacuggcagaagaccaacgagauccagcuggagaaccccuacuucuaccgggcccugcucguggagaagaagcugaaccugaacaucgaggaggaccgcuucaagaucggccgggccuucuaccaccucgcgcagcgccggggguuccuguccaaccgcauggagggcacgaaggagaacgacgggaccgucaucaagagcaucaccgagaucuccaccgccaagggcgacaagacgcugggccaguacuucuacgagcgguacaagaagggggagaagauccgcgacaccuacacccaccgggaggagcacuaccucgaggaguucgugcgcaucugcgaguuccagcagcuggacaacaaguucgccgagaaggugcggaaggccaucuucuaccagcgcccccucaagagccagaagggccucaucgggaagugcgucuucgagcccaagaagucccggugcagcgugucccgcccggaguucgaggaguaccgcaugcugugcuuccugaacaacaucaagaucaagacccccagcgacgagaaccuccgguuccugacggacaacgagaaggagaagcugaagccccaguucuuccgcaaguccaaggaccacuucgacuucgaggaccucgugaagcagcuggcgcccaagaaccaguucaaguucuacaagagccgggacauccugccgggcaacuggcuguucaacuacuccaugaacaccaccgucagcggcugccccaucuccgcccgccugaaggaccuguucggggagaacuucauggacaucaaguucgacuacauccgggagaaggacggcaagaaguccgugaucgacauccacgacaucuggcacguccucuucaccuacgacagcgaggagaagcugaaggaguucgcccgcaaccggcugaaccucgacgacaucaagaucaaggaguuccagcgcauccagcugaagaaggaguacgccgcccugagccucaaggcgauccggaagauccugcccuuccugcgcgaggggcucaucuacagccacgccguguucaucgccaacauggagacggccauccccuccgagaucuggaacaacuacaccaaccggaacaucaucaagaacgagaucuacaacaucaucagcaaccagaccgaggacaagcaggucguggacaucgugaacggcaucaucaaguccagccgcaucgagaacuccguguggagcaacgaggccguggaguucuucaagaaggaccugaacuccaagaucaagaacuacuacgggaucaagaccuacaacgacuucccggaggagaagaagauccggaucgagacguacgcguucaaccuguucaagcagcagaugaugaagaacuucggccgcggcgaguucgccgccguccagcggaucgacgagcgccucaagcuguuccugaccgacaacuucaacaucgaccccauccuccugaagaagaucuaccaccccagcgccaucgagguguaccagcccccggugcggaagaacgacgggaagcuguaccugggcucccccauggucagcuccauccgcaaccccauggccaugcgggcgcuccaccagcugcgcaagcugaucaacgagcucauccgcaaggagcugaucgacagcaacaccaaggugaacaucgagauggcccgggagcugaugaacgccaacgagcgcaaggccuaccagaacuggcagaacgaccgggagaagauccgcaaggaguacgcccucaagaucaagcagcaccuggacgucgacaaggagcccuccgacguggacauccugaaguaccagcucugggaggagcagaaccacaagugcaucuacaccgggaaggagaucaacaucagcgacuuccugggcuccaacccgaaguucgacaucgagcacacgaucccccggagcaucuccuucgacaacagccagagcaacaagacccugugcgagaacuacuucaaccgcuccgugaagaagaaccggauccccgcggcccuccccaaccacggggagaucaucgagcgccuggagaacuggaagcugaaguacgaggagcucgagaagcagauccaguacgccguccggcaggccaagggcgcgggcgacaaggacagcaaggaccgcgccauccagaagcggcacaagcugaaguucgaguacgacuacuggaagaacaaguacgaccgcuucgugauggaggacgugccggagggguucaagaacucccagcuggucgacaccggcaucaucaccaaguacagccggauguaccucaacacgcuguucgacaagguguacaccgugaaggggaacaccgucgccgacuuccgcaagcuguggggcauccaggacgaguacgagaagaaggcccgggugaaccacucccaccacugcguggacgccaucaccaucgcgugcaucaccaagagcaacuacgagaaccucgccaaguucuaccacgacugggaggagcugcacgucaaggggaucgaccagcugccgcccaugaacaagcccuggaagacguucaccgaggacaucaaggccauccaguacgagauccucgugucccacuacacccccgacaaccugcccaagcagagcaagaagauccugcgcaagaagggccggauccagaagaacgagaacggcaaccccaucuaccucaagggggacacggugcgcggcucccugcaccagcagaccuucuacggggccaucgagaagaccgaggucaacaagaagggcgagccggagaaggugaucaaguacgugguccgcaagagccuggacgugcucgacgacuccagcgugaagaacaucgucgacgacaucgugaaggagaucgugcagaacgcccggaucaaggagaaggacuucaucaaggagcuggagauccagaagcggaagcuggcgaaggccgaggagaacaaggucgugcagauccaggccgagaucgacaagcucaacaagcaggucgccgaccuguacaccaugcccaacaagaacggcaaccccauccccaucaagaaggugcgcaucuuccagaccuccgugacgaacccgauccaccugaagcagcagcgcgacaagagccagaagaccuccaagccccacaaggaguucuacuacgccgcgaacgacagcaacuacaugauggccaucuacgaggggaaggacgagaagggcaaggugaagcgggacuucaagcuccugaacaaccuggaggccggggaguucuucaaguacuccguccacaaggaccucaaggagaagaaccuggagaacauccgcaacgugauccccgacaaggugagcgccggcaagaucgagaucccccugaaggcgaucaucaagaccgggaccauggucauccucugggagaacagcccggacgaggugugggaccugacgaucuccgagguggacaagcggcuguacaaggucgugggcaugagcgugaaccgcaucaaguccgacgucaagaccuucgaguucggcaacaucgugcuccggcacaacaaggaggccagccccgccacccugcugaagauccaggacggggaguucaaguccgacgagaacuacaucgcccagcgcaagcucagccacaaccaguucaacgcccugguggagggcgucgacuucucccugagcgugcucggggagaucaagcggcugaaguga

SEQ ID NO: 1851 - RNA, 4044 nt, Artificial Sequence
  Cas9 variant
augggcgaggacgggaagcccgugcgcgucaagggcaagaccgccaucggggcccggcuguuccaggagggccacguggcggccgaccgccggauguuccgcaccacgcggcgccggcucaaccgccggaaguggcgccugaagcugcucgacgagaucuucgacccguacaucacccccguggacagcaccuucuucgcccggcugaagcaguccaaccugagccccaaggacucccgcaaggaguucaaggggagcaugcuguuccccgaccugaccgacaagcaguaccacgaggacuacccgacgaucuaccaccuccggcgcgcccucaugaccgaggacaagaaguucgacauccggauggucuaccuggccauccaccacaucgugaaguaccgcggcaacuuccugaacuccgcgaccguggacaccuucaaggccagcaaggucgacuucaagaaguccuucaaccagcucaacgagcuguacagcgccaucaaccccgaggacgccuuccagguggacaugaacaaguccgacgagacgggccggcuguuccucgacagcuccauccgcaaguucgacaagcagaagcagaucagcaagcugauccccguggucguggaggacaaggaggcgaagaagcugaacgggaagaucgcccucgagaucaccaaggccauccugggcuacaaguccaagcugaacguggucacccagaccgagcccgaggacccgaagaagugggccgugaaguucgacgacgaggacaucgacagcaagcucaacgacauccugcccgagauggacgagaaccagcaguccaucguggagaucauccaggaccuguacagccaggucacgcucaaccagaucgugcccaacgggaugucccugagcgacuccaugaucaagaaguacaacgaccaccacgagcaccugaagcucuacaagaagcugaucgacaacaucagcgacaccaagaagcggagcgcccugaagaccgcguacgacaaguacgugggcgacgacgggaagaccaucgagcaggacgaguucuacuccaacgucaagaagaaccucgacgacagcgaccuguccaagcagaucgccgaccugaucgaggccgagaaguucaugcccaagcagcgcacgagccagaacggcgugaucccgcaccagcuccaccagcgggagcuggacgagaucaucgagcaccaguccaaguacuaccccugguucgccgaggccaaccccaacaagcacgaccugcaccucgcgaaguacaagaucgaggagcugguggccuuccgcauccccuacuacgucggcccgaugaucacccccgaggaccaggagaaguccucccagaccaucuucgccuggaugaagcgcaaggagcccgggcagaucacccccuggaacuucgacgagaagguggaccggauggagagcgccaaccgcuucaucaagcggaugacgaccaaggacaccuaccugaucggcgaggacgugcucccggaccagucccugcuguacgagaaguucaagguccucaacgagcugaacauggugcgcgucaacgaccacccccugaaggugagcgagaagcaggccaucuaccgggaccucuucgagaaccagaagcgcaucuccgugaagaaccugcagaacuacgucaagagcaaguccgggcugcccaccggccccaagaucagcggccucuccgacccggaccacuucaacagcucccuggggacguacaacgacuucaagaagauguucggcgacaagguggacgaccccgaccugcaggacgacuucgagaagaugaucgaguggagcaccaucuucgaggacaagaagauccugcgggcgaagcucgacgagguggccuggcuguccgacacccagaagaacgaguucaaggagauccgcuaccagggguggggccggcugagcaagaagcuccugaccgggaucgucgacggcaacggccagcgcaucaucgacgagcuguggaacacgaacaagaacuucaugcagauccagagcgacgacuccuucgccaagcggauccacgaggccaacgccaaccagaugaaggcgaccgacguggaggacgugcucgccgacgccuacaccagcccccagaacaagaaggccauccgccaggucgugaagguggucgacgacauccagaaggcgaugggcgggguggcccccaaguucaucuccaucgaguucacccggagcgaggaccgcaacccgcggcgcacgaucucccggcagcgccagcuggagaacacccugaaggacaccgcccaggcccucgucaagagcaucaaccccgacauccuguccgagcuggacaacgccagcaaguccaagaaggggcucaccgaccggcuguaccuguacuucacgcagcucggcaaggacauguacaccgggaagcccaucaacaucgacgagaucagcaacuacgacaucgaccacaucuucccgcaggcguucaucaaggacgacucccugaacaaccgcgugcuggugagcaaggccggcaacaacggcaaguccgccaacgugccccucaagcuguucggggccaagaugggcggguacuggaagcagcuggccgacgcgggccucaucgggcagcgcaagcugaagaaccugcagaccaaccccgacaccaucagcaaguucgccaugcacggcuucauccggcgccagcucgucgagaccucccaggugaucaagcugguggccaacauccugggcgacaaguaccggaacgacgacacgaagaucaucgagaucaccgcccgcaugaaccaccagaugcgggacgaguucggguucaucaagaaccgcgagaucaacgacuaccaccacgccuucgacgcguaccucaccgccuuccugggccacuaccuguaccaccgguacaucaagcuccgccccuacuucgucuacggggacuucaagaaguuccgggaggacaaggugaccaugcgcaacuucaacuuccugcacgaccugacggacgacaagcaggagcggaucgccgacaccgagaccggcgaggugaucugggaccgcaagcggagcauccagcagcuccgcgacgucuaccacuacaaguucaugcugaucucccaggagguguucagccugaacaaggagauguucaagcagaagcuguucccggccacccucgcgaagaaguccaagcugauccagaucaagaaggacaagcccguggacaucuacggcggguacagcaacaacacggacgccuaccucaccgucgugaagcugaagggcagcaaggaggacaaguacaagaucguggggguccccaugcgggcccuggacaaccucaagcacgccgagaaggagagcccccagagcuacaccgccgagcugcgcaaggcgcuggagccgcaguucaccaagaucaagaagaaccggaagacgggcgagguguccaagguggucaccaacuucgacaucgugcucgggcgccuguucuaccggcagauggugaucgacggcagcgagaagucccugaucgccagcuccgucuaccaguacaacgccaagcagcucgugcugagcgaccaggccauccgcaccaucuccgaccaggagggcaucgacgaguucgagcugagcucccaguacgacaagguguacgacgagaucguccagaagguggagaagcuccugcccaucuuccagcaccggcacuuccaggagcgccugaacaacggcaagagccucuucgugaaccugcccguccacgacguguacgaggggaacaagcuggagcaggucgggaagaagcacaucaucaacuccauccucggcgggauccacgccaacgcggaccgccccgacaucgaccuguucggcaucaagaaccugggccaguucagcuccaccagcgggaucaaccucuccagcgacgccaucaucugcuaccagagcccgacgggccuguucgagcggcgcguggugcugaaggaccucuga

SEQ ID NO: 1852 - RNA, 4044 nt, Artificial Sequence
  Cas9 variant
augaccaagcgcgaggagcccuacaacgugggccuggacaucgggagcuccagcgucggcugggccgugguggacaacaacuaccaccuccugaacaucaagaagaacaaccuguggggcgcccgccucuucaaggaggcggagaccgcccaggucacgcgggggcaccgguccaugcgccggcgcuaccggcgccggcgcaaccggcugaacuggcuggacgagcuguucgccgacgagcuggccaagaucgacccgagcuuccugcuccgcaugaagaacuccugggugagcaagaaggaguccacccggaagcgcgaccccuacaaccuguucaucgacgagaaguacaacgacguggacuacuucaaccaguaccccaccaucuuccaccuccggaaggagcucaucaccgaggacaagaaggucgacauccgccugaucuaccuggccauccacaacaucaucaaguaccgggggaacuucacgcucgagaaccagaacuucgacaucagccagcuguccagcaacuucucccagcagaucagcgacuucuucgcgcuguucuccgacuucggcgugaucaugcccgaggacuucgacccggacaagaucagcgacauccuccugaaccccaaccugucccccagcggcaagguguccgaggccaucgccaccaucagccccaagaccaacgucaaggccaagaucaagaucauccuccugcugcucguggggaacaacggcgaccugaagaagcuguucgaccucgagaccacggagaagaucgcggugaagcuguccagccgccacaucgacagcgagcugccgaucauccucuccgagcugaacgagcagcaggagaacaucaucaccaucgccaacagcaucuucggguccaucauccugaaggacuuccucggcgacgagaccagcaucuccgccgccaaggucaucagcuucgaggaccacaagcaggaccugcagaagcugaagaccauguggcgggagacguccaacaaggaggccgugaaggcggggaagaaggccuacgaggacuacaucggccacgaggacagcgagaccuucuacaagaagaucaagaaguuccucgagaaggcccagcccguggaccuggccaacaaggcccuggcggagaucgagcucgagaacuaccugcccaagcagcgcaaccggaacaacaccgucauccccuaccagcugaacgagaacgagcucaucgccauccuggaccaccaggagaaguacuacccguuccugaaggagaaccgcgacaagauccucucccugcugaccuuccgcauccccuacuacgugggcccccuccaggacagcaacaacaaccgguucuccuggaugacgcgcaaggccagcggggccauccggcccuggaacuucuccgagaaggugaacgucgagcagagcuccaacgacuucaucaagcgcaugcggagcaccgacaccuaccugaucggcgagccggugcugcccaagaagucccugaucuaccagugcuacgaggugcucagcgagcugaacaacacccgcgucaaggacggguccagcaaccccaagcggcuggacgugacgaucaagcagcgcaucuacaacgagaucuucaagaaccagaaguccgugagcgucaaggugcuccagaacuggcugaucaaggagagcuacuucaagucccccgagaucagcggccuggccgacaagaagaaguaccucuccagccuguccaccuacaucgacuucaagaagaucuucggccagcgguucgucgacgacccggugaacagcccccagcuggaggagcucgcggaguggcugacccuguucgaggacaagaagauccuccugaucaagcugcagaacuccaaguacagcuacgaccaggccaccaucaacaagcucuccacgaugcgcuaccaggggaccggcaagcugagcaagaagcugcucguggaccugaagaccaccaagaaguccaucggcaagagcggggccgagucccugagcauccucgaccugaugugguccacgaaggacaacuucaugcagaucauccacgacgccgacuacaccuucgagcagcagaucaaggaguucaacuacgacaccgaggacgagcugacgccccucgagaaggucgccaaccugcacgggagccccgcgcugaagcggggccucaaccagagcaucaaggugguggccgacaucgucaaguucaugggccacgacccggagaagaucuucaucgaguucacccgcuccgacgacuucagcaagcugaccaucucccgguaccgccggaucaagaagcaguaccuggagaucgccaaggccaucaagaagauccccgcggaguucaaggacaucaaggaguaccagacccagcucgaggagaacaaggggaagcuggccagcgagcgccugaugcucuacuuccugcagugcggccacucccuguacagcaacaagcccaucgaccucaacaugaucaacuccagcaaguaccacguggaccacauccugccccaguccuacaucaaggacgacagccuggagaacaaggcccucgugcuggccuccgagaacgagaacaagaucgacaacaugcugaucagccacgacaucaucgccaccaaccucccgcgguggcaggcgcugaaggaccagaaccugaugggguccaagaaguucgccgaccucacgcgcaccaccgucaccgagaaccagaagaagggcuucauccagcggcagcuggugcagaccagccagaucgugaagaacaucacgcugauccucaacgaccuguacaagaacaccuccugcaucgagacccgcgccacccugagcuccgaguuccgcaaggccuucagcaacuucgacgagacgaccuaccacuaccaguuccccgaguucgucaagaaccgggacgugaacgacuuccaccacgcccaggacgcguuccucgccugcgugaucggggaguaccagcugaagaaguaccccaaggacaaccugcgccucgucuacgaccaguacuccaaguuccuggacagccugaagaaggacacccggaagaagaacggccgcaugccgcgguacacccagaacggcuucaucaucgggagcauguucaacggcaagacguacguggacgacaacggggagaucaucugggaccagaagaucaaggaguccauccgcaagaccuucaacuaccaccaguucaacgugguccggcagaccaucgagcagcacggcaagcuguucaacgacaccauccagccccacagcgaccgcuacaagcugaucccccugaagacgaaccgggaccccgccaucuacgggggcuacaacaacgacaacaacgccuacuccguggugcucgacgucgacggcaagaagaagaucaacgggaucccgauccgcaucgccaaccagcucaagagcgacgagcuggaccucuccagcuggcuggagaacaacaucaagcacaagaagcccaugaccauccugaucgacaaggugcccaaguaccagcggaucaucaacgaggagaccggcgaccuccugaucaccuccgcgaacgaggugaucaacaacguccagcuguuccuccccagcauguacacggcccugaucucccugcucgacagcaccaagaccgagauguacuccaagcugcugagcaacuacgaggccaacauccucaucgacaucuacgacuaccugcugaccaagcucaagaacaacuacccgcuguaccgcaaggagugggccaagcuggcggagcaccgggacgacuucaucgaguccgaccucgugacgcaggccagcacccugcagcagcugaucaaguucaugcacgccgaccccuccaacgugaaccucaaguucgggaacuucaagggcaaccgcuucggccggaagaacgggaacaucaagcugagcaagaccgacuucaucuacgagucccccaccggccuguucaagagcaucaagcacaucgacuga

SEQ ID NO: 1853 - RNA, 4044 nt, Artificial Sequence
  Cas9 variant
augaaguccgagaagaaguacuacaucggccuggacguggggaccaacagcgucggcugggccgugaccgacgaguucuacaacauccuccgcgccaaggggaaggaccuguggggcgugcggcuguucgagaaggcgaagacggccgccgacacccgcaccuuccggagcgggcgccggcgcaacgaccggaagggcaugcgccuccagauccugcgggagaucuucgaggacgagaucaagaaggucgacaaggacuucuacgaccgccuggacgaguccaaguucugggccgaggacaagaaggugagcggcaaguacucccucuucaacgacaagaacuucagcgacaagcaguacuucgagaaguuccccaccaucuuccaccuccggaaguaccugauggaggagcacgggaagguggacauccgcuacuacuuccuggccaucaaccagaugaugaagcggcgcggccacuuccugaucgacgggcagaucucccacgucacggacgacaagccgcugaaggagcagcucauccugcugaucaacgaccuccugaagaucgagcuggaggaggagcucauggacagcaucuucgagauccuggcggacgugaacgagaagcggaccgacaagaagaacaaccugaaggagcucaucaagggccaggacuucaacaagcaggaggggaacauccugaacuccaucuucgagagcaucgugaccggcaaggccaagaucaagaacaucaucuccgacgaggacauccuggagaagaucaaggaggacaacaaggaggacuucguccucaccggcgacagcuacgaggagaaccugcaguacuucgaggaggugcugcaggagaacaucacccucuucaacacccugaaguccaccuacgacuucgugauccugcagagcauccucaaggggaaguccacccugagcgacgcccaggucgagcgcuacgacgagcacaagaaggaccuggagauccucaagaaggugaucaagaaguacgacgaggacggcaagcuguucaagcaggucuucaaggaggacaacgggaacggcuacguguccuacaucggcuacuaccugaacaagaacaagaagaucacggccaagaagaagaucagcaacaucgaguucaccaaguacgugaaggggauccucgagaagcagugcgacugcgaggacgaggcggugaaguaccugcugggcaagaucgagcaggagaacuuccuccugaagcagaucuccagcaucaacagcgucaucccccaccagauccaccuguucgagcucgacaagauccuggagaaccuggccaagaacuaccccuccuucaacaacaagaaggaggaguucaccaagaucgagaagauccggaagaccuucacguuccgcauccccuacuacguggggccgcucaacgacuaccacaagaacaacggcgggaacgccuggaucuuccggaacaagggcgagaagauccgccccuggaacuucgagaagaucguggaccugcacaagagcgaggaggaguucaucaagcggaugcugaaccagugcaccuaccuccccgaggagaccguccugcccaaguccagcauccuguacuccgaguacauggugcugaacgagcucaacaaccugcgcaucaagggcaagccgcuggacaccgacgugaagcucaagcugaucgaggagcuguucaagaagaagacgaaggucacccucaagagcauccgcgacuacaugauccggaacaacuucgccgacaaggaggacuucgacaacuccgagaagaaccuggagaucgugagcaacaugaaguccuacaucgacuucaacaacauccugggggacaaguucgagcucgagauggucgaggaccugaucgagaagaucaccauccacaccggcaacaagacgcugcucaagaaguacaucgaggagaccuaccccgaccugagcuccagccagauccagaagaucaucaaccugaaguacaaggacugggggcgccucucccggaagcugcuggacggcaucaaggggcgcaacaagaccgacgacgugaacaccgugaucaacuucaugcggaacagcuccgacaaccucaugcagaucaucgagggcaagaacuacagcuucaacgaguacaucgacaaccugcgcaagaaguacaucccccaggagaucuccuacgaggucguggagaaccuguacgugagccccuccgucaagaagaugaucuggcaggucauccgggugacggaggagaucaccaaggugaugggcuacgacccggacaagaucuucaucgagauggccaagagcgaggaggagaagaagaccaccaucagccgcaagaacaagcuccuggaccuguacaaggcgaucaagaaggacgagcgggacucccaguacgagaagcuccugacggggcugaacaagcucgacgagagcgagcugcgcuccaagaagcuguaccucuacuacacccagaugggccgggacauguacaccggggagaagaucgaccuggacaagcuguucgacagcacccacuacgacaaggaccacaucaucccccaguccaugaagaaggacgacagcaucaucaacaaccucgugcuggugaacaagaacgccaaccagacgaccaagggcaacaucuaccccguccccuccagcauccgcaacaacccggacaucuacaacuacuggaaguaccugauggagaaggaguucaucuccaaggagaaguacaaccggcucauccgcaacacgccccugaccaacgaggagcuggggguguucaucaaccggcagcucguggagacccgccagagcacgaaggccaucaaggagcuguucgagaaguucuaccagaaguccaagaucauccccgucaaggccagccuggccuccgaccuccggaaggacaugaacacccucaagagccgcgaggugaacgaccugcaccacgcgcacgacgccuuccugaacaucguggccggcgacgucuggaaccgggaguucaccuccaaccccaucaacuacgugaacgagaaccgcgagggcgacaaggugaaguacagccuguccaaguacuucacccgcccgcgcaagagcaaggggaaggucaucuggacgcccgagaagggccggaagcugaucguggacacccucaacaagcccagcgugcugaucuccaacgagagccacgucaagaagggggagcuguucaacgccaccaucuccggcaagaaggacuacaagaagggcaagaucuaccucccccugaagaaggacgaccggcugaaggacgugagcaaguacgggggcuacaaggccaucaacggggcguucuucuuccucguggagcacaccaaguccaagaagcgcauccggagcaucgagcuguucccgcugcaccuccuguccaaguucuacgaggacaagaacacgguccuggacuacgccaucaacgugcuccagcugcaggaccccaagaucaucaucgacaagaucaacuaccgcaccgagaucaucaucgacaacuucagcuaccugaucuccaccaagagcaacgacggcuccaucaccgugaagcccaacgagcagauguacuggcgggucgacgagaucagcaaccucaagaagaucgagaacaaguacaagaaggacgccauccugacggaggaggaccgcaagaucauggaguccuacaucgacaagaucuaccagcaguucaaggccgggaaguacaagaaccggcgcaccaccgacaccaucaucgagaaguacgagaucaucgaccuggacacgcucgacaacaagcagcuguaccagcugcucguggccuucaucagccuguccuacaagaccagcaacaacgcgguggacuucaccgucaucggccugggcaccgagugcgggaagccccggaucacgaaccucccggacaacaccuaccugguguacaaguccaucaccggcaucuacgagaagcgcauccggaucaaguga

SEQ ID NO: 1854 - RNA, 4047 nt, Artificial Sequence
  Cas9 variant
augaagaagcccuacaccaucgcccuggacaucggcaccaacagcguggggugggucguggugacggacgacuaccgcgucccgaccaagaagaugaaggugcucggcaacaccgagcggaagaccaucaagaagaaccugaucggggcccugcuguucgacuccggcgacacggcggaggggacccgccugaagcggaccgcccgccggcgcuacacccggcgcaagaaccggcugcgcuaccucaaggagaucuucacggaggagauggccaagguggacgacggcuucuuccagcggcuggaggacagcuucuacguccuggaggacaaggagggcaacaagcaccccaucuucgccaaccucgccgacgagguggcguaccacaagaaguaccccaccaucuaccaccuccgcaaggagcugguggacaacccccagaaggccgaccuccggcugaucuaccuggccgucgcccacaucaucaaguuccgcgggcacuuccucaucgagggcacccuguccagcaagaacaacaaccugcagaaguccuucgaccaccucguggacaccuacaaccugcuguucgaggagcagcggcuccugacggaggggaucaacgcgaaggagcugcucagcgccgcccuguccaagagcaagcgccuggagaaccucaucucccugaucccgggccagaagaagaccgggaucuucggcaacaucaucgcccugagccucggccugacccccaacuucaaggccaacuucgggcuguccaaggacgugaagcuccagcuggcgaaggacaccuacgccgacgaccuggacagccuccuggcccagaucggcgaccaguacgccgaccuguuccucgccgcgaagaaccuguccgacgccauccugcucagcgacauccugacggaguccgacgagaucacccgggccccgcugagcgccuccauggucaagcgcuaccgggagcaccacaaggaccucgugacccugaagacccugaucaaggaccagcuccccgagaaguaccaggagaucuuccuggacaagacgaagaacggguacgccggcuacaucgagggccaggugagccaggaggaguucuacaaguaccugaagccgauccuggcgcgccucgacggguccgagccccugcugcucaagaucgaccgggaggacuuccugcgcaagcagcgcaccuucgacaacggcagcaucccccaccagauccaccuggaggagcuccacgccauccugcggcgccaggaggucuucuaccccuuccugaaggacaaccggaagaagaucgagagccuccugaccuuccgcaucccguacuacguggggccccuggcccggggccacucccgcuucgccugggugaagcggaaguucgacggggccauccgccccuggaacuucgaggagaucgucgacgaggaggcgagcgcccagaucuucaucgagaagaugaccaagaacgaccucuaccugcccaacgagaaggugcugccgaagcacucccuccuguacgagacguucaccguguacaacgagcugaccaaggucaaguacgccaccgagggcaugacgcggccccaguuccucagcgccgaccagaagcaggcgaucguggaccugcuguucaagaccaaccgcaaggugaccgucaagcagcucaaggagaacuacuucaagaagaucgagugcugggacuccguggagaucaccggcgucgaggacagcuucaacgccucccuggggacguaccacgaccugcucaagaucauccaggacaaggacuuccuggacaaccccgacaaccagaagaucaucgaggacaucauccugacccucacccuguucgaggacaagaagaugaucagcaagcggcuggaccaguacgcccaccucuucgacaagguggugcugaacaagcuggagcgccaccacuacaccggcugggggcggcucuccggcaagcugaucaacgggauccgcgacaagcagagcggcaagacgauccuggacuuccucaaggccgacggcuucgccaaccggaacuucaugcagcugauccacgacuccgagcugagcuucaucgacgagaucgcgaaggcccaggucaucgggaagaccgaguacuccaaggaccucgugggcaaccuggccgggagccccgccaucaagaagggcaucucccagaccaucaagaucguggacgagcuggucaagaucaugggguaccucccgcagcagaucgugaucgagauggcccgcgagaaccagaccaccgcgcagggcaucaagaacgcccggcagcgcaugcggaagcuggaggagacggccaagaagcugggcagcaacauccucaaggagcaccccguggacaacucccagcugcagaacgacaagcgcuaccuguacuaccuccagaacgggaaggacauguacaccggcgacgaccuggacaucgacuaccugagcuccuacgacaucgaccacaucaucccccagagcuucaucaagaacaacagcaucgacaacaagguccucaccucccagggggccaaccgcggcaagcuggacaacgugcccagcgaggccaucgugcggaagaugaagggcuacuggcagucccugcuccgcgcgggggccaucagcaagcagaaguucgacaaccugaccaaggccgagcggggcgggcugacgcaggucgacaaggccggcuucauccagcgccagcucguggagacccggcagaucaccaagcacguggcgcagauccuggacucccgcuucaacaccgaguucgacgaccacaacaagcggauccgcaagguccacaucaucacgcucaagagcaagcugguguccgacuuccggaaggaguucgggcuguacaagauccgcgacaucaaccacuaccaccacgcccacgacgccuaccugaacgccguggucgccaaggcgauccucggcaaguacccgcagcuggcccccgaguucguguacggcgacuaccccaaguacaacagcuucaaggagcggcagaaggccacccagaagaugcuguucuacuccaacauccucaaguucuucaaggaccaggagagccugcacgugaacuccgacggggaggagaucuggaacgccaacaagcaccuccccaucaucaagaacguccugagcaucccccaggugaacaucgugaagaagaccgagguccagaccggcggguucuacaaggaguccauccugagcaagggcaacuccgacaagcugaucccccgcaagaacaacugggacacgcggaaguacgggggcuucgacagccccaccguggccuacuccgugcucgucaucgcgaagauggagaagggcaaggccaaggugcugaagccggugaaggagauggucgggaucaccaucauggagcgcaccgccuucgaggagaaccccgugguguuccuggaggcccggggcuaccgcgagauccaggagcaccucaucaucaagcugcccaaguacagccuguucgagcucgagaacgggcggcgccggcugcuggccagcgcguccgagcuccagaagggcaacgagcuguuccugcccgucgacuacaugacguuccucuaccuggccgcccacuaccacgagcugaccgggagcuccgaggacgugcuccgcaagaaguacuucguggaccggcaccuccacuacuucgacgacaucauccagaugaucaacgacuucgccgagcgccacauccuggcgagcuccaaccuggagaagaucaaccacaccuaccacaacaacagcgaccugccggucaacgagcgcgccgagaacaucaucaacguguucaccuucguggcccugggcgcccccgccgcguucaaguucuucgacgccacgaucgaccggaagcgcuacaccuccaccaaggagguccucaacgccacccugauccaccagagcgugacgggccuguacgagacccggaucgaccugucccagcucggggagaacuga

SEQ ID NO: 1855 - RNA, 4047 nt, Artificial Sequence
  Cas9 variant
augaaguccgagaagaaguacuacaucggccuggacguggggaccaacagcgucggcugggccgugaccgacgaguucuacaacauccuccgcgccaaggggaaggaccuguggggcgugcggcuguucgagaaggcgaagacggccgccgacacccgcaccuuccggagcgggcgccggcgcaacgaccggaagggcguccgccuccagauccugcgggagaucuucgaggacgagaucaagaagguggacaaggacuucuacgaccgccuggacgaguccaaguucugggccgaggacaagaaggugagcggcaaguacucccucuucaacgacaagaacuucagcgacaagcaguacuucgagaaguuccccaccaucuuccaccuccggaaguaccugauggaggagcacgggaaggucgacauccgcuacuacuuccucgccaucaaccagaugaugaagcggcgcggccacuuccugaucgacgggcagaucucccacgugacggacgacaagccgcugaagcagcagcucauccugcugaucaacgaccuccugaagaucgagcuggaggaggaguucauggacagcaucuucgagauccucgcggacgugaacgagaagaagaccgagaagaagaacauccugaaggagcugaucaacgcccaggacuucaacaagcaggagggcaagauccucuacuccaucuucgagagcaucgucaccgggaaggccaagaucaagaacaucaucuccgacgaggacauccuggagaagaucaaggaggacaacaaggaggacuucgugcugaccggcgacagcuacgaggagaaccuccaguacuucgaggaggugcugcaggagaacaucacgcuguucaacacccucaaguccgccuacgacuucgucauccugcagagcauccugaagggcaaguccacccucagcgacgcccagguggagcgguacgacgagcacaagaaggaccuggagauccugaagaaggugaucaagaaguacgacgaggacgggaagcuguucaagcaggucuucaaggaggacaacggcaacggguacguguccuacaucggcuacuaccugaacaagaacaagaagaucaccgcgaagaagaagaucagcaacaucgaguucacgaaguacgugaagggcauccuggagaagcagugcgacugcgaggacgaggacgucaaguaccuccuggggaagaucgagcaggagaacuuccugcucaagcagaucuccagcaucaacagcgugaucccccaccagauccaccuguucgagcuggacaagauccucgagaaccuggccaaguacuaccccuccuucaacaacaagaaggaggaguucaccaagaucgagaagauccgcaagaccuucaccuuccggauccccuacuacgugggcccgcugaacgacuaccacaagaacaacgggggcaacgccuggaucuuccgcaacaagggggagaagauccggcccuggaacuucgagaagaucgucgaccuccacaagagcgaggaggaguucaucaagcgcaugcugaaccagugcacguaccugcccgaggagaccgugcuccccaaguccagcauccuguacuccgaguacauggugcugaacgagcugaacaaccuccggaucaacggcaagccgaucgacaccgacgucaagcugaagcugaucgaggagcuguucaagaagaagaccaaggugacgcucaagagcauccgcgacuacaugauccgcaacaacuucgccgacaaggaggacuucgacaacuccgagaagaaccuggagaucgucagcaacaugaaguccuacaucgacuucaacaacauccucggcgacaaguucgagcuggagaugguggaggaccugaucgagaagaucaccauccacaccgggaacaagaagcuccugaagaaguacaucgaggagaccuaccccgaccugagcuccagccagauccagaagaucaucaaccucaaguacaaggacuggggccggcugucccgcaagcugcucgacgggaucacgggcaccaacaucgagaccggggagaucgacaccgugaucaacuuccugcggaacagcuccgacaaccugaugcagaucaucggcagccagaacuacuccuucaacaacgacaucgacaagcuccgcaagaaguacaucccccaggagaucagcuacgaggucguggagaaccuguacgugucccccagcgucaagaagaugaucuggcaggucauccggaucacggaggagaucaccaaggugaugggcuacgacccggacaagaucuucaucgagauggccaagagcgaggaggggaagaagaccaccaucucccgcaagaacaagcugcucgcgcuguacaaggccaucaagaaggacgagcgggacagccaguacgagaagcugcucacgggccugaacaagcuggacgacuccgaccuccgcagccggaagcuguaccuguacuacacccagauggggcgcgacauguacaccggcgagaagaucgaccucgacaagcuguucgacuccacccacuacgacaaggaccacaucaucccccagagcaugaagaaggacgacuccaucaucaacaaccuggugcucgugaacaagaacgccaaccagacgaccaaggggaacaucuaccccgugcccagcuccauccggaacaacccgaagaucuacaacuacuggaaguaccugauggagaaggaguucaucagcaaggagaaguacaaccgccugauccggaacacgccccucaccaacgaggagcugggcggcuucaucaaccgccagcuggucgagacccggcaguccaccaaggccaucaaggagcuguucgagaaguucuacaagaaguccaagaucauccccgugaaggcgauccuggccagcgaccugcgcaaggacaugaacacccucaagagccgggaggugaacgaccugcaccacgcccacgacgccuuccugaacaucgucgccggggacguguggaaccgcgaguucaccuccaaccccaucaacuacgugaaggagaaccgggagggcgacaaggucaaguacagccucuccaaguacuucacccgcccgcgcaagagcaaggggaaggugaucuggacgcccgagaagggccggaagcugaucguggacacccugaacaagcccagcguccucaucuccaacgagagccacgugaagaagggcgagcuguucaacgcgaccaucgccgggaagaaggacuacaagaagggcaagaucuaccugccccucaagaaggacgaccgccugcaggacguguccaaguacgggggcuacaaggccaucaacggggccuucuucuuccuggucgagcacaccaagagcaagaagcggauccgcuccaucgagcuguucccgcuccaccuccucagcaaguucuacgaggacaagaacacggugcuggacuacgccaucaacgugcugcagcuccaggaccccaagaucaucaucgacaagaucaacuaccggaccgagaucaucaucgacaacuucuccuaccugaucagcaccaaguccaacgacggcagcaucaccgucaagcccaacgagcagauguacuggcgcguggacgagaucuccaaccugaagaagaucgagaacaaguacaagaaggacgcgauccucacggaggaggaccggaagaucauggagagcuacaucgacaagaucuaccagcaguucaaggccggcaaguacaagaaccgccggaccaccgacaccaucaucgagaaguacgagaucaucgaccuggacacgcuggacaacaagcagcucuaccagcugcugguggccuucaucucccucagcuacaagaccuccaacaacgccgucgacuucaccgugaucgggcugggcaccgagugcgggaagccccgcaucacgaaccugccggacaacaccuaccucguguacaagagcaucaccggcaucuacgagaagcggauccgcaucaaguga

SEQ ID NO: 1856 - RNA, 4047 nt, Artificial Sequence
  Cas9 variant
augaaguccgagaagaaguacuacaucggccuggacguggggaccaacagcgucggcugggccgugaccgacgaguucuacaacauccuccgcgccaaggggaaggaccuguggggcgugcggcuguucgagaaggcggacacggccgccaacacccgcaucuuccggagcgggcgccggcgcaacgaccggaagggcaugcgccuccagauccugcgggagaucuucgaggacgagaucaagaaggucgacaaggacuucuacgaccgccuggacgaguccaaguucugggccgaggacaagaaggugagcggcaaguacucccucuucaacgacaagaacuucagcgacaagcaguacuucgagaaguuccccaccaucuuccaccuccggaaguaccugauggaggagcacgggaagguggacauccgcuacuacuuccucgccaucaaccagaugaugaagcggcgcggccacuuccugaucgacgggcagaucucccacgucaccgacgacaagccgcugaaggagcagcucauccugcugaucaacgaccuccugaagaucgagcuggaggaggagcucauggacagcaucuucgagauccuggcggacgugaacgagaagcggacggacaagaagaacaaccugaaggagcucaucaagggccaggacuucaacaagcaggaggggaacauccugaacuccaucuucgagagcaucgugaccggcaaggccaagaucaagaacaucaucuccgacgaggacauccuggagaagaucaaggaggacaacaaggaggacuucguccucaccggcgacagcuacgaggagaaccugcaguacuucgaggaggugcugcaggagaacaucacccucuucaacacgcugaaguccaccuacgacuuccugauccuccagagcauccugaaggggaaguccacccugagcgacgcccagguggagcgcuacgacgagcacaagaaggaccucgagauccugaagaaggucaucaagaaguacgacgaggacggcaagcuguucaagcaggucuucaaggaggacaacgggaacggcuacguguccuacaucggcuacuaccucaacaagaacaagaagaucaccgccaagaagaagaucagcaacaucgaguucacgaaguacgugaaggggauccuggagaagcagugcgacugcgaggacgaggacgugaaguaccugcucggcaagaucgagcaggagaacuuccugcugaagcagaucuccagcaucaacagcgugaucccccaccagauccaccucuucgagcuggacaagauccuggagaaccucgcgaagaacuaccccuccuucaacaacaagaaggaggaguucaccaagaucgagaagauccggaagaccuucaccuuccgcauccccuacuacgucgggccgcugaacgacuaccacaagaacaacggcgggaacgccuggaucuuccggaacaagggcgagaagauccgccccuggaacuucgagaagaucguggaccugcacaagagcgaggaggaguucaucaagcggaugcucaaccagugcacguaccugcccgaggagaccgugcugcccaaguccagcauccuguacuccgaguacaugguccucaacgagcugaacaaccugcgcaucaacggcaagccgcucgacaccgacgugaagcugaagcugaucgaggagcuguucaagaagaagaccaaggugacgcucaagagcauccgcgacuacaugguccggaacaacuucgccgacaaggaggacuucgacaacuccgagaagaaccuggagaucgccagcaacaugaaguccuacaucgacuucaacaacauccucgaggacaaguucgacguggagauggucgaggaccugaucgagaagaucaccauccacaccgggaacaagaagcugcucaagaaguacaucgaggagaccuaccccgaccugagcuccagccagauccagaagaucaucaaccugaaguacaaggacuggggccgccucucccggaagcugcuggacgggaucaagggcacgaagaaggagaccgagaagaccgacaccgugaucaacuuccuccgcaacagcuccgacaaccugaugcagaucaucgggagccagaacuacuccuucaacgaguacaucgacaagcugcggaagaaguacaucccccaggagaucagcuacgagguggucgagaaccucuacgugucccccagcgugaagaagaugaucuggcaggucauccgcgugacggaggagaucaccaaggugaugggcuacgacccggacaagaucuucaucgagauggccaagagcgaggaggagaagaagaccaccaucucccggaagaacaagcugcuggaccucuacaaggcgaucaagaaggacgagcgcgacagccaguacgagaagcugcugacgggccucaacaagcuggacgacuccgaccugcggagccgcaagcucuaccuguacuacacccagauggggcgggacauguacaccggcgagaagaucgaccuggacaagcuguucgacuccacccacuacgacaaggaccacaucaucccccagagcaugaagaaggacgacuccaucaucaacaaccugguccuggugaacaagaacgccaaccagacgaccaaggggaacaucuaccccgugcccagcuccauccgcaacaacccgaagaucuacaacuacuggaaguaccucauggagaaggaguucaucagcaaggagaaguacaaccggcugauccgcaacacgccccugaccaacgaggagcucggcggguucaucaaccggcagcuggucgagacccgccaguccaccaaggccaucaaggagcuguucgagaaguucuaccagaaguccaagaucauccccgugaaggccagccucgccagcgaccugcggaaggacaugaacacccugaagucccgcgaggugaacgaccuccaccacgcgcacgacgccuuccugaacaucgucgccggcgacguguggaaccgggaguucaccagcaaccccaucaacuacgugaaggagaaccgcgagggcgacaaggucaaguacucccugagcaaggacuucacccgcccgcgcaagagcaaggggaaggugaucuggacgcccgagaagggccggaagcucaucguggacacccugaacaagcccuccguccugaucagcaacgagucccacgugaagaagggggagcuguucaacgccaccaucgccggcaagaaggacuacaagaagggcaagaucuaccugccccugaagaaggacgaccggcuccaggacgugagcaaguacgggggcuacaaggcgaucaacggggccuucuucuuccuggucgagcacaccaaguccaagaagcgcauccggagcaucgagcuguucccgcuccaccuccuguccaaguucuacgaggacaagaacacggugcucgacuacgccaucaacgugcugcagcugcaggaccccaagaucaucaucgacaagaucaacuaccgcaccgagaucaucaucgacaacuucagcuaccucaucuccaccaagagcaacgacggcuccaucaccgucaagcccaacgagcagauguacuggcggguggacgagaucagcaaccugaagaagaucgagaacaaguacaagaaggacgccauccugacggaggaggaccgcaagaucauggaguccuacaucgacaagaucuaccagcaguucaaggccgggaaguacaagaaccggcgcaccaccgacaccaucaucgagaaguacgagaucaucgaccucgacacgcuggacaacaagcagcuguaccagcuccugguggcguucaucagccuguccuacaagaccagcaacaacgccgucgacuucaccgugaucggccucggcaccgagugcgggaagccccggaucacgaaccugccggacaacaccuaccugguguacaaguccaucaccggcaucuacgagaagcgcauccggaucaaguga

SEQ ID NO: 1857 - RNA, 4047 nt, Artificial Sequence
  Cas9 variant
auggagaagaacuacuaccugggccucgaccuggggagcaacuccgugggcugggccgccaccgacgaggacuacaacuuccugcgccucaaggggaagaccgcguggggcgcccggaucuucagcgaggccaaggacugcaaggagcgccggacguaccgcuccaacaagcggcgccuggcccggcgcaaguaccggcugguccuccugaagcagcuguucgccgaggagaugaccaagguggacaagaccuucuuccuccgccuggcgaacagcaccuacugggaggaggacaagacgaaggacuccgacgggaacgagaucggcaagaaccugaucuucaagacccacgaggaggagaagcaguacuacaccaaguaccccaccaucuggcaccuccggaaggcccugaucgagaacgacgaggaggcccugagcaaccuccgcuacguguaccuggccauccaccacaucgucaaguaccggggcaacuuccugacggagggggagaugggcaacgacaucccgcccaucaccaccaucgaggagaucaaccagacccucucccugcuggagguggacagcuccgaggacgcgacggacaagaccaccuacaucaagcccgagagcuacaacgagcuguucaccauccucgagaacaacaaccugaacaaggugaagaagcagcaggagaucgacaagcuguucaucuccagcaaggagcgcuccgagaacaucaagaacuacaucaaccucuucaagacgaucaucgucgggggcagcuucucccugaagaagaucaacgaggacaccgaggacaucagcguggacuucaccaaggacuucgagaacuccgaggccgacaucagcaaggcccucggggacuccuucaaccuggugcugaucgccaagaaguacuacgacuacaucauccucaaggagcugcugggcaagaacaaggagaucagcgaggccaugguccagaucuacgaggagcacaaggacgaccucaagagccugaagaccauccugaaggaccucgacaacaagcugggcaacgacgggaaggaccggaucuacuacuccguguucaagcaggagcccacggagaaguucaaggagaccaacuaccugagcuucgugcagggcgggaagcucgaggagcugaacaaguacaucaagaagauccuggagaacaacgagaaggacaucgacgacaaggagaccuacaacgcgcucuacgagaaggccugcaagggcgaccuguucaagaagcaggccaacgccugcaccucccugaucccgcaccaguuccaccuccgcgagcugaagaagauccuggagaacgccggccggaaguacagcuuccucaacgacaucuccgacaagaucaucaagaucuucaaguuccgcguccccuacuacuacgggccccugaacaacgagagcaacgcgcacuccuggguggugaagaaggagggccaggagaaggccaagaucacgcccuggaacaucaacgagaucaucgacaccccgaagacccgggacaacuucuucaagaagcugaccaacagcugcacguaccuggucggggagaccgugcuccccaagaccucccuguacuacgagaaguaccuggugcucgaccgccugaacaagaugcaggucaacggcgacuaccugagcgccuccgagaagaacgacgugcucaaguucauccugagccggaagaccacgaccaucgagcagauccgcaccuaccuguccaagaacaagagcaccaaggccaacgacaucuccaucagcaacaucaaggccacggaccccuucaacgcggugucccacgccuucuacgggaagcaccccgaccucaacaucaaccugugcgaggagcugaucaaguucgccaccaucuacgccgacgacaagaaggagcucaagaaguucgucagcuccaacuucaaccugaccgacgaguucaucaaggaguaccugaacaccccgaccaacaaguggggccgccucagccggaaguuccugugcggcggggaccagcuggagauguacuacguggacgacaacggcauccuccacagcauccugaacauccuggaggagacgaacgagaaccuccaggagauccugaacaacgagaaguacggguucaaccagaagaucgccgacuucaacaacacccugaccgcggacaagaccacggaggagcagaucgaggacauccucgacuccacccccgcccugaugcgccggagcaucauccagacccuggccguggucgacgacgugaucaaggccgcgggcaaggcgccccagaagaucaugauggaggucacccgcacggacgggaagaaggaggagaccaagucccgguacgugcagcucaagaagcagaucaccaacgacaaggugcugaccagcgacgagaagaaggagcugcucacgaaccuggagaacaagaagauccagcugaagggcaagcacaucuaccucuacuucaugcagaugggcaucgacuucuacaccgggaagaucauggacaucaacgacgucaucaacggcaaguacgacaucgaccacaucaucccccaguccaugaucaaggacgacagccuggacaacauggugcugguguccaaggacuacaaccagaaggucaagaaggacaucuacccgaucugcgacgagauccgcaacaacaugcucgacaaguggaagggguacuacgcccggaagaucaucagcgaggagaaguacaaccgccugaagcggaccaaggagcugaacgccgacgagaucaacgccuucaucaaccgccagaucaacguggugaacuacuccaacauccagaucaagcggaucuucgagaucaaguaccccgagaccaagaucaucuucagcaaggccuccuuccccagccuccugcgcaaggaguacgagaucgccaagaugcgggaccugaacgacgcccaccacgccgucgacgccuaccucaacaucgugugcggcaacauccugacgacccuguacaccgacaucuucuacauguucaaggagaagaaggaggaccacaagaacaucuccuucaacauggagaagcgccucaucaacuacaucgacaagaacaaccugaaggacaagaucaagaccagcugccugcggcacgacgcgcucaucacguacaagcccgacuacgacuccgggaaguucuacaaggagaccaucuucaagaaguccggcgacaaggagaccggccugaucccgcugcacaccaaggggcccaugagcgacacgaagaaguacggcggguacagccagcucagccaguccuacaucaucgccguggaguacaagcugaagaacaagaccgucaagaagcugugccgcgugcccacccucuaccugaagcaguacaagaacgaccugaacaccaucgccaagaucaugaucgacgacgagaaggccacggacaucaaggugcuccggaagaucuaccugaaccagaagauccgcuacaacggcugcuacuaccugaucuacaccagcaaggagaagcagaacaaguacaagauggccuaccagaacuaccucgacaacgacuaccugaucuaccugaacaagugccucaagaagaucgacgagcuggacgacggcgagcugaccucccaggaguucaucgucaacaaggacggggacaaguuccucaucgacaagaaccacaaccuggagaucuucaagagcaucaaggagcaguacaacaagaccaucuacgacuacacgcccuacaucgugcagucccgggagaugaaggaggaggacuucaacaaccugagccucaagaagcagaucgacacccugcugaacaugaucaagauccucucccgcagcaacgagcaggcgaaguucgagaccgccuucuucgagaacuucaccaagguguuccugaagacgaugaccaucaccaacgagaaggucuacaucgugaacgaguccccgagcggccuguucaaggggaaggaggagcucaucuga

SEQ ID NO: 1858 - RNA, 4047 nt, Artificial Sequence
  Cas9 variant
augaagaaguucgaggacuacuaccugggccucgaccuggggaccagcuccaucggcugggccgugaccaacgagaaguacgacauccugcgcuucaacaagaaguucaugugggggacgcaccucuucgacaugggcaacaccgccagcgagcggcgcaucuuccggaccucccgccggcgccugaagcggaagaagaaccgcaucgagcugcuccagacccuguucagcgcggagauguccaagaaggacuucggguucuuccagcggcugaaggagagccaguacuucaucgaggacaagacguucaagaacaagaacacccucuucauggacgagaacuacaccgaccaggacuaccacauggaguaccccaccaucuaccaccuccgcaaggcccugaucgacaacgaggaguccgccuucgagauccggaagcuguaccuggccaucagccacauccugucccaccgcggccacuuccucuucgagggcgagcugagcgacaaccuggacuucgacgacaucuucaacgaguucgucaaguaccucaacgaggagcugaacaucgacuucaagaucaaguccgacgugagccugcaggccaucaaggagauccucacggacaagaugcugaaccggaccaagaagaaggagaagcuguccgagcuccuggaggaggagaagaacaagaucuaccaggagaucuggaagcugcucguggggaacgaggcgaagaugagcaccaucuucgacgacaaggaguacgaggaggccaagaucgccuucuccaagggcaacuacgacgagaaggaggaggaguacgagagcauccugggggagaagauccuguucguccagaaggccaaggcgaucuacgacuggaugcuccugcagaacauccugaaggaggacaaguaccucuccuacagcaaggugaagcuguacaacgagcacaagaaggaccugaagauccucaaggacgugcugaagaaccuggacaagaagaucuacaaggagaucuucuccgagaacggccucuacgaggaguaccugcgcaucgagaagaagaagaucgggagcaaggaggagaagaccaaggacauccuguacaaccggcucaagaagaucuucgagaaccgcgacaacauggccaucgaggacauccugaacaagaucgagcuggacagcuuccucccgaagcagaagaucaaggacaacggcgucaucccccgccaggugcaccagaaggagcuggagaucauccugaagaacgccgagaaguacuucaaguggcucaucgagaaggacgagacgggccuguccgugagcgagaagaucaugaagaucuucaaguucaagauccccuacuacgucgggccccugaacuccaagagcccguucgccuggaucgagcggaaggaguacggcaagauccugcccuggaacuucgagaacaugguggacauguccaagaccgccgagaaguucaucaagcggaugaccaacaagugcaccuaccuccccgagaaggacgugauccccaagaacagccugcuguacacgaaguacaugguccucaacgagcugaacaaccugaagauccgcggggagaagaucaagguggagcucaagcagaagaucuacaccgagcuguuccagaagaacaagaagaucggcaugaagacccugaucgaguuccucaagucccagaacaucguggucaccaagguggagaucacgggcaucgacgggaccuucaacaccagccugggcuccuacaucgacaugaagaagaucuucggggaggagaagaucgugaaggacagcuacaagaagaugaucgaggacaucauccuguggaucacccucuacggcgaggagaagaagcugaucaaguccaagaucgaggagaaguacccggagaaggucacgcccgaggagaugaagcugauccucaagcugaaguaccgggacuggagccgccuguccaaggaguuccucaccgagaucgagaccauggacgaggagaccggggagcugaucagcaucaucgagaugcuguggcgcaagaacgagaacaucauggagcuccuguccuacaaguacgacuucagcaaccggaucaaggaguacaacggcaucaacgagaaggagaagaacaucacguacgaggaccuggugaaggaccuccagaucucccccagcgugaagaagaugaucuggcgcgcgcuggucaucgugaaggagaucaagaaggugaccaacaagucccccaagaaggucuucaucgagauggcccgggacacccagaccgagaagaagcgcacggagaagcggaaggacaagcugcucgagcuguacaagaacaucaagaacgacgacagcaucaaggagcuggagaagaaccucaaggacaagaccaacgacgaccucaagagcaagaagcuguaccuguacuaccugcagcugggccgcugcauguacuccggggaggugauccggcucgaggaccugaugaacgacaaccuguacgacaucgaccacaucuacccgcagagcaagaucaaggacgacuccuucgacaacaccguccucgugaagaagcagaucaacgccgacaagaccaacgaguaccccaucgacaagagcauccagaacaagugcaaggccuucuggacgucccugaaggagcgcggccugaugagcaacaccaaguacgagcggcucacccgcaccgagggguucuccgacgacgagcuggccggcuucaucagccggcagaucguggagacccgccaggcgacgaagguccuggccgaccuccugaaggugaucuucggguccgacacccggaucguguacgucaaggccggccugaccagcgacuuccgccagaaguucggcaucuacaaguuccgggagcucaacgacuaccaccacgcccacgacggguaccugaacaucgugaccggcaacaucuacaacacgcuguucaccgacaaccccuacaacuucaucaaggaccgcaagaaggacaaccggaccuacaaccucaacaagguguucgagcgcgagaacgacgucuggaaccccgacgugaugcuguccaagaucgagcgguacaucuacaagauccgcccgcuguucacccgcgccagcuacgagcagaagggcggguucuccgaccagaacaucagcuccgagaaggacaagcuccggccccucaagagcuccggggugcugagcaacaucaaguacggcggcuacgacaagaucaagaacagcuacuucuucaucgucgaguacacggagaagaagaagcgcgugcgguccaucgagacccugcccaucuacaucaagaaguccaucagcaccaaggaggaccuggagaaguacugcaaggaggagcugaagcuccaggagcccaaggugcuggucagcaagcugaacuacaagucccucaucuacagcaacgggcacgaguacuacaucaacuccaagaccgcggacagcaucacgauccagaacggcauccagaucauccugaccaaggagaacuacgagaccuaccgcaagaucuacaagaaccuggaguaccucaagcugaucuacaaggacgagaagauccgggaggagaagauccuggagaagaucccgaagauccucaagaacaacaagaacgaccgcgaccuguccgaggacgagaucagcgagaaguucuggaagcuguacaaggagaucuucgagaagaucaagaucgggaucuucuccaaguucaagagcacccuccccaucuacaucgaggacugcaagaagcugaaggacuucacgacccugaacaacuacgccaagucccgguucauccaggagauccucaagugccugaacagccagcagggcgaguucgacaccaaguacacccacaacuacuccaagaaguacaacacgaagcugagcaaguccaagauccucgagaacgacuucuacaucaucaaccagagccccaccggccuguucgagaagaagguguuccuggacaaguga

SEQ ID NO: 1859 - RNA, 4047 nt, Artificial Sequence
  Cas9 variant
augggggaggacgggaagccccugcgcgugaagggcaagaccgccaucggggcccggcuguuccaggagggcaacccggcggccgaccgccggauguuccgcaccacgcggcgccggcugaaccgccggaaguggcgccugaagcuccuggacgagaucuucgaccccuacaucacccccgucgacagcaccuucuucgcccggcugaagcaguccaaccucagccccaaggacucccgcaaggaguucaaggggagcaugcuguucccggaccugaccgacaagcaguaccaccucgacuaccccacgaucuaccaccuccggcacgcccugaugacccaggacaagcaguucgacauccgcaugguguaccucgccauccaccacaucgugaaguaccggggcaacuuccugaacuccacccccgucgacagcuucaaggcguccaaggugaacuucgacgaccaguucaagaagcugaacgagcucuacaccgccaucaaccccgaggagagcuuccagaucaaccuggccaacuccgagaagaucggccagcaguuccuggacccgagcauccgcaaguucgacaagaagaagcagauccccaagaucgugcccgucacgauggacgacaaggccguggacaagcucaacgggaagaucgcguccgagaucaucaacgccauccugggcuacaagagcaagcuggacguggccguccagugcgaccccgaggacuccaacccgugggccgugaaguucgacgacgaggacaucgacgccaagcuccagaagauccugcccgagauggacgagaaccagcagagcaucaucgggaucauccaggaccuguacucccaggugacccucaaccagaucguccccaacggcaugagccuguccgagagcaugaucaagaaguacaacgaccaccacgaccaccugaagcucuacaagaagcugaucgggcagaucuccgacagcaagaagaagaccgcgcugaagaaggccuacgaccaguacgugggcaacgacggcaaggugaucgagcaggacgacuucuacagcuccgucaagaagaaccucgacgacagcgagcuguccaagcagaucauggaccugaucgacgccgacaaguucaugcccaagcagcggaccagccagaacggggugaucccgcaccagcuccaccagcgcgagcuggacgagaucaucgagcaccaguccaaguacuaccccuggcuggccgagagcaaccccaacaagcacgaccuccaccuggccaaguacaagaucgaggagcugguggcguuccggauccccuacuacgucggcccgaugaucacgcccgaggaccagaagaaguccggggccgccguguucagcuggaugaagcgcaaggagcccggccagaucacccccuggaacuucgacgagaagguggaccggauggaguccgccaacaaguucaucaagcgcaugaccaccaaggacacguaccucaucggcgaggacguccugccggacgagagccugcucuacgagaaguucaaggugcugaacgagcugaacauggugcgcgucaacggggacucccucaagguggccgacaagcaggcgaucuaccaggaccuguucgagaacuacaagcacaucagcgucaagaagcugcagaacuacaucaagggcaagaccgggcuccccaacaaccccgagaucuccggccugagcgaccccgaccaguucaacaacucccuggggaccuacaacgacuucaagaagcuguucggcgacaagguggacgacccggaccuccagaacgacuucgagaagaucguggaguggagcaccgucuucgaggacaagaagauccugcgggccaagcugaacgagaucacguggcucaccgacaagcagaaggacgaccuggaguccagccgcuaccagggcugggggcggcuguccaagaagcuccugaccggcaucgugaacgaccagggggagcgcaucaucgacgagcuguggaacaccaacaagaacuucaugcagauccagagcgacgacgacuucgccaagcggauccacgaggccaacgccgaccagaugaaguccacgaacauggaggacgugcucgcggacgccuacaccagcccccagaacaagaaggccauccgccaggucgugaagguggucgacgacauccagaaggccaugggcgggguggcgcccaaguucaucagcaucgaguucacccgguccgaggaccgcaacccgcggcgcaccaucagccggcagcgccagcuggagaacacgcugaaggacaccgccaagucccucgucaagagcaugaaccccaacauccuguccgagcuggacaacgccagccgguccaagaagggccucaccgaccgccuguaccuguacuucacccagcucggcaaggacauguacacgggggagcccaucaacaucgacgagaucagcaacuacgacaucgaccacauccugccccaggccuucaucaaggacgacucccugagcaaccgggugcucguguccaaggccgugaacaacggcaagagcgcgaacgucccgcugaagcuguucggggccaagaugggccacuucuggaagcagcucgccgaggccgggcugaucaacaagcacaagcugaagaaccuccagaccaaccccgacaccaucuccaaguucgccaugcacggcuucauccgccggcagcugguggagaccagccaggugaucaagcuggucgcgaacauccucggcgacaaguaccgcaacgacgacacgaagaucaucgagaucaccgcccggaugaaccaccagaugcgcgacgaguucggguucaucaagaaccgcgagaucaacgacuaccaccacgccuucgacgccuaccugaccgccuuccugggccgguaccucuaccaccgcuacaucaagcugcggcccuacuucguguacggggacuucaagaaguuccgcgaggacaaggugaccaugcggaacuucaacuuccugcacgaccucaccgacgacacgcaggcgcgcaucgccgacaccgagaccggcgaggucaucugggaccgggagaccuccaucaagcagcugcgcgacguguaccacuacaaguucaugcugaucagccaggagguguacacgcuccggggcgccauguucaaccagaccaucuaccccgccagccaggcggggcgcaagaagcugaucccgaugaaggccgacaagcccgucgacguguacggcggguacuccggcagcaccgacgccuacauggccaucgugcggauccacgacaagaagggggacaaguacaaggucgugggcgugcccaugcgcgcccugaaccggcucaacaccgcgaagaacgucuccgacgccaaguacgaccaggagcugaaggaggugcugacgccccaguucaccaagagcaagaagaaccgcaagaccggcgagaucacccagacgguggaggacuucgaggucgugcucgggaaggugauguaccggcagcuggucaucgacggcgacaagaaguucaugcugggguccagcaccuaccaguacaacgccaagcagcucgugcuguccgacgagagcaucaagacccuggccuccgagggcaagcucaacgaggcccaggagagcgcggccuacgacaagguguacgacgagauccuggacaaggucaacaaguacuucgcccuguacgacaccaacaaguuccgccagaagcucucccuggggaaggacaaguucgugggccugccgaaccacaacguguucgacggcagcaagaagaucuccagcgggaagcgggagauccucaacgagauccugaacggccugcacgccaacgccacgcucgggacccuguccgacaucggcuucagcacccccuucgggaagaugcagcagccccgcggcaucggccuguccagcaacaccuccaucgaguacgagagcuucacgggccucuucaagcggaccaucuuccugaaggaccuguga

SEQ ID NO: 1860 - RNA, 4047 nt, Artificial Sequence
  Cas9 variant
augaagaagcccuacaccaucgcccuggacaucggcaccaacagcguggggugggucguggugacggacgacuaccgcgucccgaccaagaagaugaaggugcucggcaacaccgagcggaagaccaucaagaagaaccugaucggggcccugcuguucgacuccggcgacacggcggaggggacccgccugaagcggaccgcccgcccccgguacacccgccggaagaaccgccugcgguuccucaaggagaucuucacggaggagauggccaagguggacgacggcuucuuccagcgccuggaggacagcuucuacguccuggaggacaaggagggcaacaagcaccccaucuucgccaaccucgccgacgagguggcguaccacaagaaguaccccaccaucuaccaccuccggaaggagcugguggacaacccgcagaaggccgaccuccgccugaucuaccuggccgucgcccacaucaucaaguuccgggggcacuuccucaucgagggcacccuguccagcaagaacaacaaccugcagaaguccuucgaccaccucguggacaccuacaaccugcuguucgaggagcagcgccuccugacggaggggaucaacgcgaaggagcugcucagcgccgcccuguccaagagcaagcggcuggagaaccucaucucccugauccccggccagaagaagaccgggaucuucggcaacaucaucgcccugagccucggccugacccccaacuucaaggccaacuucgggcuguccaaggacgugaagcuccagcuggcgaaggacaccuacgccgacgaccuggacagccuccuggcccagaucggcgaccaguacgccgaccuguuccucgccgcgaagaaccuguccgacgccauccugcucagcgacauccugacggaguccgacgagaucacccgcgcgccccugagcgccuccauggucaagcgguaccgcgagcaccacaaggaccucgugacccugaagacccugaucaaggaccagcucccggagaaguaccaggagaucuuccuggacaagacgaagaacggguacgccggcuacaucgagggccaggugagccaggaggaguucuacaaguaccugaagcccauccuggcccggcucgacggguccgagccccugcugcucaagaucgaccgcgaggacuuccugcggaagcagcgcaccuucgacaacggcagcaucccccaccagauccaccuggaggagcuccacgccauccugcgccggcaggaggucuucuacccguuccugaaggacaaccgcaagaagaucgagagccuccugaccuuccggauccccuacuacguggggccccuggcccgcggccacucccgguucgccugggugaagcgcaaguucgacggggccauccggcccuggaacuucgaggagaucgucgacgaggaggcgagcgcccagaucuucaucgagaagaugaccaagaacgaccucuaccugccgaacgagaaggugcugcccaagcacucccuccuguacgagacguucaccguguacaacgagcugaccaaggucaaguacgccaccgagggcaugacgcgcccccaguuccucagcgccgaccagaagcaggcgaucguggaccugcuguucaagaccaaccggaaggugaccgucaagcagcucaaggagaacuacuucaagaagaucgagugcugggacuccguggagaucaccggcgucgaggacagcuucaacgccucccuggggacguaccacgaccugcucaagaucauccaggacaaggacuuccuggacaaccccgacaaccagaagaucaucgaggacaucauccugacccucacccuguucgaggacaagaagaugaucagcaagcgccuggaccaguacgcccaccucuucgacaagguggugcugaacaagcuggagcggcaccacuacaccggcugggggcgccucuccggcaagcugaucaacgggauccgggacaagcagagcggcaagacgauccuggacuuccucaaggccgacggcuucgccaaccgcaacuucaugcagcugauccacgacuccgagcugagcuucaucgacgagaucgcgaaggcccaggucaucgggaagaccgaguacuccaaggaccucgugggcaaccuggccgggagcccggccaucaagaagggcaucucccagaccaucaagaucguggacgagcuggucaagaucaugggguaccucccccagcagaucgugaucgagauggcccgggagaaccagaccaccgcgcagggcaucaagaacgcccgccagcggaugcgcaagcuggaggagacggccaagaagcugggcagcaacauccucaaggagcaccccguggacaacucccagcugcagaacgacaagcgguaccuguacuaccuccagaacgggaaggacauguacaccggcgacgaccuggacaucgacuaccugagcuccuacgacaucgaccacaucaucccccagagcuucaucaagaacaacagcaucgacaacaagguccucaccucccagggggccaaccgcggcaagcuggacaacgugccgagcgaggccaucgugcgcaagaugaagggcuacuggcagucccugcuccgggcgggggccaucagcaagcagaaguucgacaaccugaccaaggccgagcgcggcgggcugacgcaggucgacaaggccggcuucauccagcuccagcugguggagacccggcagaucaccaagcacguggcgcagauccuggacucccgcuucaacaccgaguucgacgaccacaacaagcggauccgcaagguccacaucaucacgcucaagagcaagcugguguccgacuuccggaaggaguucgggcuguacaagauccgcgacaucaaccacuaccaccacgcccacgacgccuaccucaacgccguggucgccaaggcgauccugggcaaguacccccagcuggcccccgaguucguguacggcgacuaccccaaguacaacagcuucaaggagcggcagaaggccacccagaagacccucuucuacuccaacauccugaaguucuucaaggaccaggagagccugcacgugaacuccgacggggaggagaucuggaacgccaacaagcaccucccgaucaucaagaacguccugagcaucccccaggugaacaucgugaagaagaccgagguccagacgggcggguucuacaaggaguccauccugagcaagggcaacuccgacaagcucaucccccgcaagaacaacugggacacccggaaguacgggggcuucgacagcccgaccguggccuacuccgugcuggucaucgcgaagauggagaagggcaaggccaaggugcugaagcccgugaaggagauggucgggaucaccaucauggagcgcaucgccuucgaggagaaccccgugguguuccucgaggccaagggcuaccgggagauccaggagcaccugaucaucaagcugcccaaguacagccucuucgagcuggagaacgggcgccggcgccugcucgccagcgcguccgagcugcagaagggcaacgagcuguuccucccggucgacuacaugacguuccuguaccuggccgcccacuaccacgagcucaccgggagcuccgaggacgugcugcggaagaaguacuucguggagcgccaccuccacuacuucgacgacaucauccagaugaucaacgacuucgccgagcggcacauccuggcgagcuccaaccuggagaagaucaaccacaccuaccacaacaacagcgaccugcccgucaacgagcgcgccgagaacaucaucaacguguucaccuucguggcccucggcgcccccgccgcguucaaguucuucgacgccacgaucgaccggaagcgcuacaccuccaccaaggagguccugaacgccacccugauccaccagagcgugacgggccuguacgagacccgcaucgaccucucccagcugggggagaacuga

SEQ ID NO: 1861 - RNA, 4050 nt, Artificial Sequence
  Cas9 variant
augaagcagaaguucuacgugggccuggacauggggaccgccagcgugggcugggccgugaccgacgacaaguacaacaucaucaagcgccacgggaaggcgcucuggggcgugcggcuguucaagacggccaacaccgccgaggagcgccggaucuuccgcgccgcccggcgccggacccagcgccggaagcagcgcauggagcugcuccaggagaucuucggggacgagaucuccaagaccgacaucggcuucuaccagcggaugaaggagagcaaguacugguucgaggacaagcgcgacaucaacggcaagcagcccgagcugccguacgcgcuguucgucgacgacggguucacggacaaggacuaccacgagcaguuccccaccaucuuccaccuccggaacgugcuggugaacgaguggacccagaaguacgacauccgccuggucuaccucgccauccaccacaucaucaagcaccggggccacuuccuguucgaggggaagaagauguccgaggugaccgacuucggcagcgccuucgaggccuucugcaagguggcguccgacaacgacaucgagaucacggucgacgaggagaagcugaaggacaucgaggaccuccucaagagccgccagaaguccaagaccgccaagaagcaggagcuggggaagaucaucgccggcgccgacaagcagaagaaggcccucgcggcccuggugaccggcugcauggugaagcugagcgagaucuucgccgacaagucccucgacgacggggagcggaacaagaucagcuucgccgacuccaacuacgacgaguacaucgccaacgucgaggagacccuggcggagcgcuuccugcucaucgccgccggcaaggcccuguacgacugggccgugcugagcgacauccucgagggguccacguacaucagcgaggcgaaggugaagaucuacaagaagcacggcgacgaccugcggaagcugaagggccuccugaagacccgccccgacgaguacaagcugaucuucgggcuccccgagaagcaggccaacuacuccgccuacaucggcauggucaagaagaacgggaagaaggugccgaucgacaagaagugcaccaaggccgacuucuacagcuuccugaagaagacccugaacaagaucaacuucgaggacgagaaggagcgggagaucgccgaguccaucaucaacgagaucgagaacgagacguuccuccccaagcaggucaucagcgacaacggcgugauccccuaccagcugcacgaggcggagcuggaccgcauccucaagaacgccgcccuguacuaccccuuccuguccgagaaggacgacgagggguacaccaacauggacaagaucaaggccaucuucaaguuccgcaucccguacuacgugggcccccucaacaccuaccacagcgacaagggcgggaacagcugggcggugcggaagcaggacggcaagaucuaccccuggaacuucgaguccaagaucgacgccggggagagcgcccgcaaguucaucggccggaugaccaacaagugcacguaccugaucgggaaggacguccugcccaaggagucccuccuguacagcaaguucauggugcugaacgagcucaacaaccugcgcaucgacggcgagaagguguccgucgagaucaagcaggccguguacgagaacgucuucaagaaguaccagcgggugaccggcaagaaggugaaggacuuccugauccgcagcgggaucaucggccgggagcaggagcucuccggguucgaccagaacuucaagagcucccugaaggccuaccacgacaucaagcagaucgcgggcgacaucaaccugagccagaaccagaaggaggacaucaucaaggagaucaccgucuucgccgacucccagaagaugcugaagaagcgccucaagaucaaguacccggagcugagcgacaagcaggucaccaagcuggccgccaagaaguacacgggguggggccggcucucccgcgaguuccuggaggagguggagagcgugaacaaggagaccggcgaggugcugaacaucaucuccgcccucugggagaccaacgagaaccugaugcagcugcucagcaacaaguacgacuaccuguccgagaucaagcggcugaacgacgaggcggaggacaagagcgagguggucaccuacgacgacgugcagaagcucuacgugucccccgccgucaagcgccccguguggcagacgcugaagaucguggaggagaucagcaagaucauggggagcaagcccgagcggaucuucgucgagauggcccgcgagccgggccagaagggggacgugaaggugucccgcaagagccggcugcucgagaaguacaaguacugcaagaaggaggcccccgagaucuacgagaaccuggucaaggaggacgacaacaagcugcgguccgacaagcuguuccuguacuacacccagaugggccgcugcauguacagcaacgaggugaucgacaucgaggaccuguucaccaaccgguacgacaucgaccacaucuacccccaguccaaggugauggacgacagccucgacaaccgcguccuggugaagcgcgagcugaacuccaacaagaccgacguguuccccgucccgaaggaguacauggacaaggccaagacgcucugggacaugcugaagaagaaggaccugaucagcaaggagaaguaccaccggcucacccgccgggacggcuucuccgagaacgagcugagcggguucaucgcgcgccagcugguggagacccggcaguccaccaaggccgugacgcagcuccugaccaaggccuaccccgagagcgagaucgucuacgccaaggcgaacgccguguccgaguuccgccacaaguucggcuucaccaaggugcggagcaucaacgacuaccaccacgccaaggacgccuaccugaacaucgucguggggaacaccuacuacgugaaguucaccaaggacgccgcgugguucauccgcaacaaccccggccggacguacaaccucaagaagauguucgagcaggggaccgucucccgcggcggcgagaccgccugggugagcggggaggacggcaccaucuucacggugaagcgggucauggggaagaacaacauccuguucacccgcaaggccuacgaggugcggggcgggcuguucgaccagcagaucaugaagaagggcaagggccagauccccgugaagaacaacuccgaggacgaccgccucugcgccaccgagaaguacggggccuacaacaaggcgagcggcgccuacuucaugcuggucgagagcgaggacaagaaggggaacaagauccggacccuggaguucgugccgguguaccucgccaaggagcuggagaaguccgaggacgccgccauccgcuacugcgucgagaagcuggagcucaagaaccccgacgugcgggugcgcaagaucaagauggacagccuguucaacgucgacggcuuccggaugcaccuguccgggcgcacgggcaagcagcucaucuucaagugcgcggagcagcuggugcuggacgaggagagccagaagauccucaagaagaccgccaagguguucgccgacuacaaggagaacaagaacaucaagaucuccgacaagaucgagcugaccgacgagaugcugaucaagcucuacgagcuguucuacaagaagcugaaggacaccgucuacaacauccggcucagcacccaggugaagacgcuggaguccggcaaggagaaguucgagaagcugagccuccuggacaagugccuggugaucgaggagauccuccaccuguuccagugccaguccgucgccgcgaaccugagcuccaucgggggcgccgccaccgccgggauccucgugcugaacaacgagaucagccgcugcggcaaggucgagaucaucaaccaguccaucaccggguucuacgagcaggucaucgaccugaagaacaucuga

SEQ ID NO: 1862 - RNA, 4050 nt, Artificial Sequence
  Cas9 variant
augcagaaguacuaccugggccucgacaucgggaccaacagcgugggcugggcggucaccgacgagaacuacaaccugugcaaguucgggggcaagcgcaugugggggauccggcuguucgacggcgcccagacggcggaggagcgccggaugaaccgcuccaaccggcgccggcucagccgccagaagcagcggaucgaccugcugcaggagcuguucgccaaggagaucgccaagguggaccccaccuucuucauccgccugaacgagucccggcuguacauggaggacaagagcaccggcaccaaguucccccucuucgccgacccgggguacacggacaaggaguacuacaaggaguaccccaccaucuaccaccuccgccaggagcugaucaagaaccccgagucccacgacauccggcucguguaccuggccugccaccacauccugaagaaccgcggccacuuccucaucaacgggagcuucuccgaccugaagaaccugagcuucgucugccgggagaugcucgacgcguucaacgagcuguccaaguaccagcugaugaucagcgacaucgacgcccucgagaagauccuguccgaccgcaagcagcagaaguccgccaaggugaaggagcuggugcagaucuucgagugcgucccgcgggaggacaagagcgacgccaagaucugcaaggagauccucagcaaccugugcaaguuccuggugggcgcgaaggggaacaucacccgccucuucgacaccgacuucgacgagauggagacguccagcuucuccuucggcgacagcaaguacgaggacucccugcugcccagccucgaggagaacuaccccgacuacgccaacgugauccagaagaucaaggccauguacgacuggagcguccugguggagaucauggccggcgagaacuaccuguccuucgccaaggugaacgcguacaagaagcacaaggagaaccucagcauccugaagucccugaugaagaaguacugcacccccgacgucuaccagcgguucuucuacgagaccgacgagaaguccagcuacgggaacuacaucggcgccauccacaacaacgggcacagccacaccaugaagaagugcgacgaggagacguucuacaagucccucagcaagauccuggacaagcugguggugcagaagaccgaccaggacacccucgagauccugaagaaggaggccaagaaccagacccugcucccgcuggcccgcacgaaggccaacggcgucauccccaaccagauccacauccaggagcugcgggcgauccucgacaacgccaagaccuaccuguccuuccugaacgaggccgacgaguacggcaccaucgccgagaagaucauccgcaucgccaaguucaagauccccuacuacgcggggccccucagcacccgccacaaggagcagggcgccaacacguggaucgugcggaagcaggaggggcgcaucuacccguggaacuucgaggagaugguggaccuggagcgguccaacaacgaguucauccgccggaugaccaacaagugcaccuaccugaucggcgaggacguccugcccaagaacagccuccuguacuccaaguucauggugcugaacgagcucaacaaccugaagauccgcgggcacaagaucagcguggagcugaagcaggagcucuacaaggagcuguucugcaagaaggccaaggucaccggcaaggcccugcucguguaccugaagaagaaggacgccgagcugacgcucgaggacaucuccggcuucgacgcggacuucaagagcucccugagcaucuacaucgacuucaagaaccacauccugcgggagcagaucgacgacgggaaguaccaguccaucguggagaacaucaucaaguggaagaccaucuucgacgucgacagcaagaugaucgagaagcucaucgcccgcgaguaccccaacauguucagcuccgagcagaucaagaagaucugccggcugaagugccgcggcugggggaacuucagcucccgguuccugaacggcauccagggggagaacaccgagaccaaggagugcuucacgaucaucgaggcccucuggaagaccaacuacaaccugaugcagcugcucagcaagcaguucaccuucaaggacgccaucgacugcaucaacgcggacaaggugggcaagaucgacaaggucaccuacgagaacacggugaaggaccugguggucucccccgccaacaagcgcgccaucuggcagaccgugcagaucaccgaggagaucaagaaggugaugaagugcgagccggagaagaucuucgucgagauggcccggggcggggagaaggagaagaagcgcaccaucagccggaaggagcgccugcucaagcuguacauggacuacaaggacgagaaccgggacuggaucaaggagaucgagucccgcgacgagcaggacuucacgaaccggaagcuguaccucuacuacacccagaucggccgcugcauguacagcggggaggagaucucccuggaggagcugaugcagaagaacagcaagugggacaaggaccacaucuacccccaguccaagaucaaggacgacagccucgacaaccuggugcuggcccgcaaggacaucaacaacaacaaguccaacaagcuccugcccaccggcauccaggacaagaugaagaaguacuggaagaugcugcucaaguacggguucaucagcaagaagaaguacgaccggcugaugcgcaccgaggacuucuccgacgaggagcugagcggcuucaucgcgcggcagaucguggagacccgccaguccagcaaggccgucgccgagcuccuggagcaccugaacgagcacacggagaucguguacgugaaggccgagcucgucagcgacuuccggcacgacaacaacaugcugaagucccgccggaucaacgacuaccaccacgccaaggacgcguuccugaacaucguggugggcaacgucuacaacgccaaguucaccgccaacccccgcaacuggaucaagaagaaccggaacaccaacuacagcauccgccggguguucgacuacaccgugaagcgcggguccacgaucgucuggcagggcgugaaggacgggggccacagcaucgacggcaucaagaagaccauggcccggaacgacauccucuacaccgagcgcaccuacugcgagcagggggagcuguucaacgccacgcugaucaagaagggcaacccgaacgcgaucgggcucaagaagggccuggaccccaugaaguacgggggcuacuccagccccaagaccuccgccuucgccuucaucgaguucgacggcaagaaggggcggcagaaccaccugguggagauccccgucuacaucgccaacaucgcggcccgccagccggaguacaucaagaaccaccucgaggagaagaagggcuaccagaacgugaucgugaagaaguaccccauccagaagaacgcccugaucaagcuggacggguaccccgcccggcuccgcggcgccaacgagaaguccaucacccugaagaacgcgguccagcuggugcucaagcccgaguaccacgagaccauccggaacguggagaaguaccuggaguacaucgacaaggacgagagcgucagcaaggccgcccgcuucucccacacggagcuggacaagcucuacgacgagcugugcuucaaggccgagaacagcaucuacaagaagcggccggccaaccaguccgcgacccugaagaacgggcagaagaccuuccucgccaucaccaaccugaaggagaaggcccaggugaucaacaacaucaucacgauguuccgcugcgacgccaccaccaccacgaaccugaagaccaucggcggcagcgccaacgccgggggcaugcaggucaacaagaacacccucaccucccagaagguggugcuggugcaccagagcaucacggggcuguucggcaccgaggaggagcuccuguga

SEQ ID NO: 1863 - RNA, 4053 nt, Artificial Sequence
  Cas9 variant
augaagaagcccuacagcaucggccuggacaucgggaccaacuccgugggcugggccgucgugaccgacgacuacaaggugccggccaagaagaugacgguccucgggaacaccgacaagagccacaucaagaagaaccugcugggcgcgcuccuguucgacuccgggaacaccgccgccgaccgccggcugaagcgcaccgcccggcgccgguacacgcgccggcgcaaccggauccucuaccugcaggagaucuucgccgaggagaugagcaagguggacgacuccuucuuccaccgccuggaggacagcuuccucgugaccgaggacaagcggggcgagcgccaccccaucuucggcaaccuggaggaggaggucaaguaccacgagaacuuccccaccaucuaccaccuccggcaguaccucgcggacaaccccgagaagguggaccugcgccugguguaccucgcccuggcccacaucaucaaguuccgggggcacuuccugaucgagggcaaguucgacacccgcaacaacgacguccagcggcuguuccaggaguuccuggccguguacgacaacacguucgagaacuccagccugcaggagcagaacgugcaggucgaggagauccucaccgacaagaucuccaagagcgcgaagaaggaccgcgugcugaagcuguucccgaacgagaaguccaacgggcgguucgccgaguuccucaagcugaucgugggcaaccaggccgacuucaagaagcacuucgagcuggaggagaagacgccccuccaguucagcaaggacaccuacgaggaggagcuggagguccugcucgcccagaucggggacaacuacgccgagcuguuccuguccgcgaagaagcucuacgacagcauccugcuguccggcauccucacggugaccgacgugagcaccaaggcgccccuguccgccagcaugauccagcgcuacaacgagcaccagauggaccuggcccagcucaagcaguucauccggcagaagcuguccgacaaguacaacgaggucuucagcgacgugagcaaggacggcuacgccggguacaucgacggcaagaccaaccaggaggccuucuacaaguaccugaaggggcuccugaacaagaucgagggcuccggcuacuuccuggacaagaucgagcgcgaggacuuccuccgcaagcagcggacguucgacaacgggagcaucccccaccagauccaccuccaggagaugcgcgccaucauccggcgccaggccgaguucuacccguuccuggccgacaaccaggaccggaucgagaagauccugaccuuccgcauccccuacuacgugggcccccuggcccgggggaaguccgacuucgcguggcugagccgcaaguccgccgacaagaucacccccuggaacuucgacgagaucgucgacaaggagagcuccgccgaggccuucaucaaccggaugaccaacuacgaccuguaccucccgaaccagaaggugcugcccaagcacagccugcucuacgagaaguucacgguguacaacgagcugaccaaggucaaguacaagaccgagcagggcaagaccgccuucuucgacgcgaacaugaagcaggagaucuucgacgggguguucaaggucuaccgcaaggugacgaaggacaagcugauggacuuccucgagaaggaguucgacgaguuccggaucguggaccugaccggccuggacaaggagaacaaggccuucaacgccuccuacggcaccuaccacgaccuccgcaagauccuggacaaggacuuccuggacaacagcaagaacgagaagauccucgaggacaucguccugacccugacccucuucgaggaccgggagaugauccgcaagcggcuggagaacuacuccgaccugcucaccaaggagcaggucaagaagcuggagcgccggcacuacaccggguggggccgccugagcgccgagcucauccacgggauccggaacaaggagucccgcaagaccauccuggacuaccugaucgacgacggcaacagcaaccgcaacuucaugcagcucaucaacgacgacgcgcuguccuucaaggaggagaucgccaaggcccaggugaucggggagacggacaaccugaaccagguggugagcgacaucgccggcucccccgccaucaagaagggcauccuccagagccugaagaucguggacgagcuggucaagaucauggggcaccagcccgagaacaucgugguggagauggcgcgggagaaccaguucaccaaccagggccgccggaacucccagcagcgccucaaggggcugaccgacagcaucaaggaguucggcagccagauccugaaggagcacccggucgagaacucccagcuccagaacgaccggcuguuccuguacuaccuccagaacgggcgcgacauguacaccggcgaggagcuggacaucgacuaccugagccaguacgacaucgaccacaucaucccccaggccuucaucaaggacaacuccaucgacaaccgggugcucacgagcuccaaggagaaccgcggcaagagcgacgacgugcccuccgaggacgucgugaaccggaugcgccccuucuggaacaagcugcugagcuccgggcucaucagccagcggaaguacaacaaccugaccaagaaggagcugaccccggacgacaaggccggcuucaucaagcgccagcucguggagacccggcagaucaccaagcacgucgcccgcaugcuggacgagcgguucaacaaggaguucgacgacaacaacaagcgcauccggcgcgugaagaucgugacgcugaaguccaaccucgucagcuccuuccggaaggaguucgagcuguacaaggugcgcgagaucaacgacuaccaccacgcccacgacgcguaccugaacgccguggucgugaaggcccuccuggugaaguaccccaagcuggagcccgaguucgucuacggggaguaccccaaguacaacagcuaccgggagcgcaagaccgccacccagaagauguucuucuacuccaacaucaugaacauguucaagagcaaggugaagcucgccgacgaccagaucguggagcgcccgaugaucgaggucaacgacgagaccggcgagaucgcgugggacaagacgaagcacaucaccaccgugaagaaggugcuguccuacccccaggucaacaucgugaagaagguggaggagcagaccaucggccagaacgggggccuguucgacgacaaccccaagagcccccucgaggucaucccgagcaagcuggugccccugaagaaggcccucaaccccgagaaguacgggggcuaccagaagccgacgaccgccuaccccauccugcugaucguggacaccaagcagcucauccccaucuccgucauggacaagaagcgguucgagcagaaccccgugaaguuccugaaggacaagggguaccagcagaucgagaagaacaacuucgugaagcugccgaaguacacccucgucgacaucggcaacggcaucaagcgccugugggccagcuccaaggaggugcacaaggggaaccagcugguggucagcaagaagucccaggaccuccuguaccacgcgcaccaccuggacaacgacuacagcaacgaguacgugaagaaccacuaccagcaguucgacauccucuucaacgagaucacguccuucagcaagaagugcaagcugggcaaggagcacauccagaagaucgaggaggccuacuccaaggagcgggacagcgccuccaucgaggagcuggccgacggguucaucaagcuccugggcuucacccagcugggggccaccagccccuucuccuuccucggcaucaagcugaaccagaagcaguacaccggcaagaaggacuaccugcuccccugcauggaggcgacgcugauccaccagagcaucaccgggcuguacgagacccgcaucgaccucuccaagcugggcggggacuga

SEQ ID NO: 1864 - RNA, 4053 nt, Artificial Sequence
  Cas9 variant
augggcaagaacuacuaccuggggcucgacaugggcaccagcuccguggggugggccgucaccgacgagaaguaccgcauccugcgggccaagggcaaggaccuguggggcgugcgccucuucagcgaggcgaagacggccgccgagcggcgcacccaccggaccucccgccggcgccuggaccgggagaaggcccgcaucgccugccugaaggagauguucgcggaggagaucaacaagaucgaccccggguucuaccagcggcucaacgacagcaaguacuuccuggaggacaagaaggagcaccagccguacgccaucuucgccgacaccggcuacacggacaaggaguacuacgacgaguaccccaccaucuuccaccuccgcaaggcccuccugaacaucgagaacgacaagaagaaguacgacgugcggcuggucuaccucgcgauccugaacauguucaagcaccgcgggcacuuccugaacgccaaccucgacgacaaguccggcgggaaccugaaggaguacaucgagaugcugcaccagagcauggugaacauccucaacaucaaccugaagaacguggagaucgagaagaucgagaagauccugaaguccacccaguacagcaacuccgagcggcucgagaaccugcuggagcucuacgagcugagcaagaacaagaacaagaucgagaccgagaucuucaaguucaucugcggccugaaggggacgaucuccaagaucuacgucgaggacaaguucgaggacgaguucgccaagaugacccucagcuuccgcgacuccaacuucgacgagaagaucaucgagaucgaggacaaccuggacgacgacaaguacgacauguuccugcucaucaagcagauccacgacuggagcgugcuggccaacaucaugaacggcgaggaguaccuguccguggcccgggucaagcucuacgacaagcacaagaaggaccuggaggugcugaagaaguacuacaagcagaacagcauggaggaguacaacaagauguuccgccagaugaacgacggcaacuacuccgcguacguggggagcgucaucuacaaggacaacuccgugcggcgcggcugcaagagcaagaaggaggacuucuacaagaacauccucaacaccaucaagagcugggaggacugcgaggccaaggaguacaucaccuccgagaucgacaaggggaacuuccugcccaagcagaucacggccagcaacggcgugauccccaaccagguccacaagaaggagcugaagaagauccucaagaacgccuccgaguaccugaacuuccugaacgagaaggacgagagcggcuacaccaucuccgagaagaucgugaagcuguucgaguuccagaucccguacuacguggggcccaucgccuacaacaucggcaacgacgagagcaagcaccggcacaacaugugguccguccgcaaggagaaggggcccaucuaccccuggaacuucgagcagaagaucgacaucaagaaguccagcgagaaguucauccgcaaccugaucaaccacugcaccuaccugaacgacgaggaggugcucccgaagaacagccugcuguacgagaaguucauggugcucaacgagcugaacaagcugaagaucaacggcgagaagaucuccgucgagcugaagcagaacaucuucaacgaccucuucaagaaggggaagaaggugaccaagaagggccugaucaaguaccugaaggagcagggcgagaucgacaacugcgaggagguggagaucagcgggaucgacggcgacuucacgaacaagcucuccaacuacaagaaguucgcggacaucuucgggguccagagccugaccuacgagcagaccgacaucgccgagaacaucauccgguacuccaccaucuacggcgacagccgcaaguuccuggaggagcggauccgcgaggaguacuccaacgugcucgacgagaagcagaucaagcggauccuggggaugaaguucaaggacuggggccgccugagcaaggagcuccuggagcuguccggcgucgacaaggagacgggggagaucgccagcgugaucagccggauguggaacgacaacuacaaccucauggagcugaucgccaccgagcgcuucuccuacgccuacgagaucgagcagcggagcaagaagcuggagaagaccaucuccaccaucgaguacgaggaccucgacgagcuguacaugagcacgcccgugaagcgcauggucuggcagaccauccuggugcucaaggagcuggaggaggugcugggcugcccgcccaagcggaucuucgucgagauggcgcgcgacgugaacgcccccaaggaccggaaggacucccgcaagaagaagcuccuggagcuguacaagaacugcaagaaggaggagggggacuggagcaaggagcucaacgcccgggaggaguccgaguucaagagcaagaagcuguaccuguacuacaugcagaagggccgcugcauguacuccgggaagcccaucgaccucaagaaccugcugaacgacaaccucuacgacaucgaccacaucuacccccggcacuucgugaaggacgacagcaucgagaacaaccugguccugguggagaagaacuucaacgcccacaaguccgacaacuaccccaucgagaacgagauccgccagaagaugcacagcauguggaagaugcuccgggacggcaacuucaucaccgaggagaaguacucccgccugauccgcaaggaggaguucaccgacgacgagaaggccaaguucaucagccggcagaucguggagacgcgccagggcaccaaggucaucaccgaccuguucgagcagaccuucccggaguccgacaucguguacgugaaggcggggaacgucagcgaguuccggcacaaguucaagcucaucaagugccgcaacgugaacgacuuccaccacgccaacgacgccuaccugaacaucguggucggcaacguguacuacacgaaguucaccaaguccgcccugaacuucaucaaggacuacaagaagaaccccgagaagaacaaguaccacauggaccacauguuccaguaccccgugagccgcgggggcgucgacgcguggaucaccaagggcgccgagagcaucuccauggugcggaagaugauggccaagaacacccccauggugacgcggaugaacuacgagaagcacagcgggcagaagggcgggaucuccgaccagaacaucugcagcgccaagaucgccaagaagaacgucuaccucccgaucaagaugggcgacgagaagcugaagaacguggagaaguacgggggcuacggcucccugaccgcgaaguacuucuuccucguggagcacaccaucaagaagaagcgcauccggaccaucgaggccuaccccauguaccuggacgcccugaacaaggagaacaagcuccugaacuacugcguccaggugcuggaguacgacgagcccaagaucaucauggagaagaucaaggucaagagccucuucaagaucaacggguacuacuacuaccugaacgccaaguccgugaaccgcaucaucuggggcaacgccacccagcuguuccucgagaacgacaucaacgaguacgugcggaagaucagcaagaacaucgagugcaucgacaucaacuccgagaacaacaucaagguguacgacaucuucaucgagaaguacagcaacaagcuguucuccaaccgccuggggaaccucaaggaggcgaucauccagaaccggaacaaguucaucgagcugaagaucaacgagcagaucaacgucauccuggagcucgugcgcuacagccaggacggcguguacuccaucaaccugagccagcuggggcucuccagcacguacgccaucaaccggaccuccaaggagaucagcaagaugaaggagugcaagcugaucaaccaguccgucaccggccuguacgagaacgagaucgaccuccugaccguguga

SEQ ID NO: 1865 - RNA, 4053 nt, Artificial Sequence
  Cas9 variant
augcagcaguacuaccugggcguggacauggggagcgccuccgucggcugggccgugaccgacgagaaguaccagcucgugcgcaagaaggggaaggaccuguggggcguccggaccuucgacaucgcgcagacggccgaggugcgccgggugagccgcaccaaccggcgccggcagaaccgccggaagcagcgcauccagauccugcaggagcuccugggggaggagguccugaagaucgacgccggcuucuuccaccggaugaaggagucccgcuacguggccgaggacaagcggacccucgacggcaagcaggucgagcugcccuacgcccuguucguggaccagggguucaccgacaaggacuucuacaagcaguucccgacgaucaaccaccucaucguguaccugaugaccaccagcgacacccccgacauccgccugguguaccucgcgcugcacuacuacaugaagaaccggggcaacuuccugcacuccggggacaucaacgacgucaaggacauccagagcauccucgagcagcuggagaacgugcugaaggaguacguggacgacugggagcucucccugaaggacaaggucgacgccaucaaggagaucuacaacaaggaccugggccgcggggagcggaagaaggccuucaucaacacgcucggcgugaagaccaagagcgccaaggcguucugcucccugaucagcggcggguccaccaaccuggccgagcuguucgacgacagcggccugaaggaguccgaguacgccaagaucgaguucgccaacgccaacuucgaggacagcguggaggggauccaggcgcugcucgaggaccgcuucgccgucaucgaggccgccaagcggcuguacgacuggaagauccugaccgacauccucggcgacaacgccucccuggcggaggcccgcgucaagagcuacgagacgcaccacgagcagcugguggagcucaaguccuucaucaagaaguaccuggaccggaagaucuaccaggacaucuucaucaaccccaacaucgccaacaacuaccccgccuacgugggccacaccaagaucaacgggaagaagcaggagcuggaggugaagcgcgccaagcgcaacgacuucuacgcguacaucaagaagcaggucaucgacccgaucaagaagaaggugagcgacaaggccgugcucgcccggcuggccgagaucgagucccugaucgaggucaacaaguaccucccccuccaggugaacagcgacaacggcgugauccccuaccagaucaagcugaacgagcuccgccggaucuucaacaaccuggagaaccgccugcccguccucaaggagaaccgggacaagaucaucaagaccuucagcuaccgcaucccguacuacguggggccccugaacggcgugaaccggaacgggaaguccaccaacuggaugguccgcaaggagggcgaggagggcaagaucuaccccuggaacuucgaggagaagguggaccuggaggccagcgcggagaaguucauccggcgcaugacgaacaagugcaccuaccucgugaacgaggacguccugcccaaguacucccugcuguacagcaaguaccucgugcuguccgagcugaacaaccuccggcuggacgggcgcccgcuggaggugagcgucaagcaggagaucuacgagaacguguucaagcggaaccgcaaggugacccucaagaagaucaagaacuaccugcugaaggagggcgucaucuccgagaaggacgagcucagcgggcuggccgacgacgugaaguccagccugaccgccuaccacgacuucaaggagaagcucggccaccugacgcugaccgaggaccagauggagaagaucauccucaacgugacccuguucggggacgacaagaagcugcucaagaagcggcuggccgcgcuguaccccaacaucgacgagaagucccucagccgcauggccaccuucaacuaccgggacuggggccgccuguccaagaaguuccugagcgagaucacguccgucgaccaggagaccggcgagcuccggaccaucauccagugcauguacgagacccagaacaaccugaugcagcugcucagcgagcccuaccacuucguggaggccaucgagaaggagaaccccaagguggaccuggaguccaucagcuaccgcaucgucaacgaccuguacguguccccggccgugaagcgccagaucuggcagacgcuccuggucaucaaggacaucaagcaggucaugaagcacgaccccaagcggaucuucaucgagauggcccgcgagaagcaggagagcaagaccaccaagagccggaagcagguccuguccgagguguacaagaacgcggagaaguacaagaaccucuucgagaagcugaacagccugaccgaggagcagcuccgcuccaagaagguguaccuguacuucacgcagcuggggaagugcauguacaccaacgacgccaucgacuucgagaaccucgugagcgccaacuccaacuacgacaucgaccacaucuacccccagagcaagaccaucgacgacuccuucaacaaccuggugcuggugaagaagggcaucaacaacgacaagagcgaccgguaccccaucgacaagaacauccgcgacgacgagaaggugaagacccucuggaacacgcugcuguccaaggggcucaucaccaaggagaaguucgagcggcugauccgcagcaccccguucuccgacgaggagcuggccggcuucaucgcccggcagcucgucgagacccgccagagcaccaaggcgguggccgagauccuguccaacugguuccccgagagcgagaucguguacuccaaggccaagcacaucacgaacuuccggcaggacuucgagauccugaagguccgcgagcucaacgacugccaccacgcccacgacgccuaccugaacaucgugguggggaacgcguaccacaccaaguucaccaacagccccuaccgguucauccagaacaaggccaaccaggaguacaaccugcgcaagcuccugcagaaggccaagaagaucgaguccaacggcgucaucgccuggaucggccagagcgagaacaaccccgggaccaucgcgacggugaagaaggugaucagccggaacaccguccugaucucccgcauggugaaggagguggacggccagcuguucgaccagcagcucaugaagaaggggaagggccaggucccgaucaagagcuccgacgaccggcugaucgacaucagcaaguacggcggguacaacaaggccaagggcgccuacuucguguucaucaaguccgugcgccgggggaagaccaucaagagcuucgaguacauccccguccaccucgccaagaaguucgacugcaaccuggagcugcucaaggaguaccuggaguccgagaaggaccugaacaacguggagauccucaugcccaaggugaugaucaacagccuguucaacuacaacggcucccugauccgcauccccgggcgguacgacaagaagucccuccugaucaacgucgacgugccgcugcuccuggagagccagcacaucaagcagcugaaggucaucgagaaguacauguacaagaagcgcgugagcaagaacuccaacauccuccugaccaaguucgccagcgaccagcugaaggaccucgacgcgcuguucgacgugcuguccuacaagcucaacgagaacaucuacaacgucaucaacgacaaguacgacaagcuggugaucugccgcgacaaguucaucagccuggacacggaggugaagugcgagaugaucuucgagcuccugcaccuguuccagugcaacucccagcucgccaacaucaccaagaucggcgccaccagcaaguucggcuccaucagcaugagcaagaaccugaaggagaacgacaagauguccaucauccaccagagccccuccgggaucuucgagcacgagaucgagcugaccgcccucuga

SEQ ID NO: 1866 - RNA, 4053 nt, Artificial Sequence
  Cas9 variant
augaagcgcauccugggccucgaccuggggaccgccagcaucggcugggcccuggugaacgaguccgagaacgagaaggagaaguccgagaucaucaagcucgggguccgggugaacccccugaccacggacgagcagaccgacuucgagaagggccgcccgcuguccgugaacgcggaccggacccucaagcgcggggcccggcgcaaccugcagcgguucaagcagcgccggaagaaccugaucgagauccucaucaagaagggcuucaucaccaacaucagccugcugacggagaucggcuccaacaccaccuaccagacccucgagcugcgcgccaagagcgucaaggagaagaucgagaaggaggaguucgcccgggugcugcucacgaucaacaagaagcgcggguacaaguccagccggaaggccaagaacgacgaggagggcucccugaucgacgggaugagcguggcgaaggagcuguacgacaacaaccucaccgucggccaguacguguaccagcugcuggagaagggcgggaaguacauccccgacuucuaccgcuccgaccuccagaacgaguucgacgugaucuggaacuuccagaaggaguucuaccccaacauccugaccggcgagcuguacaagaagcuccaggggcagggccagcagaacagccggaagcuguuccuggccauccaccagaucuacaccgccgagaacaaggggaagcgcgacacggucaagaagcagcacuacaaguggcggaacgacgccaucaacacccagcuccugaucgaggagguggcguacgugcuggucgagaucaacaacaaccucaacaaguccagcggcuaccugggcgccaucuccgaccgcagcaaggagcuguacuucaacaaggagaccgugggggagaaccucuacaagcagauccaggagaacccccagaccucccugaagaaccagguguucuaccggcaggacuaccuggacgaguucgagcagaucugggagacgcaggccaaguucuacagcgagcucaccaaggagcugaaggaggagguccgcgacguggugaucuucuaccagcggaagcugaagucccagaagcaccucaucagcgagugcgaguucgagaagcaccacaaggccauccccaagagcagcccccuguuccaggaguucaagaucuggcagauccugaacaacaucgaguucaagcacaagaagaccaaggagcucaagauccugagcgaggagcugaaggagacccucuucgaggagcugaacauccgcggcaacuucacguccgacgccguccugaaguucgugaagcucgacaagaaggagugggagcugaacuacaagaaggggaucgagggcaaccgcaccaacgaggugcuguacaacgucuaccagaagaucgcggaguacgagggguacggcuucgacuggagcaagaaguccgccguggagaucaaggaggagcugaacaccaucuucagcgagaucggcaucaacuccaagauccucgacuucaaccccgagaucagcgggaacgacuucgacaagcaggaguccuaccagcuguggcaccuccucuacagcgccgaggaggacggcuuccugaagcagaagcugcaggacaaguacggguucaaguccgaguacgccaacaugcucgccaacgugagcuuccaguccgacuacggcagccuguccgcgcgggccaucaagaagauccugcccaaccucaucgccgggcacgaguucagcgaggccugcucccugagcggcuacaaccacuccaacagccugaccaaggaggagcucgccaaccgcccgcugaagggcaagcuggagcuccugaagaagaacagccugcggaaccccgucguggagaagauccucaaccagauggucaaccuggugaaccaggugaucgaguccuacggggagaucgacgagguccgcaucgagcuggcgcgggagcucaagaaguccgcccaggagcgcgcccugaugacgaccaacaucaacgccagcaagaccaaguacgagagcuuccggaagcugcuccagaaggacuucggcaucaagaaccccacccgcaacgacaucaucaaguaccggcuguacgaggagcugaaggccaacaaguaccacacgaucuacaccaacaaguacaucccccgcgacaagcuguucuccaaggagaucgacaucgagcacaucaucccgaaggcgaagcuguucgacgacagcuucuccaacaagacccuggccuuccggaagcccaaccaggacaaggggaacaugaccgccaucgacuacauccucagcuaccaguccaaggacaucgacaacuacaagagccgcaucgagaaccuguucaagaacggcaagggggacaucuccaaggccaagcggaacaagcugcucauggaggagaaggacauccccgacggcuucaucgaccgcgaccugcggaacagccaguacaucgcgaagaaggccaagcagcugcucgaggaggugauccgcacggugaacaccaccaccggcuccgucacgaacaagcugcgggacgacugggggcugaucaacgugaugcaggagcucaacaugcccaaguucaaggccaucgacgagagccugaucgagcagaucgagaagaaggacggcaccuucaagacccgcaucaaggacugguccaagcggaacgaccaccgccaccacgccauggacgcccugaccguggcguucacccgcuacaaccacauccaguaccucaacaaccugaacgccaagagcgacaagaagggggccaucuacggcauccaggagcuggagacguacgucaacuccaagggcaagcggaaguucaucaagccgaugcacaacuuccgcgaggaggccaagaagcacaucgaggacauccucaucagcuucaaggccaagaacaagguggugaccaagaacaucaacaagaucaagagcaaggacggguucaucaagaagguccagcugaccccgcggggccagcugcacaaggagaccguguacgggaagaucaacgagguggucgugaaggaggagaagaucaacgcgaaguucgaccucgagaagaucaacaaggugacgaagcccaucuaccgcaacgcccugcugaagcggcuccaggaguucaacggcgagcccaagaaggccuucaccgggaagaacucccugagcaagaacccgaucuaccuggacgucgcccagaccaagacccuccccgaguccgugaaggugcaguucuucgaggagaacuacacgauccgcaaggagaucagccccgaccugaagaucgacaagaucaucgacaagggcauccagcggauccugcucaagcgccuggacgaguucaacggcaagcccaaggaggccuucuccaaccuggagaagaacccgaucuggcucaacaaggagaaggggaucgcgaucaagcgggucaagaucaagggcgugaagaacguggagagccugcacaacaagcgcgaccaccuggggaacgagauccuccagaagggcaaguccgcccccaacgacuacgucagcaccgggaacaaccaccacguggccaucuaccaggacaagaacggcaagcugcaggagaagguggucuccuucuacgaggccguggcgcgggugaacaacaagcugcccaucaucgaccaggacuucaacaaggaccucggcuggaaguuccuguucaccaugaagcagaacgagauguucgucuuccccagcgaggacuucaagccgcuggagaccgaccucauggacaagaagaacaacuccaagaucagcaagaaccuguuccgcgugcagaagcuggggaacaaggacuacacguuccggcaccaccucgagaccaagaucgaggacaucaagaagcugcgcgacuucaccuacauccggaagcgcaaccccgaguccaucaagaacaucaucaaggugcggaucaaccaccugggcaacaucguccacgugggggaguacuga

SEQ ID NO: 1867 - RNA, 4056 nt, Artificial Sequence
  Cas9 variant
augagcaagaaguacuaccugggccucgacaucgggaccaacuccgugggcugggccgucaccgacgagaacuacaaccugugcaaguacgccgggaagcgcauguggggcauccggcuguucgagggcggggagacggcggagcagcgccggaucagccgcuccaaccggcgccggcucagccgcaagaagcagcggaucgaccugcugcaggagcuguucgccgaggagaucgccaagauggaccccaccuucuucauccgccugaacgagucccggcugcaccucgaggacaagagcaccggcgagaaguucccgcuguuccgcgacaaggacuacaccgacauccaguacuacaaggaguaccccacgauguaccaccuccggaaggagcucaucgagaacuccaaggugcacgacauccgccugguguaccuggccugccaccacauccucaagaaccgggggcacuuccugaucaacggcagcuucuccgacgucaagaagcugagcuccgugugcgagagcaugcucaacuccuucaacgggaucagcaaguaccagaucgagaucaacgacaucgagcgccuggaggagauccuguccgaccggaagaagcagaaguccgugaaggccaaggagcucauccagaucuucgagugcggccccugcgaggacaagaccgacgagaagaccugcaaggcgaucgucagcaaccugugcaaguggcugaccgggcucaagggcaacaucaacagcaucuucgacaugcaguucgaggagaucgacacguccagcuucagcuucaccgagcccaaguacgaggacaccaucuccgccgcccuggaggagaaguacccggacuacgccgacgugauccagaagaucaaggcgguguacgacuggagcguccugguggagaucauggccggcgaggacuaccucuccuucgccaaggugaacgccuacaacaagcacaaggagaaccugugcauccugaaggaggucauccgcaaguacugcgacagcgagaucuaccacaaguucuucaacggguucgacgagaagaacggcuacgggaacuacaucggcuccaucuacaagaacggccacagcuacgccaugaagaagugcuccaccgaggacuucuacaagacgcucgggaagauccuggacaagauccagcccgagaaggaggacgagaacgugcuggaggagcucaagguggaggucaagaaccagacccugcugccccucgcgcggaccaccgccaacggcacgauccccaaccaggugcacauccaggagcugcgcgccauccuggacaacgccaagaaguaccucccguuccugaacgaggaggacgaguacgggaccguggccgagaagaucaucagcaucgcgaaguuccggauccccuacuacgucggcccccuguccacccgccacaaggagcagggggccaacagcuggaucgugcgcaagcaggagggccggaucuaccccuggaacuucgaggagaugguggaccucgagcaguccaacaaggaguucauccagcgcaugaccaacaagugcacguaccugaucggcgaggacguccugccgaagaacagccuccuguacucccgguacauggugcugaacgagcucaacaaccugcgcauccgggggaacaagaucagcgugaagcugaagcaggagcuguacaaggagcuguucugcaccaaggccaaggucaccggcaagggccucuucaacuaccugaagaaggaggacgaggagcucgcccuggaggacaucuccggguucgacaucgacuucaagagcucccugaccagcuaccucgacuucaagaagcagauccugggggaggagaucgagaaggacaaguacaagggcaucguggagaacaucaucaaguggaagacgaucuacgacgacgacuccaagaugaugaagaagaugaucgagcgcgaguaccccaacgucuucagcaaggacaagaucaagaagaucugccgguucaaguacagcggcugggggaacuucucccugagcuuccucaacggcauccgcggggccgaccgggagaccggcgaguccuucaccaucaucgaggcgcuguggaagaccaacuacaaccugaugcagcuccugagcaagcaguucacguuccgcgaggagaucgaccugaucaacgccgagaagguggggaagaucaacaagguguccuacgacaacaccgucaaggaccucaucgugagccccgccaacaagcgggccaucuggcagaccgugcagaucaccgaggagaucaagaaggucaugaagugcgagcccgagcgcaucuucaucgagauggcccggggcggcgagaaggagaagaagcgcacggugucccggaaggcgcgccugcuggagcucuacgccgccugcaaggacgacgugcgggacuggaccaaggagaucgaggaccgcgaggagcgggaguucaacagcaagaagcuguaccuguacuacacccagauggggcgcugcauguacuccggcgaggagaucaacaucgacgagcucaugcagaagaacagcaagugggacaucgaccacaucuacccgcaguccaagaucaaggacgacagccuggacaacaugguccuggccaagaaggugaucaacaacuccaagcagaacaagcuccugagcuccgacauccgcaucaagaugaagaaguacuggaacgcgcuguacaaggggaacuucaucagcaagaagaaguacgaccggcucacccgcacggaggacuucaccaacgaggagcuguccggcuucaucgagcggcagaucguggagacccgccagagcagcaaggccgucgccgagcugcucaaccggcuguacgagcacuccgagaucguguacgugaaggccggccuggucagcgacuuccgccacgacaacaagcuccugaagucccggcgcaucaacgacuaccaccacgccaaggacgcguuccugaacaucgugguggggaacgucuacaacgccaaguucaccagcaacccccggaaguggaucaaggagaaccgcggcaccaacuacuccauccggcgcguguucgacuacaacgugaagcgggggaacacggucguguggcagggcguggaggacgggggccacagcaucgacgagauccgcaagaccauggcccggaacgacauccucuacaccgaguacaccuacugcgacaagggcgagcuguucaacgccacgcugaucaagaaggggaacgacaaggccaucaaccucaagaaggcgcuggacuccgucaaguacggcggguacaacagccccaagaccuccgccuucgccuucaucgaguucgacggcaagaagaaggagcgcaagaaccacaucguggagauccccguguacaucgucaacaucgccaagcggcagccggacaccaucaaggaguaccuggagcagaagaagggguacaagaacgugguggucaagaaguaccccaucaagaagaacgcccucaucaagaucgacggcuaccuggcgcgccugcggggcgccaacgagaccgacauccuccugaagaacgccgugcagcugauccucaacgacaaguacuacgagaucauccgccggguggagaaguaccuggaguacaacguccgcuacgaggccgagagcauguucgagggguucgaccacgcggaccugaacucccucuacgacgagcugacgagcaagcuggagaccuccaucuacaagaagcgccccgccaaccagcucaacgcccuggagaagggcaaggagaaguucaagaacauccagacccugcgggagaaggcccagaucaucaaggagaugcucaucauguaccgcugcgacgccgcgaccguggccaaccugaaggccaucgggggcagcgccaacgccggguccaugaagaucaagaagaacacgcugaccagccggucccucgugcuggucaaccagagcaucaccggccuguucgagaccgaggaggagcucguguga

SEQ ID NO: 1868 - RNA, 4056 nt, Artificial Sequence
  Cas9 variant
auguacaagaaguacggcaucgggcuggacaucggcaccagcuccaucggguggagcguggucgacgaguacggccacaucauccgcgugaaggggcagaccggccucggcgugcggcuguuccgcgaggggcagcccgccgccgaccggcgcacguuccggaccacccgccggcgccugggccggcgccgguggcgccuccggcugcugcgcgagaucuucgacccguacaucgcggcccaggaccccaacuucuucgcccggcagaaggccuccgccaucgcgcccggggacagccgcuucaaggccgucuaccggcuguucaacgaccagaccgaccgccaguucuacgacaaguaccccacgguguaccaccuccggcagaagcugaugaccgagaagcgccaguucgacauccgggagaucuaccucgccgugcaccacaucgucaaguaccgcggccacuuccugaccgggggcgccgcgaagaacuucaagccgggcaagcuggaccucaacaccuacuucgccacgaucaacgcccagcuggccgccaucuucauggacucccagguggagcugccccagcucgacugggacgcgguggucagccugcugaccaacgaccaggagucccccagcgaccgccagaaggcccucaccaagaugcugguggcccagggggacgccacccagaagcgguucuacacggaguucuccaaggcccugcucggccugaaggcgaagcuguacgugcucaccggguucgagggcgacaagaccgaccagaaggcccugacccugagccucgagacgcuggacgaccaccaggacgacgucacccagcugcucggcgacgagcagcgccagcugguggagcugcucgcccgggugcaguccgccauccagcuggccaucaucauccccaacgggaagaccuucagcggccagaugguccagcaguaccagacccacuacgaccagcugcgccuccugaaggacuaccgggagcagcugacggaccagaagcaccgccgggcgcucaagcaggccuacgccgacuaccuggccaacgaccaggaccaggacgcccuggugaaggcgguggagaagguccucaagcagaaccagccgcuguccaccgugggggugcgccugcagaccgccaucgacgccggcgacuuccuccccaagcagcggaccaaggccaacagcgucaucccccaccagauccaccagcaggagcuggaccgcaucaucgaggcgcaguccguguacuaccccuggcuggccgaggagaacccgguggccgcccaccggagcuacgcccccuacaagcucgacgagcuggucgacuuccgcgugcccuacuacgucgggccccuggugcagccgcaggcggacaaggccgccaaggagacgaaguucgccuggaugacccggaaggaggcccaguccaccacccccaucacgcccuggaacuucgagcaggagguggaccgcaacgcgagcgccaacgccuucauccagcggaugaagaccaccgacaccuaccugcucggcgaggacguccugcccaagaacucccugcucuaccagcgcuucgaggugcugaacgagcugaacaacgugcgggucgacggcaagcuccugacgaucgccgagaagcagcgccuguuccaggaccucuucguggaccggagccaggccagcgugaccaucgcgcagcugcaggccaaccugaucgcccacggggccgcgaaggaccgcgucgagaucaagggccucgccgacccgaagcgcuuccuguccagccugaccaccuaccacgacuacgcccagaucauccccgaggcccucgagcagcccgacaagcgggccgacaucgagaagaucaucaacugguccacgaucuucgaggacaccagcaucuucaaggagaagcugcaggagaucgcguggcugacccccgaccagcgccggcagcucucccagaagcgcuaccggggguggggccagcugagcgacaagcugcucacccagcugcgcgacgccaccgggcaguccgugauggaccugcucuggacggagccgaacaacuucaugcagaucauccggcgcaccgaguuccagcaggccaucgcccgggugaaccagaccgaccugaagcagcaggaccuggccaccacgaucaacgaccucuacaccagcccccagaacaagaaggcgauccgccagguccugcuggugguggccgacauccagaccgccaugcacgaggucgcccccuccuggcuguucaucgaggccgcgcggggccccgagcagaacccgaagcgcaagcuggcccggcagcagcagcugcucgaggccuacaagaccagcgccaaggagaucgugaacgaggcggugaaggagaagcugcuguccgccaucgacgaccaccagaaguucgaggaccaggucgugcucuacuuccagcagaacggccuggacauguacacggggaagccccuggacuucgagcgccucagcaaguaccacaucgaccacaucaucccccaguccguggucaaggacgacagccuggacaaccgggugcugaccaccccggaggagaacgagcgcaagggcgcccgggugcccgggccccucuacgccucccagcagggccgcuggcggcugcugcagcgcgccgggcucaucagccagcggaagcuggaccaccuccuccugcgccccgaggagcuggaccagcaggcgaccggcuucgucgcccgccagcucguggagacgcgccaggugaucaagcugaucaccaacauccugucccagcaguacgacccggagcagaccaagcucgucagcgugaaggccggccugucccaccaguuccggacccggcugaaccuccccaagcugcgcgagcugaacgacuaccaccacgcccacgacgccuaccucgcggcccggaucgggacguaccugcugcagcgcuaccccaaccucgagcgguucuucguguacggccaguaccagaagacccgcuucgaccugaagcggcacuucaacuucaucggggagaugcugaagggcaagcccgaggacgccgucaucgugaaggccccgcacagcgagaccgugaucugggacaagcaggacgaggucaagcagcucaagaagaucauggaguaccgccaccuccuggugacccacgagguguacgacaaccacggcgcccuguucaaccagacgauccaccccgcgaagaaccccaagaaccggaagcugaucccccgcaagaccacccagagcaccgagcuguacgggggcuacuccggggagacgaccggcuaccucgccaucgcccggaccgucaccaagaacaagaucagcuaccaggugcugcgcgugccgacgcggcuggucgggcgccuccagcgguccagcgaguccgcccagcgccagauccugaccgacugguucgcccccagcuucgugucccggggcaagcagcagcccuucgagaucgugcugcgccacgucuucaagaaccagaccgugaucgacgacauccacgagcagagccaccgcuucggccuccgguccgacaccuacuacugcaaccagcagcagcuggugcugagccucgagcagcagcgcaugaucaucgaccagaagcugaacaacacgaacaagcugauggucguguacgaggcggugugcgaccaggucgccaaguacuucccccucuaccggaugaaccacuucaaggagucccugcuggaggccgggccgaagcucgccgagcugcccaucaacaccgugcagagcaagaacggcaagcugaagcucgggcagcgcuccgugcugcugcagaccaugcagggccuccacgcgaaccccgagaccaaggaccugagcaucaucgggugccccaaguacuucggcaagcugcaggucuccagcggcaucaagcugacggagaacgccgugcucauccacgaguccccgaccgggcuguuccagcggcgcguccggcugagcgaccucuga

SEQ ID NO: 1869 - RNA, 4056 nt, Artificial Sequence
  Cas9 variant
augaagauccugggccucgaccuggggaccaacagcaucggcugggccguggucaacgaggccgagaacgagcgcgaguccagcuccaucauccggcugggggugcgcgugaacccccucaccgucgacgagcagaacaacuucgagaagggcaagccgaucacgaccaacgcggaccggacccugaagcgcagcaugcggcgcaaccugcagcgguacaagcuccgccgggccaaccuggugucccugcucaagacccagggguggaucacggacgagacccugcugagcgagcagggcaacaacuccaccuucgagaccuaccgccuccgggccgaggccgccacgaaggagaucacccuggagcaguucgcgcgcgugcugcucaugcugaacaagaagcggggcuacaagagcucccgcaagaugaagcacgacgaggacgggagcuucgucaacaaccuggacaucgcccgggagcucuacgacuccggccugacccccgggcaguacgccuacaaccugcucaaggacggcaagaaguacauccccgacuucuaccgcagcgaccugcaggaggagcuggacaagaucugggccuaccaguacgaguaccacgagaacauccucacccacucccugcggagcgcgaucaucgaccaguccaagacggggaccaccaagaucuuccugaagacccacggcaucuucacggccgacaucaagggcaaccgcaacgagcggaacaagcagcuguucgagcuccgcugcggggcccuggagcgggcccucaccgccgaggagcuggcgaccgugaucgccgaggugaacggccagaucaacagcuccagcggguaccugggcgccaucuccgaccgcagcaaggcccucuucaucaaccaccagaccgucggccaguaccugaugcagcagcuggaccgcgaccccaacaagagccucaagaaccagccguucuaccggcaggacuaccuggacgaguucgagcagcugugggagacgcaggcccacuaccaccccgagcucaccgcggcccugaagcacgagauccgcgacaucaucaucuucuaccagcggcgccugaagucccagaaguggcucguggccaacugccccuucgagcaccggaaggugugccccaagagcuccccgcuguuccagcacuuccgcaucuggcagguccugaacaacgugaccgugaccgucgacaacaagacguacgugcucaacgaggagcagaaguccauccugagcaaggagcugcucuacaaggagaagaucagcaagcgggacgcccugaagaugcuguucgugaaggccaagggggucgacaugaacuucgcgucccuggagggcgaccgcaccaugagcaaccuccugaaggccgcccaggagaucguguccaucagcgggcacggcgacuacgacuucgggaagaugcccgccgacgacauccacaacaucauccgguccguguucggcggccugggguucgccaccgacuggcucaaccuggacaccgacgcggacgaccuggagcaggagagccagaugcgccucuggcaccugaucuacuccuucgagggcgacaacagcacgaccggggacaccaagcuggucgagcggcucaugucccugcugaaccucccccaggaguacgcccgccuguucgccaacgugcaccuggaggacgacuacugcggcaucagcuccaaggcccucaagcggauccugcccuucaugaaggcggggcacaucuacagcgaggccugcgcccuggccggcuacaagcacuccgagcagagccucacccgcgaggagaacaagaaccggccgcugaaggaccaccuggagcagcuccccaagaacagccugcgcaaccccguggucgagaagauccugaaccagauggugaacgucgugaacuccaucaucgacacguacggccggcccgacgagauccgcaucgagcucgcccgggagcugaagaacaacgcgcuggggcgccaggccaucuucgaggccaucaaccgcaacaccaaggagagcgagcggauccagcagauccucaagaaggaguucggccugacccacgugucccgcaacgacaucauccgguaccgccuguaccaggagcucagcgggaacggcuacaagacccuguacuccaacaucuacaucccgcaggagaagcuguucagcaaggagaucgacaucgagcacaucaucccccaggcccgccucuucgacgacuccuucagcaacaagacgcuggaguaccgggacgucaacaucaagaaguccaacaccaccgccaucgacuucgugcggaacgaguacggggagaacgagguggagcaguacaagaagcgcgucaacgaccugcucaagagcggcgcgaucucccaggccaaggccaagaagcugaagaugaccgaggccgagauccccaacgacuucaucgagcgggaccugcgcaacacccaguacaucagccggaaggcccaggagaugcuccgcgacguggcgcggguggucacggccaccaccggcuccgugaccgaccgccugcggcaggacuggcagcugguggacgucaugcaggagcucaacugggacaaguacgagcgccaggggcugacgaccgugaucaacggccgggacgggcagcagauccgccggaucaccgacuggaccaagcgcaacgaccaccggcaccacgccauggacgcccugacgaucgcguucaccaagcccgccuacaucagcuaccucaaccaccugaacgcccgcuccgaggacgacauccgcagcaucgagcggcgcuuccuggagcgggacgccaacggccaccuccgcuucaucuccccgaucgcccacaacuuccggagcgaggcgaagcgccaccuggagaugauccuggugagcaucaaggccaagaacaaggucgugacccggaacaacaacaccacgaagaccaagggcgggcgccggaaccgcauccagcucacgccccggggccagcugcacgacgccaccguguacggguccauccugcucccccacaccaagaccaucgccgucgacggcaagaugaccgccgagaucaucggccaggugcagaaccccguguuccgccaggcgcugagccagcggcuggaggccugcgggaacgacccgaagaaggccuucaccggcaagaacucccucgagaaggcccccgucuggaucgaccaggcccacacggagcacgugcccgcggaggugaccauccagcgccuggagccccagcacaccauccggcgcgccgucaacaaggaccugaacaucaacaaggugcucgacaaggggauccagcacauccugcaggcccggcuggacgccuacggcggggacgcggccaaggccuucgccaaccucgacaacaacccgaucuggcugaaccaggagaagggcaucgccaucaagcgcgugaccacggcggagaacaucagcggggagccccugcaccacaagcacgacaaggagggccggcccauccucgacaccaacggcaagccgaugcccuccgacuucguccgccugaugaacaaccaccacguggccaucuuccaggacgccgacgggaaccugcaggagcacaucgugagcuucuacgaggccgucgcccgcgugaccgagcucggccugcccgugaucgacaaggaguacaacaaggacaagggguggcaguuccuguucacccucaagcagaacgaguacuucgucuuccccaacccggcgcagggcuucaaccccgacgagaucgaccugacggacgagcggaacuacucccgcaucagccccaaccuguaccgggugcagaagauguccagcaaguacuacguguuccgccaccaccucgagaccaccgucgaggacaagaaggagcugcaggggaucaccuggaagcggauccagucccugaacaaccucaagggcaucgugaaggugcgcaucgaccacaucggccggaucguccagaucggggaguacuga

SEQ ID NO: 1870 - RNA, 4056 nt, Artificial Sequence
  Cas9 variant
auguucagccagcagaacaaccuguacugcgagucccucagcaagcuguacuacaacaucaccaagaacuuccuguccaagaacgaggugugccgcaucuacgagaucuucuucugcagcauccucaccuacuuccugaagaaguacaaccacgacaucuucaagaaguccagcacgaugaagaccauccugggccucgaccugggggucaccuccaucggcugggccgugaucgugaccgacgacgacaacacgcccaucaagauccuggggaugggcagccggaucaucccgcucuccaccgccgacaaggaggaguuccagaaggggcaggcgaucagcaagaaccagucccgcaccaucgcccggacccagcgcaagggcuacaaccggaagcagcugcgcaaggaggagcugaagaagauccucggcgagcuggggaucacgcccagcaaggagcugcucaaccugcccuccaucgagcuguggaagcuccgggccgacgccgccagcggcaacgcgccccuguccgccgagcagcuggggcgcaucuucuacaugcucaaccagaagcggggcuacaagagcgcccgcuccgaggccaaccaggacaagaaggacaccgacuacgucgcggccgugaaggggcggcaccagcagcugaaggagaagggccagaccaucggccagcacuucuacaccgagaugcugacgcucgaggagaacagcgggcacuuccaggugaagaacaacgucuacccgcgcgaggccuaccuggaggaguucaacgccaucaucgccgcgcagaagccccagcacgccuuccugaccgacgacgugguggaccggcuccgcgacgaggucaucuucuaccagcggaagcugaagucccagaagggccuggugagcaucugcgaguucgagggguucgagcgcaccuucuucgacaacgugaagcagaaggacaagaccaucuucacgggccccaaggucgcccccaagagcuccccgcuguuccagcugugcaagaucugggagaccgugaacaacaucaaccugaaggugaagaacaccgacggcagcaagaacaagugggccgacuacguccccacccucgagcagaagcaggagaucaucgagcaccuguucaagaacgccgggaucucccuggacgcgcuccggaagauccugggcuucaacaaggacgagaucuucgugaacaagcagaucgagaaggggcugcagggcaacacgaccuacgccgagauccacaagauccucggggacagcaagcccgagcugcugggcuucaacaucaacaucgagcccuccaagcacagcgcccuccugguggacaagcgcaccggcgagauccuggccgagaaggaggggcagcaggucuccgccgagaucgagaaggagaacuucuaccagcucuggcacaccaucuacagcaucaaggaccuggacgagugcgcggccgcccugaucaagcgguucaacaucgacccgaacguggccgcccagcucgcgaagaucgacuucuccaagggcgccuucgggaacaagagcaacaaggccaugcgcaagauccugcccuaccugaugcagggcuacaacuacgccgacgcgugcucccuggccggguacaaccacagcgacucccagacgaagaaggagaaggaggagaacguggucgacgacaagcucaagcugcuggagaagaacagccuccggcagcccgugguggagaagaucaucaaccagaugauccacgucgugaacgccaucaucgacaaguacggcaagcccgacgagauccgcgucgagcuggcccgcgaccugaagaaguccaaggacgagcggaacgaggccgagcuccagaacgcgagcaacaagaagcugaacgaggagguggccaaccgccugaaggagcucggccugccggugaccaagcgguucguccagaaguacaaguucaucuuccccgugcgcgaccggaagaucaaggaggcccagcuggugaaccagugcaucuacugcggggagaccuucaacgucaccgaggcccucuccggcgacaacuucgacguggaccacaucauccccaagagcaugcuguucgacgacucccagacgaacaaggugcugguccaccgcaagugcaacgccaaggacaagagcaacaagaccgcguacgacuucaucgccgccaagggggagaacgagcucgccaucuaccuggaccggguggacgacugguucaagcgcggcgugcugagcuacgggaagaugcagcggcucaaggucuccuacgagcaguacgccgagcgcaagcagcugaagaaggagaccgaggcggacaucaagcugugggagaacuucaucgagcgggaccuccgccagacccaguacaucgccaagaaguccaaggaccugcugaagaagaucugcaacaacgugacggugaccgagggcaagaucaccgcccagcuccggaaccuguggggcugggacgacguccugaugaaccuccagcugcccaaguacaaggcccuggggcagaccgagaucaaggaguggacgagcgagcacggccgccggcuccacaagaaggaggagaucaccaacuggaccaagcgcgacgaccaccggcaccacgcgaucgacgcccuggugguggccugcaccaagcagggguucauccagcgcaucaacacccugaacagcuccgacacgaaggacgccauggaccgggagaucaaggccgcgaaggagaaguacaacgagcucuacgacaagaagcugcugaccgagaccaacgagcaggucaagaaccacaccgagcgcuucaacaagcucgagacguaccucaagagccagcagccgccccuguucaccacccgcuacguggagcaggaggccgacaagaucuucguguccuucaaggccggcaagaaggccgccaccuacggcauccggaagaucaagaaggacgggaagaaggucguggugcaggagaagaucgucgugccccgcggcgcgcuccacgagcagagcguguacgggaagaucaagacgcaggagaaggacaagccccugaaguaccuguucgagaacccggagaccaucgucgacaaccggaucaagauccucgugaaggagcgccuggacaaguucgagggcgacgugaagaaggcccugaccucccucaagaaggagccccuguucaucgacaacgagaagaacacccugcucgagaaggccgccugcuacacggacgccaccguccugaaguacaagcugcaggcgcucaaggccaaccaggugaacgacaucguggacgagggggucaagcggaucgugaaggcccgccuggcccagcacaagaacgagaaggaggcguucaaggacaccgugugguucaaccaggagaagcggauccccaucgucagcgugcgcguguucgcccggcccgacgccuccaagcuggccaucaucaagaccgacgagaacaacaagccgaucggcuucgcccucacgggcaacaaccaccacaucgcgaucuacaaggacaacaccgggaagcugguccagcacaucugcaccuucuggagcgccguggagcgcaagaaguucggcgugcccaccgucgugaagaacacggggacccugugguccgagcuccugcacaaggaccugcccggcaccuuccucgacaagcugccgcaggacgggcuggagcucgaguacagccugcagcagaacgagauguucgugcugggccuccccaaggaguccuucgaggacgccaucaagaacaacgaccugccccugcucagcaagcaccuguaccuggucugguccaucagcgacaacgacuacugguuccggcaccaccucgagaccaagaacagcgagcugaaguccacgaccggcgccaaggagagcaagcgcuacuaccgguuccaguccguggggaccuucaccaaggagaaccccaucaaggugcagcugaaccaccucggcgagaucacgaagaucggggagccguga

SEQ ID NO: 1871 - RNA, 4059 nt, Artificial Sequence
  Cas9 variant
augaagaagcgcaaccgggaggaguacuacgugggccuggacaucgggaccagcuccgucggcugggccguggccacccccgacuaccgcaucccgaaguuccgggggcacaagauguggggcagccgccucuucgcggaggggaagcgggccgccgagcgccggcaguuccgcacgaaccggcgccggcuggcccgccggcgcgaccggcugcagauccucgaggagcuguucgccgaggagauggcgaagguggacaacaccuucuucaugcgccugaaggaguccaaguucuuccucgaggacaagaccgucaaggagaagcacauccuguucagcaccgacaaguucgacgccgaccgguucuacaaggacaaccccacgaucuaccacgugcgcaagcggcugauggaggaggagccccaggacauccgcgagcuguuccucgccgugcaccacauccugaaguaccggggccacuuccucuucgccggcucccuggagcagaacggggcgagcaucgaggagcugguccgcacccuccugggcaagcaggggcuggccauccucgacgacaccaucgacuccaacgagauggugaacauccugaagaacaccggcgagaccaagagcgaccgcaagaaggacgugcaggagcuguggaacccccucaaggacaaggucaagaaggcccaggccgccgagauggcggggcuggugcugggccucaaguccgacaucagcaagcuguucgccaacuccgacuacaaggaccuggacagcuccaucaagaacaucaacuucagcuccggcgacuacgaggagaagcgggacgacuacgccaacagcaucggggacgacaucgugcuccuggacaccaugaaggcccuguacgacacccucauccugucccagauccugcagggcaagcgcagcaucuccgccgcgaaggucgaggacuacaacacccacaaggagcagcuccgggcccugaaggccauccugaagccgcacaagcgccucuacaacgagauguuccgggagaacaacaagaaggaccugagcaacuacguggccuacaucagcuccuacagcgaggggaagcgcgugaaccgggagggcuucuacaaguacguccaggccgugcugaagcaggucgacgacuccgacagcaagcaggcgauccucgaggccauccgccuggagacguuccugccccuccugcgggugaaggacaacgccgugaucccccaccagauccaccaggccgagcuggaggccauccucgagaccgcgcgcaagaaguacaacuuccugaacgacguguccgacggcgucagcgugaaggacaagaucauccagcuguucaccuuccggauccccuacuacguggggccgcucaacccccacuccggcgagaccgucgccgaccgcaagcaggggacgggcugggugguccggaagcagcgcgggaagguguaccccuggaacuucgccgacaugguggacgucaaggccagcgcggaggccuucaucaccaaccugaccaacaagugcaccuaccugaucggcgaggacgugcugcccaagcggucccuccuguacagcgaguucaugcugcucaacgagcugaacaugaucaaguacgacggccacgagcugccgguggccaucaagcagcucuacaucgagcaggucuucaagcaggagcacaagaagcagacgaaggggcgcgugcuggacuuccugaagcggaacggccucaucaccggguccgccaccgccgugaucaccggcauggacgacgcgaucaagggggaccugcagagcuaccgcgacaugguccggaucuucggcgccggcuucgaccacuccauggccgagcgcaucauccgcugggugacgcuguucggggaggccaaggacauccucgagaacaagauccgggagguguacggcaacagcaucuccgacagccagaugcgcgccaucaagaagcugaaguacgcggacugggggcggcugucccaggccuuccucaucgccgucaagggcugcgacaagagcgggguggagcgcaacaucaucacgugccugcgggccuccagccagaaccugauggagauccucagcgaccagggcaccuacaucaagcagaucaaggccuggaaccaccagcacaccacgaacaugauggacacccuggacuaccagcugguggacgaccucuacgucgcgcccuccgugaagcgcagcaucuggcagucccugugcaucguggaggagcuggucaagaucaugggccaggcccccaagaagaucuucguggaggugacccggaccaagcaggccgagaagacgaagaaggacagccgcaagaagcggcucgucgagcuguacaccgccaucgggaaggagggcgcggccuggaagaaggagaucgaggcccaccaggccggggacuuccgccggaagaagcuguaccucuacuacacccagaugggccgcugcauguacuccaacgagcccaucgccauggacgcgcuguucaccagcgccuacgacaucgaccacaucuacccgcagucccugacgaaggacggcagcugggacaaccucgugcuggugaagucccagcugaacaaggagaaguccgaccaguacccccuccggcccgccauccgcgagaagaacaaggcccacuggcaguaccugugccgggccggguucaucagcgagaagaaguacgagcgccugaugcggaccaccgagcucaccgcggaggagcugagcggcuucaucgcccgccagcuggucgagaccucccaggccacgaaggccgugaccgggcuccuggagcggaucuacaccaacaccgagaucugcuucgugaaggccgagacggucagccaguuccgccaccagcacaacuucaucaagauccgggagcugaacaacuaccaccacgcgaaggacgccuaccucaacaucguggugggcaacgucuaccacgagaaguucaccaagaaccccugggaguucaucgcccgcuccaccgagcgccggccguacaaccugaaccgcauguacgacuucgaccugcucaagcaggggcgggugaucuggcagguccccaagagccuggagaccgugcaggccaugaugaaguccaacgacgugcgcaucacgaagaagcugcucgugcagaagggcgagcuguacgacgcgaccaucaccaaggcccacaaggccaaggagggcaccuacuucccccugaagggggccgacgcccggcuccgcgacguccaccgguacggcggguacgagaagaucaagaucgcguacuacagcguguucagcugccgcgagaaggccuccaacacgauccacacccugaucauccccaucccgguguacaaggccggccugcuccagaccgaggccgaccugaccgccuacgcguggcagacgaagcagaagaccaagcccaucaaggacaucuacagcgccaucacccccaucuacaagaagcugugcaucaacaccgucgugaagaucgacggguucaaguacuuccucggcggcaagacgggggacuacauguggcuggaccccgccaucccggugguccuggacgagcaggccgccgcguaccucaaggccaucuccaaggugggccgggccgacgacguggagaacaccgcccaggccaucgaccugaucaccgcggaggccaacgaggccuucuacgacguccugcucaagaagauggaggccaagaucuucgcgaaggccuaccagaccaucguggagaagcuggccagcgagacggcccgcgagcgguuccgcgagcuguccaucggggcccagugcagcugccuccuggagauccugaaccuccuggcgaacaacaagaccaccuucaccuucuucaaggacaagaugggcgugacgaugucccggcgcaagcagcccauggaccugaccaagcucgaggagugcaucgucuacgagaccagcaucaccgggcuguacgagaaggccgugucccugcucuga

SEQ ID NO: 1872 - RNA, 4059 nt, Artificial Sequence
  Cas9 variant
augggcaagcgcuaccacaucgggcuggacaucggcaccagcuccaucgggugggccgugauggacgacgacuucaagaucaugcgggucaagggcaagaaggggaucggcgugcgccucuucgaggagggcaagaccgccgcggagcggcgcgggcaccggacgacccgccggcgcuacagccggcgcaaguggcggcugaaccugcucgaggagaucuucgaccccgagaucgccaagguggacccgaccuucuucgcccgccugaaggaguccaaccugagccccaaggacgaccggaagcaguacuccggcaaccucaucuuccccgagaaggccaaggaggagauccgcgaguggaccgagaaguaccccacgaucuaccaccuccggaacgcccugaugaccgagaaccgccaguucgacauccgggaggucuuccucgcgcugcaccacaucgugaaguaccgcgggaacuuccuguucaacggcaacuuccagaccggggaggugaaccucagcgaccgguucgacgacaucaacuccgccuucaucagcgccugcggcgaggaggaggccccgcagauccccuccgagcuguacaacgacauccaggagcugcuguucgacaagaacacccgcaagcuggacaaccagaagcagcuggcgacgaagcucagccaggacaacgacaaggacugguccacccaguucagcaaggcccuguucggcuacaagaccaaguucaaggucgugcugcaguccaacgaggaccucgacgacuuccagcuggacagcgacgacgccgacgacaagaucgccuccaucagcgagcagaucgacgacgaccggggguccauccuggacaacaucaagauccucuacagccgcaucacccugaacgagaucgugcccgacggcaagacgcugucccagagcaugaucgagaaguacaaccuccaccgcgaccaccugaaggagaucaaggaccagcugaagcacaccgacaacugggucaaguucgacgaccucuacagccaguacgugaacgggaagcuggaguccgaccggcacaagaagcugagcuccgacgacuucuacaagaaggugcucacccuguucgacggcgagcugaagacccgcgucaaggaguggcaggagaagggcgaguuccuccccaagcagcggacggggagcaacggcgugaucccgcaccagcugcaccagaacgagcuggaccagaucaucgagaaccaguccaaguacuaccccuggcucgccacccugaaccccaacgagaagcgccagcggguggcgaaguacaagcugagcgagcucgucgccuuccgcauccccuacuacguggggccgauggugaccaaggaccaguccgacuucgccuggaugguccggaaguccgacgagaaggagaucacccccuggaacuucgaccaggugguggaccgcgacaaguccgccgaggaguucaucaaccggaugacgaccaaggacaccuaccugaucggcgaggacguccugcccgccaagagccuccuguacgagaaguucaccgugcugaacgagcucaacaacauccgcaucaacgggaagccccugacgaccgacgagaagcaccagguguaccgggaccuguuccagaacgcgaaguccaucagcaccaagaaguuccacaacuaccuggucugcaagcucaacaagccgaaccaccugaacaucaccggcuucuccgaccugacgaaguucaacagcucccucgacagcuacaucgaccugaagaagaucuucgccgaccagaucgacgaccagucccugcaggacgacuucgagaagaugauccgcuggagcaccguguucgaggacaagcagaucuucgagcggaagcucuccgagaucaacuggcugaccgaccaggagcgcagcgaggucgccaagcugcgguaccgcggcugggggcggcucagcaagcgccugcuggccggcauccacgacgagaacgggcagcggaucaucgacgcccucuggaacucccccaagaacuucaugcagauccaggcggagguggccuucaacaagcagaucaacgaccugaacaccaaggagcugagcgacaacaacguggaggacguccucgccgacgccuacacgagcccccagaacaagaaggccauccgccaggugcugcugguggucgaggacauccagaaggcgaugcacggcgacgcccccaccagcaucucccucgaguucgcccgcgaggagcaggagagcucccggacccgcagccggcgcgccgcgcuguccgccaccuaccggcagaucagcgacgagaucguguccgccacggugaagggggagcugggcaaggccaccagcaucuccgaccgccucuaccuguacuucacccagggcgggcgggacauguacaccggcgagccgaucaacaucgacgagaucagccgcggguacgagaucgaccacauccugccccaguccuucaucaaggacgacagccucgacaaccggguccuggugaagggcgccaucaacaacgggaaguccgcgaacuacgugauggaccagagcugggcccccgaccgccuggccugguggaagaagcuccuggacaaccggcugaucagccgcaagaaguaccagucccucacccugacgcccggcaagaucaacaaguacagccagaacggcuucaucaaccggcagcuggucgagacccgccaggugaucaagcucguggccaacauccugaacgaccaguacuccaacgacgacaccaagaucaucgucgugaaggccgcgcugaacagccagcuccggggguuccuggagcuguucaagaaccgcaacaucaacgacuaccaccacggcauggacgccuaccucuccaccuucaucgggaacuaccuguacaagaaguacccgaagcugcggagcuacuucguguacggcgaguucaagaaguucuccggcaagcagaaccucaagagcuucaacuuccugcacgaccuggaggacgacuccaucaacaucaucagcaacgacgacggggagaucgucggcaaccaccacgagaugaucgaggagcucgagaaggccuaccaguacaaguacaugcuggugucccgcgagguguucgagaagacgggggaccuguucaacgucaccguguacagccggaaggccaagaagacccucauccccaucaagcaggacaagcccaucaacaucuacggcggguacuccggcaacaacgacgccuacauggcgaucgugaagcugcccggcaagaaggggaagccggacaccuacaagaucgucggcaucccccugcgcuucgccggggagcucgagcgggccaagcagcugggcgagagcgccuaccgcgagaagcuguccgcggugaucacgccccaguucaccaaggagaagaaggaccgcaagaccggggagaucaccaagguggucgacgacuucgagguggugcucgaccgggucccguaccgccagcuguucaaggacagcgacaagugguucaugcugggcuccgccgccuaccaguacaacgccaagcagcucgugcugaacaacgacgacgugaagcugcucaacgagcagggccggaagaagcuggagcugcccaacgagaagcucagcuccgcccugaacgacgucuucgaccacaucauccagaucaugaacagcaaguucgggcuguacgacaagaacggcuuccgcacgaagcucaccgaggcggccagcaucuucuacgaccugccccugcgggccgaguacaacgggaacaagaaggugaccgacggcaagcucgaggugcuggacaacauccugaucgggcuccacgccgaccccuccuucggcaaccugaagcagcugaacaugagcaccccguucggccagaugcagacgaagggcggggucgugcucaacgggaacuccacccugaucuaccagagccccaccggccuguucgagcgccgggugaagcucaaggaccuguccaaguga

SEQ ID NO: 1873 - RNA, 4059 nt, Artificial Sequence
  Cas9 variant
augaagaagauccugggccucgaccuggggaccaccagcaucggcugggccuucaucaacgagggggagaacgacaacgagacguccagcaucaucaacgccggcgugcgcaucgucccccugaccaccgacgaggaggcggacuucaagaaggggaacaccaucuccaucaacgccgaccggacgcucaagcgcggcgcccggcgcggccugcagcgguucaagcagcgccgggacgcccugcuccagagcuuccgcgggaucaacuucaucuccagcaacuacguguacgccgagaccggcaagcagaccaccuucuccagcuacaagcugcgggcgaaguccgccacggagcuggugaccaaggaggagcucguccaggugcugcugaugcucaacaagaagcgcggguacaagagcucccggaaggccaagaccgccgaggagggcgacgcgaucgacgggaugaagaucgccaaggagaucuucgagaacaaccugaccccgggccaguggguguacaacagccuguccaucggcgggaaguucauccccgacuucuaccgcagcgaccuccagaaggaggucgagaagaucgugcgguuccagaaccaguuccaccccgagcagaugaacgagaagcugcuggagaacauccagggcaaggcccgcacggugaccucccaguacuucagccggauccucaacaucccccuggccgagaacaaggggacccgcgaggagaccaagcugcagcacuacaaguggcggaacgaggcccucacggaggagcuggaccugaagguccucgcguucaucaucaccgagaucaacaaccagaucaaccaguccaacggcuaccugggcgccaucagcgaccgcuccaaggagcuguacuucaaccaggagaccguggggcaguuccaguacaaccagcucaaggagaacgcccacaccaagcugaagaaccagguguucuaccggcaggacuaccuggacgaguucgagaagaucugggagacgcagagcaaguucuacccggagcucaacgacgagcucaagagcgagguccgcgacaucaccaucuucuaccagcggaagcugaagucccagaagcaccucgugagcuucugcgaguucgagaagggccacaaggccauccccaaguccagcccccuguuccaggaguuccgcaucuggcagaacaucaacaacaucguggucaagaacgagaccaccaaggagcccuuccugcucggggaggaccugaagaaggugaucgcccaggagcuguccuucaaggagagcaugacggacucccagcuccugaccuucugcgaccugaagaagggcacccacaccgugaacuucaagaagaucgaggggaaccgcacgaacaccagccucuucaaggcguucgagaagauccugguccuggagggcuacgacgagcucgaccuguccaagcuggacgccagcgacaucaaguccaucaucaagagcgccuucuccgaccucgagaucagcaccgccauccuggacuucgacccgaccauccagggcaacgacuacgacaagcaguccuacuaccagcuguggcaccuccuguacagcuccgaggaggacgacuuccugaagaagucccugauggacaaguucggguucaaggagagccaccuccccuuccugcugaacaucaaccuccaggccgacuacggcagccugagcgcgaaggccaucaagaaggugcugccccaccucauggacgggcacaucuacgacaaggccugcacgcuggugggcuacaaccacuccagcucccugaccaccgaccagaacaacgagcggguccucaaggacacccuggagcugcucaagaagaacagccugcgcaaccccgugguggagaagauccugaaccagaugaucaacgucaucaacgccaucaucaaggacccggccauggggaagcccgacgagauccggguggagcucgcgcgcgagcugaagaacaacaacgagcagcgguccgagaugacgaaggccaucaacaagagcaccaccgagcacgagcagauccgcaagcugcuccacaccgaguucggcauccaccgggucacccgcaacgacaucauccgguacaagcuguggaaggagugcgacggcaucucccuguacacggggaagcccaucgagcccagcaagcuguucaccaaggacuacgacaucgagcacaucaucccgaagucccgccuguucgacgacagcuucuccaacaagaccaucugcgagcggcagcugaacaucgacaagagcaacaagaccgccuacuccuucuuccaggagaagcucagcgccgaggaguucgaccaguucgagaagcgcgugaagucccuguucggcaagaucagccggacgaagcagaacaagcugcucauggcgaacaacgagauccccgagggguucaucgaccgccagcugcgggagacccaguacaucgccaagaaggccaaggagauccugcucgaggugucccgcaacgucaccgccaccaucggcagcgugacggacaagcugcgggacgacugggagcugguggacgucaugaaggagcucaacugggagaaguacgacaagcuggggcugaccuacaucgaggagggcaagaacggcgagcgccucuacaagaucaaggacuggaccaagcggaacgaccaccgccaccacgccauggacgcgaucaccguggccuucacgaagcccgccuacauccaguaccugaacaaccugaacgcccgcaccaacaccgacaagaaggggaacagcaucaucggcaucgagaacaaguaccucaagcgggacaagaacaacaagcugcgcuucaucgagcccaucccgaacuuccgggagguggccaagaagcagcuggaguccauccucaucagcuacaaggcgaagaacaaggucgugaccaagaacaagaacgugacgaagaaguccaacgggaccaaccagaagauccagcugacgccccgcggccagcugcacaaggagaccgucuacggcaagcuccagcaguacgugaccaaggaggagaagaucaacgccaacuucacccccgaguacgugaccaaggucgccaagaaggaguaccgggaggcccugcugaagcgccucaucgagaacgagaacgaccccaagaaggccuucaccgggaagaacgcgcugagcaagaacccgaucuacaucucccuggagaacaacauccucgugcccgagaaggugaagaucgucuggcucaagagcgacuacacgauccggaaggacaucacccccgaccugaagaucgacaaggugaucgacaucggccugaagaccauccugcagaaccgccugaacgaguucaacggggacaccaagaaggccuucgugaaccucgacgagaaccccaucuggcagaacaaggagaagggcaucgccaucaagcgggucacgaucuccggggugagcaacgcccaggcgcugcacaccaagaaggaccaccugggcaacgagauccucgacgagaacggccagccgcugcccguggacuucgucuccaccgggaacaaccaccacguggccaucuaccgcgacgagaagggcaaccugcaggaggagguggucagcuucuucgaggccgugacccggaacaaccucgggcuguccaucaucaacaagaaccacgagaagggcugggaguuccuguucagcaugaagcagaacgaguucuucaucuuccccacggacggguucaacccgcacgagaucgaccuccugaacaccgagaacuaccaccugaucucccgcaacauguuccgggugcagaagaucgccaccaagaacuacauguucaaccaccaccucgagaccaagagcgucgacggcgagaugcugaagacgaagaagcagcuguccaagaucagcuaccacuucauccagacccccuccuaccucaacuacaucaucaagauccgcaucaaccaccugggccagaucgugcagcugggggaguacuga

SEQ ID NO: 1874 - RNA, 4059 nt, Artificial Sequence
  Cas9 variant
augaagcaggacuacuacaucggccuggacauggggaccgagagcgugggcugggccgucaccgacguggacuacaaccucaucaagaagcgcgggcaggacuacuggggcguguaccuguucgacgaggcccagacggcgcaggggcggcgcgccuuccggaccaaccgccggcgccuggcccggguccgccaccggcucaaccugcugcaggagcuguucgacuccgagaucagcgccaaggacuucggcuucuucuaccgccuggagaacuccaaguacuucgacgaggacaagcccgagaucgcccggggcaaguuccuccucuucaacgacaaggacuucggggacaaggaguacuacaagaacuacccgaccaucuuccaccuccgcaacgcgcugcggacccaggagaucaaggacgugcgccuccuguaccuggccgugcaccacauccucaagaaccggggccacuuccuguucggggagcaggacuucaacgucaacgacgccagcgacguguccggcgaguucgagaagaucaaccgcuuccugagcgagaacgacggggccggcuucgaccgggagaagauccccgagaucuucgagacgcucugcaacgagaaccuggcgaagcgcgagcggaaggagaagauccuggagcucgccggcaacuccaagaacaagcugcugggggaggccgugaacgccgucgugggccucaacuucagccuguccaagauguucggggaggaccgcgacuuccagggcgagaacaagaugagcuucaccgacuccagcuucgaggagaagcuggccaaggcgcggauggcccucgacgacgacgaggccgacuuccuggagacccugaagaaggugcaguccgucgccagccuccacaacauccugcacggcaaggaguucaucuccgaggccaagaccgaggcguacgagacgcaccgccgcgaccugagcgagcucaagaaguacgugcgggagaacugccccgagaaguacgcccugguguuccgccggcaggucaagaaggggaagaagaacaccuccggcgccgacgagaacgagaaggacgacaagaaggugaacaacuacgccgccuacaucgggauggacaagggcaagggguucgagaagugcaagaaggaggacuucuacgcguuccugaagaaggagaucggcaucaacgacgagagccuccuggccaagaucgacgagggcaucuuccugcccaagcagaucuccgccgagaacugcgacaucccguaccaggugcaccucgccgagcugaaggccauccuggcgaacgccgagaacuacuuccccuuccucaagcagaaggacgagaacugcgagaugaccgucagcgagaagaucaucagccugaugaaguuccgcgugcccuacuacguggggcccuucaccgacaaggagacgcgguucuccuggaugaucaagaaggagggccugagcacccagaagaucaccccguggaacuucgacgacgucguggaccgcgacgccuccgagaagaaguucaucgagcggaugaccaacuucugcacguaccucaccggggagaaggugcugcccgccagcuccuuccuguacagcgaguacgcguuccucaacgagcugaacaaccugaaggucaacggcaccaaggaccugcgcgugaagaacauccucuucgacuucgccaagaccaacaagaagcugacgcugaagaagugcugcgagcagcucgucaagaacgggcugcugcccgagggcuccaaggcccgggacguguucagcggcaccgacggggacuucaagaacucccucagcuccuacaucgacuucaagcgcaucaucggcgacaaggccgaccuguaccgggacaugugcgagaagaucauccuguggaucaccgugaucagcgacaaggagcgccucgucaagaucaucaaggacaaguacgggaccgugcuguccgacgaggagaucaagggccugaaggcccucaacuacacgaagugggggcggcugagcgagaagcugcucgacggcaucuucgagaccgacuccgagggcgagguggggaacgucagcaucaucgagaagaugcgcaccgacaccgagaacuucauggagcugcuguccaacaagcacaacuacaagcgggcgaucgagcucgccaacagcgaguccaucguggacgagcgcgugacguaccgggccgucgaggagcuguacugcagccccgccgugaagcgcagcaucugguccgcccugaagaucgugcgggagaucgucaaggugcagggccacagcccgaagaagaucuucguggagaccacccgcgagaagcccgacgucacccgcaaggggcagcggacggugucccgcaagcagcagcuccuggacaaguaccgggagaaccugcgcaacgagaccgagcucaucaagaagaucgaggagaccgaggacagcaaguucaacuccgacaagcuguucuucuacuucacccagaugggcaaggacgcguacacgggcgagaagaucgaguucgacgacguguucaagaccgagaaguacgacaucgaccacaucuacccccggagcaagaucaaggacgacucccuggacaaccgcguccucgugcggcgcaagaucaaccagagcgugaagaaggacuccuacccccugagcgccgagauccggaaccgcauggaggggcuguggcggcagcuccgcgacaagaagcugaucuccgacgagaaguucuaccggcugacccgcagcaccccgcucaccgagaaggagugcggcgacuucaucaacgcccagcugaucgccacgucccagagcgccaaggcggccauccagcugcucaagcggaugcugcccgaguccgagaucgucuacagcaaggccgggaacgugaacgaguucaagaagcgccuggaguucgugaagauccgggagcucaacgaccugcaccacgccaaggacgcguacuucaacaucgucgugggcaacguguucaacaccaaguucaaccacaaccccgccgucuuccagcgcuccaacgggaccggcaacuacgacuucgagcggcuguacgacuucgacaucaccaacgccuggaagaagggcgacgagaaccgcauccggagcguggccgagaagaacacgugccgcgugguccgcuucagcaagaccgagaaggggcaguucuacgacgccaccaucuaccccgcgggcaagaacgacaagcucgccccggugaaggggaaggcgccccugaacgacaccuccaaguacggcggguacgacaaggagacgaccgccuacuucaugcuggucaagagccgggacaagaagaagaaggacaagacccuccugucccuggagugcgugaccgugcucgccgacaagaacuuccgcacggccgaggacaagcugaaguacugcgagaaggagcugggccucaaggagcccgagauccugaucgagaagaucaagcugaacacccucuucaagaucaacggcagcuacgccuggauccgggggcgcaccaacgaccggcuggugcugugcaacgccaaccagcucuggcuggacaacggcuccgccaaggagcugaagaagaucagcaaccacuuccgcgacgucaagaaguacaacaacaaggaccuccccgugcgggaggaggaguucuccaaggagcagaaccuggcccuguacgaccucuucaccgagaagcucgggggcaagaucuacgcggggcugccggugcagggccagaucaagaaccuggagaagggccgcgacaaguucgaggcccuggagcugaaggaccagcuguucguccugauggagauccugaaguucaugcagugcaacagcaugacguccaacaucaagcucaucgggggcgccgagaacgccgggaagaaccggaucagcaagcugauccaggacuccgacgugaagaugaucuucugcagccccaccggcuacuucugcaagguggucgacuucaagcgcuuccuguga

SEQ ID NO: 1875 - RNA, 4059 nt, Artificial Sequence
  Cas9 variant
augaagaagauccugggccuggaccuggggaccaccagcaucggcugggccuucaucaaggagcccgagaaggacguggucggguccgagaucguggacaugggcgugcgcaucgucccgcugagcuccgacgaggagaacgacuucgccaaggggaacacgaucagcaucaacgcggaccggacccucaagcgcggcgcccggcgcaaccugcagcgguucaagcagcgccggaacgcccugcucgagaucuucaaggagaagaagcugaucuccaccaacuucaaguacgccgaggacggccccagcuccaccuucagcacgcugaaccuccgcgccaaggcggccaaggagaagaucgagcugcaggaccuggugaaggugcuccugcagaucaacaagaagcggggguacaaguccagccgcaaggccaaguccgaggaggacgacggcagcgccaucgacuccauggggaucgcgaaggagcuguacgagaacgaccucacccccggccagugggucuacgaggcccugcagaaggggcggaagaacgugcccgacuucuaccgcagcgaccugcaggaggaguucaagaagaucgugaacuaccaguccgaguucuucccggacaucuucaacgccagcuucgucgaggacuggaugggcaaggccuccacccccaccaagcaguacuucaacaagaagggcgugcagcucgccgagaacaaggggaagcgggaggagcgccggcugcaggaguacaaguggcgcgcggaggccgugaacuucaagaucgaccugagcgagaucgcccucauccugucccagaucaacagccagaucagcaacuccagcggcuaccugggggccaucuccgaccggagcaaggagcucuacuucaagaaccugacggucggccaguaccuguaccagcagaucaagaagaacccccacacccgccucaagggccagguguucuaccggcaggacuaccuggacgaguucgagcgcaucugguccgugcagagcuccuucuacccccagcugaacgacgcccucaagcgggagguccgcgacaucaccaucuucuuccagcgccggcucaagagccagaagcaccugaucuccaacugcgaguucgaggaccaccacaagguggugcccaagagccaccccgucuuccaggaguuccgcaucuggcagaaccugaacaaccugcugcucaucaagaaggacaaccugaacgagaaguucgaccuggagcucgaguccaagaucgcgcuggccaacgagcuggccuucaagcgggagcucaacgugaaggacgcccugaagauccuggggcucaagcccaacgagugggaguucaacuucaccaagaucgagggcaaccgcacgaaccaggccuucuucgacgcguucgccaagaucaucgagcuggaggacggggagcccaucgaccugggcgaccucaaggccgacgacauccuggaccaguucagcgaggccuuccugcggaucgggaucgacaccgagcugcuccaggugaacuccgacaucgagggcgccgaguacgagaagcagagcuacauccaguucuggcaccuccuguacuccagcgaggacgaccagaagcugaagcugaaccugauccgcaaguucggcuucaagccggagcacgcgaagauccucgccuccaucagccugcaggacgaccacgccucccugagcagccgggccaucaagaagauccucccccaccuccaguccgggcugaucuacgacaaggcgugcaccuacgccggcuacaaccacagcuccagcuucaccaaggacgagaacgagaagcgcgagcugcgggccgagcuggagcugcucaagaagaacucccugcgcaaccccgucguggagaagauccugaaccagaugaucaacguggucaacgccauccucaaggaccccgagcuggggcggccggacgagauccgcguggagauggcccgggagcugaaggcgaacgccgagcagcgcaagaacaugacgagcaacaucgccuccgccacccgggaccacgacaaguaccgcgagauccucaagagcgaguucggccugaagcgggucaccaagaacgaccugcuccgcuacaagcuguggcuggagaccgacgggaucucccucuacacgggcaagcccaucgaggccagcaagcuguucuccaaggaguacgacaucgagcacaucauccccaaggcgcggcuguucgacgacagcuucuccaacaagaccaucugcgagcgccagcucaacaucgacaaggccaacgugaccgccuucagcuuccugcagaacaagcuguccgccgacgaguucgagcaguaccagagccgcgugaagucccucuacggcaagcugagcaaggccaagauccagaagcugcucauggcgaacgacaagauccccgaggacuucaucgcccggcagcugcaggagacccgcuacaucagcaagaaggccaaggagauccuguucgagaucucccggcgcgucagcgugacgaccgggaccaucaccgacaagcuccgggaggacuggggccugguggagaucaugaaggagcugaacugggagaaguacgacaagcucgggcugacguacaccaucgagggcaagcacggggagcgccugaacaagaucaaggacugguccaagcggaacgaccaccgccaccacgccauggacgcgcucaccgucgcccugaccaagccggccuacauccaguaccugaacaaccucaacgccaagggccugaacaacaagaagggcacggagguguucgccaucgagcagaaguaccugaagcgggagaacgggaagcucugcuucaucccgcccaucgagaacauccgcagcgaggcgaagaagcaccugucccggauccuggugagcuacaaggccaagaacaaggucgugaccaucaacaagaacaagaccaaguccaaggccggccucaacgagcagaucgcccugacgccccgcgggcagcugcacaaggagaccguguacggcaagagcuuccacuacuccaccaaguucgagaagaucggcgccagcuucaacguccagaagaucaacaccguggcgaagaaggaggagcgggaggcccuccugaagcgccuggccgagaacgggaacgacccgaagaaggccuucaccggcaagaacacccucaacaagaugcccaucuaccuggaccuggggaagaacaucaagcucuccgagaaggugaagacggucgugcuggagcagaacuacaccauccggaagaacaucgaccccgaccugaagguggacaaggucaucgacgugggcaucaagcgcauccucgagagccggcuggaggaguucgggggcaacgccaagcuggcguucuccaaccucgaggagaaccccaucuggcugaacaaggagaagggcaucagcaucaagcgcgugaagaucuccggggucagcaacguggagucccugcacgugaagaaggaccacuucggcgagccgauccucgaccaggaggggaacgagauccccgucgacuucgugagcaccggcaacaaccaccacguggccaucuacgaggacgagaacgggaaccugcaggaggaggucguguccuucuucgaggccgugguccggcagaaccagggccugcccaucaucaagaagaaccacacccucggcuggaaguuccuguucacgcugaagcagaacgaguacuucguguucccgagcgacgacuucgugcccgccgacgucgaccucauggacgagcagaacuaccaccugaucagccccaaccuguuccgcgugcagaagaucgcgcggaagaacuacguguucaacaaccaccucgagaccaaggccgucgacaacgaccugcugaaguccaagaaggagcucagcaagaucaccuaccacuucuaccagacccccgagcaccuccgcgggaucaucaagauccgcaucaaccaccugggcaagaucauccagaucggggaguacuga

SEQ ID NO: 1876 - RNA, 4059 nt, Artificial Sequence
  Cas9 variant
augaacaagaaguacuaccugggccucgacaucgggaccaacagcgugggcugggccgucaccgacgagaacuacaaccuguacaaguacgccgggaagcgcauguggggcauccggcuguucgaggcggccgacacggccgccgagcgccggaugaagcgcuccaaccggcgccggcucagccgcaagaagcagcggaucgaccugcugcaggagcuguucuccgaggagaucgugaagaaggaccugaccuucuucauccgccugaacgagagccggcuccacuucgaggacaaguccaccggggagaaguacccccuguucguggacaaggaguacaccgacaucgacuaccacaagcaguacccgacgauguaccaccuccgcaaggagcucaucgagaaccccgagccccacgacauccggcuggucuaccuggccugccaccacauccucaagaaccgcggccacuuccugaucaacggcagcaucuccgacgugaagaaccugagcuucgugugcggggagaugaucaaggaguucaacuccgucagcgaguacgagaucucccucaccgacauccgggagcuggagcgcauccugagcgacaagaagaccgcgaaguccgugaaggccaagcaggucgcccagcuguucgagugcacccccgccgaggacaaggagcagcagaagugcgcgaaggccaucaucacgaaccucagcaagcugaucgugggccucaaggggaacaucuccaagauguuccaccagccgcuggaggagaucagcaccaaguccuucaaguucaccgaggccaaguacgaggacgagaucaugcccgccaucgaggagaacuaccccgacuacgccagcgugaucgaccggaucaagggcguguacgacugguccguccugguggagauccucgacggggaggacuaccugagcuucgcgaaggugaaggccuacgagaagcacggcaagaaccugcacauccucaagaacgucaugaagaaguacugcaaggacgagguguaccaggccuucuucaacggcaucaacgagaagaacggguacggcaacuacaucggggccauccgcaagaacggccacaccuacaagauggaccggugcaagagcgaggaggacuucuacaagggccugcagaagauccuguccacgaucgugcccgaccaggaggacgaggagcuccuggagaagcugaaggccgaggucgagaaccagacccuccugccgcuggcgcgcagcaaggagaacgggaccauccccaaccaggugcaccuccaggagcugaugaagauccuggacaacgccaaggaguaccucgacuuccugaagaaggaggacgaguacggcaccaucgccgagaagaucaucuccaucgccaaguuccggauccccuacuacguggggccccugagccgccgccacaaggaggagggcuccaacagcuggaugauccggaaggaggaggggcgcaucuacccguggaacuucggcgacaaggucgacguggagcaguccaacaaggaguucaucgagcggaugacgaacaagugcaccuaccucaucggcgaggacgugcugcccaagaacagccugcucuacuccaaguacaugguccugaacgagcugaacaaccugaagauccgcgggaacaagaucagcguggagcucaagcagcggaucuacaaggaccuguucugcaccauggccaaggucaccggcaagcgcauccuggaguaccucaagauggaggaccccgagaucgugcaggaggacaucuccggguucgacaucgacuucaagagcgcgcuggccuccuaccuggacuucaagaagcaggucgugggcaacgagaucgagaaggaccacuacaaggagaucaucgaggagaucaucaaguggaagacgaucuacgacgacgacagcaagaugaugcggcgcaugaucgagcgggaguaccccgagguguucgacaaggagcagaucaagaagaucugccagcucaaguacuccggguggggcaacuucagcgaccgcuuccugaacggcgugcgcggggccgacaaggagaccgaggaguccuacaccaucaucgaggcccuguggaagaccaacuacaaccucaugcagcugcugagcaagcaguucuccuucaaggaggagaucgaccagaucaacgccgagaaggcgggcgacgucgggaagaucaacuacgagaacacggugaaggaccucaucgugagcccgagcaacaagcgggccaucuggcagaccauccagaucgccgaggagaucaagaaggucaugaagugcgagcccgagcggaucuucaucgagauggcccgcggcggggagaaggagaagaagcggaccgugucccgcaagacccggcugcaggagcuguacgcgggcugcaaggacgacacgcgcaacuggaugaaggagaucggcgaccgggaggagcgcgaguucaacagccgcaagcucuaccuguacuacacccagauggggaagugcauguacaccggcgacgagaucgacguggacgcccugaugaaggggaacuccaacugggacaucgaccacaucuacccccagagccggaucaaggacgacucccucgacaacaugguccuggugcgcaaggacgugaacaacaagaagcggaacaagauccugagccccaagauccgcgaggacaugaagggcuacuggaccaugcucugccagaagggccugaucuccaagcggaaguacgaccgccugacgcggaccaccgacuucaccgacgaggagcucagcggguucaucgagcgccagcuggucgagacgcggcaguccagcaaggccguggccgagcugcucaaccgccuguacaaggacuccgagguggucuacgugaaggccggccuggugagcgacuuccggcacgacaacgaccuccugaagucccgccgggucaacgacuaccaccacgcgaaggacgccuuccugaacaucgugguggggaacgucuaccacgugcgcuucaccagcaacccgcggaaguggaucaaggacaaccgcgacuccaacuacagcauccggcgcguguucaacuacgacgucaagcagggcgacaagaucguguggcacggguccgagaacggcggccacagcaucgaccagaucaagaagaucaugagccggaacgacauccucuacaccgaguacaccuacugcgagaaggggcagcuguucaacgagacccuggccaagaagggcaacgagaaggccaucgcccucaagaagaaccuggaccccgugaaguacgggggcuacacgacccccaagaccuccgcguucgccuucgucgaguucgacgggaagaagaaggagcgcaagaaccacaucguggagauccccguguacgucgugaacaucgccaagcgggagccggacgccgugaagaaguaccuggaggagcgcaagggcuacagcaacgucgugaucaagaaguaccccaucaagaagaacucccucaucaagauggacggcuaccuggcccgccugcgcggggcgaacgagaaggacaucauccucaagaacgccgugcagcugauccugaacaaggaccucuacgagaucguccggaagaucgagaaguaccuggaguacaaccugcaguaccaggccgacgccaaguucgagggcuucaccaugaaggaccucaacaugaucuacgaggagcuguaccugaagcucaaggagagcaucuuccagaagcggcccgcgcagcagaugaagacgcuggagaaggggaaggaggccuucaucuccaucgagaaccugggcgagaaggccaaggugaucaacgagaucaucgccauguuccgcugcgacgccaccaccguggcgaaccucaaggucaucaacgggagccagaacgccggcuccaugaaggugaacaagaacacccugacgagcaagucccugaagcucgugcaccagagcaucaccggccuguucgagaccgaggaggagcuggucuga

SEQ ID NO: 1877 - RNA, 4062 nt, Artificial Sequence
  Cas9 variant
augaagaagaaguacuaccugggccucgacaucgggaccaacagcgugggcugggccgucaccgacgagaacuacaaccugugcaaguucaacgggaagaagauguggggcauccgccuguucgaggacgccaagacggcggccgagcggcgcaccaagcgguccaaccgccggcgcaucgcccggaccaagcagcgcaucgaccuccugcaggagcugugcgagaaguccaucuucgagaaggaccccaccuucuucauccggcucaacgagagcagccugcaccuggaggacaaguccacgggggagaaguacccgcuguucguggacaaggaguacaccgacaucgacuaccaccgcgaguaccccaccguguaccaccuccggaaggagcugaucgagaaccccgagccccacgacccgcgccucgucuaccuggccugcugccacaucaucaagagccggggccacuuccuggugaacggcuccaucagcgacgccaaggaccucuccuucaucugcgagaacaugaucaacagcuucaacgcggccuccgacuacaagaucaacauccaggacaugaccgcccuggagacgauccugaccgaccgcaagauggccaagagcgugaaggcgaagcagaucguccagcuguucaagugcauccccugcgaggacaaggagcagcagaagugcugcaaggccaucaucaccaaccuguccaagcugaucguggggcucaagggcgacaucagcaagaucuucaacgaguccuucgaggagaucaagagcuucaaguucgccgagaccaaguacgaggacgagauccugcccacgauggaggagaucuaccccgaccacgccgagaucaucgagaagaucaaguccaucuacgacuggagcauccuggacgagauccucgacggggaggaguaccuguccuucgccaaggugaaggcguacgagaagcacaagaagaaccugcacgaccucaagauccugaucaagaaguacugcgacgacgagaccuaccagagcuucuucaacggcaugaacgagaagaacaaguacagcaacuacaucggguccauccggaagaacggccacaccuacaaggucgagaagugcaagagcuccgaggacuucuacaaggagcugcucaagcugcugagcuccgugaacccgggccaggaggacgagagccuccuggagcagaucaaguucgagaccgagaaccagacgcugcucccccugcugcgcaccaaggagaacgggaccauccccaaccaggugcacaugcaggagcucaucaagauccuggacaacgccuccaaguaccuggacuuccucaacgagaaggacgaguacggcaccacggccgacaagaucaucagcaucgccaaguucaagauccccuacuacgucgggccgcuguccgaccggcacaaggagaacggcagcaacuccuggauggugcgcaaggagaacggccggaucuaccccuggaacuucgacgacaagguggacgccgagaaguccaacaaggaguucauccagcgcaugaccaacaagugcaccuaccugaucggggaggacguccuccccaagaacagccugcuguacagccgguacauggugcucaacgagcugaacaaccugaagauccgcggcaacaagaucuccguggagcugaagcagcagaucuacaacgaccucuucugcaccaaggcgcgcgucacggggaagaacauccugaacuaccugaagaaggaggaccccgagcucgccgccgaggaccugagcggcuucgacguggacuucaaguccgcccugaccagcuaccucgacuucaagaagcaggucguggggaacgagaucgagaaggacuacuacaaggagaucaucgaggagaucaucaaguggaagaccaucuacaacgaggacuccaagaugaugaagcggaugaucggccgcgaguacccggagacccugaaccaggaccagaucaagaagaucugccaccugaaguacaacggcugggggaacuucagcgagacguuccucaacggcaucaagggggccaacaaggagaccggcgagugcuacaccaucaucgaggcgcuguggaagaccaacuacaaccugaugcagcuccugagcaagcaguucuccuucaaggaggagaucgaccagaucaacgccgagaagacgggggccaucggcaagaucaccuacgagaaccuggugaaggaccucguggucagccccgccaacaagcgggccaucuggcagaccauccagaucaccgaggagaucaagaaggugaugaagugcgagcccgagcgcaucuucaucgagauggcgcggggcggggagaaggagaagaagcgcacggucucccggaagacccgccugcaggagcuguacaccggcugcaaggacgacacccgggacuggaugaaggagaucggggaccgcgaggagcgggaguucagcucccgcaagcucuaccuguacuacacccagaugggcaagugcauguacacgggggaggagaucgacguggaccugcucaugaccgccaacagcaagugggacaucgaccacaucuacccccagucccggaucaaggacgacagcuucgacaacauggugcugguccgcaaggacaucaacaacaacgugaagggcaacaacaucgugccguccagcauccagaaggagaugaccuccuacuggaagaugcugcuccagaaggagcugaucagcaagaagaaguacgagcggcugacccgcuccacggacuucaccgacgaggagcucagcggcuucaucgagcggcagcuggucgagacccgccaguccagcaaggccguggccgcgcugcucaaccggcuguacaagaacuccgagaucguguacgucaaggccgggcuggugagcgacuuccgccacgacaacaagcuccucaagagccgccggaucaacgacuaccaccacgccaaggacgccuuccugaacaucguggucggcaacugcuaccgcaccaaguucacggccaacccccggcaguggaucaagaagaaccgcgacaccaacuacuccauccggcgcguguucgacuucgacaucaagcagggggacaagaucgugugguacggcaacaagaacgagaacggcaagcacaccaucgaccagaucaagaaggcgaugagccggaacgacauccucuacaccgaguacacguacugcgagaaggggaagcuguucgacgagacccugaccaagaagggcaacaagaaggccaucccccucaagaagaaccuggacccccugaaguacgggggcuacaccuccgucaagacgagcgccuucgccuucaucgaguucgacgacaagaagaaggagcgcaagaaccacaucguggagaucccgaucuacguggccaacaucgcgaagcgggagcccgaggccgucaucaaguaccucgaggagcagaagggguacgugaacaucguggucaagaaguaccccaucaagaagaacucccugcugaagaucgacggcuaccucgcccgccugcggggcggggacagcuccaucaucacccugaagaacgccgugcagcucgugcuggacaagaaguccuacgagaucauccgcaaggucgagaaguaccuggaccacaacagcaaguacgaggccaacagcaagcucgagaaguucaacgagaacgaccugaacaucaucuacaacgagcugugccucaagcugcggaacuccaucuaccagaagcgccccgugcaccagcuggagacccucgagcagggcaucgacaacuuccggagccuggagucccugaaggacaaggcgaagaucaucaacgagcuccuggccauguuccgcugcgacgccaagaccgggauggaccugcggcucaucggcggggccagcaacuccggccgcaugcggaucagcaagucccgccugacgagcaagucccugaagcucaucaaccagagcgugaccggccuguucgagaccgaggaggagcuggucuga

SEQ ID NO: 1878 - RNA, 4062 nt, Artificial Sequence
  Cas9 variant
auggagaagaacuacuaccugggccucgacauggggaccagcuccgugggcugggccgucaccgacgagaacuacaaccugaugcgcaagaaggggaaggaccuguggggcgugcgccucuucaaggaggccaagacgagcgcggagcggcgggugaagcgcaccucccggcgccggcugcagcgcgagaaggcccggaucggguaccugaaggagcuguucgccgacgagaucaacaaggucgacgccggcuucuaccagcgcauggaggacagcaaguucaucuccgacgacaagaccgugcaccagaaguucacccuguucagcgacacgaacuacaccgacgaggacuacuacaacgacuaccccaccaucuuccaccuccggaagaagcucaucgaguccgacgacgaguacgacgugcgcauggucuuccuggcccugcucaacauguacaagcaccggggccacuuccugaacgcgaaccugagcgacaacgggaugggcgacaucaacgagcaguacgaccgccucaaggagcugugcuccgaguaccugaacguggagugggagaacaagccggacaaguucgaggagauccucaaggagugcaacugcagcaacucccugcggaacgagcgccugcucgagaccuucaaccugaagaagacggacaaggagaagugcgagaugcugaagcucaucugcgggcugagcggcacccuguccaagaucuucaaggaccucgacgacgacagcgagaccaagaagaugaccaucuccuuccggagcuccaacuacgacgaggaggccaucaacguggaggagaucaucgggagcgagaacuucgagaucaucgccguccugaaggagauccacgacugguccaugcuggccaacaucaugcgcggcaagaaguaccucagcguggcgcggguggaggaguacgagaagcacaaggacgaccugaagauccugaagaaggucaucaaggaguacagcaucgaggaguacaacaacuucuuccgcgugauggccgacaacaacuacuccgccuacgugaacagcgucaacuccaacaaggagagcacgcggcgcggcgccaagugcgacaacgacaccuucuucaaggagaucaagaagaucgugaacaagugcuacgacuccgaggagaaggaguacauccucaaggagaucgagaaggggaccuuccugcccaagcagaucaucagcuccaacggcgugauccccaaccagguccacaagaucgagaugaagaagauccugcagaacgccgagaaguaccuccccuuccugaccgagaaggacgacagcgggcuguccgugagcgagcgcauccuccagauguucuccuuccagaucccguacuacaucggccccaucagcggcaagaucggguccgacgagaaguccaagaacagcuggagcgugcggaaggagaagggccgcaucuaccccuggaacuucaaggacaagaucgacgagaaggaguccgcggagaaguucaucgagcggauggucaaccacugcacguaccugaacaacgagauggugcugcccaagaacagccuccuguacgagaaguucauggugcugaacgagcucaacaaccugaagaucaacaacgagaacaucuccgucgagcugaagcagagccucuacaacaaccuguucaagaccgggaagaaggugaccgccaagggcaucaagagcuaccuggagcgcaacgggcugugcgagccgaacgaggacaucaaccucaccggcaucgacggcgacuucacgaaccggcuguccaacuacgccaaguucaaggggaucuucaacaccgacgagcugaccuacgagcaguggaacauggccgagaagaucaucaaguggagcaccaucuacggcgacuccaagaaguuccucgaggagaagauccgcaacgaguacagcgagaagcuggacucccagcagaucaagcggauccuggggaucaaguuccgcgacuggggccggcucagcgaggagcugcugaacauggagggggccgacgucaacacgggcgagaucaaguccgugaucggccgcaugugggacgagaacuacaaccucauggagcugaucgcgaccgacaacuucaccuacaagcaggucaucaaggagaagcagaacgggcuggacaagagccucuccgagaucgacuacgacgaccuggacgagcuguacgugagcgcccccgugaagcggaugaucuggcagacccuccugaucaucaaggagcugguguccgucaucggcuacgagcccacgcgcguguucguggagauggccaaggacgucaacaccgagaagaagcggaccgacagccgcaagaagaaguuccucgaccuguacaagcagugcgagaaggacgagcgggacuucuggaucaaggagaucgacgacaaguccgaggccgaguuccgcaagaagaagcuguaccucuacuacacccagaaggggcggugcauguacacgggcgagcagaucaacccccuggaccugaccaacgacaaccucuacgacaucgaccacaucuacccgcgccacuucgugaaggacgacagcaucgagaacaaccuggugcuggucaagaaggagaagaacgcccacaaguccgacaccuuccccaucgaggacgacauccggaagaaccaguacgcguucuggaagaugcucuacgagaagaacuucaucaccaaggugaaguaccagcgccugacgcgcaaggagcccuucagcgacgaggagaaggccaacuucaucaugcggcagaucguggagacccgccaggggaccaaggucaucaccgacauccuggagaaguccuucgacaagacccagaucguguacgugaaggccggcaacgucagccucuuccggcagaaguacgagugcaucaagugccgcgagaucaacgacuuccaccacgccaacgacgccuaccugaacaucguggugggcaacgucuacgacacgaaguucaccagcgacccccggaacuucaucaaggaguaccgcaagaacccgcagaagaacgaguaccacauguacaagcuguucgacuacaacgugcagcgcggggaccggguggcguggaccgccuccaacggcgagagcaugaaggucgugaaggggacccucaagaagaacacgccccuggugaccuucauguccuacgaggagcacggcggccuguacgaccagaacaucaucagcgccaaggacaucgagaaggucaaggggaagggcuaccuccccaucaaguccagcgacucccggcugaacaacaccgagaaguacgggggcuacgccaaggugagcggggcguacuucuucguggucgagcacaccgugaagaacgugcgcauccggacgaucgagcccaugccgugcuaccugaccaagguccucaccaccaaggagaagaucgaggacuacugcugcaacauccugaaguacgacucccccguggugaaguacgagaagaucaagauguacagccugaucaaggucaacggcuaccccauguaccucacgggccgcaccgggaaccagcugaucguguccaacggcauccagcuggugcucagcuacgacgaggccaaguacaucaaggaccugcugaagaucaaccaggaggaguucgaccagaaccggcucgagaaccuggggaucaacaaguuccgcaacgagaagcuguacgacacccucaacaagaaguacaccaacgagaucuacaagaagcggcccaacuccaugggcaacaagaugaucgaguggaagaacacguuccagaaccugagcaucaaggaccagaccgagguccugcuccagcugauccagcuggggcagaagcagaacuccggcgugaaccucgagaagcugggcgccagcaagaagaccggggugucccuggucagcaagaagaucaccgacaaggaguccuucgagcucaucaacaagagcaucacgggccuguacgagaacaagguggaccugcuccgcguguga

SEQ ID NO: 1879 - RNA, 4062 nt, Artificial Sequence
  Cas9 variant
auggccgccuucaaguacuaccugggccucgacauggggaccaacagcgugggcugggcggucaccgaccccaacuacaaccugcugaaggccaaggggaaggaccucuggggcauccgcgaguucaacgaggccuccacggccguggagcggcgcacccaccggaucagccgccggcgccggcagcgcgagcagguccggaucgggcugcugaaggacuacuuccacgacgccaucggcgagguggacccggacuucuuccagcgccucgcgaacuccaaguaccaccuggaggacaaggacaccgaggugcgguacaagaacaacguguucaacgacgacgacuacaccgacaaggacuacuucgaccaguaccccacgaucuaccaccuccgcaaggagcugaucgagagcaccgacaagcacgacguccggcugguguuccuggcccuccugaacauguucaagcaccgcggccacuuccugaacuccgggcucggcgagaacagcggggagaacaacaucaacaacgccuaccuggagcugaccaaccuccuguccgaguucacccaguacaaccugaacgagacgaucgacggcaagaagaucgaggacauccucagccggcgcgacaugucccggacccgcaaggccgaggggcuggcggagauccugggcguggacuacaagaacaagcccuacaaggagcucauccggggccugugcgggcugaaguucaacgccugcgccaucuuccccgagauccagagcgacgaggucccgaagcucgacaucugccuguccgaggccagcuucgacgagaaguccgacgagaucgccaacauccugggcgaggacuacuucgagaucaucauggcgaugaaggacaucuacgacaucgggagccucgccggcaucaugaagggccacaacuaccugucccaggcccgcgugaccagcuacgagaagcacaaggaggaccugcggcuccugaagaacgugauccgcaaguacugcuccaaggaggacuacgacaacuucuucaacagcgaggccgacggguccuacgccagcuacgucggcagcuacaacuccaagaccaagcagcgccggguggggaacaagcgcagcuccgaggagcuguacaaggcgaucaagaagauccucaagaacgugcccgccgaggacgccgacguccagcggauccugaugagcaucgagaacgagacguuccugcccaagcagcucaccgccuccaacggcgugauccccaaccaggugcacgccaaggagaucaagaagauccugagcaacgcggagcgcuaccugccguuccuccgggagaaggacgagaccgggcuguccgucagcgagaagaucaugaagcuguucuccuuccagauccccuacuacgugggccccaccacggagaaguccagcaaggacggcgggaacggcugggugguccgcaaggaggagggccaggugcuccccuggaacaucgacgagaagaucgacaugaaggccaccagcgaggccuucaucucccggauggugcgccggugcaccuacaucagcggggagccgguccugcccaaguccagccuggaguaccaguccuucugcgugcucaacgagaucaacaacaucaagaucgacggggagcgcaucagcgucgagcugaagcaggacaucuacaaggagguguuccagaagggcaagcgggugaccaagaagcagcugugcaaguaccugcacacgcgcggcaucaucgaggccgaggagcaggucaccgggaucgacgugaccaucaacaacgcccucaccacguacggcaaguucaaggcgauccugggggacgacaucuccaaggacagcgugcagaagauggucgagaacaucguguucuggugcaccguguacggcgacagcaagaaguuccugaaggaccggaucgaggagaaguacggggagaagcucaccaaggagcagaucaagcgcaucgucggcuucaaguucaaggacuggggcaaccuguccaagaacuuccuggagcucagcggggccgacguguccaccggcgagagcguguccaucauccgggcccuguggaacaacaaccugaaccucauggagcugaucaacagccgccuguacaacuacaaggagcggcucgccgaguaccagaacacgaugaugaagacccuguccgacaucgaggcggaggaccuggacgaguacuacuucagcgcccccgucaagcgcaugaucuggcagaccauccucaucaucaaggagcuggugaaggugcuggggugcgagcccgaccggaucuucgucgagaugacccgccgcccggacgagcggaagaugcgcacggagucccggcgcaagaaguucgaggagcucuacaagaaggugaaggacgaggacguggacuggaugaaggucaucgcccacgccgacgagaccggcagcauccgguccaagaagauguaccuguaccugacccagaagggccgcugcauguacaccgggaagcacaucgagcucagcgaccuguucaacaacaaccuguacgacaucgaccacguguacccccggcacuucgugaaggacgacaacaucgacaacaaccucguccuggugugcaaggagaagaacgcccacaaguccgacaucuacccccuggaggacgagauccucgcgagccagaagaacaugugguccgagcugcgccggagcggcuucaucacggaggagaaguacaaccgccugaucgggcggaacuccuucaccgacgagcagaaggccggcuucaucgcccgccagcucguggagaccagccaggggaccaagggcgucgccaacauccugcagcagcugcuccccgagagcaagaucguguacgccaaggcguccaacgugagcgaguuccggaacacccgcgacaucccgaagucccggcugaucaacgaguuccaccacgcccacgacgccuaccugaacaucgucgugggcaacguguacuacgucaaguucacgcagaacccccucaacuucaucaagaacgacuacgaccgcgacaagaccaagaacaacuacaaccugagcaagauguucgacugggacguggagcggaacggggagguggccuggaucgcccagaagaaggacggcgaggcggggaccaucgccaccgucaagaaggugcugggccgcaacacgccccucaugacccgguacuccuucgaggggaagggcggccugaccaacgagacccuguacagcgccaagaaggccaaggaggagggguacauccccuucaaguccagcgacgagaagaugaaggacgugacgaaguacggcggguucaccuccgucaccggcgcguacuucuuccucguggagcacaccgagaagaagaagcgcagccggaugaucgaguccgugccgcuguaccuggcccagaagaucgagcagaacccccacgagcucgagaaguacugcgagcagguccuggggcugaucgacuucgacauccgcgugcgcaagaucaagaucggcagccucaucaagcggaagggcuacuucuucuacaucacggggaagaccggccaccgccugauccugcggaacgccgugaacaugugccucaagaaggagugggucaaguacaucuccaagcuggagaaggccguggacaagaacaacguggaggggaucaucaccaaggagaagaacgagcugcucuacagcgagcugaucgagaaguucaagaacuccaucuucagcaaccgccccaaccccgucggcgacaagcuggacgaggccaaggagaaguucaucaaccucgacaucgagaagcagugcaucgugcugugccagauccugcagcucuccagcgugcugggguccgagugcgacaugacccugcucggcgagagcgcgcacugcggcaagauccugaucagcaagaagaucggggacgaggacaucuaccugaucaaccaguccgucacgggccucuacgagaagaagaucaaccugcggaccguguga

SEQ ID NO: 1880 - RNA, 4065 nt, Artificial Sequence
  Cas9 variant
augaagaagauccugggccucgaccuggggaccaacagcaucggcugggccuucaucaacgaggccgagaacgagaucgagguguccagcaucgucaacaccggggugcgcaucgugccccugacgaccgacgaggaguccgacuucaagaagggcaacaccaucagcaucaacgcggaccggacccucaagcgcggggcccggcgcggccugcagcgguucaagcagcgccgggaggcccugcucgagacguucaaccgcaucaaguucaucgccaccgacuucgucuacgccgagaccggcgcggccaccacguucuccagcuaccagcugcgggccaaguccgccguggaggcggugaccaaggaggagcuggucaaggugcuccugaugcugaacaagaagcgcggguacaagagcucccggaaggccaagaccgccgaggagggcgacgccaucgacgggaugaagaucgccaaggagaucuucgagaacaaccucaccccgggccaguggguguacaacagccuguccaagggcgggaaguucauccccgacuucuaccacagcgaccugcagaaggagcucgagaagaucguccgcuuccagaaccaguuccacuccgagcagaucaacgacaagcugcuggcggacauccagggcaagagccggacgcagaccucccagcacuucagcaagacccucaacaucccccuggccgagaacaaggggacccgcgaggagacgaagcugcagcacuaccaguggcggaacgaggcccucgccaacgagcuggacaugaagauccuggccuucaucaucaccgagaucaacaaccagaucaaccaguccagcggcuaccucggggcgaucuccgaccgcagcaaggagcuguacuucaaccaggagaccgugggccaguaccaguacaagcagcugcaggagaacgugcacgccaagcucaagaaccaggucuucuaccggcaggacuaccuggacgaguucgagaagaucugggagacccaggccaaguuccacagcgagcugaacgagaagcucaaggccgagauccgcgacaucacgaucuucuaccagcggaagcugaagucccagaagcaccuggugagcuucugcgaguucgagaagggccacaaggccauccccaaguccagcccgcuguuccaggaguuccgcaucuggcagaaccugaacaacguggucgugaagaacgagaccaccaaggagguguucgagcuguccgaggagcucaagcagcugaucgcggaggagcugcaguucaaggagagcaugaccgacguccagaugcucacguucugcgagcugaagaaggggacccacaccgugaacuucaagaagaucgagggcaaccggaccaacacguccaucuacaaggccuucgagaagauccuggagguggagggguacgagaucgacuucagcaagaugaagccccucgagaucaaggagaccgucgcccccaucuucgagacccugaacaucaacaccgugauccuggacuucgaccccacgauccagggcaacgacuucgacaagcagccguacuaccagcucuggcaccuccuguacuccgccgaggacgacgacaagcucaaggagacccugaagaccaaguucggguucaaggagaaccaccuccccuucauccugaacaucaaccugcaggccgacuacggcagccuguccgcgaaggccaucaagaagauccugccccaccucauggacggccacaucuacgacaaggccugccugauggugggguacaaccacagcuccagccugaccacggcccagaacaacgaccgcguccucaaggacacccuggagcugcucaagaagaacucccugcgcaaccccguggucgagaagauccugaaccagaugaucaacgugaucaacgcgaucaugaaggacccggccaugggcaagcccgacgagauccggguggagcucgcccgcgagcugaaggccaacaacgagcagcggaagaaggccaccagcgacaucaacaccgcgaccacggagcacgagcgcauccggaagcugcuccacuccgaguucaacaucccccgcgucacccggaacgacaucauccgcuacaagcuguggcuggagaccgggggcaucagccucuacaccgggaaccccaucaaggccuccgaccuguucagcaagaacuacgacaucgagcacaucauccccaagagccggcuguucgacgacuccuucagcaacaagacgcucugcgagcgccagcugaacaucgacaaguccaacaagaccgccuacagcuuccugcaggagaagcucuccgagaacgacuucgccgccuacgagaaccgggugaaggaccuguucaagaccggcaagaucaagagcuacaccaaguacaagaagcugcucauggcggacaacgagaucccggagggcuucaucgaccgccagcugcgggagacgcaguacaucgccaagaaggccaaggagauccugcucgaggugucccgcaacgucaccgccaccaucgggagcgugaccgacaagcugcggcaggacugggagcugguggacgucaugaaggagcucaacugggagaaguacgacaagcugggccugacgcacaucgaggaggggaagaacggcgagcgccucuccaagaucaaggacuggaccaagcggaacgaccaccgccaccacgccauggacgcgaucaccguggccuucaccaagcccgccuacauccaguaccugaacaaccugaacgccaagacgcagggggagaacaaggcgaacagcaucaucggcaucgagaacaagcaccucuaccgggacaagaacaacaagcugcgcuucaucucccccaugaagaacuuccgcgaggaggccaagaagcagcuggagagcauccucaucuccuacaaggccaagaacaagguggucaccaagaacaagaacaccaccaagaaguccggcgggacgaaccagaagauccagcugaccccgcggggccgccugcacaaggagaccguguacgggaagcuccagcaguacgccaccaaggaggagaaggugaacgccagcuucacggaggacuacauccagaaggucgcgaagaaggaguaccgggaggcccugcugaagcgccucgaggagaacgacaacgaccccaagaaggccuucaccggcaagaacgcccugaacaagacccccaucuacaucagccugaaggacaacaucaucgugcccgagaaggugaagaccgucuggcucgagacggacuacaccauccggaaggacaucaccccggaccugaagaucgacaaggugaucgacgugggcaucaagcgcauccugcagaaccggcucaacgaguucaacggggaccccaagaaggccuucgucaaccugggcgagucccccaucuggcugaacaaggagaaggggaucgcgaucaagcgcgugaccaucagcggcgugagcaacgcccaggcccuccacacgaagaaggaccaccuggggaacgagauccuggacaagaacggcaaccccaucccggucgacuucaucuccaccggcaacaaccaccacguggccaucuaccgggacgagaaggggaaccuccaggaggagguggucagcuucuacgacgccgugauccgccggaaccugggccuguccgugaucaacaagaaccacgagaaggggugggaguuccucuucagcaugaagcagaacgaguucuucaucuuccccuccgacggcuucaacccccacgagaucgaccugcugaacccgaacaacuaccaccucaucagccccaacaucuuccgcguccagaagaucuccaccaagaacuacauguucaaccaccaccuggagaccaaggcgguggacggggagaugcucaagagcaagaaggagcuguccaagacgagcuaccacuucauccagacccccaccaaccugaacggcaucaucaaggugcggaucaaccaccugggcaagaucguccaccucggggaguacuga

SEQ ID NO: 1881 - RNA, 4065 nt, Artificial Sequence
  Cas9 variant
augaagaagauccugggccucgaccuggggaccaacagcaucggcugggccuucaucaacgaggccgagaacgagaucgagguguccagcaucgucaacaccggggugcgcaucgugccccugacgaccgacgaggaguccgacuucaagaagggcaacaccaucagcaucaacgcggaccggacccucaagcgcggggcccggcgcggccugcagcgguucaagcagcgccgggaggcccugcucgagacguucaaccgcaucaaguucaucgccaccgacuucgucuacgccgagaccggcgcggccaccacguucuccagcuaccagcugcgggccaaguccgccguggaggcggugaccaaggaggagcuggucaaggugcuccugaugcugaacaagaagcgcggguacaagagcucccggaaggccaagaccgccgaggagggcgacgccaucgacgggaugaagaucgccaaggagaucuucgagaacaaccucaccccgggccaguggguguacaacagccuguccaagggcgggaaguucauccccgacuucuaccacagcgaccugcagaaggagcucgagaagaucguccgcuuccagaaccaguuccacuccgagcagaucaacgacaagcugcuggcggacauccagggcaagagccggacgcagaccucccagcacuucagcaagacccucaacaucccccuggccgagaacaaggggacccgcgaggagacgaagcugcagcacuaccaguggcggaacgaggcccucgccaacgagcuggacaugaagauccuggccuucaucaucaccgagaucaacaaccagaucaaccaguccagcggcuaccucggggcgaucuccgaccgcagcaaggagcuguacuucaaccaggagaccgugggccaguaccaguacaagcagcugcaggagaacgugcacgccaagcucaagaaccaggucuucuaccggcaggacuaccuggacgaguucgagaagaucugggagacccaggccaaguuccacagcgagcugaacgagaagcucaaggccgagauccgcgacaucacgaucuucuaccagcggaagcugaagucccagaagcaccuggugagcuucugcgaguucgagaagggccacaaggccauccccaaguccagcccgcuguuccaggaguuccgcaucuggcagaaccugaacaacguggucgugaagaacgagaccaccaaggagguguucgagcuguccgaggagcucaagcagcugaucgcggaggagcugcaguucaaggagagcaugaccgacguccagaugcucacguucugcgagcugaagaaggggacccacaccgugaacuucaagaagaucgagggcaaccggaccaacacgugcaucuacaaggccuucgagaagauccuggagguggagggguacgagauggacuucuccaagaugaagccccucgagaucaaggagaccgucgcccccaucuucgagacccugaacaucaacaccgugauccuggacuucgaccccagcauccagggcaacgacuucgacaagcagccguacuaccagcucuggcaccuccuguacuccgccgaggacgacgacaagcucaaggagacgcugaagaccaaguucggguucaaggagaaccaccuccccuuccugcucaacaucaaccugcaggccgacuacggcagccuguccgcgaaggccaucaagaagauccucccccaccugauggacggccacaucuacgacaaggccugccugauggugggguacaaccacagcuccagccucaccaccgcccagaacaacgaccgcguccugaaggacacgcuggagcuccugaagaagaacucccugcgcaaccccguggucgagaagauccucaaccagaugaucaacgugaucaacgcgaucaugaaggacccggccaugggcaagcccgacgagauccggguggagcuggcccgcgagcugaaggccaacaacgagcagcggaagaaggccaccagcgacaucaacaccgcgaccaccgagcacgagcgcauccggaagcuccugcacuccgaguucaacaucccccgcgucacgcggaacgacaucauccgcuacaagcuguggcucgagaccgggggcaucagccuguacaccgggaaccccaucaagggcuccgaccuguucagcaaggacuacgacaucgagcacaucauccccaagagccggcuguucgacgacuccuucagcaacaagacccugugcgagcgccagcugaacaucgacaaguccaacaagacggccuacagcuuccuccaggagaagcuguccgagaacgacuucgccgccuacgagaaccgggugaaggaccuguucaagaccggcaagaucaagagcuacaccaaguacaagaagcuccugauggccgacaacgagaucccggagggguucaucgaccgccagcugcgggagacccaguacaucgcgaagaaggccaaggagauccuccuggaggugucccgcaacgucacggccaccaucggcagcgugaccgacaagcugcgggaggacugggagcucguggacgucaugaaggagcugaacugggagaaguacgacaagcuggggcucacccacaucgaggagggcaagaacggggagcgccuguccaagaucaaggacuggacgaagcggaacgaccaccgccaccacgccauggacgccaucaccguggcguucaccaagcccgccuacauccaguaccugaacaaccucaacgccaagacccagggcgagaacaaggccaacagcaucaucggcaucgagaacaagcaccuguaccgggacaagaacaacaagcugcgcuucaucucccccaugaagaacuuccgcgaggaggcgaagaagcagcucgagagcauccugaucuccuacaaggccaagaacaagguggucacgaagaacaagaacaccaccaagaaguccgggggcaccaaccagaagauccagcugacgccgcgggggcgccuccacaaggagaccguguacggcaagcugcagcaguacgccaccaaggaggagaaggugaacgccagcuucaccgaggacuacauccagaaggucgccaagaaggaguaccgggaggcgcugcucaagcgccuggaggagaacgacaacgaccccaagaaggccuucacgggcaagaacgcccugaacaagacccccaucuacaucagccucaaggacaacaucaucgugcccgagaaggugaagaccgucuggcuggagaccgacuacacgauccggaaggacaucaccccggaccugaagaucgacaaggugaucgacguggggaucaagcgcauccuccagaaccggcugaacgaguucaacggcgaccccaagaaggccuucgucaaccugggggagucccccaucuggcucaacaaggagaagggcaucgccaucaagcgcgugaccaucagcggggugagcaacgcgcaggcccugcacaccaagaaggaccaccugggcaacgagauccucgacaagaacggcaaccccaucccggucgacuucaucuccacggggaacaaccaccacguggccaucuaccgggacgagaagggcaaccugcaggaggagguggucagcuucuacgacgccgugauccgccggaaccuggagcucuccgugaucaacaagaaccacgagaaggggugggaguuccuguucagcaugaagcagaacgaguucuucaucuuccccuccgacggcuucaacccccacgagaucgaccugcucaacccgaacaacuaccaccugaucagccccaacaucuuccgcguccagaagaucuccaccaagaacuacauguucaaccaccaccuggagaccaaggccguggacggggagaugcucaagagcaagaaggagcuguccaagaccagcuaccacuucauccagacgcccaccaaccugaacggcaucaucaaggugcggaucaaccaccucggcaagaucguccaccugggggaguacuga

SEQ ID NO: 1882 - RNA, 4065 nt, Artificial Sequence
  Cas9 variant
auggccgacuucgccaaguaccagcccggcaugguggcggacgggcgcaagaucccgcuggacuggacccucuacuaccugcggaagaaggcccugacccaggccauccgcaaggaggagcucgccuggauccugcugaacuucaaccagaagcggggcuacuaccagcuccgcggggaggaggaggaggagaacagcacgaagcacgaggaguacuacgagcugaaggucguguccguggaggccgcggaggagggcaagggcgggaacaccugguacaacgucacccuggagaacggcuggaucuaccggcgccagagcaagaucgagcucaacgacuggguggggaaggugcggcccuucaucgucaccacggaguacgagaucgacggcgugaccaucaagaaggacaagaacggggaggugaagcgcuccuuccgggcccccagcgagaacgacuggggccugcgcaagaagcggaccgagucccugcucgaggagagcgggaagaccgucggcgccuucaucuacaaccacauccuguccgagcccgccgacaagauccgcggcaacuucauccggacgaucgagcgcaaguucuacaagaaggagcuggaggcgauccuccgggagcagagcaagcaccagaaggagcugaaggacaucgacacccugaucgccugcaucaaggagcucuacccgaacaacaagccccaccaggacucccugaucaagaaggacaugaccuaccugcucaucaccgaccugaucuucuaccagcgcccccucaagagcaagaagucccucaucgccgacugccccuacgaguacuacgaguacgugaucaaggagacgggggagaacaagcggcagagcaucaagugcaucgccaaguccaacccguacuaccaggaguuccgccuguggcaguucaucaucaaccugcggcuguucgaccgcaacaacgacaaggaggugaccagcgaguaccuguccagcauggaggacuacacccggcuguucaccuaccucaacgaccgcaaggacaucaaccaggagacgcugcugaaggacuucuucaagcagaagaaggucaagcgcggcauggagaaggaguuccccauccgguggaacuacaucgaggacaaggagaagaaguaccccugcaacgagacccgccacgagcuccugaccgcccuggggaaggugggcaucgaccacuccuggcucgacgacaaggagcuguucuaccggcuguggcaccuccuguacagcguggaguccaaggaggaggcggagggcgcccugcgcaagcucgucgacaacgacgacuucgugaacgccuuccugaagaucaagcccuucaagaaggaguacggggccuacagcgagaaggccaucaagaagcugcucgcggugaugcggaugggcaaccuguggaacgaggucgacaucugcgagcagacccgcgaccggauccagaacaucaucaagggggacaucgacgagaagaucaaggaccgcaugggccggacguucagccagcuguccgacuuccaggggcucccggaguggcuggccugcuacgugguguacggccagcacagcgaggccaccgacauccagcgcuggaccaagcccgagaaccugauggccuacaucaacggcuucaagcagcacucccugcggaaccccaucgucgagcagugcauccucgagacccugcgcacggugcacgacaucuggaaggaggccgggcacaucgacgagauccacaucgagcugggccgggggaugaaguccaccgcggaccagcgcgcccggaugagcaagagcaucaugcagaacgagaacaccaaccuccgcaucaagucccugcugauggagcucaagaacgccaaggaguucgagaacgugcggcccuacagcccgaugcagcaggagauccugcgcaucuacgaggagggcgcccugcaggagcucaccaaggaggacgcccaguacaacgagaucuccaagaucagccagauggcgcagcccuccgccaacgagcugcugaaguaccggcucuggcuggagcagaaguacugcagccccuacacggggaagcccaucucccugagcaagcuguucaccuccgccuaccagaucgagcacaucaucccgcagagccgcuacuucgacgacuccuucaccaacaaggucaucugcgaggccgaggugaaccagcucaagagcaacaugcugggcuacgaguucaucaagaagcacggcggggagaucguccgcugcaccaugaucggcgacgugaagcuccuggacgcgaaggaguacuacaacuucgugacggagcacuacaccaacaaccggcgcaagaaggagaagcugcucauggaggacaucccccaggaguuccugaaccggcagaugaacgacucccgcuacaucagcaagaaggucauggccauccugagcaacaucgugcgggaggaggacgagcaggaggccaaguccaaguucgugaucgccugcagcgggggcaucaccgaccgccucaagcaggacugggggcugaacgacgucuggaacuccaucguguacccccgguucgagcgccugaacaagcucaccaacacggagaacuucggccggugggagaacaagaagggcaagcaggucuuccagaccagcgugccccuggagcugcagaaggacuucuccaagaagcgcaucgaccaccggcaccacgccauggacgcgcucgugaucgccugcgccagcaacaacaucaucaacuaccugaacaacgaguccgccaagagccaggagaagcgcgaggaccugcggaagaagcucugcgacaagaaccgcaucauccggaagccgugggagaccuucacccaggacgcccacaccgcgcuggagaacguggucguguccuucaagaacuacauccgcgugaucaacaaggccacgaacuacuacgagaaguacgacaagaacgggaagaaggagaucgccgagcagaagggccaggacaugugggccauccggaagcccaugcacaaggagaccgucuucggccaggugaaccugcgccggaagaucaccaucaagcucaaggacgcccuggagaagauccccgcgaucugcgacaaggagcugcgcgacuacaucaacauccucguggccaagcaguucaacaagaagcagauccuggcccacuucaagagcaucaacuaccggcugaacaugaaguccgucgacaagguggacguguggcaguucagcaacgagaaggagcccauggucgccacccgcaaguccguggacacgagcuucgacaccaagcgcaucgcgaccaucaccgacacggggauccagaagauccuccugaacuaccugaaggccaagaacaacgacccgaacaucgccuucacccccgagggcaucgccgagaugaacaagcacaucaccgaguacaacaacgggaagcagcaccagcccauccucaaggugcgggucuccgagccgaagggcgccaaguaccaggugggggagaccggcaacaagcgcagcaaguucguggaggcgcagaaggggacgaaccuguacuucgccaucuacgaggacaaggagggcaaccgguccuacaacaccaucccccugaacgaggucaucgagcgccucaagcagggccugagccccgugcccgacgccaacgagaaguccaucccgcugaaguuccaccucagccccaacgaccugguguacguccccaagaccgacgaggagaacgagaucaagauggggcagaucuacaaguucguggacagcuccggcaccacggccaacuucgugccccaccgggucagcaaccugaucuacaacguggacaagaagaucgccgagaacuucugcaaccacgagaucauccagaacgaguacgggaucggcuccccgcagagcaagaaccagaaguccaucaccggggagaugaucaaggcggugugcuggaagcucgaggucgaccgccugggcaacauccacaagaucaucaaguga

SEQ ID NO: 1883 - RNA, 4065 nt, Artificial Sequence
  Cas9 variant
augaagaagauccugggccucgaccuggggaccaccagcaucggcugggccuucaucaaggagcccgagaaggacguggucggguccgagaucguggacaugggcgugcgcaucgucccgcugagcuccgacgaggagaacgacuucgccaaggggaacacgaucagcaucaacgcggaccggacccucaagcgcggcgcccggcgcaaccugcagcgguucaagcagcgccggaacgcccugcucgagaccuucaaggagaagaaccugauccccuccaacuuccaguacgccgaggacggccccagcuccaccuucagcacgcugaagcuccgcgacaaggccgcgaaggagaagaucgagcuggacgacuucgugaaggugcugcuccagaucaacaagaagcggggguacaaguccagccgcaaggccauguccgaggaggacgagggcaccgccaucgacagcauggggaucgccaaggagcuguacgagaacgaccugacccccggccagugggucuacgaggcgcucaagaacgggcggaagaacgugccggacuucuaccgcuccgaccugcaggaggaguucaagaagaucgugaacuaccagagcgaguucuaccccgacauccugaacaccuccuucgucgaggacuggaugggcaaggccagcacgcccaccaagcaguacuucaacaagcggggcgugcagcucgccgagaacaaggggaagcgcgaggagcggcgccugcaggaguacaaguggcgggccgaggccgugaacuucaagaucgaccuguccgagaucgcgcucauccugagccagaucaacucccagaucagcaacagcuccggcuaccugggggccaucagcgaccgcuccaaggagcucuacuucaagaaccugaccgucggccaguaccuguaccagcaggucaagaagaacccccacacccggcucaagggccagguguucuaccgccaggacuaccuggacgaguucgagaagaucuggagcgugcaguccagcuucuacccgcagcugaacgacgagcucaagcaggaggugcgggacgugacgaucuucuuccagcgccgccugaagucccagaagcaccugaucagcaacugcgaguucgaggagcaccacaaggucgugcccaagucccaccccaucuuccaggaguuccggaucuggcagaaccucaacaaccugacccugaucaagaaggacaaccucaacgagaagugcgagcuggcccuggaggacaagaccgcccucgccaacgagcuggcguucaagaaggagcugagcgugaaggacgcccucaagguccuggggcugaagcccuccgacugggaguucaacuucaccaagaucgagggcaaccgcacgaaccacgccuucuucgaggccuucgccaagaucaucgagcucgaggacggggagccgaucgaccugggcaaccugaaggcggacgacauccucgaccaguucagcgaggccuuccugcggaucgggaucgacaccgagcugcuccaggugaacuccgacaucgagggcgccgaguacgagaagcagagcuacauccaguucuggcaccuccuguacuccagcgaggacgaccagaagcugaagcagaaccucauccgcaaguucggcuucaagcccgagcacgccaagauccuggccuccaucagccugcaggacgaccacgcgucccucagcagccgggccaucaagaagauccugccccaccuccaguccgggcugaucuacgacaaggccugcaccuacgccggcuacaaccacagcuccagcuucaccaaggacgagaacgagaagcgcgagcugcgggcggagcuggagcuccugaagaagaacucccugcgcaaccccguggucgagaagauccucaaccagaugaucaacguggucaacgccauccugaaggacccgaaccuggggcggcccgacgagauccgcguggagauggcccgggagcucaaggccaacgccgagcagcgcaagaacaugacgagcaacaucgcguccgccacccgggaccacgagaaguaccgcgagauccugaagaaggaguucggccugaagcgggugaccaagaacgaccuccugcgcuacaagcuguggcucgagaccgacgggaucagccuguacacgggcaagcccaucgaggccuccaagcuguucagcaaggaguacgacaucgagcacaucauccccaaggcccggcuguucgacgacuccuucagcaacaagaccaucugcgagcgccagcugaacaucgacaaggccaacgucaccgcguucuccuuccugcagaacaagcucagcgccgacgaguucgagcaguaccagucccgggucaagagccuguacggcaagcuguccaaggccaagauccagaagcuccugauggccaacgacaagaucccggaggacuucaucgcccgccagcugcaggagacccgcuacaucagcaagaaggcgaaggagauccucuucgagaucacgaugcgggugagcgugaccaccgggaccaucacggacaagcugcgcgaggacuggggccugguggagaucaugaaggagcucaacugggagaaguacgacaagcuggggcugaccuacaccaucgagggcaagcacggggagcggcucaacaagaucaaggacuggaacaagcgcaacgaccaccggcaccacgccauggacgcccugaccguggcccugacgaagcccgcguacauccaguaccucaacaaccugaacgccaaggccaucggcaacaagaagggcaccgagaucuucgccaucgagcagaaguaccugaagcgcgagaacgggaagcucugcuucaucccgcccaucgagaacauccgggccgaggcgaagaagcaccuguccaagauccuggucagcuacaaggccaagaacaagguggugaccaucaacaagaacaagaccaagaagaaggccggcuucaacgagcagaccgcccucacgccccgcgggcagcugcacaaggagaccgucuacggcaaguccuuccacuacagcaccaaguucgagaagaucggcgccuccuucgacgcgcagaagaucaacaccguggccaagaaggaggagcgggaggcccugcucaagcgccuggccgagaacgggaacgaccccaagaaggccuucacgggcaagaacagccugaacaagaugcccaucuaccucgaccuggggaagaacaucaagcuguccgagaaggugaagaccgucgugcucgagcagaacuacaccauccggaagaacaucgaccccgaccugaagguggacaaggucaucgacgugggcaucaagcgcauccuggagagccggcucgaggaguucgggggcaacgcgaagcuggccuucuccaaccuggaggagaacccgaucuggcucaacaaggagaagggcauccccaucaagcgcgugaagaucagcggggucuccaacguggagagccugcacgugaagaaggaccacuucggcgagaagauccuggacgaggaggggaacgagauccccgucgacuucguguccaccggcaacaaccaccacguggccaucuacgaggacgaggacgggaaccuccaggacgaggucgugaacuucuacgaggccgugauccggcgcaaccagggcgagagcaucaucaaguaccggcacgaggagggcuggaacuuccuguacuccaucaagcagaacgaguucuucgucuucccgagccaggacuucaaccccaacgacuucgaccugcucgaccccaagaacuacgaccugaucucccccaaccuguaccgcgcgcagaaguucagcaaggugauguacgggaacuccgccgugcgggacuacgucuuccgccaccaccucgagacggugcugaacgacgugaaggagcugaaggacgucgccuacaagcagcucaagagccugcaguaccugaacggcaucaagaaggugcggcucaaccaccuggggcagaucauccaggugggcgaguacuga

SEQ ID NO: 1884 - RNA, 4065 nt, Artificial Sequence
  Cas9 variant
augacccugcacuacaacgugggccucgacaucgggaccaacagcgucggcuacacgaucguggacgacaacgggaagauccuccaggugaagggcaagaacggguacggcguccgcguguucaaggagggcgccaccgccgcggagcggcgcaucuuccggaccacccaccgccggcugaagcgccggaaguggcgccuccggcugcugcaggacuucuucgagcccuacauccucccgcaggacgacggguucuucauccgccggaaggaguccaaccuggugcugaacgaccgcgacgaggacacggccagccucuucaacgaccgguccgaccgcgacuucuaccaggccuaccccaccaucuaccaccuccggcaggcccugaugaccgagaagcgccaguucgacguccgggagaucuaccuggccaugcaccacaucaucaaguaccgcggccacuuccugcugaacgggaccgugaacaacuucacgaacaacaagaucgaccuccacagcgacuucgaggagcugaacgcgcugcuccugaacgugauccccgagcugaaguuccagaucgaccucgaccacuccaccauguuccagaccacccugcugaacacgaccaucagccgguccggccgccagcgggaccucgucaagagcuucuacaacggguccgacgacaagcagcuggccaagcagcagaaguccguggccaccgagcugcucaaggccauccugggccugaaggcgaaguuccacaagcuguucaaccuggaccugcucgagaccacggagugggaguucagcuucgacgccgaggacaucgacgacaagcuggccaagcuggagccccucaugaccgagaaccagcagcaggucauggacauccugcagcgcaucuucgccgccaucacccugaacggcaucgugccggaggggaagacccucagcgcguccaagguggacagcuaccagaagcacaagcaggaccugaagcugcucaaggccaucgcccagcacuccgacaagaagacggccaccgugcugcagaccgccuacaacgaguacaucaacggcaucgcgagcaagccccugaagcaggaggacuucuacaagcgccucaccaacgccgucaagaaguccagcgacccccagguggccgacaugcuggcccugaucgaccaggagaaguuccuccccaagcagcggacgaaggagaacggggccaucccgcaccagcugcaccagcuggagcuggagcgcaucaucgacaaccagaaggacuacuaccccuggcucgcggagcugaaccccaaccaggcccggcagaagguggccaaguacaagcuguccgagcucgucgccuuccgcgugcccuacuacgugggcccgcugaucgagcccgagguccagcaggccaccagcaacgcgcacuucgccuggauggcccggaaggaggccggccccaucacccccuggaacuucgaccagaagguggaccgcaacgugagcgcggagcgguucaucaagcgcaugaccacgaaggacaccuaccugcucgccgaggacguccugccgcugcacucccuccuguaccagcgguucaucgugcugaacgagcucaacaacguccgcgugaacgggcagaagcugaccaagaagcagaagcaggccguguaccaggaccuguucaagcggcagccccacgucaccaagaagcaguucaagagcuaccucgugcagacgggcgaguucgccgaguccagcaagaucgaggggcuggccaacgagaccuccuucaacagcggccugaccaccgagaacgagcuccgcaagaucuucggggcgcagcuggacgaggcccgguaccagguggacuucgagcagaucaucgagugggccacgcuguucgaggacgccaagauccuccgcaccaagcuggccgagaucaccuggcugaccaccgagcagaucgagaagcucgcgggcauccgguaccgcggcugggggcgguucucccgcaagcugcuggccggccuccgggaccagaacgggcagcagaucaucgaccugcugugggacacgcccaacaacuucauggucaucgugagccaggccgccuucuccgaggccaucaccaaggagaacgagaagcucaucgaccgccgcggcgcgcaggacgugaucaccgaccuguacaccagcccccagaacaagaaggcccugcggcagguccucgccaucguggccgacgugcagaaggcgaugggcggggucccgccccagcgcaucuucaucgaguucgcccgggaggacgagaagaacccccgccgguccguggagcgcagccggcagcuggagaagcuguaccagacgaucuccaacgaguuccucaucaacagcgaggugcgccaggagcugaaggaggccgucgaccagaaggugaacuucaaggaccggcuguuccucuacuuccugcagggcgggguggaccuguacuccggcaagcgcaucaacaucgaccagcucagccacuacgacaucgaccacauccugccccaguccuucaucaaggacgacagccuggacaaccggguccucgugucccagaagcugaaccgcagcaagagcgacuccgugccgcugagcgaguucgccaacuacaaguucgggcccgccaugcaggcgaaguggcuccagcugaaggaggccggccugcucuccaagcggaaguacgacaaccugacccuggaccccaccaagcucagcaaguucgcgccccugggguucgucaaccgccagcugguggagacccgccaggugaucaagcucgccgccaaccugcuggccuccgaggagacgaaggucgugaccaucaaggccaacaugacccaccaggugcggaaggagcucgacuucccgaagaaccggaacgucaacaacuaccaccacgccuucgacgccuaccugaccgccuucgugggcaucuuccugagcaagcgcuaccccaagcucaagcccuacuucacguacggcgacuuccagaaggggaacaagcugccggaccugaagaacuucaacuuccucuacgagcugaagaacaaggaccgguccaucgacagcaacaccggcgagaucaucugggacaagcagcgcgaccuggcguacaugaacaagaucuacaacuucaagaaggugaccgucgugcacgaggugcucaccaaguccggggcccuguacaaccagacgcuguacaaggccagcgaggacaaggccuccggccggggcaccaagcagcucauccgcaagaaggacaacaugcccaccgagcuguacgggggcuacaccgggagcacguccgcguucaugagcaucguccgccuguggaagaaggacaagcccuacuacaagguggugggcauccccacccggauggccgccaagcucgccaaccaggcccagcugcuggacuaccucaccaagaaguucaccacgcgcaagcuggucaagaagaccggggacuacaagaccaccguggagcgguucgagcugguggucccgaaggugggcuucaaccagcucgugaucgacggcgggcagcccuucaugcugggcuccgcgacguaccaguacaacgcccgcgagcuguucaucagcaaggaggccgucaaggcccucaacaagcagcuguccacccacguggaccuggugcaggucuucgacgagauccucguccaggugaaccggugguucccccuguacgacaccaacggguuccgcgagaagcugagccacggccgggaccgcuucaugaagcucaacgacagcuucgaggagaaguccgacacccagaucgacgugcugaaccggauccugaucggguuccacgccaacgcggcccgcacgaaccucaagauccugggccugggcaccgaccugggguucaugacccagcaggccggcauccggcucaccgagaaggccauccuggugcaccagagccccuccgggcuguucgagcgcaagguggcccuccgggaccugaagggccugcgcuga

SEQ ID NO: 1885 - RNA, 4068 nt, Artificial Sequence
  Cas9 variant
augaccuacagcaucggccuggacaucgggaccggcuccguggggugggccgucaucggcgacgacuaccgccucaagcgggccaaggggaagaaccugaucggcgugcgccuguucgacagcgcgacgaccgccgccgagcggcgcggcuaccggaccacccgccggcgccucucccggcgccacuggcggcugcgccugcucaacgacaucuucgccagcgaccuggccgagcaggacgagaacuuccugccccggcucaaguacuccugggugaacccggacgacgagcagaacccccagcugaacagcgacgucgcgaacggggcccuguucggcuccagcgagacggacaaggccuuccacaagaacuaccccaccaucuaccaccuccgccacgagcugaugaccgacaccgccaagcacgaccugcgggagguguaccucgcgauccaccacaucgugaaguaccgcgggaacuuccugaacacggccgacaagaucaacgccgagaacuccuucaacgucgaccuguucaucgccgcccucgacgaguacaacgaguuccuggagacccccaucaccagcaucaaggacgcgcagcuguucuccgacaagcucaccgacaucaacgcccggaacaagagcgugcgcguggagaacgccauguccgagacguacgacgacaagagcaagaucuucaaggccauccugaccgcccuggucggcaacaccgcgaacuuccagaccaucuucgaccucuccgaccuggagaaggacgaggccaagaacuucaaguucaagcuggaccucgaggacguggagacgaagcuggacgugguccgggccaagcugagcgacgagcagaacgccuuccucgaggccgugcugaucgcguacgacgggaucacccugaagaugauccucggcgacuacaaguccaucagccaguccaugaucgagagcuacaagagccaccagcgcgacuggaaguacaucaagaacaacgugcggcugaacgagcagaagaucgagccggacaagaacuccgucaaguucuucaagcuggaccccaagaagcucaucuaccccagcaaccuggccuaccuccaggugaucuccagcaacgaggacgagcaccgcaagggccuggacuacuucaagaccgccauccaggacgccgacauccugcagcgcaucgagaacgacaccuuccugccccggcagcgcacgaagcggaacggggugcucccguaccagcugcaccuggccgagcucgagcagaucaucaagaagcaguccaaguacuaccccuuccuggcgaacaucuacacccaggacaacaagaccgagaacaagcugaucggccuccugaaguuccgcguccccuacuacguggggccccugguggaggccgagaaggucaccggcgacggcaagaaccacuggcugaucaagaaggagcuccaggagaacacgccgaucacccccuucaacuucgacgacgugguggacaaggacaagagcggggagcaguucaucaagcggaucaccggcaccgacuccuaccugaucggggagcccacgcugcccgagaacagccuccuguaccagaaguacaacguccugcaggagcucaacaacgugcgcaacgagcggcaccagcgccugccgaucaaggucaagcaggacaucuucgagcacguguucaagaucgacaagaacgugaacgccaagaaggucauggccuaccugaagcucaacggcuacggggacuuccagaucgcgggccuguccgacacccggaccggcaaguucaacagcaaccuguccagcuacaacuacuucguggaccuccuggggcgcgagaagaccgagaagauccgggaggaccgccuggaggagaucaucgagauccagacgguguucgaggacaagauccucgucgccaagcggcuguccaaccuggacuuccucacgccccaggagaaguccaagcugagcgccaagcacuacaccggcugggggcgccugagccagaagcuccugaccacccaguucaucaagaccgcccuguccgaggccggcgacaucaucccccagagccacuccaucaucgaccuccuguacuacaccgacaagaaccugauggagauccucaacgacaagaccuucaacgugcggaacuggcugaccgagcagaacaaggggacggagagcggcaacagccuguacgaccagaucgacgcgcucgccggccccaaggacaucaagcgcgggaucacccagguguucuccaucaucgacgacaucaagaaggccaugggcagcaacccggagaccgucuaccuggaguucgcccgggagacccagacgucccgccugaccaacagccggcucaaccgcgugcaggagaucuacaacucccccgagcugaagaccgaguucgccuaccuggcgaagaagcucgaggccgagaccaaggagagcauccacgacgaccgccuguaccuguacuaccuccaggaggggcgggacauguacacgggcaaggagauccccuucgaccagaucuccagcaacuacgacaucgaccacaucaucccccaggccuucaccaaggacgacucccuggacaaccgcgugcuggucaaccgggccaccaacgcccgcaagagcaacuccccgaccuucacgaacgacaucaucgacaaccgcaagagcugguggcagucccucgugaagcgggggcugaugagcaaggagaaguucgagcggcugaccgacaagcgcaagaccuucuccgagaaccagaccaaccacuucaucgcgcggcagcucguggagacgcgccagaucaucaagaacgucgccgaccugaucaagaacaacuacgacggcacccaggccguggccauccgggcgagccugaccggcgagaugcgccgguaccucgacuggcccaagaaccgcgacaugaacgacuaccaccacgcccacgacgcccugaugauggccaccguggggaaguacgucgaccggcgcggcuucuucgacaacggguccgugagcgacggcgccggcaacgcguacaaccuguacacgaaggacuggcucguggccgcccgggucgggacccgcaacgacagccagcgggugaaccccuacggcuucaucgugggguccaugaacagcaaggccguccgccagcaggucaacaaggagaccggcgagaucgugugggggaacgagaaccuggacuaccugcggcacgugcucuccuacaagaagauccuggugacccgccgccugagcggcuccagcggccggcucuacgccgagacgcuguucucccccaacccgaaggcgaagcugaucgcccagaaggccaaccgcagcguggcccucuacgggggcuucaccaaggccgaguccgcguacaccgcccuggucgaguucaacaagaagggggaccggagcuacaagcugaucaaggugcccauggccaucgccaaccgcgugaacgacaagcagaucaccgucacggcguacaucgccucccucaaccugcgggacuucagccgcguggugcuggagcaccucccccugggcacccugauccgggaguccgacgggagcgaguucuacgccgccuccagcgaguacaagcacaacgccaaggagcucugggcgccgaaggagauccugcgcuccagcaagaagcuggacaaggccaccgccgacaaccucaucgacaucuucgacuuccugaccaacgacaagacgaucuccaacuucaaguucuacgagaaggaccugcuccaccugaagaacguccgggacaaguucguggaggccagcgacgagaucaagaucaaggugcugagcgacgucaucuacgagcuccacaacgacgccggcuggcgcgaccccuucaagcacauccaggagaagcccgcguggaccaugcuccaggugaagggcgggaucaagcuguccgagaaggccgccaucguguaccagagccccaccggccuguucgagaccaucacgaucgucggggaguga

SEQ ID NO: 1886 - RNA, 4071 nt, Artificial Sequence
  Cas9 variant
augaagaaguucgaggaguacuacaucggccuggacauggggaccggcagcguggggugggccgugaccgacuccgccuacaacaucaucaagcgccacggcaaggcgcucugggggauccggcuguucgagagcgccaagacggccgaggagcgccggaucuuccgcaccucccggcgccggaccgagcgccggaagaaccgccugcaccuccugcaggagaucuucgccgaggagaucagcaagaaggacaugggcuucuaccagcggaugaaggaguccaaguacuggcacgaggacaagaaggacaucaacggcaacaugcccgagcugccguacgcccucuucgcggacgacggguucaccgacaaggacuacuacaagaaguaccccacgaucuuccaccuccgcuacgcccuggccaccaacaccaccgacaagcccgacauccggcugcuguaccuggcccuccaccacaucaucaagcaccgcggccacuuccuguucgaggggaagaagcugagcgaggugaaggaguucuccacggcgaucgaggcccucgugcagcaggccgaggagcaggagaucgaccucaagagccugacccaggaggagguccugacccagcuggagcacaucauguccgacgcccagugcaccaagagcgacaagaagacccagguguccaagcugaucgugggcacggacaagcagaagcagaagcaggagaaggccaucgcggcccucaucaccgggugcaccgucaagcugagcgacaucuucgccgaccccgagcuggacaaggaggagaucuccaagaucugcuucagcgacaacggcuacgaggagaaggagguggagaucgaguccgugcucgccgaccgguuccugcugaucgccgcggccaagggcgucuacgacuggacggugcuccacgacauccugggggacgcccgcuuccugagcgaggccaaggugaagaccuacgagaagcaccgggacgaccuccgcaaggucaagcagcugcugcggauggacaaggagguguacgaggccguguucggcgucuccgagaagaacgaggcgaacuacagcgccuacaucgggauggccaagaagaacggcaagaagcagccgaucgagaagaagugcucccaggaggacuucuacaaguuccucaagaagcagcuggaccgccugagcguggacgagaugggccaggagaucaucgacgagcucaaggccgagauggaccuggggacccuguuccccaagcagaugauccgggacaacggcgugauccccuaccagcuccacgagaacgagcugaacgccauccuggacaacgcgcagaaguucuaccccuuccuccuggagaaggaccaggacggguacaccccggucgagaagauccagaagaucuuccgcuuccgcauccccuacuacgugggcccccugaacacggcccaccaggacaagggcgggcacagcugguccgugcggaagaaggagggcaagaucuaccccuggaacuucagcgagaugaucgacgaggaggaguccgccaccaaguucaucgagcgcaugaccaacaagugcaccuaccucaucggggaggacguccugccgaaggagagccugcucuacgccaaguucaacgugcugaacgagcugaacaaccugcggaucgacggcgagcucaucgcgcccgagcugaagcaggacaucuacaacaacguguucaagaaguaccagcgcgucacggggaagaaggugaaggacuaccugcggaucaacggcgucaucuccaaggagcaggagcucagcggguucgaccagaacuucaaguccagccugaaggccuaccacgacuucaagcagaucgugggcaccggcgugcuguccgagagcgagcaggaggacaucguccgcgacaucacccucuucgccgacucccagaagaugcugaagcagcggauccaccgcaaguaccccaugcugagcgacaagcagaucgcccagcucgccaacaagaaguacgcgggguggggccggcugucccgcaccuuccuggagaacaucgagagcgugaacaaggagacgggggaggugaugaacaucaucaccgcccucugggagaccaacgagaaccugaugaagcugcucuccggcaaguacgacuacaccaagcagaucgagcaguggaacgcccggcagaugaagaagggggagaucgaguaccaggacaucgaggagcuguacgucagccccgccgugaagcgcccgaucuggcagacgaucaagaucgugcgggagaucaccaacaucaugggcggcgcccccaagcgcaucuucgucgagguggcgcgggagcccggggagaagggcgugcgcaaggucucccggcgcaaccagcugcucgaccuguacaaggccugcaagaaggaggcccccgagcuguacgaccggcucgccaacaaggagagcgacaacgcccugcgcuccgacaagcuguuccucuacuacagccagauggggcgcugcauguacagcggcgacgcgaucgaccuggacgagcuguucaccaaccgguacgacaucgaccacaucuacccgcaguccaaggugauggacgacagcaucgacaaccgcgugcucgucaagcgggaccugaacuccaagaagaccgacacguuccccgugagcgaggaguaccgcaaggccggcaaggcccugugguccacccuccugaagaaggggcugaucagcaaggagaaguacaagcggcucacccgcaccgagcccuucggcgaggacgagcuggccggguucaucgcgcggcagcugguggagacccgccaguccacgaaggccgucgcccaccuccuggaggaggccuaccccgacgccgagaucguguacgcgaaggcccgggccgugagcgaguuccgccacaaguucgacaugaucaagguccgggaggugaacgacuuccaccacgccaaggacgccuaccugaacaucguggucggcaacaccuacuacgugaaguucaccaaggacgcggccugguucgugcgcaacaacccggggcggaccuacaaccucaagaagauguucgagaacgagacggucaagcgcggcaacgagaccgccuggauccccggcgacaacgggaccaucugcaccgugaagaaguggaugcggaagaacaacgugcuguucacgcgccgggccuacgaggucaagggcgggcuguucgaccagaacauccucaagaagggcaaggggcagauccccaucaagggcggcgccgacgagcgccugcggucccgcgacaaguacggggcguacaacaaggccagcggcgccuacuucaugcugguggaguccgacgggaagaagggcgagcggaagcgcaccaucgaguucgugcccgucuaccucgccaagagccuggaggaguccguggagcugcgccggcgcuacugcgaggaggagcucgggcuggugaacccggacguccggcugagcaagauccgcaagaacgcgcucaucgacguggacggcuucaagaugcaccuggugggccggaccgagaaccgccugcuccugaucggggccacccagcugguccucuccgaggacgaccagcagcugaucaagaagaucggcaaguacugccuggaccaccgggagaacaaggacgccgugcucagcgagaaguacgagcugacgauggaccuguucgagaagcucuacgacaucuucguguucaagcuggagcagaccgucuacgccgugaagcuguccaagcaggccaaggaccucaaggaggugaaggaggaguuccuggcgcuggacgacgagcagaagugccuccugcugauggagauccuccaccuguuccagugcagcccccagcuggccaaccucaccaacaucgggggcggcaagagcgccgggucccugaagauccugagcgacaucaccaagcagcaguccguccuccugaucaaccagagcaucacgggcuucuacgagcaggucaucgaccugaagaccaucuga

SEQ ID NO: 1887 - RNA, 4071 nt, Artificial Sequence
  Cas9 variant
auggaggugggcaacuacuaccuggggaucgacgccggcaccgacagcgucgggugggccgugaccgacaaccaguacaacgugauccgcaagaagggcaagucccucugggggauccggcuguucgacggcgcgaacacggcccaggagcgccggaccuuccgcgcccugcggcgccggaacgagcgcaagaagcagcggaucaaccuccugcaggagcuguucugcaaggagaucugcaagcucgaccccaacuucuucauccgccugcgggacagcucccuguggagcgaggacaaggaggagaagcagaucuacucccucuucaacgacaagaacuucaacgaccgcaacuaccacaacaacuacaagaccaucuaccaccuccgggccgaccugaucaagaacaaggagaagcacgacgcccgccuggucuaccuggcgauccaccacaucaugaagaaccggggccacuuccuguucaacgggaacaucgagagcgugaccuccuucgagaacacguucaacgaguucaagaacugccuccuggacgagcuggagaucaaccucgagugcccgagcaucuccgaguucgagaacauccugaaggaccgcaccuucaagggcacccagaagugcaagaagcugaaggagcucugcagcauccccuccagcgacaagaagcuggacaacaucuucaagcugaucuccgggcucaaggccgaccugagcaucaucuucgaggacgaguccuucaaggagaacgagcacaacaagaucagcuucgccgacuccaacuacgaggagacccgggaggugcugaacagcgagauccaggagaagacgcucaucaucgacaucuucaacuccaucuacaacugggucauccugagcgacauccugagcggcggggaguacaacggcggccucuaccuguccaucgccaaggugaacaccuacaacaagcacagcaaggaccugaagauccucaaguccgugaucaagaaguacuucccccagaaguacaccgacaucuucgcgagcaacaaggagaacaacuacugcuccuacaucgggauguacaagagcggcgggaagaaguacuccgucaagaagugcagcgacaagcccgaggaguucuacaagaccaucaagaacaucaucaacaagaacacggccgaggagaucuccaacgacaaggacgugcaguacauccugagcgagaucgagaacaacuccuuccugccgcuccagaucaacaagaacaacggcgugauccccuaccaggccaacaagaucgagcuggagagcauccugaagaacgccgagaacuaccuccccuuccugaaggagaucgacaccgagugcaacaagaccaccuccgagaagaucaucgaccuguucgaguuccgcauccccuacuacgucggcccgcucaacacgagcaagggggagaacgccuggaugauccggaaggaggacggcaccauccgccccuggaacuucgagcagaagguggacaucgacaagaccgcggccgaguucaucacccggaugacgaaccagugcaccuaccugaacaacgagaccgugcugcccaaguacucccuccuguacagcgaguacaccguccugaacgagaucaacaacauccgcaucaacggggagaagaucuccguggagcucaagcaggacaucuucaacauccuguucaagaacaacaagcaggucacgugcaagaagcugcugagccaccucaacuccaacggcuacaaccugaagaaggacgaccugagcggguucgacggcaacuucaagagcucccucagcuccuacaucgaccugaagaacuacaucuucggcgacaacaucgacaagccccagaucuacaaccuggccgagaagaucauccucuggaucacccuguacggggacgacagcaagcugcucaagcgcgugcugcagaagaacugcuccgagcagcugaacccggagcagaucaagaagaucaccaagcucaaguucaagggcugggggcggcugagcaaggccuuccuguccgagcuccgcggcgccgaccgggagaccggggagacgaugaccaucaucaagggccugcgcaacacccagaacaaccugaugcagcuccugagccagaacuacaccuucacggaggagugcgagaagaucaacuccggcuacuucaucaaccccaacgagaucagcuacgacuccaucgugaagaacaucguggcgagccccuccaucaagcggagcgucuggcagaccauccagaucguggaggagauccagaaggugaugggguccaagccccgcaagaucuucgucgagauggcccggggcgaggaggagaaggugcgcaccaccagccggaagcagaagcugcucgaccuguacaagaacaucuccgacgagugcgccaaggggauguacgacgagaucuacagcaaggacgagagcgacuucaagaacauccgccuguaccucuacuacacgcagaugggcugcugcauguacuccgggaagcacaucgaccugagccagcuguccaacaccaacaucugggaccgggaccacaucuacccgcagagcaagaccaaggacgacucccucgacaaccugguccugguguacaagagcaucaacuccgagaaguccgacgacaucaucagccccaccauccagaacaacaugcgcaccuucuggaagcuccuguucgaccggaaguucaucagcgagaagaaguaccaccgccugacgcggaccacgccccucaccgacgaggagcuggccggcuucaucaaccgccagcugguggagacccggcaguccaccaaggucauggccagcaucuucaagcgcaucuaccccaacaccgagaucaucuacgugaaggcgaagaacguguccgacuuccggcaccgcaaggacugcgagaacggcgucaaggugcgcgagcucaacgacuaccaccacgccaaggacgccuaccugaacaucguggucgggaacguguacagcuccaaguucaccaacaacccgcugauguggcucaagaacaaccggaacgugaaguacagccugaaccgcauguacgacuucaaccugacggucaacaacgagaacaucuggguggugggcaacgaggggacccagaagaccgucaacaaguaccucggcaagaacgacauccuguacacccgguacgccaugacgaacaagggcgagcuguucgaccagaacccccucaaggccaccggggacaaguccaagcagaccacccuggugccccugaagaagggcaaggagguguggaaguacgggggcuacaacagcaucacgcccuccuacuucaugcucgucgagagcaaggacaagaaggggaacuacauccgcaccaucgagaccaugccgcuguaccgggagaaggaguucagcaagaacgaggaguuccugcucaacuacugcaaggaggugcacaagcugaaggagcccaagaucauccugaagugcaucaagaagaacgcgcuccugaucguggacggcuuccccaugcaccugaagggcuccaccgggcuccagcugaagcugcagggcgccguccagcucauccuggagagcgacauggugaucuaccugaagaagcucaugaaguucgugaacgagaacaacaucaacaagaacaagcuggaggucacgcccuacauggagcuguccgccaaggagaacaucaagcucuacgacaucuucauccagaagcugaccaccgggaucuacagcaagcgcccggccaaccccguggagaagcugaucaacgcgcgggacaucuucaucgagcucaccgugaaggagcagugcaucguccuguccgagauccugcaccucuuccagugcaagccccugacgagcgccaaccugguguccaucaaccucaagaagaccgugggcaucauccagaucgccaagaacaucaccgccaagaacgucaagcuggugcaccagagcccgaccgggaucuacgaguacacgguggaccugaacaagaucuga

SEQ ID NO: 1888 - RNA, 4071 nt, Artificial Sequence
  Cas9 variant
augaccaagaaggagcagcccuacaacaucggccuggacaucgggaccagcuccgugggcugggccgucacgaacgacaacuacgaccuccugaacaucaagaagaagaaccuguggggcgugcgccucuucgaggaggcccagaccgcgaaggagacccggcugaaccgcagcacccggcgccgguaccgccggcgcaagaaccggaucaacuggcugaacgagaucuucuccgaggagcucgccaagacggacccgagcuuccugauccgccugcagaacuccugggugagcaagaaggaccccgaccggaagcgcgacaaguacaaccucuucaucgacgggcccuacaccgacaaggaguacuaccgggaguuccccaccaucuuccaccuccgcaaggagcugauccugaacaaggacaaggccgacauccggcugaucuaccuggcccuccacaacauccugaaguaccgcgggaacuucaccuacgagcaccagaaguucaacaucuccaaccugaacaacaaccucagcaaggagcugaucgagcugaaccagcagcucaucaaguacgacaucuccuucccggacgacugcgacuggaaccacaucagcgacauccugaucggccggggcaacgccacgcagaaguccagcaacauccugaaggacuucacccucgacaaggagaccaagaagcugcugaaggaggucaucaaccucauccuggggaacguggcgcaccugaacaccaucuucaagacgucccucaccaaggacgaggagaagcugaacuucagcggcaaggacaucgaguccaagcuggacgaccucgacagcauccuggacgacgaccaguucaccgugcuggacgccgccaaccgcaucuacuccaccaucacgcucaacgagauccugaacggggagagcuacuucuccauggccaaggucaaccaguacgagaaccacgcgaucgaccugugcaagcuccgggacauguggcacaccaccaagaacgaggaggccguggagcagagccgccaggccuacgacgacuacaucaacaagcccaaguacggcaccaaggagcuguacacgagccugaagaaguuccucaagguggcccugcccaccaaccuggccaaggaggcggaggagaagaucuccaaggggaccuaccucgucaagccccggaacagcgagaacggcguggugccguaccagcugaacaagaucgagauggagaagaucaucgacaaccagucccaguacuaccccuuccugaaggagaacaaggagaagcuccugagcauccuguccuuccgcauccccuacuacgucggcccccugcagagcgccgagaagaacccguucgccuggauggagcgcaaguccaacgggcacgcccggcccuggaacuucgacgagaucguggaccgcgagaaguccagcaacaaguucauccggcgcaugaccgugacggacagcuaccucgucggcgagcccgugcugcccaagaacucccugaucuaccagcgguacgaggugcucaacgagcugaacaacauccgcaucaccgagaaccugaagaccaacccgaucgggagccggcucaccgucgagacgaagcagcgcaucuacaacgagcuguucaagaaguacaagaaggugaccgugaagaagcugaccaaguggcucaucgcccagggcuacuacaagaaccccauccugaucggccugucccagaaggacgaguucaacagcacccucacgaccuaccuggacaugaagaagaucuucggguccagcuucauggaggacaacaagaacuacgaccagaucgaggagcugaucgaguggcucaccaucuucgaggacaagcagauccugaacgagaagcugcacuccagcaaguacuccuacacccccgaccagaucaagaagaucagcaacaugcgguacaagggcugggggcgccucagcaagaagauccugauggacaucacgaccgagaccaacacgccccagcugcuccagcuguccaacuacagcauccuggaccucaugugggcgaccaacaacaacuucaucuccaucaugagcaacgacaaguacgacuucaagaacuacaucgagaaccacaaccugaacaagaacgaggaccagaacaucuccgaccuggucaacgacauccacgugagcccggcccucaagcggggcaucacccaguccaucaagaucgugcaggagaucgucaaguucauggggcacgcccccaagcacaucuucaucgaggugacccgcgagaccaagaaguccgagaucaccacgagccgggagaagcgcaucaagcggcugcagagcaagcugcucaacaaggccaacgacuucaagccccagcugcgcgaguaccugguccccaacaagaagauccaggaggagcucaagaagcacaagaacgaccuguccagcgagcggaucaugcuguacuuccuccagaacggcaagucccuguacagcgaggagucccugaacaucaacaagcucagcgacuaccagguggaccacauccugccgcgcaccuacauccccgacgacucccuggagaacaaggcccucgugcuggcgaaggagaaccagcggaaggccgacgaccugcuccugaacagcaacgucaucgaccgcaaccuggagcgcuggaccuacaugcucaacaacaacaugaucggccugaagaaguucaagaaccugacccggcgcgugaucacggacaaggacaagcucggguucauccaccggcagcuggugcagaccagccagauggucaagggcguggccaacauccuggacaacauguacaagaaccaggggacgaccugcauccaggcccgcgccaaccucuccaccgcguuccggaaggcccugagcggccaggacgacaccuaccacuucaagcaccccgagcuggugaagaaccgcaacgucaacgacuuccaccacgcccaggacgccuaccucgcguccuuccuggggaccuaccggcugcgccgguuccccaccaacgagaugcuccugaugaacggcgaguacaacaaguucuacggccaggugaaggagcuguacagcaagaagaagaagcucccggacucccgcaagaacggguucaucaucagcccccuggugaacggcacgacccaguacgaccggaacaccggggagaucaucuggaacgucggcuuccgcgacaagauccugaagaucuucaacuaccaccagugcaacgugacccggaagacggagaucaagaccgggcaguucuacgaccagaccaucuacucccccaagaacccgaaguacaagaagcucaucgcccagaagaaggacauggaccccaacaucuacggcggcuucagcggggacaacaaguccagcaucaccaucgugaagaucgacaacaacaagaucaagcccgucgccauccccauccgccugaucaacgaccugaaggacaagaagacgcuccagaacuggcuggaggagaacgugaagcacaagaaguccauccagaucaucaagaacaacgugccgaucggccagaucaucuacagcaagaaggucgggcugcucucccugaacagcgaccgggagguggccaaccgccagcagcugauccucccgcccgagcacuccgcccugcugcggcuccugcagauccccgacgaggaccuggaccagauccucgcguucuacgacaagaacauccugguggagauccugcaggagcucaucaccaagaugaagaaguucuaccccuucuacaagggcgagcgcgaguuccugaucgccaacaucgagaacuucaaccaggccaccaccagcgagaaggucaacucccuggaggagcucaucacgcugcugcacgccaacagcaccuccgcccaccucaucuucaacaacaucgagaagaaggcguucggccggaagacccacgggcugacccugaacaacacggacuucaucuaccagagcgugaccggccucuacgagacccgcauccacaucgaguga

SEQ ID NO: 1889 - RNA, 4071 nt, Artificial Sequence
  Cas9 variant
augaccaagaaggagcagcccuacaacaucggccuggacaucgggaccggcagcguggggugggccgucacgaacgacaacuacgaccuccugaacaucaagaagaagaaccuguggggcgugcgccucuucgagggggcccagaccgcgaaggagacccggcugaaccgcuccacccggcgccgguaccgccggcgcaagaaccggaucaacuggcugaacgagaucuucagcgaggagcucgccaacacggacccguccuuccugauccgccugcagaacagcuggguguccaagaaggaccccgaccggaagcgcgacaaguacaaccucuucaucgacaaccccuacaccgacaaggaguacuaccgggaguuccccaccaucuuccaccuccgcaaggagcugaucaucaacaagaacaaggccgacauccggcuggucuaccuggcccugcacaacauccucaaguaccgcggcaacuucaccuacgagcaccagaaguucaacaucagcacgcugaacuccaaccugagcaaggagcucaucgagcugaaccagcagcugaucaaguacgacaucuccuucccggacaacugcgacuggaaccacaucagcgacauccucaucggccgggggaacgccacccagaaguccagcaacauccugaacaacuucacccuggacaaggagaccaagaagcuccugaaggaggugaucaaccugauccucggcaacguggcgcaccugaacacgaucuucaagaccucccugaccaaggacgaggagaagcucagcuucuccgggaaggacaucgagagcaagcuggacgaccuggacuccauccucgacgacgaccaguucaccguccuggacacggccaaccgcaucuacagcaccaucacccugaacgagauccucaacggcgaguccuacuucagcauggccaaggugaaccaguacgagaaccacgccaucgaccugugcaagcugcgggacauguggcacaccacgaagaacgagaaggcgguggggcucagccgccaggccuacgacgacuacaucaacaagcccaaguacggcaccaaggagcuguacaccucccugaagaaguuccucaaggucgcccugcccaccaaccuggccaaggaggccgaggagaagaucagcaagggcacguaccucgugaagccccggaacuccgagaacgggguggucccguaccagcugaacaagaucgagauggagaagaucaucgacaaccagagccaguacuaccccuuccugaaggagaacaaggagaagcuccuguccauccugagcuuccgcauccccuacuacgugggcccccugcaguccagcgagaagaacccguucgcguggauggagcgcaaguccaacgggcacgcccggcccuggaacuucgacgagaucguggaccgcgagaaguccagcaacaaguucauccggcgcaugaccgucaccgacagcuaccucgugggcgagcccgugcugcccaagaacucccugaucuaccagcgguacgagguccucaacgagcugaacaacauccgcaucaccgagaaccugaagacgaacccgaccggcagccggcucaccguggagaccaagcagcacaucuacaacgagcuguucaagaacuacaagaagaucacggugaagaagcugaccaaguggcucaucgcccagggguacuacaagaaccccauccugaucggccugucccagaaggacgaguucaacagcacccucaccacguaccuggacaugaagaagaucuucggguccagcuucauggagaacaacaagaacuacaaccagaucgaggagcugaucgaguggcucaccaucuucgaggacaagcagauccugaacgagaagcugcacuccagcaacuacagcuacaccuccgaccagaucaagaagaucagcaacaugcgcuacaagggcugggggcggcucuccaagaagauccugaccugcaucaccacggagaccaacacccccaagagccugcagcucuccaacuacagcguccuggaccugauguggaccacgaacaacaacuucaucuccaucaucagcaacgacaaguacgacuucaagaacuacaucgagaaccacaaccucaacaagaacgaggaccagaacaucuccaaccuggugaacgacauccacgugagccccgcccugaagcgcggcaucacccaguccaucaagaucguccaggagaucgugaaguucaugggccacgccccgaaguacaucuucaucgaggucacccgggagaccaagaaguccgagaucacgaccagccgcgggaagcggauccagcgccuccagagcaagcugcugaacaaggcgaacggcuucaagccccagcuccggaaguaccuggugcccaacgagaagauccaggaggagcugaagaagcacaagaacgaccucuccagcgagcgcaucaugcuguacuuccugcagaacgggaagucccucuacagcgaggagagccugaacaucaacaagcuguccgacuaccagguggaccacauccucccccggaccuacaucccggacgacagccuggagaacaaggcccugguccucgccaaggagaaccagcgcaaggccgacgaccugcugcucaacuccaacgugaucgacaagaaccuggagcgguggaccuacaugcugaacaacaacaugaugggccucaagaaguucaagaaccugacgcgccgcgugaucaccgacaaggacaagcugggguucauccaccggcagcucguccagaccagccagauggugaagggcguggccaacauccugaacuccauguacaagaaccagggcaccacgugcauccaggcgcgcgccaaccugagcaccgccuuccggaaggcccucuccgaccaggacgaccgcuaccacuucaagcaccccgagcuggucaagaaccggaacaucaacgacuuccaccacgcccaggacgcguaccuggccagcuuccucgggaccuaccgccugcggcgcuuccccaccgacgagaugcugcucaugaacggcgaguacaacaaguucuacggccaggugaaggagcuguacuccaagaagaagaagcugcccgacagccggaagaacggguucaucaucuccccgcucgugaacgggacgacccaguacgaccgcaacaccggcgagaucaucuggaacgucggcuuccgggacaagauccugaagaucuucaacuaccaccagugcaacgugacccgcaagacggagaucaagaccgggcaguucuacgaccagaccaucuacagccccaagaaccccaaguacaagaagcugaucgcccagaagaaggacauggacccgaacaucuacggcggguucuccggcgacaacaagagcuccaucaccaucgugaagaucgacaacaacaagaucaagcccgucgccauccccauccggcucaucaacgaccugaaggacaagaagacgcugcagaacuggcucgaggagaacgugaagcacaagaaguccauccagaucaucaagaacaacgugcccaucggccagaucaucuacagcaagaaggucgggcugcugagccucaacuccgaccgcgagaucgcgaaccggcagcagcugauccugccgcccgagcacagcgcccuccugcgcauccugcagauccccgacgaggaccccgaccagauccucgccuucuacgacaagaacauccugguggagauccugcaggagcucaucaccaagaugaagaaguucuacccguucuacaagaacgagcaggaguuccuggccagcaacaucgagaacuucaaccaggccaccaccuccgagaagaucaacagccuggaggagcucaucacgcugcugcacgcgaacuccaccagcgcccaccucaucuucaacaacaucgagaagaaggccuucggccggaagacccacgggcugacccugaacgacacggacuucaucuaccaguccgugaccggccucuacgagacccgcauccacaucgaguga

SEQ ID NO: 1890 - RNA, 4071 nt, Artificial Sequence
  Cas9 variant
augagcaagaaggacuccgaguacuacaucggccuggacaucgggaccaacagcgugggcugggccgucaccaacgggaaguacgaccuccugaacaucaagaagaagaaccuguggggcgugcgccucuucgaggccgcggaguccgccgccgggcggcgcaucaaccggagcacgcgccggcgcuaccggcgccggcgcaaccggaucaacuggcugaacgagaucuucgccgacgagcuguccaagguggaccccagcuuccucacccgccugaacuccagcuggaucuccaagaaggacagcucccggacccgcgacaaguacaaccuguucauggacgccgacuacaccgacaagaacuaccaccacaaguacccgacgaucuaccaccuccggcgcgaccugauguucgacgacaagcaguucgacauccggcuggucuaccucgcgcugcacaacaucaucaaguaccgcggcaacuucaccuacgaccaccggaaguucaacgugagcgagauguccagcaaccugaccaaggcccucgagaacuucaaccaggagcugauggaguucgaggacgccuuccccgacaacaccgacuacuccgccaucagcgaggugcugcucaaguccaacaacgucagcacgaagaucgacgagaucaucuccaaccuggagcuggacaaggacaccaagaaguaccucaaggaggugcugaagcugauccucggcaacagcgcgaaccugaacaccaucuuccacaccagccuggacaaggacgacgagaagcucucccugagcgccaaggacaucgagcugaagcucaacaaccuggacucccugcucagcgacgagcagauccacuucaucuccagcgccaacgagcuguacuccagcaucacgcugaacgacauccucgacgggaagaccuaccugucccuggccaagaucaagcaguacgacacccacugcagcgaccuccaggagcugaaggagaugugguacaagaccacgaaccccgaccugaucaagaagucccgcaaggccuacaaggaguacgugcacggcagcuacaacaccgaggacuucuacaaggcgaucucccccuuccucaagaucgccaucccggaggaccuggccaaggacgcccugaagaagaucgacgccaacaccuaccuccccaagcagcggaccagcaacaacggggucauccccuuccagcugaaccugaucgagcucgagaagaucaucgacaaccaguccaaguacuaccccuuccugaaggagaaccgcgagaagaucaucagcauccuguccuuccgcaucccguacuacgugggccccauccaggcgcccacggacaagaacuucagcuggauggugaagaagauccaggccaaggcccggcccuggaacuucgacgaggucaucgaccgcgagaaguccagcaacaacuucaucaagcggaugaccaccaccgacacguaccuggugggggagccggugcuccccaagaacagccugaucuaccagaaguucgagguccugaacgagcucaacaacauccgcaucuccaagaaccugagccaggacccccugggcuccaagcucagcguggaggugaagcagcagaucuucgaggagcuguucaagcgguacaagaccgucaaguccgaccagcugaagaaguggcucauccgcaacagcuacuucaccgaccccaccaucaucggccuguccaagccgagcgaguucaacuccagccuguccacguucaucgacaugaaggccaucuucgggauggacuucgugaacaacccccggaacagcucccagcucgaggagcuggccgaguggcugaccguguucgaggacaagcagauccucagcgagaagauccgccacuccaacuaccccuacagcgaccagcagauccggaagaucuccaacaugcgcuaccggggcugggggcgcaucagcaagaagcugcugugcgacaucaaggucgagagcaccaucuacaagucccaccagcuccaccccuacagcauccuggaccugaugugguccaccaacaacaacuucuacagcauccuccacaaggacaaguacaacuucgaguccauccuggaggacuacaaccugggcacggacgacaagaccgacaucaacgagcucguggacaacauccacaccagcccggcgcugaagcggggcaucauccaguccaucaacaucgugaaggagcuggucaaguucauggggcacgcgccccagcacaucuuccucgaguucacccgcgaggacaagacgagcacccuguccgagagccggaagaagcgccugaagaagcucuacaacaaccuguccgaggacaccaagaaguucaagcuggaccuccgggacuaccuggugcccgacaagagcauccagaaggagcuggagucccacgacaaggaccucagcaaggagcgccugaugcuguacuuccuccagaacggcaagucccuguacagcgacgaggcccuggacaucaaccggcucuccgaguaccaggucgaccacauccugccccgcaccuacaucaaggacgacagccuggagaacaaggcccucgugcuggccaaggagaaccagcgcaaggccgacgaccugcuccugcagccguccaucaucaacaagaacauggagcgguggaucuacaugaaggaccacgggaugaucagccccaagaaguucaagaaccugacccgcacgaccaucaccgaggacgacaaggugcacuucaucaaccggcagcucguccagaccagccagaucaucaagaacguggccaacauccuggacaacauguacaaggagcagggcacgaccugcguggagaccaaggccaaccuguccagcgccuuccgcaccgcguucuccgagcaggacgacaaguaccacuucaagcaccccgaguucaucaagaaccgggacgucaacgacuuccaccacgcccaggacgccuaccucgccugccugcuggggcucuaccgcauccagcgguuccccagcgacgagaugcugcugaucaagaaggaguaccgcaaguucuucgcccaggcgcagaacuccgugaagaaccacggcaagaucccggacagccagaagaacggcuucauccucgcgccccuggugaacggggagacgcugaucaacaacaagaccauggagaccaucuggaacauggacuacaagcggaaggucaucaagaucuucaacuacaagcaguacaacaucaccaagcgcacggagaucaagaccggcgaguucuacaagcagacccucuacagcccccacgacgagaacgugaagaacccgaucccccagaagaagaaccuggaccccaagaucuacgggggcuacuccggggugcaguccagcuaccuggccaucaucaaggucgaccagaagaagcccaccaugguguccgugccgauccgguucagcaagaugaucgacgacggcaagcucucccugcagagcuggcuggagaacaacaucaagcacaagaagacgaucgagguccucaagaccaagauccccaucggccagcugaccuacaaccccaagaacggguaccuguccgugcagagcgagaaggagaucgccaacgcccagcagcuguuccuccccuucgagcacguggcccugcucacccugcugcacgccccgacguccgaguacgaccagauccucagcuucuacgacaccgacauccugcuggagaucuucgacgagaucaccaacaagaucaagaccuucuuccccuucuacaucgacgagcaggaguaccucgucuccauccgcgagaacuuccagagcgccacggugaucgagaaggugaacguccugcagcagcugcucaucaugcugcacgccaacagcucccggaucagcaucaagcugggcgagguguccaagaaggaccucgggcgcaagaagaagcggaucccccuggagaacaccgaccugguguaccagagcgucaccggccucuaccagaccaaguuccacaucgacuga

SEQ ID NO: 1891 - RNA, 4074 nt, Artificial Sequence
  Cas9 variant
augaacgaccgcaacaagaaguacaacaucggccuggacaucgggaccggcagcguggggugggccgucaccgacaacaacuacaaccuccugcacgccaagaagaagaaccuguggggcauccggcuguucgacggggcggagacggccgccucccgccggaccuuccgcagcacccggcgccgguaccgccggcgccggaaccgcaucaacuggcugaacgagaucuucgccgacgagcuggccaagaaggaccaguccuuccucgugcggaugaacagcuccugggugagcaagaaggacaagauccgccagcgggaccaguacaaccuguucauggacuccgacuacaccgacgucgaguaccaccgcgaguuccccacgaucuuccaccuccggaagcgccucaucgaggacaagagccaggcggacauccggcugguguaccuggcccuccacaacaucaucaaguaccgcggcaacuucaccuacgagcaccagaacuucgacgugucccacauggacagcggccuggcccugcuccugaaccagcugaaccagcagcuccaggccuucgaggucgcguucccggacgagaccaacuucgaguccaugagcaccauccugcuggagaagaagacgcccacccagaagaucgacgagaucguggaccagauccagcccgagaaggaccuccugcagaucaccaagaacaucaugaagaugcugcucgggaacaaggccgaccuggugaagaucuucucccuggacagcgacgacaagaucaccgucgaguucuccagcaacuccaucgagcaggaccucagcaaccuggaggagacgcuguccgacgagcaguucaacaucaucacccucgccaacagcaucuacagcuccaucgugcugaacgacauccugagcggcgagaccuaccucuccuucgccaaggcccggcaguacagcgaccacaagaaggaccuggcgaagcugaagaccauguggcgcgagucccccgaccgcaaggccguggggaaggccaagaaggccuacgacgacuaccuccacagcggcaaguacgggaucgaggacuucuacaaggacauguccaaguuccuggagacggccaccccggucgagcuggcgaaggaggccaacgagaagauccucaacaagagcuaccugcugaagcagcggaacaacgagaacggcgugauccccuuccagcucaacaagaacgagaugaucgagaucaucaacaaccaggccaaguacuaccccuuccuggccgagaacaaggacaagcugcucuccauccugagcuuccgcauccccuacuacgugggcccgcugcaguccaagaaggacaaccccuucgccuggauggagaagaagucccaggggaagauccggcccuggaacuucgacgagaucgucgaccgcgaggcgagcagcaacaacuucauccggcgcaugaccuccaccgacacguaccucaucggcgagcccgugcugccgcucaagagccccaucuaccagaaguacgaggugcugaacgagcuguccaacguccggaucaacgccgacgagguggacaacccccugggggacaagcugagcguggaccucaagcaggccaucuacaacgagcuguuccugaagcaccgcuccgucagcaaggcccuccugaccaaguggcugaucaaccagagcuacuuccagaacccccagaucuccggccucgccgacagcaagaaguucaacuccggccugaccaccuaccacgacuucaagaagaucuucggggaggacuucgugaacgacccgacgaaccagagccagcuggagcagcucgcggaguggcugaccaucuucgaggacaagaagauccugaagaucaagcucgacgacucccaguucaacugcacccccgagcagaucaagaagaucgccggcaugcgguaccagggguggggccgccugagcaagaagcugcucugcgacaucaagaccacgaccgugaccuccaagaaccaccagcaggccagcuacuccauccuggaccugauguggaacaccaaccggaacuucaucagcguccucaagaacgacacguacaaguucgaggacaagauccagaccuucaaccuggacaagaacgaggccgcgacgccccaggccaugaucgacgagcugcagaccucccccgcccucaagcgcgggauccggcagagcgugaccaucauccaggagcuggucaaguucaugggccacgccccggagcacaucuuccuggaguucacccgcgaggacgacguguccagccucaccaagucccgggacagccgccugaacaagcuguacgcccggaucgcgaagaacaccaagaagaccgacgacgagcucaagaagucccugcugcccagcagcgacaucaaggccacgcucaaggccaacaagaacaaccuguccaacgaccgccugaugcucuacuaccugcagaugggcaagagccuguacuccaaccagccccucgacaucaaccggcugagcgaguaccagaucgaccacauccugccccaguccuacaucaaggacaacagccucgagaaccgcgcccuggugcuggccuccgagaaccagcacaagagcuccgaccuccugcugaagccggagaucaucaaccagaacaucgcgcgcuggcgguacaugaaggacgccgggcucaugggccccaagaaguucaagaaccugacccgcauccagaucaccgacagcgaccagaacaacuucaucaaccggcagcugguccagaccucccagaucaucaagcacgugagcaacauccucgacuccauguacggggaccagggcacgcagugcguggagacccgcgcccaccugagcaccgaguuccggaaggccuucuccaacgaggacgacaacuaccacuuccagcaccccgaguucgucaagaaccgcaacaucaacgacuaccaccacgcccaggacgcguaccuggccugccuccuggggcuguaccagaugaagaaguaccccaccgacaacaugauccuccugaagaaggaguacaagcgguucuucagcaacacgaagaagaucuacgacaagaagcaccacuucccggacuacgugaagaacggcuggaucaucggcuccauguucaacggggagaaguacguggacgaggagaccggccagaucaucugggaccagcagaccaaggacauggucagcugcaucuuccaguacaagcaguacaacgugaccaagcgcacggaggccgccaacggggaguucuacaaccagaccguguacaagaaggaccccaacgagaagcggaagcugaucucccucaagcagggccuggacaccaagcuguacgggggcuacagcggcgacaaccccgcguacaucguccucgugaagaucgacgacaagaagaacaagcuggugaagaugccgauccgccuggccgagcaggucgacaacaagaccaucgaccuccagacguggcuggaggagaacgugccccacaagaaggggauccaggugcugaagaccaagaucccccucggccaggucaucuacagcaagaagaacggguaccuggcccugaaguccgacaccgagaucgugaacgcccagcagcucgugcugcccuacggcuacgucgcccugcucacccugcugcagaagaugccggagaacaaguacgacgaggugcucgcgugcuacgacgacggcauccuggacaacaucuucguggccaucaucgacaagaugaagcacuucuaccccuacuacagcggggagcugaagacgcucuccgacaacaucgacaacuucaaggagagccccgacgucaacaagaucaagacccugcagcagcugcuccugcugcuccacgccuccagcaccaccgccuccaucgaguucaacaacgugaagaagaacagccugggccggaagcccaacuccaucaacauccagaacacggaccugcucagcuucuccgccaccgggcuguacgagagccgcauccacaucgacuga

SEQ ID NO: 1892 - RNA, 4074 nt, Artificial Sequence
  Cas9 variant
auggccgccaagaacuacaacaucgggcuggacaucgggaccagcuccaucggcugggcgaucguggacgacaacuaccagcucaugcacgccaaggggaaguacggcuacgggacccgcaucuacagcgagggccagacggccgccgaccggcgcggcuuccggaccacccgccggcgccugaaccggcgcaaguggcggcugcgccuccugcaggacuucuucgagcccuacauccugccgcaggacgaggccuucuucauccggcagaagcaguccaaccucgucccccaggacaccaagaagcaguaccccgagagcgugcuguucgacgacacguccgacaaggacuucuacaccgaguaccccaccaucuaccaccuccgccaggcgcucaugaccgagaaccggcaguucgacauccgcgagguguaccuggccauccaccacaucgucaaguaccgggggcacuuccugaacaacgccccggugaagacguucaagagcggcaaccucgaccuggccaucaaguucaacgagcugaacgaggaguucaaguccguguaccccgaccucgagcugcaguucaaccuggaccagaucgacgagaucaagaagauccuccuggacagcaccaagucccgcuucgaccggcagggggaggcggucaagcugaucuacaccgugagcgaggugaagaccaucgagaagcuccagaacaagaucgucaagcaguuccuguccggcauccuggggcucaacacgcgcuucgacgugcugaccaacaccgagagcgacgacuccauguggaaguucagccuggacuccgagagcuccgacgacgcccucgacgagaucaucgcccagcuggacgaccccgccauccacguggucgagcuggugaacgagauccacagcuccaucacccucgccggcaucgugcccgagggccaggggcugagcgagagcauggucgagaaguacgaggcgcacaaggcccaccuccagcuccugaaggccguggagaagcugguggacaagaaggccgccgacaagcucgaggucgcguacgaccaguacaucaacggcaaggacuccaagcaguucaucaaggaggacuucuacaaggccgugcagagcgagaucaaggggguggccggcgacgaggucgccgagaucaaccagcugaucgagcuggaccaguucaugccgaagcagcggacgaaggagaacggcgccaucccccaccagcuccaccagcacgagcuggacgugaucaucgagaaccaguccaaguacuacgacuggcugggggagaaggugggcaacgaguacaagcucgacaagcuggucagcuuccgcgugcccuacuacgucgggccccugguggacaccgcguccaaggagaagaaggacgagacccgguucgccuggauggugcgcaagaacccggagagcaccgaggccaucacgcccuggaacuucgaggacaucgucgacaagaacgccuccgccgagaacuucaucaagcgcaugaccaccaaggacaaguaccuccugaacgaggacgugcugcccaagugcagccuccugacccaggacuucgagguguacaacgagcugaacaacauccgggucaacggcgagaaguucacggcggagcagaagcagcugauccacgacgagcuguucaccaagcacgccuccgugagcaucaagcagcugaaggacuuccugguguccgagcucauguacguccgcgacaaccugaagguggaggggcuggccgacgagaagaagcucaugagcucccugagcacccaguucgacuaccagaagaucauccccgaccagaucaacgacgugaaguaccgggaggacaucgagcagaucaucgagugguccaccaucuucgaggacgccgcgaucuucaagacgaagcugaaggagaucgacuggcucaccgacgagcagcgcaacaagcuggccaacaagcgguaccgcggcuggggcagccuguccaagcggcuccuggccugccuggucgacgagaacgggcagcgcaucaucgacauccuccgggacagcuccgacaacuucaugaugaucgugaaccgcccggaguucaagcaggccaucuucgacgagaacgccaaccugaccgagaccaacagcaagaaggacauguucgagaugaucgacaacuucuacacgagcccccagaacaagaaggcgauccgccaggugcugcucgucgugcaggacauccagaacgccaugggcgggguggcgccccagaagaucuucaucgaguucgcccgggaggacgaggucaacggccggcgcaccaacucccgguacagccagauccgcgagauguacuccaaggugaccgacgacgugaucaacaagaccguccgcggggagcuggaggccaacaagggcagccugaacaaggagaagcuguuccuguacuuccugcagggcgggaucgaccucuacuccggcaagacgaucaacaucgacaacaucagcuccuacgacguggaccacgugcugccccagagcuucaucaaggacgacuccaucaacaacaagguccuggugaacgccaaggggaaccgggugaagaacgacaacgucccgauggagcuguucggcgccaagauguaccccaccuggaagcggaugguggacaccgggaucaugagcaaggccaaguucaagaaccucacccugaaccccgacaacguggacaaguucaaggccgagggcuucaucaaccgccagcucgucgagacccgccagaucaucaagcugguggcccagauccugaacgacaagcucggcgacgacacgaagaucguguccgucaaggcgaaccugacccacgacaugcggguguucuucgacuuccccaagaaccgcaacgugaacaacuaccaccacgccuucgacgccuaccugagcgccuucgucgggaccuaccucuacaagcgguacccgaagcugcagcccuacuucguguacggcgaguucaagaagauggacaagcugaagaacaugaccuccuucgacuuccuccgcgaccugaagcacacggacaagguggucgacaaggacaccggggagaucaucgcggacaagcuggccgugaucaccaacaugaacaagaucuacgacuucaagaaggugcucgucacccacgaggugcacgagaacagcggcgccauguacgaccagacgcuguaccccgccaagcuggacaagucccucggccggaagggggccaagcagcugauccccaagaaggacgacaugccgaccgcgcuguacggcggguacaccggcagcaaggacgccuucauguccaucgugcgccucaagaagaaggacgaggucuacuacaaggugaucgggauccccgugcggaucgccgacagcguccagcacggcaaggagguggacguggaggcccugacccaguucaucgagacgaaguucaccaaggagaaccugaacaagaagaccggcgagaucacccgcaaggucgagugguucgagcucgugcugcccaagguccuguucgggcaggccguguucgacggcgggcagccguucaugcucggcagcuccacguacccccacaaccugcgggagcuggugcucaccaaggacagcgucaagaagaucgcggggaaggaguccaacaagagcuaccuggacgccuacgacgagaucauggaggccaugaacaaguacuucccccuguacgacaccaacaaguuccgcgagaaggugaucgagggccgguccaaguucaucgaccuccccgacaaggacgaguacgagaacaacaagcuggugcaggucggcaagagcaccaucaucgaccgcauguucaucgggcugcacgccaacgccgcgcggacggaccucaagaacaucggcaucaccaccccguucggguucaugcagcaggccuccggcaucaagcugaccaaggacacgguggugcuguuccagagcuccaccggccucuucgagcgcaaggucgcccugaaggaccuguga

SEQ ID NO: 1893 - RNA, 4077 nt, Artificial Sequence
  Cas9 variant
augaaggagcccuacggcguggggcuggacaucggcaccaacagcgucggguggaccgugguggacgccuccggccacguccgcaagaucaaggggcagacgggcaucggcgugcggcuguucaaggagggggccgcggccgccgaccgccggggcuuccgcaccacccggcgccggcugaagcgcgugaaguggcggcugcgccuccugcgggaguucuucgaccagccgaucagcaaggucgacaucaacuucuucgcccgccggaaguacuccgacgugagcccccgcgaccccaacuacaacgggcuggagaagacccucuucaacgaccgguccgaccaggacuucuaccacgacuaccccacgaucuaccaccuccgcgaggcccugaugacccagcaccggaaguucgacgugcgcgagaucuaccucgcgauccaccacaucgucaaguaccggggcaacuuccugcgcaacgacgccgccaccgccuaccggagcgggacccuggaccuccagcagcacuucgagacgcugaaccaccuguucucccaggcggaccucgagcugaaccugaaccucaccaccgacguggcccugcuggacagcaucaagcagacccucgugcgcacggacaucucccgcagcgaccggcagaagcugaucaugccgcugcucgccguccugaccggcgccaccaccgccgagaagaagcgccagaaggcgguggugacggaguucgccaaggcccuggucggcaacaagaccaagaucgacgugcucacccugaccgacaucgacgccacggaggccaaggacugggcguucucccuggaggagaaccaggacaagcuccccgggaucgaggaccgguucagcgaggugggccagcagaucaucgacgaggucauccgccuguacgccuccgugaaccuggcccagcucauccccgaggggaagcgguucagccaguccaugguggagaaguacaagcgccacggcgaggaccugaagcugcucaaggccuacauccggagccaguccgacgccaagcgcggccgggcgauccgcgccaccuacgaccaguacaucgacggggucaagagcaagcaggucacccaggaggccuuccagaaggcccugggcaaguucguggacgccgacguggaccugaacuccugggcggcccagaucaagcaggccaucgacagcgagcaguucaugcccaagcuccggaccaagcagaacggggccaucccguaccaggugcagcagaacgagcuggaccagaucaucagcaaccagaaggaguacuaccccuggcugggcgaggagaaccccgucaucaagcgccgggggaaguuccccuacaagcucgacgagcuguucggcuuccgcgugccguacuacgugggcccccugaucacgaaggagaugcaggcggccaccgccaacgccggguucgccuggaugguccggaaggcggacggccccaucacccccuggaacuucgacgacaagguggaccgcguggccuccgccaccgccuucauccagcggaugcagacgaccgacaccuaccucaucggggaggagguccugccggcccgcagccugaucuaccagcgguucauggugcucaacgagcugaacaacauccgcguggacgacggccagcugacgccccgccagaagcagcggcuguacaaccaggucuucaagaagcacaagcgcgugaccgcgaagaacauccaggacaaccucguggccgcccgggaguuccccaccgcgccccgcaucaccgggcuggccgacccgaaggucuucaacuccagccuguccaccuaccacgaccucaagcagguccugcccgaggccaugagcgacgugcggaagcaggccgacaucgagaagaucauccugugguccacgaucuucgaggacagcaccaucuucaagcagaagcucaccgagaucuccuggcugaccgccgcccagcugaagcagcucggccagcugcgcuaccggggcugggggcagcugcuccgcaagcugcugaccggccucaaggacgacaacaaccggagcaucauggacgggcugugggagacgaacgcgaacuucaugcagcugcgcucccagcccgccaucgagaaccagaucaagagcgccaaccaggccaaccucaccaccgccgaccugcaggacaccaucaacgagcuguacacgagcccccagaacaagaaggcgauccgggaggugaugguggugcucgccgacaucaaggacgccaugcacggccagaccccgaacuggaucuucgucgaggccgcccgcgggggcggcguggcggggcggcgcacccagucccgguccaagcagaucguggccgccuaccagggcaccgcccaggccaucguccgcgaccaggugcagcgggagcugaaggagaagaucaagaacaaggcgaacuucaacacgcgccuggugcucuacuuccugcagaacgggcgggaccuguacaccggcgacgccaucaacaucgaccgccucagcgaguacgacaucgaccacauccugccccagucccuggucaaggacgacagccucgacaaccgggugcugaccaacgcccgcaucaaccgcgagaagaacgacaccuucgccuccgagaaguucggcaagaagaugggggcgaaguggaaggagaugcaccggaugggccugaugacgaagcgcaagcucgaccaccuccugaugcggcccgacgagaucagcaaguacgccaccggguucaucaaccgccagcugguggagacccggcaggucaucaagcugguggaggagcugaucaacgccgaguaccccagcaccgccaucguguccgucaaggccaaccucacgcaccaguuccgccagaccuucgacuucccgaagauccgggaggugaacgacuaccaccacgcguucgacgccgcccugaccgccuucaucggcaccuaccugcucaagcgcuaccccaagcuggagcgguucuucguguacgggaaguucgccaagcagcccgucaaccugacgcgcuucaacgugauccggaagcucgcgaagaccgacaccccgaucaccgacaucgacacgggcgaggugcugugggacaagcugaccgacaucaaguacuucgagacccucuacgacuacaagcgccugcuggucacccgggaggugagcgagaacuacggcgccauguucgaccagacgcuccugaaggccuccgacaacgggaagcgccugauccggaagaagcagagcuucgacaccgccaucuacggcggguacaccggcaagacccucgccuacauggcgaucgugaaggucuccacgaagaaggacgugcaguaccagguggucggggugcccaccaccauggugacccagaucgagcagcuggagcagcagggcaugacgaacaagcaggccgucaccaaggugaucgagccccugaucgccgccaacaacaagaagaugcucaccuacgaggugcugcugcccaagguccgcuucgagcaggucgugcgggaccgcaucaagggccagacccaccgguucgcccucgggaccgacacguacuaccacaacauccaggagcuguaccugccgcucacccugcagcgcgcguuccugggcaagcagaacgagagcgaggugcagcucaaccagaaccugcugaccguguucgacgccacccucgcccaggucaaccgcuacuucccccuguacgagaugaacaaguucaagaagauccugaacuccgcccgggaccagaucgagcuccuggaggcgaagaaccaguucgugaagaacaagcuggugcucgggaagcagggcauccugacgaacauguucaucgggcugcacgccaacgccagcuacggcgaccucaagguccugggcgugaagaucgacuucgggaagcuccaggugcccggcgggaucaagcugaccggcgacgccgagaucaucuaccagucccccaccgggcuguucgagcgcaagaucgcccugaaggaccucuga

SEQ ID NO: 1894 - RNA, 4077 nt, Artificial Sequence
  Cas9 variant
augaacgagcccuacggcguggggcuggacaucggcaccaacagcgucggguggaccgugguggacaugaacggccgcguccggaaggugaaggggaagacggcccucggcgcccgccuguucaaggagggcgcgaccgccgaggaccggcgcggguuccggaccacccgccggcgccugaagcgggugaaguggcgccuccggcugcugcgcgaguucuucgaccagccgaucuccaagaucgaccccaacuucuucgcccggcgcaaguacagcgacaucagcccccgggaccccaacuacaacggccucgccaagacgcuguucaacgaccgcaccgaccaggaguucuaccacgacuacccgaccaucuaccaccuccgggacaagcugaugaccuccgaccgcaaguucgacauccgggagaucuaccuggccauccaccacaucgucaaguaccgcgggaacuuccugcggacgggccccgcgucccaguacgggagcgccucccuccaccuggccaccagcuuccagaagcugaacgaccucuucgcccaguccgaggagagccugaacuucaagcuggugaccgacgaggcgcagcuccagcagauccagcagauccuggugcgcaccgaccugucccgcagcgagcagcagcggcagaucuggccccucauggucgugcugaugggcgccacggccgccgagaagaagcgccagaaggacuucgccaaggagcuggcgaacgcccucgugggccugaaggccaagcugaacgucgugacccucaccaacguggacaccacggucgugaaggacuggaccuucacccuggaggagucccaggacaagcugcccgagaucgaggagcagcucagcgagguggggcagcagaucauggacgaggucauccagcuguacgccuccgugaaccuggcccagcucaucccggcgggcaagcgguucagccagcacaugguggagaaguacaaccaccacgagaagaaccuggagcugcucaaggccuacauccacucccagagcgacuccaagcgcgggcgggagauccgcgccaccuacgaccgguacaucgacggcgucaagagcaagcccgugacgcaggagauguucuacaaggaccugaugaaguacguggaggccgacgccaccagcaaccaccuggcggccgagaucaaggacgagaucgacuccgagcaguucaugcccaagcuccgcaccaagcagaacggcagcauccccuaccagguccagcaguacgagcuggaccagaucaucucccaccagaagaaguacuacccguggcugggggaggagaaccccguggccgagcggcgcggcaaguuccccuacaagcucgacgagcuggucggguuccgggugcccuacuacgugggcccgcugaucaccaaggaggaccagcaggccacgagcggggccggcuucgcguggaugguccgcaaggccgacggccccaucacccccuggaacuucgaccagaagguggaccggaucgccuccgccaccgcguucauccagcgcaugcagaccacggacaccuaccucaucggggaggacgugcugcccgcccggagccugaucuaccagcgcuucaugguccucaacgagcugaacaacaugcggguggaggaccagaagcuggccccgcgccagaagcagcggcuguacaaccagguguucaagcagcaccagcacgucuccgugaagaacauccagcagaaccucauggacgccggcgaguaccgcgagacccccaagaucaccgggcuggccgaccccaagggcuucaacagcucccugagcacguaccacgacuucaagaagauccuccccgaggcgaucgccgacgagcacaagcgcgccgacaucgagaagaucauccugugguccaccaccuucgaggacagcgccaucuucaagcagaagcuggaggagguggccuggcucaccgacgcgcagcggaagcagcuguccgggcugcgcuaccggggcuggggccagcucagccacaagcugcugacggccuucaaggacgacaacgggcgcuccgucauggacggccucugggagaccagcgacaacuucaugcagcugcggaagcagccggccaucgagacccagaucaaggaggccaaccaggccaaccugaccgacgcggacauccaggacaccaucaacgagcucuacacgagcccccagaacaagaaggccauccgcgaggugaugcuggugcuggacgacaucaagaacgccaugcacgggcagacccccuccuggaucuucaucgaggccgcgcggggcgggggcgucgccggccgccggacccagucccgcagcaagcagaucguggaggccuacaagagcaccgccaaggagaucguguccgagaagguccagcacgagcucaacgagaagaucaaggccaaggcggacuucaacacgcggcuggugcuguacuuccuccagaacgggcgcgaccuguacaccaacgaggccaucaacaucgaccggcugagcgaguacgacaucgaccacauccucccccagucccuggugaaggacgacagccuggacaaccgcguccucaccuccgcccggaucaaccgcgagaagaacgacaccuucgccagcgagaaguucggccggaagaugggggcccaguggcgcgagcugcaccggaacggccugaugacgcagcgcaagcucaagcaccuccugaugcggccggacgagaucuccaagcacgcgaccgacuucaucaaccgccagcugguggagacccgccaggugaucaagcuggucgaggagcugaucagcuccgaguaccccagcgccuccaucguggccgugaaggccaaccucacccaccaguuccggcagacguucaacuuccccaagcugcgcgaggucaacgacuaccaccacgccuucgacgcgagccugaccgccuucaucggcauguaccuccugaagcaguacccgaagcuggagcgguucuucguguacgggaaguucgccaagcagcccaucaaccucacccgcuucaacgugauccggaagcuggccgucgcggaggagcccaucgccaacaucgagaccggcgagauccugugggacaagacggccgacaucaagugcuucgagaagcucuacaacuacaagcgccugcuggugacccacgaggugcgggagaacuacggggccauguucgaccagaccaucuucaaggccaccgacucccgcaagcggcucauccagaagaagaagggcuucgcgacggagaccuacgggggcuacaccggccgcacccuggccuaccuggccaucgucaagguggugacgaacaaggacacccaguaccaggucguggggauccccaccaccauggugacgcagauccagcagcucgaggccagcggccugaccuccaagcaggccgucaccaaggcgaucggggccaugaucaacgagaacaacaagaagcugcagagcuacgaggugcuccugccgaaggugcgguucgagcaggucgugcgcgacgaggugaagggccacauccaccgguucgcccuggggaccgacacguacuaccacaacauccaggagcucuaccugccccugaccauccagcgcgccuuccucggcaagcggaacgacaccgacgcccagaccgagcagaaccugcugacggucuucgagaccacccucgcccaggugaaccgcuacuucccccuguacgagaugaacaaguucaagcagauccugaacuccgcgcaggagaaguucgccgcccuccccaccaagaacaagaccgugaagaacaagcuggucacgggcaaggacggggugcugaacaaccucuucaucggccugcacgccaacgcgagccugggggaccucaagauccugggcaugaagaccggguucggcaagcuccaggugccgggcgggcugaagcugaccgaccaggccgagaucaucuaccagagccccaccggccuguucgagcggaaggucgcccucaaggaccuguga

SEQ ID NO: 1895 - RNA, 4077 nt, Artificial Sequence
  Cas9 variant
augaacgagcccuacggcguggggcuggacaucggcaccaacagcgucggguggaccgugguggacaugaacggccgcguccggaaggugaaggggaagacggcccucggcgcccgccuguucaaggagggcgcgaccgccgaggaccggcgcggguuccggaccacccgccggcgccugaagcgggugaaguggcgccuccggcugcugcgcgaguucuucgaccagccgaucuccaagaucgaccccaacuucuucgcccggcgcaaguacagcgacaucagcccccgggaccccaacuacaacggccucgccaagacgcuguucaacgaccgcaccgaccaggaguucuaccacgacuacccgaccaucuaccaccuccgggacaagcugaugaccuccgaccgcaaguucgacauccgggagaucuaccuggccauccaccacaucgucaaguaccgcgggaacuuccugcggacgggccccgcgucccaguacgggagcgccucccuccaccuggccaccagcuuccagaagcugaacgaccucuucgcccaguccgaggagagccugaacuucaagcuggugaccgacgaggcgcagcuccagcagauccagcagauccuggugcgcaccgaccugucccgcagcgagcagcagcggcagaucuggccccucauggucgugcugaugggcgccacggccgccgagaagaagcgccagaaggacuucgccaaggagcuggcgaacgcccucgugggccugaaggccaagcugaacgucgugacccucaccaacguggacaccacggucgugaaggacuggaccuucacccuggaggagucccaggacaagcugcccgagaucgaggagcagcucagcgagguggggcagcagaucauggacgaggucauccagcuguacgccuccgugaaccuggcccagcucaucccggcgggcaagcgguucagccagcacaugguggagaaguacaaccaccacgagaagaaccuggagcugcucaaggccuacauccacucccagagcgacuccaagcgcgggcgggagauccgcgccaccuacgaccgguacaucgacggcgucaagagcaagcccgugacgcaggagauguucuacaaggaccugaugaaguacguggaggccgacgccaccagcaaccaccuggcggccgagaucaaggacgagaucgacuccgagcaguucaugcccaagcuccgcaccaagcagaacggcagcauccccuaccagguccagcaguacgagcuggaccagaucaucucccaccagaagaaguacuacccguggcugggggaggagaaccccguggccgagcggcgcggcaaguuccccuacaagcucgacgagcuggucggguuccgggugcccuacuacgugggcccgcugaucaccaaggaggaccagcaggccacgagcggggccggcuucgcguggaugguccgcaaggccgacggccccaucacccccuggaacuucgaccagaagguggaccggaucgccuccgccaccgcguucauccagcgcaugcagaccacggacaccuaccucaucggggaggacgugcugcccgcccggagccugaucuaccagcgcuucaugguccucaacgagcugaacaacaugcggguggaggaccagaagcuggccccgcgccagaagcagcggcuguacaaccagguguucaagcagcaccagcacgucuccgugaagaacauccagcagaaccucauggacgccggcgaguaccgcgagacccccaagaucaccgggcuggccgaccccaagggcuucaacagcucccugagcacguaccacgacuucaagaagauccuccccgaggcgaucgccgacgagcacaagcgcgccgacaucgagaagaucauccugugguccaccaccuucgaggacagcgccaucuucaagcagaagcuggaggagguggccuggcucaccgacgcgcagcggaagcagcuguccgggcugcgcuaccggggcuggggccagcucagccacaagcugcugacggccuucaaggacgacaacgggcgcuccgucauggacggccucugggagaccagcgacaacuucaugcagcugcggaagcagccggccaucgagacccagaucaaggaggccaaccaggccaaccugaccgacgcggacauccaggacaccaucaacgagcucuacacgagcccccagaacaagaaggccauccgcgaggugaugcuggugcuggacgacaucaagaacgccaugcacgggcagacccccuccuggaucuucaucgaggccgcgcggggcgggggcgucgccggccgccggacccagucccgcagcaagcagaucguggaggccuacaagagcaccgccaaggagaucguguccgagaagguccagcacgagcucaacgagaagaucaaggccaaggcggacuucaacacgcggcuggugcuguacuuccuccagaacgggcgcgaccuguacaccaacgaggccaucaacaucgaccggcugagcgaguacgacaucgaccacauccucccccagucccuggugaaggacgacagccuggacaaccgcguccucaccuccgcccggaucaaccgcgagaagaacgacaccuucgccagcgagaaguucggccggaagaugggggcccaguggcgcgagcugcaccggaacggccugaugacgcagcgcaagcucaagcaccuccugaugcggccggacgagaucuccaagcacgcgaccgacuucaucaaccgccagcugguggagacccgccaggugaucaagcuggucgaggagcugaucagcuccgaguaccccagcgccuccaucguggccgugaaggccaaccucacccaccaguuccggcagacguucaacuuccccaagcugcgcgaggucaacgacuaccaccacgccuucgacgcgagccugaccgccuucaucggcauguaccuccugaagcaguacccgaagcuggagcgguucuucguguacgggaaguucgccaagcagcccaucaaccucacccgcuucaacgugauccggaagcuggccgucgcggaggagcccaucgccaacaucgagaccggcgagauccugugggacaagacggccgacaucaagugcuucgagaagcucuacaacuacaagcgccugcuggugacccacgaggugcgggagaacuacggggccauguucgaccagaccaucuucaaggccaccgacucccgcaagcggcucauccagaagaagaagggcuucgcgacggagaccuacgggggcuacaccggccgcacccuggccuaccuggccaucgucaagguggugacgaacaaggacacccaguaccaggucguggggauccccaccaccauggugacgcagauccagcagcucgaggccagcggccugaccuccaagcaggccgucaccaaggcgaucggggccaugaucaacgagaacaacaagaagcugcagagcuacgaggugcuccugccgaaggugcgguucgagcaggucgugcgcgacgaggugaagggccacauccaccgguucgcccuggggaccgacacguacuaccacaacauccaggagcucuaccugccccugaccauccagcgcgccuuccucggcaagcggaacgacaccgacgcccagaccgagcagaaccugcugacggucuucgagaccacccucgcccaggugaaccgcuacuucccccuguacgagaugaacaaguucaagcagauccugaacuccgcgcaggagaaguucgccgcccuccccaccaagaacaagaccgugaagaacaagcuggucacgggcaaggacggggugcugaacaaccucuucaucggccugcacgccaacgcgagccugggggaccucaagauccugggcaugaagaucggguucggcaagcuccaggugccgggcgggcugaagcugaccgaccaggccgagaucaucuaccagagccccaccggccuguucgagcggaaggucgcccucaaggaccuguga

SEQ ID NO: 1896 - RNA, 4077 nt, Artificial Sequence
  Cas9 variant
augaaggagcccuacggcguggggcuggacaucggcaccaacagcgucggguggaccgugguggacgccuccggccacguccgcaagaucaaggggcagacgggcaucggcgugcggcuguucaaggagggggccgcggccgccgaccgccggggcuuccgcaccacccggcgccggcugaagcgcgugaaguggcggcugcgccuccugcgggaguucuucgaccagccgaucagcaaggucgacaucaacuucuucgcccgccggaaguacuccgacaucagcccccgcgaccccaacuacaacgggcuggagaagacccucuucaacgaccgguccgaccaggacuucuaccacgacuaccccacgaucuaccaccuccgcgaggcccugaugacccagcaccggaaguucgacgugcgcgagaucuaccucgcgauccaccacaucgugaaguaccggggcaacuuccugcgcaacgacgccgccaccgccuaccggagcgggacccuggaccuccagcagcacuucgagacgcugaaccaccuguucucccaggcggaccucgagcugaaccugaaccucaccaccgacgucgcccugcuggacagcaucaagcagacccucgugcgcacggacaucucccgcagcgaccggcagaagcugaucaugccgcugcucgccgugcugaccggcgccaccaccgccgagaagaagcgccagaaggcggucgugacggaguucgccaaggcccuggugggcaacaagaccaagaucgacguccucacccugaccgacaucgacgccacggaggccaaggacugggcguucucccuggaggagaaccaggacaagcuccccgggaucgaggaccgguucagcgaggugggccagcagaucaucgacgaggugauccgccuguacgccuccgucaaccuggcccagcucauccccgaggggaagcgguucagccaguccaugguggagaaguacaagcgccacggcgaggaccugaagcugcucaaggccuacauccggagccaguccgacgccaagcgcggccgggcgauccgcgccaccuacgaccaguacaucgacggggugaaguccaagcaggucacccaggaggccuuccagaaggcccugggcaaguucguggacgccgacguggaccugaacuccugggcggcccagaucaagcaggccaucgacagcgagcaguucaugcccaagcuccggaccaagcagaacggggccaucccguaccagguccagcagaacgagcuggaccagaucaucaacaaccagaaggaguacuaccccuggcugggcgaggagaaccccgugaucaagcgccgggggaaguuccccuacaagcucgacgagcuggucggcuuccgcgugccguacuacgugggcccccugaucacgaaggagaugcaggcggccaccgccaacgccggguucgccuggaugguccggaaggcggacggccccaucacccccuggaacuucgacgacaagguggaccgcguggccagcgccaccgccuucauccagcggaugcagacgaccgacaccuaccucaucggggaggagguccugccggcccgcucccugaucuaccagcgguucauggugcucaacgagcugaacaacauccgcguggacgacggccagcugacgccccgccagaagcagcggcuguacaaccaggucuucaagaagcacaagcgcgugaccgcgaagaacauccaggacaaccucguggccgccggggaguuccccaccgcgccccggaucaccggccuggccgacccgaaggucuucaacagcucccugagcaccuaccacgaccucaagcagguccugcccgaggccauguccgacgugcgcaagcaggccgacaucgagaagaucauccuguggagcacgaucuucgaggacuccaccaucuucaagcagaagcucaccgagaucagcuggcugaccgccgcccagcugaagcagcucggccagcugcgguaccgcggguggggccagcugucccggaagcuccugaccgggcugaaggacgacaacaaccgcagcaucauggacggccucugggagacgaacgcgaacuucaugcagcugcggucccagcccgccaucgagaaccagaucaagagcgccaaccaggccaaccugaccaccgccgaccuccaggacaccaucaacgagcuguacacgagcccccagaacaagaaggcgauccgcgaggugaugguggugcuggccgacaucaaggacgccaugcacgggcagaccccgaacuggaucuucgucgaggccgcccggggcggcgggguggcgggccgccggacccagagccgcuccaagcagaucguggccgccuaccaggggaccgcccaggucaucgugagcgaccaggugcagcgggagcucaaggagaagaucaagaacaaggccaacuucaacacgcgccugguccuguacuuccuccagaacggccgggaccuguacaccggcgacgcgaucaacaucgaccgccuguccgaguacgacaucgaccacauccucccccagagccuggugaaggacgacucccuggacaaccgggugcucaccaacgcccgcaucaaccgggagaagaacgacaccuucgccagcgagaaguucgggaagaagaugggcgccaaguggaaggagaugcaccgcauggggcugaugacgaagcgcaagcuggaccaccuccugaugcggcccgacgagaucagcaaguacgcgaccggcuucaucaaccgccagcuggucgagacccgccaggugaucaagcucguggaggagcugaucaacgccgaguaccccuccaccgccaucgucagcgugaaggccaaccugacgcaccaguuccggcagaccuucgacuucccgaagauccgggaggugaacgacuaccaccacgccuucgacgcggcccucaccgccuucaucgggaccuaccugcugaagcgcuaccccaagcucgagcgguucuucgucuacggcaaguucgccaagcagcccgugaaccugacgcgcuucaacgugauccggaagcuggccaagaccgacaccccgaucaccgacaucgacacgggcgagguccucugggacaagcugaccgacaucaaguacuucgagacccuguacgacuacaagcgccuccuggugacccgggagguguccgagaacuacggggcgauguucgaccagacgcugcucaaggccagcgacaacggcaagcgccugauccggaagaagcaguccuucgacaccgccaucuacgggggcuacaccgggaagacccuggccuacauggccaucgucaaggugagcacgaagaaggacgugcaguaccaggucgugggcgugcccaccaccauggucacccagaucgagcagcucgagcagcagggcaugacgaacaagcaggcggugaccaaggugaucgagccccugaucgccgccaacaacaagaagaugcugaccuacgagguccuccugcccaaggugcgcuucgagcaggucgugcgggaccgcaucaaggggcagacccaccgguucgcccugggcaccgacacguacuaccacaacauccaggagcucuaccugccgcugacccuccagcgcgccuuccuggggaagcagaacgaguccgaggugcagcugaaccagaaccuccugaccgucuucgacgcgacccuggcccaggugaaccgguacuucccccucuacgagaugaacaaguucaagaagauccugaacagcgcccgcgaccagaucgagcugcucgaggccaagaaccaguucgugaagaacaagcugguccugggcaagcaggggauccucacgaacauguucaucggccugcacgcgaacgccuccuucggcgaccucaagagccugggggugaagaccuccuucggccagcuccaggugcccgggggcaucaagcugaccggggacgccgagaucaucuaccagagccccaccggccuguucgagcgcaagaucgcccugaaggaccuguga

SEQ ID NO: 1897 - RNA, 4077 nt, Artificial Sequence
  Cas9 variant
augaagcagggcaagcgcggguacuaccugggccucgacaucgggaccgacagcaucggcuacgccgugaccgacgagcaguaccaccuccugcgguuccacgggaacgacgccuggggcucccacgucuucgacagcgcgucccucugcgacgagcgccggggcuuccgcagcgcccggcgccggcuggaccgccggcagcagcgcgugaagcugcuccaggagaucuucgccaaggagaucgccaacaucgacccccgguucuucauccgccuguccgagagcuaccgguggcgcgacgacacggacgaccgguacaucuacuucaacgaggaggaguacaccgacauccaguacaugcgcgacuacccgaccauccaccaccugaucugcgagcucauggagaacgaggaggagcacgacauccggcugguguaccuggccugcgcguggcucgucgcccaccgcgggcacuuccugucccagcugagcguggacaacaucgacucccucaucgacaucgagagcguguaccagaaguuccugcacuucuucaucgacaacggcugcgagaaccccuggauccaggacgccgagcuggucgggggcauccucaaggagcacaucggggugaccgagaagcacaaccggcugggcgagaucaugcugggcaaccgcaagcccuccaaggacgugcgggacacguuccucuacagcgaguacugcaucauccgccugcuggccgggggcacgugcaagcuccgcgaccuguacgggaaggaggaguacgaggacuucggcuccgucagccuggagauggacgacgacaagcucgcggagaucaugaucaacaucggcgaggacuacgagcugaucgccgugcugcggucccuccacgacuggagcgugcuggccgacauccuggacgggcagaacggccucaccaacaucuccaccgccaaggucgccaucuacgagcagcacaagaaggaccuggcgacgcugaaguacuucauccgcaaguacugccccgagaaguacaacgccaucuucaaggacgcccgggaggacaacuacguggccuacagcuaccacuacaacaacaagcucgacgggcagaucaagaagaaggccgacaccgagaccuucuccaaguuccugaucaagaucauccacagcaucaagccggacaaggaggacgagaucaucuaccaggacauggacaaccgccugggccuccggcaguuccugcccaagcagcgcaacaccgacaaccgggugaucccccaccagcuguacgaguacgagcucaagaagauccuggagaacgcggccaaguaccugagcuuccucaaccagaaggaggacgggaucuccaacacggagaagaucaucagcaucuucaaguucaagauccccuacuacgucggcccgcugaacaagcacuccgaguucgccuggaucgaccgcaagagcggcaagauccugcccuggaacuacgagaacaugaucgacgacgacgccuccgaggaggccuucaucaagaagaugaccaaccagugcaccuaccuccccggggagagcgugcugcccaaggacucccugugcuaccagaaguucauggugcugaacgagaucaacaacaucaaggucgacggccggaagaucagcgugggggcgaagcagggcaucuacuccgaccucuuccugaaguacaagaaggugaagcgcagccagaucgaggaguaccugaucuccaacgggcagcucgagaagaaccggcgcgagacccugagcggcaucgacauccagaucaaguccagccuguccagccacaucgccuuccggcgccuccuggagcagaagauccugaacgaggccgacgucgagcggaucaucgagcgcgccuccuacgccgaggacaagggccggguggcgaaguggcuccgcgccaaguacccgcaccugacggaggccgacaucaaguacaucugcaaggugaagaucaaggacuucgggcggcugagccgcaccuuccucaccggcaucgagggggccugcaaggagaccggcgaggucgcgacgaucaucuccaugaugugggagagcaacgacaaccugauggagcugcucagcgagcgcuacaccuucgccgacaccauccuggaguucaaguccgacuacuacaccgagcggaagcagacgcugagcgagcgccucgacgagauguacguguccaacgccguccggcgccccaucuaccggacccuggacaucgugaaggaccuggagaaggccuucgggaagcccgagaagaucuucaucgagaugacccgcggcgccaugcccgagcucaagggcaagcggaccaagagccgccagcagcagcugcuggaguacuacgacaagugcaaggaggaggacgugcgggaccucaagcagcagcuggaggcgcugggggaguacgucgacaacaagcuccaguccgaccgccuguuccuguacuucaugcaguucggcaagugcgccuacagcgggaugccgaucucccucgagcggcugauggccggcagcaaggaguacgacaucgaccacaucuacccccaggccuacgugaaggacgacuccaucaucaacaacaaggugcugguccucagcguggccaacggcgagaagaaggacguguaccccaucaaguccgagauccgcaacaagaugcagaagacguggagcuucuggcaccacgucgggaccaucuccgacgagaaguacaagcggcugauccgcagcacccccuucaccgaggacgagaaguacggcuucaucaaccggcagcugacggagaccucccagagcaccaaggugguggcggagcuccugaaggagcgcuacccggaggccgagaucgucuacuccaaggccgggcugaucagcgacuuccggcacgaguucgaccucuacaagagccgcuccuacaacgaccugcaccacgccguggacgccuaccugaacaucguggucggcaacguguaccacaugcgguucagccgccagugguucaacgugaacuccagcuacuccaucaagaccaagacccucuucacccacaccgucaacugcaacgggaaggagguguggaacaaggacaugcugcccggcgugcugaagaccgcgaagaagaacaccgcccacuucacgaagcacgccaccuucaagaccggcgggcuguucgaccagaaccccgucaagaaggcccccggccugaccccgcugaaggcggggcuccccacggagaaguacggcggguacaacaaggccggcgugauguucuucauccccgugcgguacaagagcggcaagaagaccguccugauggugcuguccguggagcuccuguacgggaaccgcuuccuggaggacgagaucuucgccaaggaguacgccaaggaccgccuccagcggaugaucggcaagagcgucgacgagaucgacuuccccaucgggaugcgcccguggaaggugaacaccauccugucccuggacggcuuccggaucugcaucaccgggaacgccagcggcggcaagugccucaucgcgcagcccaucaugcaguucuccagcgacgaguacuggaaguacuaccugaagaagguggagaaguucgucgagaaggugaagaacaacuccagcuacguguacgacgucgacuacgacgccgugcagcacgaggacaaccugaagcucuacgaccuguaccuggacaagcuccagaacuccaucuaccgcaagcggaucaacgcccccauccagacgcugaucgaggggcgcgagaaguucaucgacugcagcgugaucgagcagugccagguccugcucaacauccaccagguguucggccggaugaccuccgggugcgaccugacccugaucggcgggaagacccgcagcgccuccacggugaacuucagcagcaucauccucaacuggaagaagaacuacaccgacguccggaucaucgaccaguccgccagcggccugugggaggugguguccgagaacauccuggaguaccucuga

SEQ ID NO: 1898 - RNA, 4077 nt, Artificial Sequence
  Cas9 variant
augggcaagauguacuaccuggggcucgacaucggcaccaacagcgugggguacgccgucaccgaccccuccuaccaccuccugaaguucaagggcgagccgauguggggcgcccacguguucgcggccgggaaccagagcgccgagcgccgguccuuccgcacgagccggcgccggcucgaccgccggcagcagcgcgugaagcugguccaggagaucuucgcccccgugaucucccccaucgacccccgguucuucauccgccugcacgagagcgcccucuggcgggacgacguggcggagaccgacaagcacaucuucuucaacgacccgaccuacaccgacaaggaguacuacuccgacuaccccacgauccaccaccugaucgucgaccugauggagagcuccgagaagcacgacccccgccucguguaccuggccguggccuggcuggucgcccaccggggccacuuccucaacgagguggacaaggacaacaucggggacgugcugagcuucgacgcguucuaccccgaguuccuggccuuccucuccgacaacggcgucagcccgugggugugcgaguccaaggcccugcaggccacccugcucagccgcaacuccgugaacgacaaguacaaggcccucaagagccugaucuucgggucccagaagcccgaggacaacuucgacgcgaacaucagcgaggacggccugauccagcugcuggccgggaagaaggucaaggugaacaagcuguucccccaggaguccaacgacgccagcuucacccugaacgacaaggaggacgccaucgaggagauccugggcacccucacgcccgacgagugcgaguggaucgcccacauccggcgccuguucgacugggcgaucaugaagcacgcccugaaggacggccggaccaucagcgaguccaaggugaagcucuacgagcagcaccaccacgaccugacccagcugaaguacuucgucaagaccuaccucgccaaggaguacgacgacaucuuccgcaacguggacagcgagacgaccaagaacuacguggccuacuccuaccacgucaaggaggugaaggggacccugccgaagaacaaggccacccaggaggaguucugcaaguacgugcugggcaaggucaagaacaucgagugcagcgaggcggacaagguggacuucgacgagaugauccagcggcucacggacaacuccuucaugcccaagcaggucagcggggagaaccgcgugauccccuaccagcuguacuacuacgagcugaagaccauccucaacaaggccgccuccuaccugcccuuccugacccagugcggcaaggacgccaucagcaaccaggacaagcuccuguccaucaugaccuuccggaucccguacuucgugggcccccugcgcaaggacaacagcgagcacgccuggcucgagcgcaaggcggggaagaucuaccccuggaacuucaacgacaaggucgaccuggacaaguccgaggaggccuucauccggcgcaugacgaacacgugcaccuacuaccccggcgaggacgugcugccgcucgacagccugaucuacgagaaguucaugauccugaacgagaucaacaacauccggaucgacggguaccccaucuccguggacgucaagcagcaggucuucggccuguucgagaagaagcgccgggugaccgugaaggacauccagaaccuccugcugagccucggggcccuggacaagcacggcaagcugaccggcaucgacaccaccauccacuccaacuacaacaccuaccaccacuucaagagccucauggagcgcggggugcugacgcgggacgacguggagcgcaucgucgagcggaugaccuacuccgacgacaccaagcgcgugcggcuguggcucaacaacaacuacggcacccugacggccgacgacgugaagcacaucagccgccugcggaagcacgacuucgggcgccucuccaagauguuccugaccggccugaaggggguccacaaggagaccggcgagcgggcgagcauccucgacuucauguggaacaccaacgacaaccugaugcagcugcucagcgagugcuacacguucuccgacgagaucaccaagcugcaggaggccuacuacgccaaggcccagcugagccucaacgacuuccuggacuccauguacaucagcaacgccgugaagcgccccaucuaccggacccuggcgguggucaacgacauccgcaaggccugcggcaccgcccccaagcggaucuucaucgagauggcccgcgacggggaguccaagaagaagcgcagcgugacccggcgcgagcagaucaagaaccucuaccgguccauccgcaaggacuuccagcaggagguggacuuccuggagaagauccuggagaacaagagcgacggccagcuccaguccgacgcccuguaccuguacuucgcgcagcucgggcgggacauguacacgggcgacccgaucaagcuggagcacaucaaggaccagagcuucuacaacaucgaccacaucuacccccaguccauggucaaggacgacagccuggacaacaaggugcucgugcaguccgagaucaacggggagaaguccagccgcuacccccuggacgccgccauccggaacaagaugaagccccugugggacgccuacuacaaccacggccucaucagccugaagaaguaccagcgccugacccgguccaccccguucaccgacgacgagaagugggacuucaucaaccgccagcucgucgagacgcggcagagcaccaaggcccuggcgauccugcucaagcgcaaguuccccgacaccgagaucguguacagcaaggccggccuguccagcgacuuccggcacgaguucgggcuggugaagucccgcaacaucaacgaccuccaccacgccaaggacgccuuccuggcgaucgucaccggcaacguguaccacgagcgguucaaccgccggugguucauggugaaccagcccuacagcgucaagacgaagacccuguucacccacuccaucaagaacgggaacuucguggccuggaacggcgaggaggaccucggccgcaucgugaagaugcugaagcagaacaagaacaccauccacuucacgcgguucagcuucgaccgcaaggaggggcuguucgacauccagccgcucaaggccuccaccggccuggucccccggaaggccgggcuggacguggugaaguacggcggguacgacaagagcaccgccgcguacuaccuccugguccgcuucacccuggaggacaagaagacgcagcacaagcucaugaugauccccguggagggccuguacaaggcccgcaucgaccacgacaaggaguuccugaccgacuacgcccagaccaccaucuccgagauccuccagaaggacaagcagaaggugaucaacaucauguuccccaugggcacgcggcacaucaagcugaacagcaugaucuccaucgacggguucuaccugagcaucggcgggaaguccagcaagggcaaguccguccucugccacgccauggugccgcugaucgugccccacaagaucgagugcuacaucaaggccauggagagcuucgcgcgcaaguucaaggagaacaacaagcugcggaucgucgagaaguucgacaagaucaccguggaggacaaccucaaccuguacgagcuguuccuccagaagcugcagcacaaccccuacaacaaguucuucuccacccaguucgacgugcugaccaacgggcgcagcacguucaccaagcucucccccgaggagcagguccagacccugcugaacauccucagcaucuucaagaccugccggagcuccggcugcgaccucaagagcaucaacggcuccgcccaggccgcccgcaucaugaucagcgccgaccugacggggcuguccaagaaguacagcgacauccggcugguggagcaguccgcgagcggccuguucguguccaagagccagaaccuccuggaguaccuguga

SEQ ID NO: 1899 - RNA, 4083 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccgaccgccgggccucccgcacgacccggcgccggcucagccgcaaccgguggcgccuguccuuccugcgggacuucuucgagagccacaucaccccgaccgaccccaacuucuucaugcgccagaaguacuccgagaucagccccaaggacaaggcgcgguacaaguacgagaagcgccucuucaacgaccggacggacgccgaguucuaccagcaguaccccaccauguaccaccuccgcacccggcugcugaccgacccguccaaggccgacgugcgcgagaucuacuucgccauccaccacauccucaagagccgggggcacuuccugacguccggcuacgcgaaggacuucaacaccaacaaggucgcccugaacgagaucuuccccgcccugcaggacgccuacgcccagguguaccccgaccuggacaucaccuucgacgagaacaaggugaacgaguucaagaccguccuccuggacgagaaggcgacgcccagcgacacccagcgcgcccuggugaaccuccugcuggccgaggacggggacaaggacauccucaagcagcagaagcagguccugaccgaguucgccaaggccguggugggccugaagaccaagcucaacguggcgcuggggacggaggucgacuccagcgaggccaccgccuggaacuucucccugggccagcucgacgacaagugggccggcaucgagagcgccaugaccgacgaggggaccgagauccuggaccagauccgggaccuguaccgcgcgcgccuccugaacggcaucgugccggccgggaagacgcugucccaggccaagguggacgacuacgagcagcaccacgaggaccucgagcuguucaaggacuaccugaagcagcucgaggacgacggcauggccaaggccauccggcagcuguacgaccgcuacaucgacggcgacgacgcgaagcccuucguccgggaggacuucgugaaggcccugaccaaggaggugaccgcccaccccaacgccaagagccccgagcuccuggagcgccugguccagccggacuucaugcucaagcagcggaacaaggcgaacggggccauccccgugcagaugcagcagcgcgagcuggaccagaucaucaagaaccaguccguguacuacgacuggcuggccgcccccaaccccgucgagaagcaccggcagagcaugccguaccaguucgacgagcuccugaacuuccgcauccccuacuacgugggcccccuggugaccgccaaggagcagaaggcggcccagggcggggucuucgccuggauggugcggaaggaccccgacgggaacaucacgccguacaacuucgacgagaaggucgaccgcgaggccagcgccaacaccuucauccagcggaugaagaccaccgacacguaccucaucggcgaggacgugcugcccaagcagucccugcuguaccagagcuacgaggugcucaacgagcugaacaacguccgcgugaacgacaacaagcuguccuucgaccagaagcagcagguccucggcgagcuguucgagcggcacaacaccgugaccaucaagcaguucguggacaaccugcucgcgcacggggacuacgaccgcauccccgaggugcggggccuggccgacgagaagcgcuuccugagcucccucagcaccuacaaccagcugaaggggauccugcacgaggccaucgacgacuccgacaagcagacggacaucgagaagaucaucgccuggagcaccaucuucgaggacaaggccaucuucaagaccaagcucaacgagaucuccuggcugaacgcgggcaugaucaacagccuggccaacauccgguaccgcggguggggccaguucucccacaagcuccugaacgagcugacccucagcacgggccggaccgucuucgaggagcugcugaucuccagccacaaccucaugcagauccugaccgacgaggugcugaagcagaagaucgccgagcucaacgcccacgagcugaaggcguccgggaucuacgccgccaucgacgacgccuacaccagccccuccaacaagaaggcccugcgccaggugcucagcgucaucgacgacaucaccaacgcggccggccaggccccgaacuggcuguacaucgagacggccgacggggacggcgugcccgggaagcgcaccaacucccggcagcgcaagauccaggagaucuacgugaacgccgcgcaggagcugaucaccggcagcguccggggcgagcucgaggacaagaucgccagccgcgccgacuucaccgaccggcuggugcuguacuucaugcagggcgggcgcgacaucuacacgggggagccccucaacaucgacaaccuguccagcuacgacaucgaccacauccugccccagucccucaucaaggacaacagccuggacaaccgggugcugguccacccgcucgugaaccgcgagaaggacaccaucuucgccuccacccgguucgccaagcagaugaacggcauguggcgccaguggcacgcggccggccugaucagcucccggaagcugcgcaaccuccagaugcggcccgacgagaucgacaaguacgccagcggguucguggcccgccagcuggucgagacccggcagaucaucaagcugacggagcagaucguggcggaccaguaccccgacgccaagaucaucgccgugaaggccggccucuccagccagcugcgcaaggagcuggacuucccgaagaaccgggaggucaaccacuaccaccacgccuucgacgcguuccucgccgcccgcaucgggaccuaccugcugaagcgguaccccaaccucgagcccuucuucaccuacggcaaguucaagaagaccgaggugaagaagcugaaguccuucaacuucauccgcgacaugacgcacgccaaggacaagaucguggccaaggagaccggggagaucgucugggacaacgcgagcgacaucaacgagcuggaccggaucuacaacuucaagcgcaugcucaucacccacgaggugcgcuucgagaccgccucccuguucaagcagacgcuguacgccgccaagaacagcaagaaccggggcggcucccgccagcucauccccaagaagaagggguaccugguggacaucuacggcggguacacccaggagaccggcagcuaccuguccgucgugcggcucaccaagaaggccauguacgcgguggucaaggugagcacgcgcgacgccgccaagcuggccguggccaagagcaucuccgagcagaaggagaacgagacccugaagaagaucaucgacgggaagcucagcaagaccuccaagaagggcaagaccacgcaccagcuguucgagaucguccugccgcgggugggccagaagacccucuucaagaacagcaaguacaaccaguuccuggugaacuccgacaccuacaugcacaacuaccaggagcuguggaugccccgcgaguaccagcggauguggaaggacauccuccugagcaaccacggggacgcgcagcuggagggccagcucgaccagaucuucaaguucaucgucucccaggugaacagcuacuucaaccuguacgacaucaaccaguuccgcaagaagaucgccgacgccaccgacaaguucgccaagcugcccacgcacgacaccgacaacgcgcgggggaagaucgccaccaucggccagcuccugaucgggcugcaggccaacgccaugcgcuccgaccuccggaaccuggacaucaagacccccuucggccugcuccagaucggcacggggaucacccuggaccuggacaccagcaucaucuaccaguccccgaccggccucuucgagcgcgaggugccccugacggaccuguga

SEQ ID NO: 1900 - RNA, 4083 nt, Artificial Sequence
  Cas9 variant
augaccaagcugaaccagcccuacggcaucgggcucgacaucggcagcuccagcaucggguucgccguggucgacgccaacucccaccuccugcgccucaagggcgagaccgcgaucggggcccggcuguuccgcgagggcgagagcgccgccggccggcgcgccucccggacgacccgccggcgccugagccacaaccgguggcgccuccgguuccugcaggacuucuucgacccgcacaucuccagcaucgaccccgacuucuuccugcgccagaaguacuccgagaucagccccaaggacaaggagcgguucaaguacgagaagcgccucuucaacgaccggaccgacgcgcaguucuacaagcaguaccccaccauguaccaccuccgccugcaccucaugaacgacgccuccaaggccgacccgcgggagaucuucuucgccauccaccacauccucaagagccgcgggcacuuccugacgcccggcgacgcgaagaacuucaacaccgacgacguggaccucaagcacaucuuccccgcccugaccgaggccuacgcccaggccuaccccgaccugacccucuccuucgagccgagcaaggcggagaaguucaaguccauccugcuggacgaggacgccacgagcaacgacacccagaaggcccucgugaagcugcugcucuccgacgacggggacaaggagguccugaagcagcagaagaaggugcugaccgaguucgccaaggccguggcgggccucaaggucaaguucaacguggcccuggggaucgaggugaccgacgccgacgucgagaaguggcacuucggcauggcccagcuggaggacaaguggagcgacaucgagcccucccucacggaccagggcauggagaucuucgagcagauccaggaccuguaccgggcccgccugcucaacgggaucgugcccgcgggcaagacccugagccaggccaagguggacgacuacgaccagcacugcaaggaccugaagcuguucaaggaguaccugaagcagcugaacgaccacgaccucgccaagcggauccgccugcuguacgaccgcuacaucgacggggacgacgccaagcccuuccuccgggacgacuucgucaaggcccugaagaaggaggugaccgcgcacccgaccgagcuggccgagagccuccuggagcgcauggagcaggacaacuucaugcugaagcagcggacgaaggccaacggcuccauccccgugcagaugcagcagcgcgagcucgacaagaucaucgccaaccaggcggaguacuacagcuggcuggccgccgagaaccccgucaaggagcaccgggacuccaagcccuaccagcuggacgagcugcucaacuuccgcaucccguacuacgugggccccaugaucaccaagaagcagcaggagaaguccgggcagaacguguucgccuggaugguccggaaggaccccagcggcaacaucacccccuacaacuucgacgagaagguggaccgcgaggccagcgcgaacgccuucauccagcggaugaagaccacggacaccuaccugaucggggaggacgugcugccgaagcagucccuccuguaccagaaguacgagguccugaacgagcucaacaacgugcgcgugaacggcgagagccuguccaccgaccagaagaagcggcugauccgcgagcuguucgagcggcacagcuccgucacccugaagcaguucguggagaaccuggucgcccacggggacguggccaagcgccccgacgugcggggccucgccgacgagaagcgcuuccugagcucccugagcacguaccaccagcuccggggcauccugcacgacgcgaucgacgaccgcgggaagcaguccgacaucgagaacaucaucaccuggagcaccgucuucgaggacgccuccaucuucaagagcaagcugggcgagaucuccuggcucgacagcaagacccggacgacccugagcaacauccgcuaccgcggguggggccaguucucccggaagcugcucgacgggcugaagcugggcaacggccacaccaucauccaggagcucaugcugagcucccgcaaccugaugcagauccucaccgacgagacgcugaagaaggagauggccacccugaaccaggagcggcucaagcccgacagcaucaacgaggccaucgacgccgcguacaccucccccagcaacaagaaggccauccgccaggugcugaagguggucgacgacaucaagcacgccgccaacgaccaggcgccguccuggcuguacaucgagaccgccgacgggggcgggcaccccggcaagcggacgcucagccgccagaagcagauccaggccaucuacgagaacaccgccaaggagcugaucgacuccgccgugcgcggggagcugaaggacaagaucgcggacaagaccaacuucagcgaccggcucgugcuguacuucaugcagggcggccacgacaucuacaccgggaccgcccugaacaucgaccagcucuccagcuacgacaucgaccacauccugccccagucccugaucaaggacgacagccucgacaaccggguccuggugcacgccaagaucaaccgcgagaagaacgccgaguucgccuccacgcuguucgcggccaagauggccagcaccuggcaccgguggcgcgacgccggccucaucuccgggcggaagcugaagaaccugcucaugcgccccgacgagguggacaaguacgccaagggcuucgucgcgcggcagcugguggagacccgccagaucaucaagcugaccgagcagaucguggccgcccaguacccggacacgaagaucaucgccgucaaggcgggccucagccaccagcugcggcaggagcuggacuuccccaagaaccgcgacgugaaccacuaccaccacgccuucgacgccuuccucgccgcccggaucgggaccuaccugcugaagcgcuaccccaaccucgcgccguucuucaccuacggcgaguucaccaagacgaaccugaagaagcugcagagcuucaacuucaucggggcccucacccacaccgacggcaagaucaccuccaaggacacgggggaggugcugugggacaaccagcgggacaucgaggagcuggaccagaucuacaacuucaagcgcaugcucaucacccacgaggucuacuucgagaccgccggccuguucaagcagaccguguacgccgccaaggacagcaaggagcgcggcgggucccggcagcugauccccaagaagaagggcuacagcacggggaucuacggcggguacacccaggagaccggcuccuacaacgcgcucgugcgccugaccaaggccggcaaggucguguaccggguguucaagaucagcacgcagaacgccgccgagaucgccgcggcccgcucccugagcgccgaggaggggaacgagcggcucugccagauccuggagcagucccugcucaagaccaacaaggacaagaagaacaccgucgaccuguucgacguggugaucccccgccugggcaaggaggcccucuuccacaacagcaaguacgggcuguuccuggucaacuccgacaccuacuaccacaacuaccaggagcucuggcugagccgggagaaccagaagauccugaagaagcuguucuccacgaaguacgaccagagcgagauggaccgcgacgcccugcaccuguucgagaccaucgcgaagcaggucgagcaguucuucaagcucuacgacaucaaccaguuccggaccaagaucuccagcgccuucgacgccuucgagaagcugcccguggagggcgaggaggggaagguggagacccugaagcagcuccugaucggccugcacgccaacccggugcgcuccgaccucaagaaccugggcaucaagacgcccuucggguuccugcaggcgggcaaggggauccaccucgacgacgacaccgagaucauccagcagagccccgccggccuguucaagcggcgcgugcggcuggccgaccuguga

SEQ ID NO: 1901 - RNA, 4086 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccgaccgccgggccucccgcaccacccggcgccggcucagccgcaaccgguggcgccuguccuuccugcgggacuucuucgagagccacaucaccccgaccgggcccaacuucuucaugcgccagaaguacuccgagaucagccccaaggacaaggcgcgguacaaguacgagaagcgccucuucaacgaccggacggacgccgaguucuaccagcaguaccccaccauguaccaccuccgcaaccggcugcucaccgacccguccaaggccgacgugcgcgagaucuacuucgccauccaccacauccucaagagccggggccacuuccugaccuccggguacgcgaaggacuucaacacgaacaaggucgcccugaacgagaucuuccccgcccugcaggacgccuacgcccagguguaccccgaccuggacaucaccuucgacgagaacaaggugaacgaguucaagaccguccuccugaacgagaaggcgacccccagcgacacgcagcgcgcccuggugaaccuccugcuggccgaggacggcgacaaggacauccucaagcagcagaagcagguccugaccgaguucgccaaggccgugguggggcugaagaccaagcucaacguggcgcugggcaccgaggucgacuccagcgaggccacgguguggaacuucucccugggccagcucgacgacaagugggccgggaucgagagcgccaugaccgacgagggcaccgagauccuggaccagauccgggaccuguaccgcgcccgccuccugaacgggaucgugccggcgggcaagacccugucccaggccaaggucgacgacuacgcccagcaccacgaggaccucgagcuguucaaggacuaccugaagcagcucgaggacgacggcacggccaaggccauccggcagcuguacgaccgcuacaucgacggggacgacgcgaagcccuucgugcgggaggacuucgugaaggcccugaccaaggaggucaccgcccaccccaacgccaagagccccgagcuccuggagcgccuggcgcagccggacuucaugcucaagcagcggaacaaggccaacggcgccauccccgugcagaugcagcagcgcgagcuggaccagaucaucaagaaccaguccguguacuacgacuggcuggccgcccccaaccccgucgagaagcaccgcaagagcaugccguaccagcucgacgagcugcugaacuuccggauccccuacuacguggggccccucgugaccgcgaaggagcagaaggccgcccagggcggggucuucgccuggauggugcggaaggaccccgacggcaacaucacgccguacaacuucgacgagaaggucgaccgcgaggccagcgcgaacaccuucauccagcggaugaagaccaccgacacguaccugaucggcgaggacgugcugcccaagcagucccugcucuaccagcgcuacgaggugcugaacgagcugaacaacguccgggugaacaacgagaagcucagcaucgagcagaagcagcaggucauccgcgagcuguucgagcggcacaacuccgugaccaucaagcaguucgccgagaaccugcgcgcccacggggacuacgcccacauccccgagauccggggccucgccgacgagaagcgcuuccugagcucccugagcaccuaccggcagcucaagucccugcugcccgacgcgaucgacgacccggccaagcaggccgacaucgagaacaucaucgccuggagcaccguguucgaggacgcggccaucuucaagacgaagcucaaggagaucaacuggcuggacucccagaccaucaccaagcugagcaacauccgcuaccgcggguggggccaguucucccacaaguuccucaacgggcugacccugggcaacggccacacgaucauccaggagcuguuccugagcaacaacaaccugaugcagauccucaccgacgagacccugcagaagaagaugaccgagcugaacgccgacaagcucaaggccgccaacaucaacgacgcgaucgacgacgccuacaccucccccagcaacaagaaggcccugcgccaggugcugcgggucaucgaggacaucaagcgggccgccgacgggcaggaccccuccuggcucuacguggagacggcggacggcgggggcacccccgggaagcgcacccgggcccgccagcaccagcugcaggagaucuacgccaacgccgcccacgagcugaucgacagcgcggugcggggcgagcucgaggacaagaucgccgacaaggccgacuucaacgaccgccugguccuguacuucaugcagggcgggcgggacaucuacaccggcacgccgcucaacaucgaccagcuguccagcuacgacaucgaccacauccugccccagucccucaucaaggacaacagccuggacaaccgcgugcuggugcacgccaucaucaaccgggagaagaacgcgaccuucgccagcaccaucuacgcccagaagaugaacgccaccuggcgccaguggcacgaggccgggcucaucuccggccggaagcugcgcaaccugcagaugcggcccgaccagaucgacaaguacgcgagcggcuucgucgcccgccagcucguggagacgcggcagaucaucaagcugaccgagcagaucguggccgcccaguacccggagaccaagaucaucgccgucaaggcggggcugucccaccagcuccgcgaggagcuggaguuccccaagaaccgggacgugaaccacuaccaccacgccuucgacgccuuccuggccgcccgcaucggcaccuaccuccugaagcgguuccccaaccugcaggcguucuucacguacgggaaguucaagaaggccgacgugaagaagcuccgcggcuucaacuucauccgcgacaucacccacgccgaggacaagaucgucgugaaggacaccggggaggugaucugggacaagaagcgggacgucgacgagcuggaccgcaucuacaacuucaagcggaugcugaucacccacgaggugcacuucgagaaggccgaccucuucaagcagacgguguacggcgccaaggacagcaaggaggcgggcgggaagaagcagcugaucuccaagaagaagggcuaccccgucgacaucuacgggggcuacacccaggagaccgggagcuaccuguccguggugcgccucaccaagaaggccauguacgccgucgugaaggugagcacgcgggacgccgcgaagcuggccgucgccaaguccaucagcgagcagaaggagaacgagacccugaacgacaucaucgacgagaagcucuccaagaucagcaagaacggcaagaucacccacgagcuguucgagguggugcugccgcgcgucggccagaagacccucuucaagaacuccaaguacaaccuguuccuggugaacagcgacacguacaugcacaacuaccaggagcucuggaugccccgggaguaccagaagauguggaaggacaucucccugagcaaguacggggacgcccagaccgaggaccagcuggaccagaucuucggcuucaucgugucccaggucaacagcuacuucaaccucuacgacaucaaccaguuccgcaagaagcugaacgacgccgcggacaaguucgccacccugcccaugcgggacaccgacgacaugcaggggaagaucgccacgaucggccagcuccugaucgggcugcaggccaacgccgcgcgcagcgaccuccggaaccuggacaucaagacgccccugggccuccugcagaucccgaacggcaucucccuggacagcgacaccuccgugguguaccagagccccaccgggcuccuggagcgcgagguccaccuguccgaccucuga

SEQ ID NO: 1902 - RNA, 4086 nt, Artificial Sequence
  Cas9 variant
augaagaagcccuacagcaucggccuggacaucgggaccaacuccgugggcuggagcgucgugaccgacgacuacaaggugccggccaagaagaugaagguccucgggaacacggacaaggaguacaucaagaagaaccugaucggcgcccugcuguucgacuccggggagaccgcggaggccacccgcaugaagcggaccgcccgccggcgcuacacgcggcgccggaaccgcauccuguaccugcaggacaucuucagccccgagcucaaccagguggacgaguccuuccugcaccggcuggacgacagcuuccucguggccgaggacaagcgcggcgagcggcacgucaucuucggcaacaucgccgacgaggugaaguaccacaaggaguuccccaccaucuaccaccuccgcaagcaccuggcggacuccagcgagaaggccgaccuccggcugguguaccuggcccucgcccacaucaucaaguaccgcgggcacuuccugaucgacgagcccaucgacauccggaacaugaacucccagaaccuguucaaggaguuccuccuggcguucgacggcauccaggucgacugcuaccuggccagcaagcacaccgacaucuccgggaucaucaccgccaagaucagcaagucccgcaagguggaggccgugcucgagcaguucccggaccagaagaagaacagcuucuucggcaacauggucucccugguguucgggcugaugcccaacuucaagagcaacuucgagcucgacgaggacgccaagcugcaguucucccgggacagcuacgacgaggaccuggagaaccuccugggcaucaucggcgacgaguacgcggacguguucgucgccgccaagaagguguacgacuccauccugcucagcgggauccugacgaccaacaaccacagcaccaaggcgccccuguccgccagcaugaucgaccgcuacgacgagcacaacuccgacaagaagcuccugcgggacuucauccgcaccaacaucggcaaggagguguucaaggaggucuucuacgacacgagcaagaacggguacgccggcuacaucgacggcaagaccaaccaggaggacuucuacaaguaccugaagaaccuccugcagaagguggacgggggcgacuacuucaucgagaagaucgagcgggaggacuuccugcgcaagcagcgcaccuucgacaacggguccaucccccaccaggugcaccucgacgagaugaaggccauccugcggcgccagggcgaguucuacccguuccugaaggagaacgccgagaagauccagcagauccucaccuucaagauccccuacuacgucgggccccuggcccggggcaacagccgcuucgccugggcguccuacaacagcaacgagaagaugacgcccuggaacuucgacaacgugaucgacaagaccuccagcgcccaggccuucaucgagcggaugaccaacaacgaccuguaccucccggaccagaaggugcugcccaagcacucccugcucuaccagaaguucgccgucuacaacgagcugaccaagaucaaguacgugacggagaccggcgaggcccgccuguucgacgucuuccugaagaaggagaucuucgacgggcuguucaagaaggagcggaaggugaccaagaagaagauccugaacuuccuggacaagaacuucgacgaguuccgcaucaccgacauccagggccucgacaacgagacggggaacuucaacgcgagcuacggcaccuaccacgaccugcugaagaucaucggggacaaggaguucauggacuccagcgacaacguggacguccucgaggacaucgugcugucccugacccucuucgaggaccgggagaugaucaagcagcgccugcugaaguacgaggacaucuucagcaagaaggugaucgccaaccucacccggcgccacuacacgggcuggggccggcuguccgccaagcugaucaacgggaucaaggacaagcacagccgcaagaccauccucgacuaccugaucgacgacggccacuccaaccggaacuucaugcagcugaucaacgacgacaaccucagcuucaaggacgagaucgccaacagccaggucaucggggacggcgacgaccugcaccagguggugcaggagcuggcggggucccccgccaucaagaagggcauccuccagagccugaagaucgucgacgagcuggugaaggugaugggcuacaaccccgagcagaucgucguggagauggcccgcgagaaccagaccaccgcccgggggcgcaacaacucccagcagcggcucggcagccugacgaaggccauccaggacuucggguccgacauccugaagcgcuacccgguggagaacaaccagcuccagaacgaccagcuguaccuguacuaccuccagaacggcaaggacauguacaccggcgacacccuggacauccacaaccugagccaguacgacaucgaccacaucaucccccaguccuucaucaaggacaacagccucgacaaccgcguccugaccaacuccaagagcaaccgggggaaguccgacaacgugcccagcaacgagguggucaagcgcaugaagggcuucuggcugaagcagcucgacgcgaagcugaucucccagcggaaguucgacaaccugacgaaggccgagcgcgggggccucagcgccgaggacaaggccggguucaucaagcggcagcugguggagacccgccagaucaccaagcacguggcccggauccuggacgagcgcuucaaccgggacuucgacaagaacgacaagcgcauccggaacgucaagaucgugacccucaaguccaaccuggugagcaacuuccgcaaggaguucggcuucuacaagguccgggagaucaacaacuuccaccacgcgcacgacgccuaccugaacgccgugguggccaaggcccuccugauccgcuaccccaagcuggagccggaguucgucuacggcgaguaccccaaguacaacuccuaccgggagcgcaagagcgcgaccgagaagauguucuucuacagcaacaucaugaacauguucaagacgaccaucaagcucgccgacgggcgggugguggagaagcccgucaucgaggccaacgaggagaccggcgagaucgccugggacaagaccaagcacuucgcgaacgugaagaaggugcuguccuacccccaggucagcaucgugaagaagguggaggagcagaccgggggcuucuccaaggagagcauccugccgaagggcggguccgacaagcucaucgcccgcaagacgaagaacaacuaccugagcacccagaaguacggcggguucgacucccccaccgucgccuacagcaucauguucguggccgacaucgagaagggcaaguccaagcggcugaagacggugaaggagaugaucgggaucaccaucauggagcgcagccgguucgaguccaacagcgucaccuuccucgaggagaagggcuaccgcaacauccgcgagaacaccaucaucaaguuccccaaguacucccuguucgagcuggagaacgggcggcgccggcuccuggccagcgcgaucgagcugcagaagggcaacgagauguuccucccccagcaguucgugaaccugcuguaccacgcccagcacgccaacaaggaggacuccgugaucuaccucgagaagcaccgccacgagcugagcgagcuguuccaccacaucaucggcgucuccgagaagacgauccucaagccgaagguggagaugacccugaacgaggccuucgagaagcacuucgaguucgacgaggugagcgagcuggcccaguccuucaucagccuccugaaguucaccgcguucggggcccccggcggguucaaguuccuggacgccgacaucaagcagagcaaccuccgguaccagaccgucacggaggugcuguccagcacccugauccaccaguccgugaccggccucuacgagacccgcaucgaccugagcaagcucgggggcgaguga

SEQ ID NO: 1903 - RNA, 4086 nt, Artificial Sequence
  Cas9 variant
augggcaacuacuaccuggggcucgacaucggcaccaacagcguggggugggccgucaccgacgagaacuacaacaucgagcgcuucaagaagaagaacauguggggcauccggcuguucgacgaggccaagacggcggagucccgccggauccaccgccaggcccggcgcaugcggcagcgcaagauccagcggcugaaccuccugauggagcuguucgacguggagaucagcaagguggacgaguccuucuucauccgcaagaaggagagcgaccuccacuacgaggacaagucccaggacagccgguacgcccuguucaacgacaaggaguucaacgacaaggacuaccacaacaaguaccccaccaucuuccaccugaucauggaccucaucgagaacgacgagaagaaggacauccgccugcuguaccucgccugccacuaccugaucaagaaccgggggcacuucaucuucgagggccagaaguucgacgucaacuccagccugaacaacaacaucaacaagcucaagucccaccuggaccaguucuacaacaucugccuggacuucgacaacgacaagcucaucgagauccuggugaaccagaaccugaacaucagcgagaaguccaagaagaucaaggagcuccugcgcaagaccaaccuggaggugggcaucgccaaccucaucgccgggggcagcaucaagcuguccaacauguucgacgacgacgagcugaagaaccucgacuacaacagccuguccuucaagaacagcaacuucgacgaggggcgggagcuguucgaggagguccucgaggaccgcuucgagcugguggagauccugaaggacauccacgacgcguccgugcucgagaccaugcugagcuccgccagcaucagcccggacggcgggaaguacaucuccagcuccaugaucaacagcuacaacaagcacaagcgggaccugaagcuccugaagaagaucaucaagaaguacaagaaguccgaguacgacaacaucuuccgcgacgagaacaucaagaacaacuaccugagcuacacgcggaccggcaucaacaagaacaagaagguccaggccgaggacaacaccgacuccgacggcuucuacaaguacaucgugaagauccucaaggacaucaaggagaacgacagcgacgaggacaucaaguacauccuguccgagaucgacaagaagaacuucgugcccaagcagcgcaccaaggagaacagcgucauccccuaccagcugcgggagaucgagcuccgcaagaucaucgacaaccaguccaaguaccacaaguuccugaacgagguggacgagaaggggaucagcgugaaggagaagaucaucucccugcucacguuccgcauccccuacuacaucggcccgcugaaccccagcuacaacgaggagaagaacuucaccaccuccugggucaagcggcuggcgaaggggaaggugacccccuggaacuucgaggacaugguggacaucgacgccagccgcgaggccuucaucgagaacaagcucaacaagugcuccuuccugcuggacgagacgguccugcccaaggacagccuccuguaccaggaguacauggugcugaacgagcucaacaaccugaagaucaacggccaguccaucaacaccgaccugaagaaguccaucuacgaggagcuguucaagaaguacaagaaggugacccggaagcgccugaucagcuacaucaaggagaaggagaacaugagcggcgacaucgucaucaccgggaucgacggcgacuucaagcaggggcucaagagcuacaucgccuucaaggacaucaucggcgagaagaucgacgacgacaucuaccggaaggagguggagaagaucauccgcgacaucucccucuacggggacgacaagagcuucauccagaagaagaucaagaacgagaacaagcuggaccuguccgacgaccagaucagcaagaucgccaagcucaaguucaaggacuggggccgguucuccaagaagcugcuggugggcaucaaggcgagcgacaagaacacgggggagaucgacaacaucaucggcuucaugcgcaacuacaacuacaacaucaugcagcucauggccaacgucuucaccuucaaggacgagaucgagaagcugaacuccaaguacuacaccgacgagaagaucaacaucgacuaccuggacgaccucuaccugagcuccccggccaagcggaugcuguggcagagcuuccagaucguggacgagaucaagaacaucaagaacuccgaccccaagaagaucuucaucgagauggcccgcagcaaggaggacaagcccacccggaagaugucccgcaagagccggcucgagaagcuguacacggacuccaagaagcaguucaucaagcuguucgggcccgacgaguacgacaagcucaacaacgagaucaagaacaagagcgagagcgacuuccgcugggacaaccuguaccuguacuacacccaguucggccggugcauguacucccucgacccgaucgaccuggaggagcugagcaacaagaaccucuacgaccaggaccacaucuaccccaaguccaagaucuacgacgacagcaucgagaaccgcguccuggugaagaagcagcugaaccucgacaaguccaacgaguaccccauccccgaccgggugcugaacaaggacaagaacaagcugcucgccuucuggaagaugcugaacgagaaggagcugaucggggacaagaaguacgcgcgccucauccgcaagagcccguucaccgacgaggagcugggcgacuucaucgcccggcagcuggucgagacccgccaggccacgaaggagaccgccaacaugcucaagcggcugugccccgacuccaagaucguguacgugaaggccaagaacgucagcgacuuccgccggaaguucgacauccugaagugccgcuccaucaacgaccuccaccacgcgcacgacgccuaccugaacaucguggugggcaacgucuucgacaccaaguucaccagcaacccccugaacuucaucaagaacaacuccaagaaccggagcuacaaccucgagaagaucuacgacuacgacgugauccgcaacgagaagaucgccuggcuggccgagcggaaggaggagaaccaggacggguccaucgccacggugcugaagaaccucagcaagaacgacauccgcgucacccggcgcaccuacaucaagugcgaggaccuguucgacgagaacaucgugcggaagggcaacgggaaguuccccaucaaggagaacaacaacaaguccgacaccaacaaguacggcggguacagcggcaucaagaacgcguacuucgugcugcucgaggacgagaagcacaaccgcauccuggaggccaucccguccuucaucuacaagaaggagaagaacggcgagaaggggagcgucaucaacuaccugcagaacauccucggcaucaaguccgccaagauccugcgggacaagaucaagaucgggagccugcucaagaucgacaaguuccccuacaaccuggccggcaagagcggcaacgggauccugaucuccggcggggugcagcucauccuggacaagaacacgagcaaguacaucaagaagaucgagaacuacaaguacaagcuggacgagaacaaggacuaccagaucaacaucuucgacaagcucuccaaggaggagaacaucaagcuguucgaccuguucguggacaaguucgagaacagcaucuacaagaaccgcgucaacaucaagcucaaggagaucaagcuggcgcggcccaaguucgagcaccuguccaucgaggagcagaucaagacccucacccagaugcugauccuguucggccgcgagaacaacgccgugaaccucgaguacaucgggcugcccaagaacaccggcaagacgaagaucaacaagaagaucaacaacaaggacaucaagaucaucaaccagagcaucaccggccuguacgagaccgaggaggaccucgccaacaucuga

SEQ ID NO: 1904 - RNA, 4086 nt, Artificial Sequence
  Cas9 variant
augaccaagcugaaccagcccuacggcaucgggcucgacaucggcagcaacuccaucggguucgccguggucgacgccaacagccaccuccugcgccucaagggcgagaccgcgaucggggcccggcuguuccgcgagggccaguccgccgccgagcggcgcgagagccggacgacccgccggcgccugucccggacccgcuggcggcucagcuuccugcgcgacuucuucgccccgcacaucaccaagaucgaccccgacuucuuccugcggcagaaguacuccgagaucagccccaaggacaaggaccgcuucaaguacgagaagcggcuguucaacgaccgcacggacgcggaguucuacgaggacuaccccuccauguaccaccuccggcugcaccugaugacccacacccacaaggccgacccgcgcgagaucuuccuggccauccaccacauccucaagagccggggccacuuccugacccccggggccgcgaaggacuucaacacggacaagguggaccuggaggacaucuuccccgcccugaccgaggccuacgcccagguguaccccgaccucgagcugaccuucgaccuggccaaggcggacgacuucaaggccaagcuccuggacgagcaggccaccccguccgacacgcagaaggcccuggucaaccuccugcugagcuccgacggcgagaaggagaucgugaagaagcgcaagcagguccucaccgaguucgccaaggcgaucaccgggcugaagaccaaguucaaccuggcccucggcacggagguggacgaggccgacgccagcaacuggcaguucuccauggggcagcuggacgacaaguggagcaacaucgagaccuccaugaccgaccagggcaccgagaucuucgagcagauccaggagcuguaccgggcccgccuccugaacggcaucgugcccgcggggaugagccugucccaggccaagguggccgacuacggccagcacaaggaggaccucgagcuguucaagacguaccugaagaagcucaacgaccacgagcuggccaagaccauccgcgggcuguacgaccgguacaucaacggcgacgacgccaagcccuuccuccgcgaggacuucgucaaggcgcugaccaaggaggugaccgcccaccccaacgaggugagcgagcagcugcucaaccggaugggccaggccaacuucaugcugaagcagcgcacgaaggccaacggggcgaucccgguccagcugcagcagcgggagcucgaccagaucaucgccaaccagagcaaguacuacgacuggcuggccaagcccaaccccguggagaagcaccgcgccuccaagcccuaccagcuggacgagcugcucaccuuccggaucccguacuacgugggcccccugaucacccccaaggagcaggccgagagccgcgagaacgucuucgcguggaugauccggaaggaccccuccgggaacaucaccccguacaacuucgacgagaagguggacugccccgccagcgccaacauguucauccagcgcaugaagaacacggacaccuaccugaucggcgaggacgugcuccccaagcggucccugcuguaccagaaguacgagguccucaacgagcugaacaacgugagcaucgacgggcgccggcugggcgccgaccagaagcagcgccucauccgggagguguucgagcgccacuccagcgucaccaucaagcaggucgccgagaaccugguggcgcacggcgacuucgccaagcggcccgagauccgcgggcuggccgacgagaagcgguuccucuccagccuguccaccuaccaccagcugaagaagauccuccacgaggccaucgacgacccgacgaaggagcacgacaucgagaacaucaucaccuggagcaccguguucgaggacgccgcgaucuucaagaccgagcuggccaagaucuccuggcuggacagcgacacgaucaaggcccucuccaacauccgcuaccgcggcugggggcaguucagccggaagcugcuggacggccucaagcuggggaacggccacaccgugauccaggagcugaugcucuccaaccacaaccugaugcagauccugaccgacgagacccucaagaccacgauggccgagcugaaccaggacaagcugaaggcggacgacaucgaggacgucaucaacgacgccuacaccagccccuccaacaagaaggcccuccgccaggugcugcggguggucgaggacaucaagcacgccgccaacggccaggaccccagcuggcuguacaucgagaccgcggacgggcccggcaccgccgggaagcgcacgcagagccggcagaagcagauccagaccguguacgccaacgccgcccaggagcucaucgacuccgcggugcgcggcgagcuggaggacaagaucgccgacaaggccagcuucaccgaccggcugguccucuacuucaugcagggcgggcgcgacaucuacaccggcgccccgcugaacaucgaccagcugucccacuacgacaucgaccacauccucccccagagccugaucaaggacgacucccuggacaaccgggugcucgugaacgccacgaucaaccgcgagaagaacaacgucuucgcgagcacccuguucgccuccaagauggccgccaccuggcggaaguggcacgaggcggggcugaucagcggccgcaagcuccggaaccugaugcugcgccccgacgagaucgacaaguucgcccacggguucguggcccggcagcucguggagacccgccagaucaucaagcugacggagcagaucgccgccgcgcaguacccgaacaccaagaucaucgccgucaaggccggccugucccaccagcuccgggaggagcuggacuuccccaagaaccgcgacgugaaccacuaccaccacgccuucgacgccuuccuggcggcccggaucggcaccuaccuccugaagcgcuaccccaagcuggcccccuucuucaccuacggggaguucgccaagguggacgucaagaaguuccgggaguucaacuucaucggcgcccucacgcacgcgaagaagaacaucguggccaaggacaccggggagaucgugugggacaaggagcgcgacauccaggagcuggaccgcaucuacaacuucaagcggaugcugaucacccacgaggucuacuucgagaccgccgaccucuucaagcagacgaucuacgccgccaaggacagcaaggagcgcggcggguccaagcagcugaucccgaagaagcagggcuaccccacccagguguacggcggguacacccgggagaacaccgcguaccuggccguggucaagacgguggagaagaaggccgacguguaccgcgucgugcggaucgccaccagccagguggcggcccucaaggaggcccgcgcccaguccaccgucaaggagcgggagcugcugaagaaguuccucaccacgaaguucaccaagaucggcaagaacgggaagaaggccaucacccccuucgacaucgugaucccccgcgugccgcgggagcagcuguuccacaacaagcgcuacggcuucuucauggucaacagcgacacccugaugcacaacuaccaggagcucuggaugucccggagcgaccagcagauccuguccaagcuggugaaguccgcgaagacgguggagaacgggcaggucggccgccucuucgagaacaucguggagcagaucaacaaguacuucccccuguacgacaucaaccaguuccggaagaagcuggaccagagcaaggacaucuucagcaagcucccccuggagggcaacgggaccaccagcggcaagcgcgagaccauccagaacauccugacgggggccggcaccggggccaagaacggcgaccucaagaaccugggcaucaagacccccuucggguuccuccaggugccguccggcaucguccuggacgacgacaccacccugaucuaccagagccccacggggaugcugaaccggaucgugcgccucuccgagcuguga

SEQ ID NO: 1905 - RNA, 4086 nt, Artificial Sequence
  Cas9 variant
augaagaacgaggagaacaucuaccugggccucgacaucgggaccgacagcgugggcuacgccgucaccgacgacaaguacaagaucaugaaguaccacgggaacgccgcguggggcuccacgaucuucgacgccggggcccugggcgccgaccgccggguguuccgcagcgcccggcgccggcuggaccgccggcaggagcgcauccagcuccugcaggagaucuucgcgaacgagaucgccaagguggacgagcgguucuucauccgccugcucgaguccggccuguggcgggccgacgccgaggaccgcuacgucuucuucaacgacaaggaguacaccgacgugcaguacaugcgggacuaccccaccauccaccaccugaucugcgagcucaucuacaacccgaacaagcacgacgugcgccuggucuaccuggcgugcgccuggcucgugacccaccgggggcacuuccugagcaacaucaacacggagaacaucgccgaccugguggacauccacaacgucuacaacggcuucaugcgcuucuucgaggagaacgagaucaucugcgacuggcgggaggugaacguggaggagcucgggcgcguccuggccgccaacaucggcaucaacgagaaguaccggaaccuguccaccguccucuucgcgacccgcaagcccgacaagaaggccaaggagggguuccccuacagcgaggacgccaucgugcggcugcuggccggcgggaccugcaagcucaaggacguguacaucaaggaggaguacgacgaguucggguccaucacgcugggcauggacgacgagaagaugaccgagaucauggccgacaucggggacgacuucgaccugaucaaggcgcuccgcagccuguacgacuggggcauccuggccaacauccucgugaacgagaacaacagcccccugaucagccaguccaaggugaaggucuacgagcagcaccgcgaggaccuggccaaccucaaguaccuggugcacaaguacaucccgcacaaguacaacgagaucuuccgggagauccgcggcgacaacuacguggccuacagcuaccacuacgagcugaagaacgacgagaagauggggaagaaggccgacgucgagaaguucuccaaguuccuccugaagauccuggagggcaucagcguggacgagcaggacaagguggucuacgacaacaugaucgagcggcucacccugcgccuguuccuccccaagcagaagaacaccgacaaccgggugaucccccaccagcuguacgaguacgagcugaaguccauccucaagaacacgaagaacuaccugcccuuccugaaggagaaggacagcgacgggaucuccaacgaggacaagaucaucagcaucuucaaguucaagaucccguacuucgucggcccccucaacugcaacucccaguucgcguggauccagcgcaaggccgacgggaagaucuuccccuggaacuucgaggacaagguggacuucgacgccagcgagcaggccuucauccagcggaugaccaaccagugcaccuaccugcccgaggagagcgugcugccgaagcagucccucuacuaccagaaguucaugguccugaacgagaucaacaacaucaagaucgacggccgcaagaucagcguggccaugaagcaggagcuguacaacgagaucuucgagaagaagaagcgggugcgcaagaaggacgucaucgacuucuucguguccaacggcuaccuggagggcggcaaggaggcgcucaucagcgggcuggacgagcagauccacaccaaccuguccagcuuccacgccuuccggcgccuccugcagaaccacauccuguccguggaggacgucgagagcaucaucgagcgggccuccuacagcgacgacaagcgccgggugcuccuguuccugaagaacaaguacuccuuccucacggacgaggacaucaaguacaucugcaagaucaagaucaaggacuucggccgccugagcaagaaguuccugguggacuucgaggggaccugcaaggagaccggcgagaucuccaccguccuccggcugaugugggagacgaacaacaaccugauggagcuccugagcgacaaguacaccuucgccaacggcaucaaggagaaccgcaagaaguacuacaccgagcagcagaagacccuggacgaccggcucgacgagauguacaucuccaacagcgugaagcgcacgaucuaccgcacccuguccguggucaaggacgugaccaaggcguucggggugcccaagaagaucuucgucgagauggcccggaccaacaaccccgaccugaagggcaagcgcacgcggacccgccagcagcaggucaucgagcucuacgccaagugcgacgaggaggacgugcgggagcugaagcaccagauggagagccugggggaguacguggacaacaagcuccaguccgacaagcuguuccuguacuucauccaguucggcaagagcgccuacagcgggaagaugaucgaccucgagaagcugauguccggcagcaagguguacgacaucgagcacaucuacccccaggccuacgugaaggacgacuccaucaucaacaacaagguccugguguucagcgaggagaacggcgcgaagcaggacaucuacccgaucaagaccgagauccgcaagcagauguccgggaucuggaccacguggcaccacgugggcgccaucagcgacgagaaguacaagcggcucacccgcuccacccccuucaacgaggacgagaaguacggguucaucaaccggcagcugaccgagacgagccaguccaccaaggccaucgcccagauccugaacgagaaguaccccgagaccgagaucgucuacgugaaggccggccucgugagcgacuuccgccacgaguucggccugugcaagugccgguccuacaacgaccugcaccacgcgaucgacgccuaccucaacgucgugguggggaacgucuacaacaugaaguucaaccgcaagugguucagcguggacuccaaguacagcaucaagaccaagaccaucuucucccacagccuggugugcaacggcaagaucaucugggacaaggagaagaugcugcccaugguccucaagaacgccaagaagaacaacgcccacuucacgaaguaccaguucaugaagaccgggggcuucuucgaccagaugccgugcaagaaggccuccgggcuggugccccggaagaagggccuggacaccgagcgcuacggcggguacaacaagagcggcaucauguuccucacccccaugcgguacaagaucgggaagaaguccgacaucaucauccuguccaucgagcugcucuacggcaagcuguuccugaaggacgagguguucgcgaagaaguacgccgaggagcgccuccagaagaucaucgggaagaaggccgacgaggucagcuuccccaugggcaugaagccguggaagaucaacacggugcugucccuggacggcuucaacgugugcaucaccgggaucggcgggggcgggaagugccucagcgcccagcccaucaugcagcugucccugcccuacgagcucgcgaaguaccugaagaagaucgagaaguucgucgagaagaacaagaacaacgccaacuacaucuacgacgagcaguacgacagcguguccguggacgagaacaucaagcuguacgacgucuaccucgacaagcuggagaacagcaucuacaacaagcggaucaacucccccgaggccauccugaagaacggccgcgagaaguucugcaagcucaacgugcuggagcaggccgugacccugaucaacauccagagcaucuucggccggaugaccgggggcugcgaccucgagaacaucgggggcaagaagcacuccgccgcgacggucaacuucagcuccaacgugagcaacuggaagaaguacuacaacgacgugcgcgucguguaccaguccccgagcgggaucugggagcggcgcucccagaacauccuggagcugcucuga

SEQ ID NO: 1906 - RNA, 4086 nt, Artificial Sequence
  Cas9 variant
augaacgagcccuacggcguggggcuggacaucggcaccaacagcgucggguggaccgugguggacaugaacggccgcguccggaaggugaaggggaagacggcccucggcgcccgccuguucaaggagggcgcgaccgccgaggaccggcgcggguuccggaccacccgccggcgccugaagcgggugaaguggcgccuccggcugcugcgcgaguucuucgaccagccgaucuccaagaucgaccccaacuucuucgcccggcgcaaguacagcgacaucagcccccgggaccccaacuacaacggccucgccaagacgcuguucaacgaccgcaccgacaaggaguucuacgacgacuacgccaccaucuaccaccuccgggacaagcugaugaccuccaaccgcaaguucgacauccgggagaucuaccuggcgauccaccacaucgucaaguaccgcgggaacuuccugcggacgggcccggccucccaguacgggagcgccucccuccaccuggccaccagcuuccagaagcugaacgaccucuucgcgcaguccgaggagacccugaaccugaagcucgugaccgacgaggcccugcugcagcagauccagcagauccucgugcgcacggaccugagccgcuccgagcagcagcggcagaucuggccccugauggccguccucaccggcgccagcgccgcggagaagaagcgccagaagaacgugguggucgagcuguccaaggcccuggugggccucaaggccaagaugaacguggucacccugaccgagguggacgccgccguggucaaggacuggacguucaccauggaggagagccaggacaagcugcccgagaucgaggagcagcucuccgagguggggcagcagaucauggacgaggugauccagcuguacgcgagcgucaaccuggcccagcucauccccgccggcaagcgguucucccagcacaugguggagaaguacaagcaccacgagaagaaccuggagcugcucaaggccuacauccacagccaguccgacagcaagcgcgggcgggagauccgcgccaccuacgaccgguacaucgacggcguggacagcaagccggucacccaggagauguucuacaaggaccugaugaaguacguggaggcggacgccacguccaaccaccuggccgccgagaucaaggacgagaucgacagcgagcaguucaugcccaagcuccgcaccaagcagaacggcuccauccccuaccagguccagcaguacgagcuggaccagaucaucagccaccagaagaaguacuaccccuggcugggggaggagaacccgguggccgagcggcgcggcaaguuccccuacaagcucgacgagcuggugggguuccggguccccuacuacgugggcccccugaucaccaaggaggaccagcaggcgaccuccggggccggcuucgccuggauggugcgcaaggccgacggcccgaucacgcccuggaacuucgaccagaaggucgaccggaucgcgagcgccaccgccuucauccagcgcaugcagaccaccgacacguaccucaucggggaggacgugcugcccgcccggucccugaucuaccagcgcuucauggugcucaacgagcugaacaacaugcgggucgaggaccgcaagcuggcgccccagcagaagcagcggcuguacaaccagguguucaagcagcaccagcacgugagcgucaagaacauccagcagaaccucauggacgccggcgaguaccgcaagaccccgcagaucaccgggcuggccgaccccaagggcuucaacuccagccuguccaccuaccacgacuucaagaagauccuccuggaggccaucgccgacgagcacaagcgcgccgacaucgagaagaucauccuguggagcacgaccuucgaggacuccgcgaucuucaagcagaagcucgaggagguggccuggcugaccgacgcccagcggaagcagcugagcgggcuccgcuaccggggcuggggccagcugucccacaagcugcucaccgccuucaaggacgacaaggggcgcagcaucauggacggccugugggagacguccgacaacuucaugcagcugcggaagcagcccgccaucgagacccagaucaaggaggcgaaccaggccaaccucaccgacgccgacauccaggacaccaucaacgagcuguacaccagcccccagaacaagaaggccauccgcgaggugaugcugguccucgacgacaucaagaacgcgaugcacgggcagacgccguccuggaucuucguggaggccgcccggggcgggggcguggccggccgccggacccagagccgcagcucccagaucgucgaggccuacaaggggaccgcgaaggagaucgugagcgagaaggugcagcacgagcugaacgagaagaucaaggccaaggccgacuucaacacccggcugguccucuacuuccugcagaacggccgcgaccuguacacgaacgaggccaucaacaucgaccggcucuccgaguacgacaucgaccacauccugccccagagccuggugaaggacgacucccucgacaaccgcgugcugaccagcgcccggaucaaccgcgagaagaacgacaccuucgcguccgagaaguucgggcggaagaugggcgcccaguggcgcgagcugcaccggaacggccucaugacccagcgcaagcugaagcaccuccugaugcggcccgacgagaucagcaagcacgccacggacuucaucaaccgccagcuggucgagacccgccaggugaucaagcugguggaggagcucaucuccagcgaguaccccgccgccuccaucgucgcggugaaggccaaccugacccaccaguuccggcagaccuucaacuucccgaagcugcgcgaggugaacgacuaccaccacgccuucgacgccagccucacggcguucaucgggauguaccugcugaagcaguaccccaagcucgagcgguucuucgucuacggcaaguucgccaagcagcccaucaaccugacccgcuucaacaucauccggaagcuggccguggccgagaagccgaucgccaacaucgagaccggggagauccucugggacaagaccgcggacaucaaguacuucgagaagcuguacaacuacaagcgccugcucgugacgcacgagguccgggagaacuacggcgccauguucaagcagacccuguucaaggccuccuacaacaagagcaagacccuggugcccaagaagaaccacauggagaccuccguguacgggggcuacagcaaccaggagacggccuaccucgccaucguccgcauccccuucaaguccggcuucaaguucaucgugguggggauccccacccggauggucgcgaagaucaagcacuaccagagccugggcgccacccugaaccaggccacccacaaggugaucgagccgaaguucacgaagaucagccgcaagaccaagcagaccgugaucuccgacuacgaggucgugcuccccaagguguaccuggaccaggucgugcgggaccaggugaaggggcagauguaccgcuucagccugggcuccgacaaggaguaccacaacguccaggagcucuaccugccccugagcauccagcaggccuucguggggcacuacgacgaguccgacgaccagcggagcaacgaccucgugaaggucuacgacgccgcgcugaagcagcugcagcgcuacuucccccuccaccugucccggaacuucgaccagguggccagccaggcccaccaguccuucgagggccugaagaacaacguccagaccagcgacaagcagcucggcaagaaggaggugcugaacucccuguucguggggcuccacgccaacgccacgcgcagcaaccuguccguccugggcaugagcaaggacuucgggcggaucaaguccaacggcaucacccucaccgaccaggcggagaucaucuaccagagcccgaccgggcuguucgagcgcaagguggcccugaaggaccucuga

SEQ ID NO: 1907 - RNA, 4086 nt, Artificial Sequence
  Cas9 variant
augggcaacuacuaccuggggcucgacaucggcaccaacagcguggggugggccgucaccgacgagaacuacaacaucgagcgcuucaagaagaagaacauguggggcauccggcuguucgacgaggccaagacggcggagucccgccggauccaccgccaggcccggcgcaugcggcagcgcaagauccagcggcugaaccuccugauggagcuguucgacguggagaucagcaagguggacgaguccuucuucauccgcaagaaggagagcgaccuccacuacgaggacaagucccaggacagccgguacgcccuguucaacgacaaggaguucaacgacaaggacuaccacaacaaguaccccaccaucuuccaccugaucauggaccucaucgagaacgacgagaagaaggacauccgccugcuguaccucgccugccacuaccugaucaagaaccgggggcacuucaucuucgagggccagaaguucgacgucaacuccagccugaacaacaacaucaacaagcucaagucccaccuggaccaguucuacaacaucugccuggacuucgacaacgacaagcucaucgagauccuggugaaccagaaccugaacaucagcgagaaguccaagaagaucaaggagcuccugcgcaagaccaaccuggaggugggcaucgccaaccucaucgccgggggcagcaucaagcuguccaacauguucgacgacgacgagcugaagaacuucgacuacaacagccucuccuucaagaacagcaacuucgacgaggggcgggagcuguucgaggagguccuggaggaccgcuucgagcucguggagauccugaaggacauccacgacgcguccgugcuggagaccaugcucagcuccgccagcaucagcccggacggcgggaaguacaucuccagcuccaugaucaacagcuacaacaagcacaagcgggaccugaagcugcucaagaagaucaucaagaaguacaagaaguccgaguacgacaacaucuuccgcgacgagaacaucaagaacaacuaccugagcuacacgcggaccggcaucaacaagaacaagaagguccaggccaaggacaacaccgacuccgacggcuucuacaaguacaucgugaagauccugaaggacaucaaggagaacgacagcgacgaggacaucaaguacauccucuccgagaucgacaagaagaacuucgugcccaagcagcgcaccaaggagaacagcgucauccccuaccagcugcgggagaucgagcugcgcaagaucaucgacaaccaguccaaguaccacaaguuccucaacgagguggacgagaaggggaucagcgugaaggagaagaucaucgcgcugcugacguuccgcauccccuacuacaucggcccgcucaaccccuccuacaacgaggagaagaacuucaccaccagcugggucaagcggcuggccaaggggaaggugacccccuggaacuucgaggacaugguggacaucgacgccucccgcgaggccuucaucgagaacaagcugaacaagugcagcuuccuccuggacgagacgguccugcccaaggacucccugcucuaccaggaguacauggugcugaacgagcugaacaaccucaagaucaacggccagagcaucaacaccgaccugaagaaguccaucuacgaggagcuguucaagaaguacaagaaggugacccggaagcgccucaucagcuacaucaaggagaaggagaacaccagcggcgacaucgucaucacggggaucgacggcgacuucaagcaggggcugaaguccuacaucgccuucaaggagaucaucggcgagaagaucgacaacgacaucuaccggaaggagguggagaagaucauccgcgacaucagccuguacggggacgacaaguccuucauccagaagaagaucaagaacgagaacaagcucgaccugagcgacaaccagaucuccaagaucgcgaagcugaaguucaaggacuggggccgguucagcaagaagcuccuggugggcaucaaggccuccgacaagaacaccggggagaucgacaacaucaucggcuucaugcgcaacuacaacuacaacaucaugcagcugauggccaacgucuucaccuucaaggacgagaucgagaagcucaacagcaaguacuacaccuacgagaagaucaacguggacuaccuggacgaccuguaccucuccgccccggccaagcggaugcuguggcagagcuuccagaucgucgacgagaucaagaacaucaagaacuccgcgcccaagaagaucuucaucgagauggcccgcagcaaggaggacaagcccacgcggaagaugucccgcaagagccggcuggagaagcucuacaccgacuccaagaagcaguucaucaagcuguucgggcccgacgaguacgacaagcugaacaacgagaucaagaacaagagcgaguccgacuuccgcugggacaaccucuaccuguacuacacccaguucggccggugcauguacagccuggacccgaucgaccucgaggagcugagcaacaagaaccuguacgaccaggaccacaucuaccccaaguccaagaucuacgacgacagcaucgagaaccgcgugcucgugaagaagcagcugaaccuggacaaguccaacgaguaccccauccccgaccggguccucaacaaggacaagaacaagcugcuggccuucuggaagaugcucaacgagaaggagcugaucggggacaagaaguacgcccgccugauccgcaagagcccguucaccgacgaggagcucggcgacuucaucgcccggcagcugguggagacgcgccaggcgaccaaggagaccgccaacaugcugcggcgccucugccccgacuccaagaucguguacgucaaggccaagaacgugagcgacuuccggcgcaaguucgacauccugaagugccgguccaucaacgaccugcaccacgcccacgacgccuaccucaacaucguggucggcaacguguucgacaccaaguucacgagcaacccccugaacuucaucaagaacaacuccaagaaccgcagcuacaaccuggagaagaucuacgacuacgacgugauccggaacgagaagaucgcguggcucgccgagcgcaaggaggagaaccaggacggguccaucgccaccguccugaagaaccugagcaagaacgacauccgggugacccgccggaccuacaucaagugcgaggaccucuucgacgagaacaucgugcgcaagggcaacgggaaguucccccugaaggagaacaacaacaaguccgacacgaacaaguacggcggguacagcggcaucaagaacgccuacuucguccugcucgaggacgagaagcacaaccggaucaucgaggcgaucccguccuucaucuacaagaaggagaagaacggcgagaaggggagcgugaucaacuaccugcagaacauccugggcaucaaguccgccaagauccuccgcgacaagaucaagaucgggagccugcugaagaucgacaaguuccccuacaaccucgccggcaaguccggcaacgggauccugaucagcggcggggugcagcugauccucgacaagaacaccagcaaguacaucaagaagaucgagaacuacaaguacaagcuggacgagaacaaggacuaccagaucaacaucuucgacaagcuguccaaggaggagaacaucaagcuguucgaccucuucgucgacaaguucgagaacagcaucuacaagaaccgggugaacaucaagcugaaggagaucaagcucgcccgcuccaaguucgagcaccugagcaucgaggagcagaucaagacccugacccagaugcucauccuguucggccgggagaacaacgccgugaaccuggaguacaucgggcuccccaagaacacgggcaagaccaagaucaacaagaagaucaacaacaaggacaucaagaucaucaaccaguccaucaccggccuguacgagaccgaggaggaccuggcgaacaucuga

SEQ ID NO: 1908 - RNA, 4089 nt, Artificial Sequence
  Cas9 variant
augaagaagcccuacagcaucggccuggacaucgggaccaacuccgugggcugggccgucaucaccgaggacuacaaggugccggccaagaagaugaaggugcucgggaacacgagccgcgacuucaucaagaagaaccugcugggcgcgcuccuguucgacuccggggagaccgccgaggcccggcgccugaagcggaccgcccgccggcgcuacacccggcgccggaaccgccuccgguaccugcaggagaucuuccuggacgagaugaacaagcucgacagcggcuucuuccaccgccuggacgacuccuuccugguccccgaggagaagcggggcagccgcuaccccaucuucgggacgcuccaggaggaggugaacuaccacgagaacuuccccaccaucuaccaccuccggaagaagcuggccgacuccaaggagaaggcggaccuccgccugaucuaccuggcccucgcccacaugaucaaguaccggggccacuuccuguacgaggagagcuucgacuccaacaacaacagcauccaggagaucuucaacgaguucaccgccgaguaccacaacaccaucgagggguccugccugagcggccagaucgagcaggucgaggcgauccucacggacaagaucuccaagagcgccaagcgcgagcggauccugaagcuguucccggccgagaaguccaccgggcuguucagcgaguuccugaagcugaucgugggcaaccaggccgacuucaagaagcacuucgaccucgaggagaagaccccgcugcaguucuccaaggacaccuacgaggaggaccuggagaaccuccuggagcagaucggcgacgaguucgccgaccuguuccuccuggcgaagaagcuguacgacgccacgcuccuggccgggauccugaccgccaccgacgugagcaccaaggcgccccucuccgccagcaugaucaaccgcuacgagacgcaccagcaggaccuggccgcccugaagcaguucaucaagaacaagcuccccgagaaguacagcgagguguucuccgaccugagcaaggacggcuacgccggguacaucaacggcaagaccacccaggaggccuucuacaaguacaucaagaaccugcucaucaaguucgagggcgcggucgacuuccuggagaagaucgagcgggaggacuuccugcgcaagcagcgcaccuucgacaacggguccaucccgcaccagcuccaccuccaggagaugaacgccauccugcggcgccagggcgaccacuaccccuuccugaaggagaaccgggagaagaucgagaagauccucacguuccgcauccccuacuacguggggccccuggcccggggcaaccgcgacuucgccuggcugacccggaacagcgaccaggccauccgcccguggaacuucgaggagguggucgacaagaccuccagcgcggaggacuucaucaacaagaugaccaacuacgaccucuaccugcccgaggagaaggugcugcccaagcacuccauccucuacgagacguucgccguguacaacgagcugaccaaggucaaguucaucgccgaggggcugcgggacuaccaguuccucgacagcggccagaagaagcagaucaucaaccugcuguucaaggacaagcgcaaggugaccgagaaggacaucauccacuaccuccacaccguggacggcuacgacgggaucgagcugaagggcaucgacaagcaguucaacgccucccugagcacguaccacgaccuccugaagaucaucaaggacaaggacuucauggacgacgcggacaacgaggccauccuggagaacaucguccacacccucaccaucuucgaggaccaggagaugaucaagcagucccuggcccaguacgacgccaucuucgaccggaaggugaugaaggcccugacccgccggcacuacacgggguggggcgagcucagcgcgaagcugaucaacgggauccgcgacaagcagaccggcaagaugauccuggaguaccucaaggacgacggcgagaucaaccggaacuucaugcagcugaucaacgacgacucccugagcuucaaggagaccauccagaaggcccaggugaucggggagaccgagaacaucaagcagaucguccaggagcuccccggcuccccggccaucaagaaggggauccugcagagcaucaagaucguggacgagcugguggagaucaugggcuacaaccccgaguccaucgucguggagauggcccgcgagaaccaguucacgaaccaggggcggcgcaacagccagcagcggcucaagaagcugaccgacuccaucaacaagcugggcagcagcauccucgaggagcaccccgucgacaacucccagcugcagaacgaccgccuguuccucuacuaccugcagaacggcaaggacauguacaccggggaggcccuggagcucagcaagcuguccagcuacgacguggaccacaucaucccccaggcguucaucaaggacgacucccuggacaaccgcgugcucgucagcuacgccaagaaccggggcaaguccgacgacgugccgagccuggagaucgugcagaagcgcaaggccuucuggcggcagcugcucgacucccagcugaucagcgagcgcaaguucaacaaccugaccaaggccgagcgcgggggccucaccgaggacgacaaggccggcuucaucaagcggcagcuggucgagacgcggcagaucaccaagcacguggcgcagauccuggacgcccgcuucaacaccgaggugaccgagaaggggaagaagaagcgggccgucaagaucaucacgcucaaguccaaccuggugagcaacuuccgcaaggacuucgagcuguacaaggugcgggagaucaacgacuaccaccacgcccacgacgcguaccucaacgccgucgugggcaccgcccugcugaagaaguaccccaagcucgagcccgaguucguguacggggacuaccccaaguacaacuccuaccgcgagcggaagaccgccaccgagaaggucuacuucuacagcaacaucaugaacuucuucaagacgaccgugaagcuggccgacggcuccgagaagaagcgccaccagaucgagaccaacgaggagaccggggagaucgugugggacaagacgaagcacuucgagaucguccggaaggugcugagcuacccccaggugaacaucgucaagaagaccgaggagcagaccgugggccagaacggcgggcuguucgacaacaacaucguguccaagaacaaggucguggacgcgagcaagcugauccccaucaagagcggccugucccccgagaaguacgggggcuacgcccgccccaccaucgccuacagcgugcucgucaucgccgacaucgagaaggggaaggccaagaagcugaagcggaucaaggagauggugggcaucacgauccaggacaagaagaaguucgaggcgaacccgaucgccuaccuggaggagugcggcuucaagaacaucaacuccaaccacaucaucaagcuccccaaguacagccuguucgaguucgacgacgggcagcgccggcugcucgccuccagcaucgagcugcagaagggcaacgagcugauccuccccuaccaccugaccgcccugcucuaccacgcccagcgcaucaacaagaucuccgagccgauccacaagcaguacguggaggcgcaccagaacgaguucgaggagcugcugaccaccaucaucagccucuccaagaaguacauccagaagcccaacgucgagagccugcugcagcaggccuucgaccagacggacgaggacaucuaccagcucuccgagagcuucaucucccugcugaagcucaucagcuucggggcccccggcgccuucaaguuccuggggguggacaucucccagagcaacgugcgguaccaguccgucagcuccugcuucaacgcgacccugauccaccagagcaucaccggccucuacgagacccgcaucgaccugagcaagcugggcgaggacuga

SEQ ID NO: 1909 - RNA, 4089 nt, Artificial Sequence
  Cas9 variant
augaacgagcccuacggcguggggcuggacaucggcaccaacagcgucggguggaccgugguggacaugaacggccgcguccggaaggugaaggggaagacggcccucggcgcccgccuguucaaggagggcgcgaccgccgaggaccggcgcggguuccggaccacccgccggcgccugaagcgggugaaguggcgccuccggcugcugcgcgaguucuucgaccagccgaucuccaagaucgaccccaacuucuucgcccggcgcaaguacagcgacaucagcccccgggaccccaacuacaacggccucgccaagacgcuguucaacgaccgcaccgacaaggaguucuacgacgacuacgccaccaucuaccaccuccgggacaagcucaugaccuccaaccgcaaguucgacauccgggagaucuaccuggcgauccaccacaucgucaaguaccgcgggaacuuccugcggacgggcccggccucccaguacgggagcgccucccuccaccuggccaccagcuuccagaagcugaacgaccucuucgcgcaguccgaggagacccugaaccugaagcucgugaccgacgaggcccugcugcagcagauccagcagauccucgugcgcacggaccugagccgcuccgagcagcagcggcagaucuggccccugauggccguccucaccggcgccagcgccgcggagaagaagcgccagaagaacgugguggucgagcuguccaaggcccuggugggccucaaggccaagaugaacguggucacccugaccgagguggacgccgccguggucaaggacuggacguucaccauggaggagagccaggacaagcugcccgagaucgaggagcagcucuccgagguggggcagcagaucauggacgaggugauccagcuguacgcgagcgucaaccuggcccagcucauccccgccggcaagcgguucucccagcacaugguggagaaguacaagcaccacgagaagaaccuggagcugcucaagaccuacauccacagccaguccgacagcaagcgcgggcgggagauccgcgccaccuacgaccgguacaucgacggcguggacagcaagccggucacgcaggagauguucuacaaggaccugaugaaguacguggaggccgacgcgaccuccaaccaccuggccgccgagaucaaggacgagaucgacagcgagcaguucaugcccaagcuccgcaccaagcagaacggcuccauccccuaccagguccagcaguacgagcuggaccagaucaucagccaccagaagaaguacuaccccuggcugggggaggagaacccgguggccgagcggcgcggcaaguuccccuacaagcucgacgagcuggugggguuccggguccccuacuacgugggcccccugaucaccaaggaggaccagcaggccacguccggggcgggcuucgccuggauggugcgcaaggccgacggcccgaucacccccuggaacuucgaccagaaggucgaccggaucgccagcgcgaccgccuucauccagcgcaugcagaccacggacaccuaccucaucggggaggacgugcugcccgcccggucccugaucuaccagcgcuucauggugcucaacgagcugaacaacaugcgggucgaggaccgcaagcuggcgccccagcagaagcagcggcuguacaaccagguguucaagcagcaccagcacgugagcgucaagaacauccagcagaaccucauggacgccggcgaguaccgcgaggccccgaagaucaccgggcuggccgaccccaagggcuucaacuccagccuguccaccuaccacgacuucaagaagauccuccccgaggccaucgccgacgagcacaagcgcgccgacaucgagaagaucauccuguggagcacgaccuucgaggacuccgcgaucuucaagcagaagcuggaggagguggccuggcucaccgacgcccagcggaagcagcugagcgggcugcgcuaccggggcuggggccagcucucccacaagcugcugaucgccuucaaggacgacaacgggcgcagcaucauggacggccucugggagaccuccgacaacuucaugcagcugcggaagcagcccgccaucgagacgcagaucaaggaggcgaaccaggccaaccugaccgacgccgacauccaggacaccaucaacgagcucuacaccagcccgcagaacaagaaggccauccgcgaggugaugcugguccuggacgacaucaagaacgcgaugcacgggcagacccccuccuggaucuucguggaggccgcccggggcgggggcguggccggccgccggacgcagagccgcagcucccagaucgucgaggccuacaaggggaccgcgaaggagaucgugagcgagaaggugcagcacgagcucaacgagaagaucaaggccaaggccgacuucaacacccggcugguccuguacuuccuccagaacggccgcgaccuguacaccaacgaggccaucaacaucgaccggcuguccgaguacgacaucgaccacauccucccccagagccuggugaaggacgacucccuggacaaccgcgugcucacgagcgcccggaucaaccgcgagaagaacgacaccuucgcguccgagaaguucgggcggaagaugggcgcccaguggcgcgagcugcaccggaacggccugaugacccagcgcaagcucaagcaccuccugaugcggcccgacgagaucagcaagcacgccaccgacuucaucaaccgccagcuggucgagacgcgccaggugaucaagcugguggaggagcugaucuccagcgaguacccggccgccuccaucgucgcggugaaggccaaccucacccaccaguuccggcagaccuucaacuuccccaagcugcgcgaggugaacgacuaccaccacgccuucgacgccagccugaccgcguucaucgggauguaccuccugaagcaguaccccaagcuggagcgguucuucgucuacggcaaguucgccaagcagccgaucaaccucacgcgcuucaacaucauccggaagcuggccguggccgagaagcccaucgccaacaucgagaccggggagauccugugggacaagaccgcggacaucaaguacuucgagaagcucuacaacuacaagcgccugcuggugacccacgagguccgggagaacuacggcgccauguucaagcagacgcuguucaaggccuccgacaacaagagcaagacccuggugcccaagaagaaccacauggagaccuccguguacgggggcuacagcaaccaggagaccgccuaccuggccaucguccgcauccccuucaaguccggcuucaaguucaucgugguggggaucccgacgcggauggucgcgaagaucaagcacuaccagagccucggcgccacccugaagcaggccacccacaaggugaucgagcccaaguucaccaagaucagccgcaagacgaagcagaccgugaucuccgacuacgaggucgugcugcccaagguguaccucgaccaggucgugcgggaccaggugaaggggcagauguaccgcuucagccugggcuccgacaaggaguaccacaacguccaggagcuguaccucccccugagcauccagcaggccuucguggggcacuacgacgaguccgacgaccagcggagcaacgaccuggugaaggucuacgacgccgcgcucaagcagcugcagcgcuacuucccgcugcaccucucccggaacuucgaccagguggccaaccaggcccaccagagcuucgagggccugaagaacaacguccagaaguccgacaagcagcugggcaagaaggaggugcucaacagccuguucguggggcugcacgccaccgccacccgcuccaaccucagcguccugggcauguccaaggacuucgggcggcugcagagccgcuccggcaucacgcucaccgaccaggcggagaucaucuaccagagccccaccgggcuguucgagcggaagguggcccugaaggaccucuga

SEQ ID NO: 1910 - RNA, 4089 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccaagcgccgggccgggcgcacgacccggcgccggcucucccgcaaccgguggcgccugagcuuccugcgggacuucuucgagucccacaucaccccgaccgaccccaacuucuucaugcgccagaaguacagcgagaucucccccaaggacaaggcgcgguacaaguacgagaagcgccucuucaacgaccggacggacgccgaguucuaccagcaguacagcaccauguaccaccuccgcaaccggcugaugaccgaccccucccgcgccgacgugcgggagaucuacuucgccauccaccacauccucaagagccgcggccacuuccugaccccgggggacgcgaaggacuucaacacgaacgacgucgcccuggacgagaucuuccccgcccugcaggacgccuacgcccagguguaccccgaccugggcaucaccuucgacgaggacaaggcgaacgaguucaagaccauccugcucaacgagaucgccaccuccaucgacacgcagcgggcccuggugaagcugcuccuggccgaggaggacgacaaggacauccugaagcagcagaagcagguccucaccgaguucgccaaggcggugguggggcugaagaccaagcugaaccucgcccugggcaccgaggucgacagcuccgaggccacggccuggaacuucagccugggccagcucgacgacaagugggccgggaucgaguccgcgaugaccgacgagggcaccgagauccuggaccagauccgcgaccuguaccgcgcccggcuccugaacgggaucgugcccaccggcaagacgcugagccaggccaagguggacgacuacacccagcaccacgaggaccuccagcuguucaaggccuaccugaagcagcucgaggacgacggcaccgccaaggcgauccgccagcuguacgaccgguacaucgacggggacgacgccgccccguuccugcgcgagaacuucgucaaggcccucaccaaggacgugacggcgcaccccaacaccaagucccccgagcugcuggagcggcucgcccagcccgacuucaugcugaagcagcgcaacaaggccaacggcgccaucccggugcagaugcagcagcgggagcuggaccagaucaucaagaaccaggccgucuacuacgacuggcucgcggcccccaaccccguggagaagcaccgcaagagcaugcccuaccagcuggacgagcugcucaacuuccggaucccguacuacguggggccccuggucaccgccaaggagcagaaggccgcccagggcgggguguucgcguggauggugcgcaaggaccccgagggcaacaucacccccuacaacuucgacgagaaggucgaccgggaggccuccgccaacacguucauccagcgcaugaagaccaccgacaccuaccugaucggcgaggacgugcugccgaagcagagccuccuguaccagcgguacgaggugcugaacgagcucaacaacguccgcgugaacaacgagaagcugagcaucgagcagaagcagcaggucauccgggagcuguucgagcgccacaacuccgugacgaucaagcaguucgccgagaaccuccgggcccacggggacuacgcgcacauccccgagauccgcggccuggccgacgagaagcgguuccugagcucccucagcaccuaccgccagcugaagucccugcuccccgaggccaucgacgaccccgccaagcaggcggacaucgagaacaucaucgccuggagcaccguguucgaggacgccgccaucuucaagaccaagcugaaggagaucuccuggcuggggagcgaggccaucacgaagcucuccaacauccgcuaccggggcugggggcaguucagccgcaaguuccugaacggccugacccucggcaacgggcacaccaucauccaggagcugcugcucuccaccaacaaccugaugcagauccugaccgacgagacgcuccagaagaagaugaccgagcugaacgcggacaagcugaagaccgccaacaucaacgacgccaucgacaacgccuacaccagcccguccaacaagaaggcccuccggcagguccugcgcgugguggacgacaucaagcgggcggccgacggccaggaccccagcuggcuguacgucgagacggccgacgggggcgggacccccggcaagcgcacccgggcccgccagcaccagcuccaggagaucuacgccaacgcggcccacgagcugaucgacaccgccgugcggggcgagcuggaggacaagaucuccgacaaggccgacuucaacgaccgccucgugcuguacuucaugcagggcgggcgggacaucuacacgggggcgccccugaacaucgaccagcucagcuccuacgacaucgaccacauccugccgcagagccugaucaaggacaacucccucgacaaccgcguccuggugcacgccaucaucaaccgggagaagaacgccaccuucgccagcaccaucuacgcccagaagaugaacgcgaccuggcgccaguggcacgaggccggccugaucagcggccggaagcuccgcaaccugcagaugcggcccgaccagaucgacaaguacgccuccggguucguggcccgccagcuggucgagacgcggcagaucaucaagcucaccgagcagaucguggccgcgcaguaccccgacaccaagaucaucgccgugaaggccggccugagccaccagcugcgcgaggagcucgaguucccgaagaaccgggacgucaaccacuaccaccacgccuucgacgccuuccuggcggcccgcaucgggaccuaccugcucaagcgcuuccccaaccugcaggccuucuucacguacggcaaguucaccaaggccgacgugaagaagcugcggggguucaacuucauccgcgacaucacccacgccgaggacaagaucguggcgaaggacaccggcgaggucgugugggacaagcagcgggacguggacgagcucgaccgcaucuacaacuucaagcggaugcugaucacgcacgagguccgcuucgagaccgccgaccuguucaagcagaccguguacggcgcccgggacuccaaggaggccgggggcagcaagcagcucauccccaagaagaagggguaccccguggacaucuacggcggguacuuccgcgagaacaccgcguaccuggccgucgugaaggugacgaagaagaccgagaccaucuucaaggucgugaagaucgccaccucccagguggccgcccugaacaaggcgcggagccgcuccacggccgaggagcucagcguccugaccgagcugcucaagccgaaguucuccaaggugggcaagaacggcaagaucaccgacacccccuucgaggugguccugccccgggugccccgcgagcagcuguucuacaacgccaaguacggguucuucauggugaacagcgacacgauguuccacaacuuccaggagaucugggucucccggagcgaccagaagauccuccagcagauccgcaaggccaagaucgacuacccgaacguggaccaggaccuggacaaccuguuccacaaccucgccgaccagaucgugaaguacuucgaccuguacuccaucgcgggcuucaaggagaagaucagccagucccagaacaccuucaacgaccuggccgucgacgacaccgaccagagcguggggaagaucaccgugaucaacgagcuccugaagggcgcccaggccaacgggaugacgggcucccugaagguccucaagaucagcacccccuucggcuucacccaggacaagagcggggugcugaccaaggacuccagcaucaucuaccagucccccaccggccuguucgagcggagcgugcgccucacggaccuguga

SEQ ID NO: 1911 - RNA, 4089 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccaagcgccgggccgggcgcacgacccggcgccggcucucccgcaaccgguggcgccugagcuuccugcgggacuucuucgagucccacaucaccccgaccgaccccaacuucuucaugcgccagaaguacagcgagaucucccccaaggacaaggcgcgguacaaguacgagaagcgccucuucaacgaccggacggacgccgaguucuaccagcaguacagcaccauguaccaccuccgcaaccggcugaugaccgaccccucccgcgccgacgugcgggagaucuacuucgccauccaccacauccucaagagccgcggccacuuccugaccccgggggacgcgaaggacuucaacacgaacgacgucgcccuggacgagaucuuccccgcccugcaggacgccuacgcccagguguaccccgaccugggcaucaccuucgacgaggacaaggagaacgaguucaagaccauccugcucaacgagaucgcgaccuccaucgacacgcagcgggcccuggugaagcugcuccuggccgaggaggacgacaaggacauccugaagcagcagaagcagguccucaccgaguucgccaaggccgugguggggcugaagaccaagcugaaccucgcgcugggcaccgaggucgacagcuccgaggccacggccuggaacuucagccugggccagcucgacgacaagugggccgggaucgaguccgccaugaccgacgagggcaccgagauccuggaccagauccgcgaccuguaccgcgcgcggcuccugaacgggaucgugcccaccggcaagacgcugagccaggccaagguggacgacuacacccagcaccacgaggaccuccagcuguucaaggccuaccugaagcagcucgaggacgacggcaccgccaaggccauccgccagcuguacgaccgguacaucgacggggacgacgcggccccguuccugcgcgagaacuucgucaaggcccucaccaaggacgugacggcccaccccaacaccaagucccccgagcugcuggagcggcucgcgcagcccgacuucaugcugaagcagcgcaacaaggccaacggcgccaucccggugcagaugcagcagcgggagcuggaccagaucaucaagaaccaggccgucuacuacgacuggcucgccgcgcccaaccccguggagaagcaccgcaagagcaugcccuaccagcuggacgagcugcucaacuuccggaucccguacuacguggggccccuggucaccgccaaggagcagaaggccgcccagggcgggguguucgccuggauggugcgcaaggaccccgagggcaacaucacccccuacaacuucgacgagaaggucgaccgggaggcguccgccaacacguucauccagcgcaugaagaccaccgacaccuaccugaucggcgaggacgugcugccgaagcagagccuccuguaccagcgguacgaggugcugaacgagcucaacaacguccgcgugaacaacgagaagcugagcaucgagcagaagcagcaggucauccgggagcuguucgagcgccacaacuccgugacgaucaagcaguucgccgagaaccuccgggcccacggggacuacgcccacauccccgagauccgcggccuggcggacgagaagcgguuccugagcucccucagcaccuaccgccagcugaagucccugcuccccgaggccaucgacgaccccgccaagcaggccgacaucgagaacaucaucgcguggagcaccguguucgaggacgccgccaucuucaagaccaagcugaaggagaucuccuggcuggggagcgaggccaucacgaagcucuccaacauccgcuaccggggcugggggcaguucagccgcaaguuccugaacggccugacccucggcaacgggcacaccaucauccaggagcugcugcucuccaccaacaaccugaugcagauccugaccgacgagacgcuccagaagaagaugaccgagcugaacgccgacaagcugaagaccgcgaacaucaacgacgccaucgacaacgccuacaccagcccguccaacaagaaggcccuccggcagguccugcgcgugguggacgacaucaagcgggccgcggacggccaggaccccagcuggcuguacgucgagacggccgacgggggcgggacccccggcaagcgcacccgggcccgccagcaccagcuccaggagaucuacgccaacgccgcgcacgagcugaucgacaccgccgugcggggcgagcuggaggacaagaucuccgacaaggccgacuucaacgaccgccucgugcuguacuucaugcagggcgggcgggacaucuacacgggggcgccccugaacaucgaccagcucagcuccuacgacaucgaccacauccugccgcagagccugaucaaggacaacucccucgacaaccgcguccuggugcacgccaucaucaaccgggagaagaacgccaccuucgccagcaccaucuacgcccagaagaugaacgccaccuggcgccaguggcacgaggcgggccugaucagcggccggaagcuccgcaaccugcagaugcggcccgaccagaucgacaaguacgccuccggguucguggcccgccagcuggucgagacgcggcagaucaucaagcucaccgagcagaucguggccgcccaguaccccgacaccaagaucaucgcggugaaggccggccugagccaccagcugcgcgaggagcucgaguucccgaagaaccgggacgucaaccacuaccaccacgccuucgacgccuuccuggccgcgcgcaucgggaccuaccugcucaagcgcuuccccaaccugcaggccuucuucacguacggcaaguucaccaaggccgacgugaagaagcugcggggguucaacuucauccgcgacaucacccacgccgaggacaagaucguggccaaggacaccggcgaggucgugugggacaagcagcgggacguggacgagcucgaccgcaucuacaacuucaagcggaugcugaucacgcacgagguccgcuucgagaccgcggaccuguucaagcagaccguguacggcgcccgggacuccaaggaggccgggggcagcaagcagcucauccccaagaagaagggguaccccguggacaucuacggcggguacuuccgcgagaacaccgccuaccuggcggucgugaaggugacgaagaagaccgagaccaucuucaaggucgugaagaucgccaccucccagguggccgcccugaacaaggcccggagccgcuccacggcggaggagcucagcguccugaccgagcugcucaagccgaaguucuccaaggugggcaagaacggcaagaucaccgacacccccuucgaggugguccugccccgggugccccgcgagcagcuguucuacaacgccaaguacggguucuucauggugaacagcgacacgauguuccacaacuuccaggagaucugggucucccggagcgaccagaagauccuccagcagauccgcaaggccaagaucgacuacccgaacguggaccaggaccuggacaaccuguuccacaaccucgccgaccagaucgugaaguacuucgaccuguacuccaucgccggcuucaaggagaagaucagccagucccagaacaccuucaacgaccuggcggucgacgacaccgaccagagcguggggaagaucaccgugaucaacgagcuccugaagggcgcccaggccaacgggaugacgggcucccugaagguccucaagaucagcacccccuucggcuucacccaggacaagagcggggugcugaccaaggacuccagcaucaucuaccagucccccaccggccuguucgagcggagcgugcgccucacggaccuguga

SEQ ID NO: 1912 - RNA, 4089 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccgaccgccgggccucccgcacgacccggcgccggcucagccgcaaccgguggcgccuguccuuccugcgggacuucuucgagagccacaucaccccgaccgaccccaacuucuucaugcgccagaaguacuccgagaucagccccaaggacaagucccgguacaaguacgagaagcgccucuucaacgaccggacggacgcggaguucuacaaguacgagaacugccccaccauguaccaccuccgcaaccggcugaugaccgacccgagcaaggccgacgugcgcgagaucuacuucgccauccaccacauccucaagucccgggggcacuuccugacccccggcgacgccaaggacuucaacacgaacaaggucgcggugaacaagaucuuccccgcccugcaggacgccuacgcccagguguaccccgaccucgacaucaccuucgacgagaacaaggucaacgaguucaagaccgugcugcugaacgagaaggccaccccgagcgacacgcagcgcgcgcucgugaaccugcugcucgccaaggagggggaccgggacauccugaagcagcagaagcaggcccugaccgaguucgccaaggccgucgugggccucaagaccaagcugaacguggcgcuggggaccgaggucgacuccagcgaggccacggccuggaacuucucccucggccagcuggacgacaaguggaccggcaucgagagcgccaugaccgacgaggggaccgagauccuggaccagauccgcgaccucuaccgcgcccggcugcugaacggcaucgugcccgcggggaagacgcucucccaggccaagguggacgacuacgcccagcaccacgaggaccuggagcuguucaaggacuaccucaagcagcuggaggacgacggcaccgccaaggccauccgccagcuguacgaccgguacaucgacggcgacgacgcgaagcccuucguccgcgaggacuucgugaaggcccucaccaaggaggugaccgcccaccccaacgccaagagcccggagcugcuggagcggcucgcgcagcccgacuucaugcugaagcagcgcaacaaggccaacggggccauccccguccagaugcagcagcgggagcuggaccagaucaucaagaaccaguccguguacuacgacuggcucgccgcccccaacccgguggagaagcaccgcaagagcaugcccuaccagcuggacgagcugcucaacuuccggauccccuacuacgucggcccccuggugacggcgaaggagcagaaggccgcccagggcgggguguucgccuggaugguccgcaaggacccggacgggaacaucacccccuacaacuucgacgagaagguggaccgggaggccagcgcgaacaccuucauccagcgcaugaagaccacggacaccuaccugaucggcgaggacguccuccccaagcagucccugcuguaccagagcuacgaggugcugaacgagcucaacaacgugcgggucaacgacaacaagcuguccuucgaccagaagcagcagguccugggcgagcuguucgagcgccacaacaccgugaccaucaagcaguucguggacaaccugcuggcccacggggacuacgaccggauccccgaggugcgcggccucgccgacgagaagcgguuccugagcucccugagcacguacaaccagcucaaggggauccugcacgaggccaucgacgacuccgacaagcagaccgacaucgagaacaucaucgccuggagcaccaucuucgaggacaaggcgaucuucaagaccaagcugaacgagaucuccuggcucaacgccggcaugaucaacagccuggccaacauccgcuaccggggguggggccaguucucccacaagcugcucaacgagcugacgcugagcaccggccgcaccguguucgaggagcuccugaucuccagccacaaccugaugcagauccucaccgacgagguccugaagcagaagaucgccgagcugaacgcgcacgagcucaaggccuccgggaucuacgccgccaucgacgacgccuacaccagcccguccaacaagaaggcgcugcgccaggugcugagcgugaucgacgacaucacgaacgccgccggccaggcccccaacuggcucuacaucgagaccgccgacggggacggcguccccgggaagcggaccaacucccgccagcggaagauccaggagaucuacgcgaacgccgcccaggagcugaucaccggcagcgugcgcggcgagcuggaggacaagaucgccagccgggccgacuucacggaccgccucgugcuguacuucaugcagggcgggcgggacaucuacaccgggaagccccugaacaucgacaaccucuccagcuacgacaucgaccacauccugccgcagucccugaucaaggacaacagccucgacaaccgcguccuggugcacccccuggugaaccgggagaaggacaccaucuucgcguccacccgcuucgccaagcagaugaacggcauguggcggcaguggcacgccgccggccucaucagcucccgcaagcugcggaaccugcagaugcgccccgacgagaucgacaaguacgcgagcggguucgucgcccggcagcucguggagacgcgccagaucaucaagcugaccgagcagaucguggccgaccaguacccggacaccaagaucaucgccgucaaggccggccuguccagccagcuccggaaggagcuggacuuccccaagaaccgcgaggugaaccacuaccaccacgcguucgacgccuuccuggccgcccggaucgggaccuaccuccugaagcgcuaccccaaccuggagcccuucuucacguacggcaaguucaagaagaccgaggugaagaagcucaaguccuucaacuucauccgggacaugacccacgccaaggacaagaucgucgcgaaggagaccggggagaucgugugggacaacgccagcgacaucaacgagcuggaccgcaucuacaacuucaagcgcaugcugaucacgcacgaggugcgguucgagaccgccucccucuucaagcagacccuguacgccgccaagaacagcaagaaccgcggcggcucccggcagcugaucccgaagaagaagggguaccucgucgacaucuacggcggguacacccaggagacgggcagcuaccuguccguggugcgccugaccaagaaggcgauguacgccgucgugaaggugagcacccgggacgccgccaagcucgccgucgccaagagcaucuccgagcagaaggagaacgagacccugaagaagaucaucgacgggaagcugagcaagacguccaagaagggcaagaccacccaccagcuguucgagaucgugcucccccgcgugggccagaagacccuguucaagaacagcaaguacaaccaguuccucgucaacuccgacacguacaugcacaacuaccaggagcuguggaugccccgggaguaccagcgcauguggaaggacauccugcucagcaaccacggggacgcgcagcuggagggccagcuggaccagaucuucaaguucaucgugucccaggugaacagcuacuucaaccucuacgacaucaaccaguuccggaagaagaucgccgacgccaccgacaaguucgcgaagcugcccacccacgacaccgacaacgcccgcgggaagaucgccacgaucggccagcugcucaucgggcugcaggccaacgccaugcgguccgaccugcgcaaccucgacaucaagaccccguucggccugcugcagaucggcaccgggaucacccucgaccuggacacgagcaucaucuaccagucccccaccggccuguucgagcgggaggucccccucaccgaccuguga

SEQ ID NO: 1913 - RNA, 4089 nt, Artificial Sequence
  Cas9 variant
augaaccaggagcccuacgccaucggccuggacaucgggaccagcucccucggcugggccaacgcggacauggacggguacaucgcccgcgugaagggccagaccgggcugggcguccggcuguucgaggagggccagccggccgccgaccgccggagcuuccgcacgacccggcgccggcucucccgccggcgcuggcggcugcgccugcuccgggagaucuucgacgagcccaucagcuccaucgaccccaacuucuucgcccgccagaaggcgagcuccaucagccccaaggacgaccgguucgagaccaccuaccagcuguucaacgacaagacggaccaggaguucuacuccaaguacccgaccaucuaccaccuccgcugggcccugaugaccgagcaccggaaguucgaccugcgcgagaucuaccuggccgugcaccacaucgugaaguaccgggggaacuuccuccgcagcggcaaccccaaguccuucaagcccagcgagcuggacuucucccagcgguucaaggaggucaacgggcuguggcaccucaucuucgacgagguggcgccccagcugccgaccgacaaccuggaggagaucacgaagcucgugcuggacaccacccgcacccgcgccgaccggcagcgcgagagcgucaagcugcucauggccgccacggacaaccacaaggacuggaagcccuaccugaccgaguucaccaaggccauccugggccucaagaccaagcuguaccugcucacggggguggacguggccaaggcggaccagaagaccuggaccuucucccuggaggacaucgaggaccaccgggccgaccuggagaccgccuucgacgaccgcagccucgagcugaucgagaagcuggucgaccuccaggccgccauccagcugacggagaucaugcccuccggccaguacuucagccaguccaugaucuaccgguacgaccagcacaaggagcaccuccgcuggcugaaggacuacgcggagcagcagaccgacgccaacaagcggaaggccgugcgccuggccuacgaccacuacaucgagggcgacgccaaggggaagcccgagaucgcggacgacuucuacaaggagcugaaccggauccucaagggcgacaccagcgagcuggccaagaagaucaaccacgagaucgcccuggagcacuucaugccgaagcagcgcaccaaggagaacggggugauccccuaccagauccaccagcaggagcucgacagcaucaucgacaaccagaagaaguacuaccaguuccugggcgaggacaaccccgucgugucccaccacggcagccagcccuacaagaucgacgagcugguguccuuccgggucccguacuacguggggcccaugaucacggccgaccagcagaagaagaccgccgcgggccaguucgccuggauggugcgcaaggacagcggggacaucacccccuggaacuucgacgacaaggucgaccggaccgccuccgccacgaacuucauccagcgcaugaagaccaccgacaccuaccucaucggcgaggacgugcugccccugcagagccucacguaccagaaguucauggugcugaacgagcugaacaacauccggaucaacggggagcugcucacccgcgagcagaagcagcggaccuacaacgacgucuucaagggccacggcaccgugaacgugaagucccugaucaagagccuggagugccacuccgaggucacgggggcgaucaagguggagggccucgccgacccgaagcgcuucaacagcgcccugaccaccuaccgggacuucaagaagauccugcccgucgccaucgaccagccccagcgccaggccgacaucgagcgcaucaucaacugguccaccaucuucgaggacgcggacaucuucaaggccaagcuccaggagaucgacuggcugaccgacacgcagcgggaccgccugagcaccaagcgguaccgcggguggggccggcucuccgccaagcugcugcucaacaucaaggacacccaggggcugagcaucauggaccagcuguggaacacccagcacaacuucaugcagaucgugcacgagcccgacuacgccgagaagaucgagaagacgaacgccaagggccucaagcagcaggacaucuucgagaccaucaacgagauguacaccuccccgcagaacaagaaggcgcugcgccagauccuggccgugguccgggacauccagaaggcccaccacggccaggcccccagccgcaucuucaucgaggccgcgcgcggggccgagcagaacccccagcggacccggcagcgccagaagcagcucgccgaccuguucgccgaccaggcgaaggagaucgugaacgagacgguggcccaggagcugaacgacgagaccgacaacaaggcccgguucaccgaccgccucaugcuguacuuccugcagaacggccaggacauguacaccggggagaagcucaacaucgacaagcuguccacguacgacaucgaccacauccugccccagagccucgucaaggacgacucccuggacaaccgggugcuggugagcaaggucgagaaccucaagaagaacgaccacuucgccagcgagcuguacgcccgcaagaugcagggcaccugggagcuguggcgguccgcggggcucaucagcgcccgcaagcugaagcaccuccugaugcggccggacgagaucaacaaguacgccaccggcuucauccgccggcagcugguggagacccgccaggugaucaagcuggucacggacgugcucuccaacgaguacgacagcgacaagaccaagaucaucuccgugaaggccggccugagccaccagcugcgcauggagcucgaccugcccaagguccgggagcugaacgacuaccaccacgccuucgacgcguuccucgccgugcgcaucgggaccuaccugcugaagcgguaccccaagcucgagcgcuucuucguguacggccaguaccaggucgccccgcagcuggaccugcggcgcuucaacuucauccacgaccucguguccgggaagcaggagaagaucguggccgaggagaccggcgagaucgucuggaaccgggagaaggacgugagcuacaugaagcaccuccugucccugaagcaccuccuggugacgcacgaggucaaggaggaccacggcgcccuguucaaccagaccaucuacaaggcgaagaaggacaacgggaacgugggcgggaagaugaagcugcugcccaccaagagcaaccgccccaccgagaucuacggcgggcacuccagccaggccaucgccuaccucgccaucgugcgggucaacggcaaggagcccuccuaccgcgugaugggcgugccgauccggauccuggaccagcugaagcaggcgaagaagcagggggaguacgccgagcgccucgcccugaagcaguucuucacgcccgacuucaccaagggcaaggggaagaucgucagcgacuucgacguggugaucccccacaucccccugcuccagccggucaucgacgagaucuccggccagagccaccgguucgcccuggggaccaacaccuacuaccgcaaccugcagcagcucauccugacgcuggccgaccagaaggugcucaucuccaaggagaccggcguggacgaggagaagaagcuggucgagguguacagccacaucugccagcaggucaugaaguucuucccccuguacgaccggaacaaguuccgcgagcuccugguggacagccggucccacuucgagcagcugcccaucgugaaccgcuacagcgacgcgggcaagcucgagaucgccgggaagcggggcauccugcagcagaucaugguggggcugcacgccaacgccacccccggcgaccucaaggagcugggggucaagaccccguucggcaagcuccaggugcccggcgggaucaagcugacggagaacgccaagcugaucuacgagucccccaccggccuguucaagcgcgaggugaagaucaccaccgaguga

SEQ ID NO: 1914 - RNA, 4089 nt, Artificial Sequence
  Cas9 variant
augaagaagaaggccgagaagaucuaccugggccucaacguggggaccaacagcaucggcuacgccgucaccgacgagcaguaccgccugcugaaguucaacgggaacgacgcguggggcuccaucguguucgacgccgccagcuccaacgaggaccggcgcaaccaccggcucgcccgccggaaccuggaccgccggcagcagcgcaucguguggcugcaggagaucuucgccaaggagaucagcaaggucgacgaccgguucuucauccgccucuccgagagcuuccgguggcgcgaggacgugcaggaccgguacguguucuucaacgacaaggaguacacggacguccaguacaugaaggaguaccccaccauccaccaccugaucugcgagcugauggacaacaagaccccgcacgacgugcgccucguguaccuggcgugcgccuggcugaucacccaccgggggcacuuccucaacaaccugaacgucgagaagcuggacgagaucauggacuucuccagcguguaccagaacuucaucaacuacuucacggagaacggcuacaagcgccccuggggcgagaucgacguguccgcccucagcgagguccugaagcagaagaccgggaucaccgugaagaacaaggagcugcagaacauccuccuggagggcaagaagcccgagaaguccgggaccgaggaguuccccuucagccaggacuccaucauccggcugcucgccggcgggcagugcaagcugaaggacguguucugcaaggaggaguaccuggaccucggcagcgucucccugggcauggacgaggagaaguucgacgagaucagcggguccaucggcgaggacuacgaccugcucaucgcgcugcgcgggcuguacgacuggagcgugcucgccaaccugcugaacggccacuccgagacgaucagcauggccaaggugcagauguacgagcagcacggcaaggaccuccagauccugaaguacuucguccggaaguacgugccggacaaguacaacgagguguuccgcaaggccaaggccgacaacuacgucgcguacaccgggcacauggacaaggacaccgccagccagaucaagaagaaggccaaggccgaggaguucuccaaguacgugcugaagcucaugagccccaucaagcccgagaagaccgaccugcaguccuacgaggacaugugcgagcggcugaagcucaaccgcuuccugcccaagcagaagaacacggacaaccgcgugaucccgcaccagcuguacgaguacgagcucauccagauccugaagaacgccagcgucuaccugcccuuccucaacgacaccaacaacggcaucuccgaggcggacaaggugcugagcgucuuccgguacaagauccccuacuacguggggccccugaacgaggaguccagcuucgccuggaucucccgcaagcagggcaagaucaccccguggaacuucaaggagaugguggacgaggacgccagcgagaacgccuucauccggcgcaugaccaacaagugcacguaccuccccaccgaggacguccugcccaaggacucccugugcuaccagaaguucauggugcugaacgagaucaacaaccuccagaucgacgggcugaagauccccgugaaggccaagcagggcaucuaccacgagcuguucgagaagaacaagaaggucaagcggaaggacaucgaggaguaccucauccgcaacaacuaccuggacaaggacagcaccgagcugaucuccggcaucgacgagcagauccacagcgggcucuccagcuacugcgcguucuucaaccugcugaacaagaagauccucuccgaggacgacguggagcggaucaucgagcgcgccagcuacgccgaggacaagucccgggugaucaaguggcugcgcaaggaguacccgggccugagcgaggacgacauccgguacaucgcccgcaucaagauccgggacuucgggcgccucagcaagaccuuccugacgggccugaaggggugcgacgucuccaagggcuucgacggccaggacguggagaugaucagcauccuccagaccaugugggagaccaacgacaaccugauggagauccuguccgacaaguacaccuuccucgaggcccuggaggcguucacgcaggaguacuacaccgggaagaagaagucccugaaggagcggcucgacgagaugcgcgugagcaacagcguccggcgccccguguaccggacccuggccguggucaaggacaucgagaaggccuucggcaagcccaacaagaucuucguggagaugacccgcgggggccaggccgaccagaaggggaagcgcaucaagucccggaagcagcagauccuggaccucuacgacaagugcaaggacgacgugcacgaccugauguggcagcuggagagccucggcgaguacgcggacucccgccugcagagcgaccggcuguaccucuacuucaugcaguucggcaagugcgccuacuccggggcccacaucggcuucgagcagcugauggccgggagcgucgaguacgacaucgaccacaucuacccccaguccuacgugaaggacgacagccugaacaacaaggugcucguccuguccgaccugaacggcacgaaggacaacaucuacccggugagccccgagauccgcggcaagaugcaggggcucugguccugguggaaccacgugggcgccaucagcgacgagaaguacaagcggcugauccgcagcgcgcccuucaccgacgaggagaagaugggguucaucaaccggcagcugaccgagaccucccagagcacgaaguucaucgccgaccuccugaaggagcgcuuccccgacgccgaggucguguacgugaaggccggccuggucuccgacuuccggcacgaguucgaccuccccaagagccgcuccuacaacgaccugcacaacgccgcggacgccuuccugagcgugguggccgggaacgucuacgacaugcgguucuccaagaagugguuccgcaucgacgagaaguacagcgugaaggugaagaccaucuucacccacgaggucaagugccggggcgacaucaucugggacggcaugccgaugcucgagaagguggaggacaccgcccgcaagaacacggcccacuucgugaaguacgcggccuucaagaccgggggccuguucgaccagaaccccgucaagaaggggaccggccugaucccccucaaggccgggcugccgaccgagaaguacggcggcuacaacaaggccgggaucauguuccugauccccgugcgguacaacaucggcaagaaguccgagauccucauccugcccguggagcugaugcacgggaagcacuuccucgaggacaaggucuucgcgcgcaacuacaccuucacgcggcuggagaacauccugggcaagaaggugggggaggugagcuucccgaugggcaugcgccccuggaagaucaacaccaugcucuccuucgacggcuuccgggucugccugaccgggaccagcggccgcgggaagugccugguggcccagcccgugaugcaguucuccgccgacgagcacuggcgguucuacgucaagcgccucgagcgcuucguggagaagaucggcaucaaccccgaccugcuguacgacaaggaccacgacaaggugagcaaggacgagaaccucaagcuguacgagcuguacgucgacaagcuccagaacacgaucuacaagaagcgggugaacuccccggugcagacccugcugaaggggaaggaggaguucaagaagcucagcaucgaggagcagugccagguccugcugaacauccaguccguguucggccgcaugaccggcgggugcgaccucacccugaucggcgggagcgcccacuccgccgcgacgggcagccugagcaccaccaucuccaacuggaagaagaaguacagcaccguccggaucaucgaccagucccccagcggcaugugggagaaguccagcgagaaccuccuggacuuccuguga

SEQ ID NO: 1915 - RNA, 4092 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccgaccgccgggccucccgcacgacccggcgccggcucagccgcaaccgguggcgccuguccuuccugcgggacuucuucgagagccacaucaccccgaccgaccccaacuucuucaugcgccagaaguacuccgagaucagccccaaggacaaggcgcgguacaaguacgagaagcgccucuucaacgaccggacggacgccgaguucuaccagcaguaccccaccauguaccaccuccgcaaccggcugcucaccgacccguccaaggccgacgugcgcgagaucuacuucgccauccaccacauccucaagagccgggggcacuuccugaccuccggcuacgcgaaggacuucaacacgaacaaggucgcccugaacgagaucuuccccgcccugcaggacgccuacgcccagguguaccccgaccuggacaucaccuucgacgagaacaaggugaacgaguucaagaccguccuccuggacgagaaggcgacccccagcgacacgcagcgcgcccuggugaaccuccugcuggccgaggacggggacaaggacauccucaagcagcagaagcagguccugaccgaguucgccaaggccguggugggccugaagaugaagcucaacguggcgcuggggaccgaggucgacuccagcgaggccaccgccuggaacuucucccugggccagcucgacgacaagugggccggcaucgagagcgccaugacggacgaggggaccgagauccuggaccagauccgggaccuguaccgcgcgcgccuccugaacggcaucgugccggccgggaagacccugucccaggccaagguggacgacuacgagcagcaccacgaggaccucgagcuguucaaggacuaccugaagcagcucgaggacgacggcauggccaaggucauccggcagcuguacgaccgcuacaucgacggcgacgacgccaagcccuucgugcgggaggacuucgugaaggcgcugaccaaggaggucacggcccaccccaacgccaagagccccgagcuccuggagcgccuggugcagccggacuucaugcucaagcagcggaacaaggccaacggggcgauccccgugcagaugcagcagcgcgagcuggaccagaucaucaagaaccaguccgucuacuacgacuggcuggccgcccccaaccccguggagaagcaccggcagagcaugccguaccagcucgacgagcugcugaacuuccgcauccccuacuacgugggcccccucgucaccgccaaggagcagaaggccgcgcagggcgggguguucgccuggaugguccggaaggaccccgacgggaacaucaccccguacaacuucgacgagaagguggaccgcgaggccagcgccaacaccuucauccagcggaugaagacgaccgacaccuaccugaucggcgaggacgugcugcccaagcagucccugcucuaccagagcuacgagguccugaacgagcugaacaacgugcgcgugaacgacaacaagcucuccuucgaccagaagcagcagguccugggcgagcuguucgagcggcacaacaccgugacgaucaagcaguucguggacaaccuccuggcccacggggacuacgaccgcauccccgagguccggggccuggcggacgagaagcgcuuccucagcucccugagcaccuacaaccagcugaaggggauccuccacgaggccaucgacgacuccgacaagcagaccgacaucgagaagaucaucgccuggagcaccaucuucgaggacaaggccaucuucaagacgaagcugaacgagaucuccuggcugaccgccggcaugaucaacagccucgcgaacauccgguaccgcggguggggccaguucucccacaagcugcugaacgagcucacccugagcaccggccggacgguguucgaggagcugcucaucuccagccacaaccugaugcagauccugaccgacgaggugcucaagcagaagaucgccgagcugaacgcccacgagcugaaggccuccgggaucuacgcggccaucgacgacgccuacaccagccccuccaacaagaaggcccuccgccagguccugagcgugaucgacgacaucaccaacgccgcgggccaggccccgaacuggcuguacaucgagaccgccgacggggacggcgugcccgggaagcgcacgaacucccggcagcgcaagauccaggagaucuacgccaacgccgcgcaggagcucaucaccggcagcguccggggcgagcuggaggacaagaucgccagccgcgccgacuucaccgaccggcuggugcucuacuucaugcagggcgggcgcgacaucuacaccggggagccccugaacaucgacaaccuguccagcuacgacaucgaccacauccucccccagucccugaucaaggacaacagccuggacaaccgggugcucguccacccgcuggugaaccgcgagaaggacacgaucuucgccuccacccgguucgccaagcagaugaacggcauguggcgccaguggcacgcggccggccugaucagcucccggaagcuccgcaaccugcagaugcggcccgacgagaucgacaaguacgccagcggguucguggcccgccagcuggucgagacccggcagaucaucaagcucaccgagcagaucguggcggaccaguaccccgacgccaagaucaucgccgugaaggccggccuguccagccagcugcgcaaggagcucgacuucccgaagaaccgggaggucaaccacuaccaccacgccuucgacgcguuccuggccgcccgcaucgggacguaccugcucaagcgguaccccaaccuggagcccuucuucaccuacggcaaguucaagaagaccgaggugaagaagcugaagucccucaagagcuucaacuucauccgcgacaugacccacgccaaggacaagaucguggccaaggagacgggggagaucgucugggacaacgcguccgacaucaacgagcuggaccggaucuacaacuucaagcgcaugcugaucacccacgaggugcgcuucgagaccgccagccucuucaagcagacccuguacgccgccaagaacuccaagaaccggggcggcagccgccagcugauccccaagaagaagggguaccucguggacaucuacggcggguacacgcaggagaccggcuccuaccugagcgucgugcggcugaccaagaaggccauguacgcgguggucaaggugagcacccgcgacgccgccaagcucgccguggccaaguccaucagcgagcagaaggagaacgagacgcugaagaagaucaucgacgggaagcuguccaagaccagcaagaagggcaagaccacccaccagcuguucgagaucguccugccgcgggugggccagaagacgcuguucaagaacuccaaguacaaccaguuccucgugaacagcgacaccuacaugcacaacuaccaggagcuguggaugccccgcgaguaccagcggauguggaaggacauccugcucuccaaccacggggacgcgcagcuggagggccagcuggaccagaucuucaaguucaucgucagccaggugaacuccuacuucaaccucuacgacaucaaccaguuccgcaagaagaucgccgacgccaccgacaaguucgccaagcugcccacccacgacacggacaacgcgcgggggaagaucgccaccaucggccagcugcucaucgggcugcaggccaacgccaugcgcagcgaccugcggaaccucgacaucaagacccccuucggccugcugcagaucggcaccgggaucacgcucgaccuggacaccuccaucaucuaccagagcccgaccggccuguucgagcgcgaggugccccucaccgaccuguga

SEQ ID NO: 1916 - RNA, 4092 nt, Artificial Sequence
  Cas9 variant
augcgcggcaacuaccacaucgggcuggacaucggcaccagcuccaucgggugggccgugaucgacgacaacgccaaggucaugcgggcgaagggcaagaccgccaucggggcccgccucuacaacgagggccagacggccgccgaccggcgccuguuccggaccacccgccggcgccugaaccggcgcaaguggcggcucaagcugcuggacgagaucuucgaccccuacaucaccccgguggacgcggccuucuucgcccgccucaagcagagcaaccugucccccaaggaccagaaccgggacuggacgggcagcaugcuguuccccgaccgcaccgaccggaaguuccacaaggacuaccccaccaucuaccaccuccgccacaagcugaugaccgaggaccaccaguucgacauccgggagaucuaccuggccauccaccacaucgugaaguaccgcgggaacuuccucaacacgaccccggucuccagcuucuccgugagcgacgugaaguucgacgagcaguucgaccggcugaacgagcuguacgcggccgucucccccgacgagcccuucgccaucaacggcgacaacagcaaggccaucgagacccuccugcuguccgacgagaccaagaaguucgacaagcagaagcagagcgccaagcucauccuguccgagacgggggacaaggcgcuggacaaggagaacaccaagguggccacccagaucagcaaggccauccucggcuacaagacccagcuggacgugcugcucaaguacgacgccaucaacuccagcgccuggaagaucgagcuggacgacgagaacaucgacgacacgcugcccgggcuccugucccagcuggacgagaaccgccaggagauggucagcaucauccagaaccucuacgcccaggugacccugaaccagaucgugccgaacggcaugucccugagcgagagcaugaucgagaaguacaacgcgcaccgggaccaccucaagcugcugaagcagcucgaggacaagaucgacgaccccaagaagaagaagggccuggaggccgccuacgacgccuacgucgggaagaacaugaagguggcgaaccaggacguguucuacgccuccgucaagaagaaccuggacgacagcgaccucgccaagcagaucgccgaccugaucgaggcccagaaguucaugcccaagcagcgcaccucccagaacggcgugaucccccaccagcugcaccagcucgagcuggaccagaucaucgagaaccagagcaaguacuacccguggcugaccgcggccaaccccaaccccaagcgcauccaccaggccaaguacaagcucgacgagcugguggccuuccggauccccuacuacgucgggccgcuggugacgcccgaggagcaggagaaguccgcgaaccagguguucgccuggaugaagcgcaagcagcccggcaccaucacccccuggaacuucgaccagaaggucgaccggauggccagcgccaaccgcuucauccggcgcaugaccacgaaggacaccuaccucaucggcgaggacgugcugccggacgccucccugaucuacgagcgguucaaggugcugaacgagcucaaccuggucaaggcgaacuaccaccgccuggcccccgcccagaagcaggccgccuaccgggaccucuucgagaaccagaaguccaucuccaccaagaagcugcagaacuaccugguggaccagggguacuucaccgcgaagcccaagaucacgggccucagcgaccccgagcgcuucaacuccagccuggggaccuacaucgacuucaaggagaucuucggcgaccaggucgacaacccggaccggcaggacgacuacgagaagaucaucgagugguccaccguguucgaggaccgccagaucuacgaggccaagcugcggacccucgacuggcugacggaggaccagauccaggcccugaagaccaagcgcuacaacggguggggccggcucagcaagaagcugcugaccggcaucguggacgagaacggggagcgcaucaucgacguccucuggaacaccaaccagaacuucaugcagguccagucccaggagagcuucgccaagcggauccacgaggccaacgcgaagcagaugaaggugacgggcguggaggacauccuggccgacgccuacaccagcccccagaacaagaaggccauccgccaggugauccggguggucgacgacauccagaaggcgaugggcgggguggcccccaccagcguguccaucgaguucacccgcagcgaggaccagaacccccgccggacccagagccgcgagucccagcugcagaacacguucaaggucgacgccaaggagaucguggacagcgaccucgugaccgagcuggagaccgucuccaagagcaagaaggggcugaccgaccggcucuaccuguacuucacgcagcugggcaaggacauguacaccggcgacccgcucaacaucgacgagcuguccaccuacgacaucgaccacauccugccccaggccuucaucaaggacgacagccucgacaaccgcgugcugguguccaaggccgucaacaacgggaaguccaacaacgugcccgugaagcuguucggcgggaagaugggcggguucuggaaggagcucgcggaccaccggcugaucagcaagcgcaagcugaagcaccuccugaccgacccggacacgaucgacaaguacaccaugcggggcuucauccgccggcagcuggucgagaccagccaggugaucaagcucguggcccagauccugggcgacaaguaccagaacgacgacaccaagaucaucgaggucacggccaagaugaaccaccagaugcgcgagaacuucaagcugaucaagaaccgggaggugaacgacuaccaccacgccguggacgccuaccucaccgcguucgucgggcaguaccuguacaagcgcuaccccaagcugcggcccuacuucguguacggcaacuucaagaaguucaacgaggaccacguguccuuccgcuacuucaacuuccuccacgagcugauggacgagaacaacaagcggaucgucgagcccgagaccggggagguggugcuggagcgcgagccggccaucgccuacaugaagcgggucuaccacuucaaguucaugcucaucagccaggagguguacacccgccgggacgccauguucaaccagacgaucuaccccgccaaggaggcgaaccgccggaagcugaucgccaucaagcacggcaagcccguggacgucuacggcggguacuccggcagcguggacgccuacauggccaucgugcgcauccacgacaagaagggggacaaguacaaggucgugggcgugcccaugcgcgcgcuggagauccucaacgccacccacgacaagaaggacuacgacgccaagcugaagcagauccuggucccgaaguucaccaaggugaagaagucccggaagaccggggagaucacgaagaagguggaggacuucgagaucguccucggcaaggugauguaccgccagcuggugaucgacggcgacaagaaguucauggucgggagcuccaccuaccuguacaacgcccggcagcucgugcugagcgacagcucccuggacacccucgccagcaagggcacccuggacuccgacgcggacagcaagcgccugguggccgucuacgacgagaucguggagaaggucgacaaguacuucccccucuacgacaagaacgccuuccgguccgggcugcacaagggccgcgacaaguaccugcuccugcccaaccggagcacguucaacggggccaagaaggugcacuccggcaagcgcgagauccugaacgagauccucaacggccugcacgccaacgcgacccucgggggccugaaggaccugaagaucagcacccccuucgggaagaugcagggccaguccgggaucccgcugagcuccaacaccaucaucugcuaccagagccccacgggccucuucgagcaccgggugucccugaaggaccuguga

SEQ ID NO: 1917 - RNA, 4092 nt, Artificial Sequence
  Cas9 variant
auggagaacaaccgcuacaacgugggccuggacaucgggaccagcuccaucggcuucgccgucaccgacgagcaggacgagcucguccaggugaaggggaagaacuacaucggcgugcggcuguucaaggaggggcagacggccagcgagcgccgguccuuccgcaccacccggcgccggcugaagcgccggaaguggcgccucggccugcuggaggagaucuucgcgcccuaccucgcccagggcgacccguacuuccuggcccggaugaaggagagcaacaucagcccccgcgacgagcggaagaaguacuacgggagccugcuguucuccgacgacaccguguucuacgacaaguaccccacgguguaccaccuccgccacgcccugaugaccgaggaccggaaguucgacauccgcgagaucuaccucgccguccaccacaucaucaaguaccggggcaacuuccugaucaacacccugaucaacgaguucagcuccaaggcgguggacuucaagaaggacgccgacauccucaacgaccuguucgagcaguucuacaucagcgacaucaacgacuccuuccagcugaacaccgccgacaugaacgagaucagcgagcuccugcuggacaacuccaagacgcgccucgaccggcagcgcgagagccugaagaagcuggccaagaagguggacgacaucuccgucgcgaagaagcaccagaagaucgccaccgaguucagcaaggccauccucgggaacaaggccaaguucgacgugauccugaacgugaccaccgacuccagcaacgacugguccuucaagcuggaggacgaggacgccgacgagaagaucgucgugcuccuggaggagcugaacacgccccagcaggaggcgcucaacaucauccaccagugguacagccagaucagccugaacggcaucgugccggacgggaaguccaucagcgaggccaugaucuccagcuacgagcugcacaaggagcaccucgcccugcugaagcagcagaucaacaacaccaaggacaagaagaaggcccacggccuccacgaggccuacaacgaguacguccacggcaacaacaacaagaagcugaaccaggcggacuucuacuccaaggugaagcagaaccuggagagcucccucaucaccgacgagauccuggagcugaucaacgccgagaacuucaugcccaagcagcggaccagcgccaacggggugaucccccaccagcuccaccagcaggagcuggaccgcaucauccagaaccaggccaaguacuaccccuuccuggccgagacgaacccgaacgagaagcgcuccaaggucgcgaaguacaagcucgacgagcugguggccuuccgggugcccuacuacgucggcccccugaucaccgccaccgaccagaagaagaccagcgggaaggaguucgccuggauggugcgcaagcagcccggccggaucacgccguggaacuucgacgagaaggugaacaagauggaguccgccaacaccuucauccgccggaugaccaccaaggacagcuaccucaucgcggaggacguccugcccgacgagucccugcuguaccagaaguucaaggugcucaacgagcugaacaaccugcgcgccgacggccggaagcucaaggucagcgugaagcagaagguguucaaggagcuguuccagcagcagaagacgaucaccaucgucaagcugcagaacuaccucaaggccgagugcuccuuccugaccacccccgagaucagcgggcuguccaagcccgagcacuucgugagcucccucgccacguacaucgaccugaagaagaucuucggcgaggacaucgacaacccggcgcgccagaacgacuucgagcggaugaucgagugggccaccaucuucgaggacaagaacaucuacagcgagaagcugaacgagaucaaguggcucaacgaccgccagaagaaggagcugaagaacaagaacuaccacggguggggcaagcugagcgccaagcuccugaaggggcugcgggacuccgacgagugcagcaucaucgagcacauguggaacacccagcagaacuucaugcagguccaggccgaggaggacuucgcccagcgcauccaggaggagaacaaccagcaccucaagggcaacacccuggaggaggugcuggcggacgccuacacgagcccccagaacaagaaggccauccgccagguggugaaggucaucgaggacauccagaaggccaugggcgggaucgcgccccagaagaucuccaucgaguucacccgggcccccgaggagaagccgcggcgcuccguggagcggcagcagcagaucgagaagaucuacaagagcguggccaacgaggucgagaacgccggcgugaaggacgagcuccagcgcuucuccgaccggaagcagacccugaccgacaaguacuuccuguacuucacgcagcucgggaaggacauguacaccggcaagagcaucaacaucgaccagaucgggaacuaccagaucgaccacauccugccccaggccuucaucaaggacgacucccuggacaaccgcgugcucgucagcgccgcggugaacaacggcaaguccgacaacgugcccaccaagaacgaccgcuacaagguccgggagcacggccagcgccuguacgaccaggggcugaucagcaagcggaaguucaacaaccucaucaccgaccccgacuccaucaacaaguucaccgcccgcggcuucgugaagcggcagcugguggagacgagccaggucauccgccugguggccgaguuccucuacaacaaguaccaguccaagagcgagaucaucgaggugcgggccaagaugaacucccagcugcgcaaggacuucgggcugaucaagaaccggaacgucaacgacuaccaccacgcgcucgacgccuaccugaccaccuucaucggcaacuaccuguaccgccgguacccgaagcuccgcgccuacuucaccuacgggugcuucaagaagguggacgacagccagcugaaguacuucaacuuccugcacgacaucgaggacgacaagaagaagaucaucaaggacaacgacacgggcgagauccucuggcaccgggacgagggcaucgcccgcuucaagcggaucuacaacuucaaguacaugcuggugacccacgagguccugacccgccagggggccauguucaagcagaccguguacagcgcggccguggccggcuccaagaagcucauccccgucaaggaggaccggcccaucgacaucuacgggggcuacacgaacaacaacgacgccuuccuggccaucgugaaggugaccaagaagaagcaguacauggucgugggcaucccccagcgcgcgguggucaagcugaacgacgccgccaagcaggggagcaaggccuaccagaaggugcucuacaacgugaucaagccgcaguucaucaagaagaagaaggaccggaagaccggcaagaucacccagaagcuggagaacuucgagaucgucguguccaagacgcuguaccgccagcucaucaucgacggggaccagaaguacaugcugggcagcuccgccuacaaguacaacgcgaagcagcuggugcucagcgaguacgcccuggagguccuggaccgguccaucuucgagaagaaggaguacaccaccguggaccucgacaacguguacgacgagauccuggcccaggucgacaaguacuucagccuguacgacaagaacaaguuccgccagaagcuccacgagucccgcaagaucuucaccgagcugcccaucaacaaccuguucagcgggacgaagcuccugaaguccggcaagcgggagacccugaacgagauccucgagggccugcacgccaacgcgaccaagaaggaccugaagucccucaaguucuccacgccccuggggaugauccaguacccgagcggcaucauccuguccgagaacgccauccucugcuaccagagccccaccgggaucuucgagcgccgggugacccugaaggaccuguga

SEQ ID NO: 1918 - RNA, 4092 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccgaccgccgggccucccgcacgacccggcgccggcucagccgcaaccgguggcgccuguccuuccugcgggacuucuucgagagccacaucaccccgaccgaccccaacuucuucaugcgccagaaguacuccgagaucagccccaaggacaagucccgguacaaguacgagaagcgccucuucaacgaccggacggacgcggaguucuacaaguacgagaacugccccaccauguaccaccuccgcaaccggcugaugaccgacccgagcaaggccgacgugcgcgagaucuacuucgccauccaccacauccugaagucccgggggcacuuccugacccccggcgacgccaaggacuucaacacgaacaaggucgcggugaacaagaucuuccccgcccugcaggacgccuacgcccagguguaccccgaccucgacaucaccuucgacgagaacaaggucaacgaguucaagaccgugcugcugaacgagaaggccaccccgagcgacacgcagcgcgcgcucgugaaccugcugcucgccaaggagggggaccgggacauccugaagcagcagaagcaggcccugaccgaguucgccaaggccgucgugggccucaagaccaagcugaacguggcgcuggggaccgaggucgacuccagcgaggccacggccuggaacuucucccucggccagcuggacgacaaguggaccggcaucgagagcgccaugaccgacgaggggaccgagauccuggaccagauccgcgaccucuaccgcgcccggcugcugaacggcaucgugcccgcggggaagacgcucucccaggccaagguggacgacuacgcccagcaccacgaggaccuggagcuguucaaggacuaccucaagcagcuggaggacgacggcaccgccaaggccauccgccagcuguacgaccgguacaucgacggcgacgacgcgaagcccuucguccgcgaggacuucgugaaggcccucaccaaggaggugaccgcccaccccaacgccaagagcccggagcugcuggagcggcucgcgcagcccgacuucaugcugaagcagcgcaacaaggccaacggggccauccccguccagaugcagcagcgggagcuggaccagaucaucaagaaccaguccguguacuacgacuggcucgccgcccccaacccgguggagaagcaccgcaagagcaugcccuaccagcuggacgagcugcucaacuuccggauccccuacuacgucggcccccuggugacggcgaaggagcagaaggccgcccagggcgggguguucgccuggaugguccgcaaggacccggacgggaacaucacccccuacaacuucgacgagaagguggaccgggaggccagcgcgaacaccuucauccagcgcaugaagaccacggacaccuaccugaucggcgaggacguccuccccaagcagucccugcuguaccagcgguacgaggugcugaacgagcucaacaacgugcgcgucaacaacgagaagcugagcaucgagcagaagcagcaggucauccgggagcuguucgagcgccacaacuccgugaccaucaagcaguucgccgagaaccuccgggcccacggcgacuacgcccacaugcccgagauccgcgggcuggccgacgagaagcgguuccugagcucccucagcaccuaccgccagcugaagucccugcucccggaggcgaucgacgaccccgccaagcaggccgacaucgagaacaucaucgccuggagcacgguguucgaggacgcggccaucuucaagaccaagcugaaggagaucaacuggcuggacucccagaccaucaccaagcucagcaacauccgcuaccggggcugggggcaguucucccacaaguuccugaacggccugacgcucgggaacggccacaccaucauccaggagcuguuccugagcaacaacaaccucaugcagauccugaccgacgagacccugcagaagaagaugaccgagcucaacgccgacaagcugaaggccgccaacaucaacgacgcgaucgacgacguguacacgucccccagcaacaagaaggcccugcgccaggugcuccgggucaucgaggacaucaagcgcgccgccgacggccaggaccccuccuggcuguacguggagaccgccgacgggggcgggaccccgggcaagcggacccgcgcgcggcagcaccagcugcaggagaucuacgccaacgccgcccacgagcucaucgacagcgccgugcgcggggagcuggaggacaagaucgcggacaaggccgacuucaacgaccggcugguccucuacuucaugcagggcggccgcgacaucuacacggggacgccccugaacaucgaccagcuguccagcuacgacaucgaccacauccucccccagucccugaucaaggacaacagccuggacaaccgggugcucgugcacgccaucaucaaccgcgagaagaacgccaccuucgcgagcaccaucuacgcccagaagaugaacgccaccuggcggcaguggcacgaggccggccugaucuccgggcgcaagcugcggaaccuccagaugcgcccggaccagaucgacaaguacgccagcggcuucgucgcgcggcagcugguggagacccgccagaucaucaagcugaccgagcagaucguggccgcccaguaccccgagaccaagaucaucgccgucaaggccggccucucccaccagcugcgggaggagcuggaguuccccaagaaccgcgacgugaaccacuaccaccacgcguucgacgccuuccucgccgcccggaucgggacguaccugcugaagcgcuuccccaaccuccaggccuucuucaccuacggcaaguucaagaaggcggacgugaagaagcugcgcggguucaacuucauccgggacaucacccacgccgaggacaagaucgucgugaaggacaccggcgaggugaucugggacaagaagcgcgacgucgacgagcuggaccggaucuacaacuucaagcgcaugcucaucacgcacgaggugcacuucgagaaggccgaccuguucaagcagaccguguacggggccaaggacagcaaggaggccggcggcaagaagcagcugaucuccaagaagaagggguacccggucgacaucuacggcggguacacccaggagaccggcagcuaccucuccguggugcggcugacgaagaaggcgauguacgccgucgugaaggugagcacccgcgacgccgccaagcuggcggucgccaaguccaucagcgagcagaaggagaacgagacccucaacgacaucaucgacgagaagcuguccaagaucagcaagaacgggaagaucacccacgagcuguucgagguggugcucccccgggucggccagaagacgcuguucaagaacuccaaguacaaccuguuccucgugaacagcgacaccuacaugcacaacuaccaggagcuguggaugccccgcgaguaccagaagauguggaaggacaucucccugagcaaguacggcgacgcccagaccgaggaccagcucgaccagaucuucggguucaucgugucccaggucaacagcuacuucaaccuguacgacaucaaccaguuccggaagaagcugaacgacgccgccgacaaguucgcgacccuccccaugcgcgacacggacgacaugcagggcaagaucgccaccaucgggcagcugcugaucggccuccaggccaacgccgcccggagcgaccugcgcaaccuggacaucaagaccccgcucgggcugcugcagauccccaacggcaucucccucgacagcgacaccuccgugguguaccagagccccacgggccugcuggagcgggagguccaccucuccgaccuguga

SEQ ID NO: 1919 - RNA, 4092 nt, Artificial Sequence
  Cas9 variant
augaccaagcugaaccagcccuacggcaucgggcucgacaucggcagcaacuccaucggguucgccguggucgacgccaacagccaccuccugcgccucaagggcgagaccgcgaucggggcccggcuguuccgcgagggccaguccgccgccgaccggcgcgagagccggacgacccgccggcgccugucccggacccgcuggcggcucagcuuccugcgcgacuucuucgccccgcacaucaccaagaucgaccccgacuucuuccugcggcagaaguacuccgagaucagccccaaggacaaggaccgcuucaaguacgagaagcggcuguucaacgaccgcacggacgcggaguucuacgaggccuaccccuccauguaccaccuccggcugcgccugaugaccgacgccagccaggccgacccgcgggagaucuuccuggcgauccaccacauccugaagucccgcggccacuuccucacccccggggccgccaaggacuucaacaccgacgagguggaccugaagcacaucuuccccgcccuggccgaggcguacgcccagguguaccccgaccucgagcugaacuucgacagcgcccuggccgacgacuucaaggccaagcuccuggacgaggacgcgaagccguccgacauccagaaggcccuggucaaccuccugcugagcuccgacggcgagaaggagaucgugaagaagcggaagcagguccucacggaguucgccaaggccaucaccgggcugaagaccaaguucaaccuggcccucggcaccgagguggacgaggcggacgccagcaacuggcaguucuccauggggcagcuggacgacaaguggagcaacaucgagacguccaugaccgaccagggcaccgagaucuucgagcagauccaggagcuguaccgcgcccgccuccugaacggcaucgugcccgccgggaugagccugagccaggccaagguggcggacuacggccagcacaaggaggaccucgagcuguucaagaccuacaucaagaagcugaacgaccacgagcucgccaagacgauccgggggcuguacgaccgcuacaucaacggcgacgacgccaagcccuuccugcgggaggacuucgucaaggcccucaccaaggaggugaccgcgcaccccaacgagguguccgagcagcugcugaaccgcaugggccaggccaacuucaugcucaagcagcggaccaaggccaacggggccaucccgguccagcugcagcagcgcgagcuggaccagaucaucgccaaccagagcaaguacuacgacuggcucgcgaagcccaaccccguggagaagcaccgggccuccaagcccuaccagcuggacgagcugcugacguuccgcaucccguacuacgugggcccccucaucacccccaagcagcaggccgagagcggggagaacgucuucgccuggauggugcggaagaaccccuccggcaacaucaccccguacaacuucgacgagaagguggaccgcgaggccagcgcgaacaccuucauccagcggaugaagacgaccgacaccuaccugaucgacgaggacguccugcccaagcagucccuccuguaccagaaguacgaggugcugaacgagcucaacaacgugcgcaucaacaacgaggcccugagcaccgaccagaagcagcggcugauccgcgaggucuucgagcggcacuccagcgugacgaucaagcaggucgccgacaaccucguggcccacggggacuucgcccagcgccccgagauccggggccuggcggacgagaagcgcuuccuguccagccucuccaccuaccaccagcugaaggagauccugcacggcgccaucgacgaccccaccaagcuccacgacaucgagaacaucaucaccuggagcacgguguucgaggacgccgccaucuucaagaccaagcuggcggagaucgacuggcuggacccggccaccaucaagaagcucuccaacauccgguaccgcggguggggccaguucagccgcaagcugcuggacgggcucaagcugggcaacgggcacaccgucauccaggagcugaugcucuccaaccacaaccugaugcagauccuggccgacgagacgcucaaggagaccaugaccgagcugaaccaggacaagcugaagaccgacgacaucgaggacgugaucaacgacgccuacaccagccccuccaacaagaaggcccuccgccaggugcugcgggucguggaggacaucaagcacgcggccaacggccaggaccccagcuggcuguacaucgagacggccgacggccccgggaccgccggcaagcggacccagagccgccagaagcagauccagaccguguacgccaacgcggcccaggagcucaucgacuccgccguccgcggggagcuggaggacaagaucgccgacaaggccagcuucacggaccggcuggugcucuacuucaugcagggcgggcgggacaucuacaccggcgcgccgcugaacaucgaccagcugucccacuacgacaucgaccacauccucccccagagccugaucaaggacgacucccuggacaaccgcgugcucgucaacgccaccaucaaccgggagaagaacaacguguucgccagcacccuguucgccggcaagaugaaggcgacguggcgcaaguggcacgaggccgggcugaucuccggccggaagcuccgcaaccugaugcugcggcccgacgagaucgacaaguucgccaagggguucguggcccgccagcucgucgagacccggcagaucaucaagcugaccgagcagaucgccgcggcccaguacccgaacaccaagaucaucgccgugaaggccggccugagccaccagcuccgcgaggagcuggacuuccccaagaaccgggacgugaaccacuaccaccacgccuucgacgcguuccuggccgcccgcaucggcacguaccuccugaagcgguaccccaagcugacccccuucuucaccuacggggaguucgccaaggucgacgugaagaaguuccgcgaguucaacuucaucggcgcccucacccacgcgaagaagaacaucaucgccaaggacacgggggagaucgugugggacaaggagcgggacauccaggagcuggaccgcaucuacaacuucaagcgcaugcugaucacccacgagguccacuucgacauggccgaccucuucgaccagaccaucuacgccgccaaggacuccaaggagcggggcgggagcaagaaccugauccagaagaagcagggcuaccugaccggcaucuacgggggcuacuccacggagcgcgggagcuacguguccaucauccggaccuucaagaagggcgcgccgaucuacaacaucgugaacaucagcaccgccgacgucucccuccugagcgacaagcagcgcguguccgaggccagcgccgacgugcugcucaaggagcugaucaagaagaagcuggcgaagcgcaagagcggggagaacaccaaguccggcgccuucgagaucguccucccccgggugggcaagaacacgcuguucaagaacaagaaguacgggcuguuccucguggagagcaccaccgaguuccacaacuaccaggagcuguggcugccccggaacgaccagaugcucaucaaguccauccagagccacaagaucgaggaguccaaggccgacuacgagcugacccgcauguaccggaacaucgccagccaggucgaccacuacuucggccuguacacgauccgcaaguucuccgagaagcucaccgccagcaucaacgacuacggggcgcugcccguguacaaguccgagaccaccgacggcaaguacgaggugcugagcaaccucuucgaggggcugggcuccggcacgagcaccgggaaccugaccgccgucaagcuccagccgaacuucggccggguguaccugaccuccgggaucgugcuggaggacgacacgagcaucaucuaccagucccccaccggccucuucgagcgcagcgucaagcuggccgaccuguga

SEQ ID NO: 1920 - RNA, 4092 nt, Artificial Sequence
  Cas9 variant
augaccaagcugaaccagcccuacggcaucgggcucgacaucggcagcaacuccaucggguucgccguggucgacgccaacagccaccuccugcgccucaagggcgagaccgcgaucggggcccggcuguuccgcgagggccaguccgccgccgaccggcgcggcagccggacgacccgccggcgccugucccggacccgcuggcggcucagcuuccugcgcgacuucuucgccccgcacaucaccaagaucgaccccgacuucuuccugcggcagaaguacuccgagaucagccccaaggacaaggaccgcuucaaguacgagaagcggcuguucaacgaccgcacggacgcggaguucuacgaggacuaccccuccauguaccaccuccggcugcaccucaugacccacacccacaaggccgacccgcgcgagaucuuccuggccauccaccacauccucaagagccgggggcacuuccucacccccggcgccgcgaaggacuucaacacggacaagguggaccuggaggacaucuuccccgcccugaccgaggccuacgcccagguguaccccgaccucgagcugaccuucgaccuggccaaggcggacgacuucaaggccaagcuccuggacgagcaggccaccccguccgacacgcagaaggcccuggucaaccuccugcugagcuccgacggggagaaggagaucgugaagaagcgcaagcagguccucaccgaguucgccaaggcgaucaccggccugaagaccaaguucaaccuggcccucgggacggagguggacgaggccgacgccagcaacuggcaguucuccaugggccagcuggacgacaaguggagcaacaucgagaccuccaugaccgaccagggcaccgagaucuucgagcagauccaggagcuguaccgggcccgccuccugaacgggaucgugcccgcgggcaugagccugucccaggccaagguggccgacuacgggcagcacaaggaggaccucgagcuguucaagacguaccugaagaagcucaacgaccacgagcuggccaagaccauccgcggccuguacgaccgguacaucaacggcgacgacgccaagcccuuccuccgcgaggacuucgucaaggcgcugaccaaggaggugaccgcccaccccaacgaggugagcgagcagcugcucaaccggauggggcaggccaacuucaugcugaagcagcgcacgaaggccaacggcgcgaucccgauccagcugcagcagcgggagcucgaccagaucaucgccaaccagagcaaguacuacgacuggcuggccgcccccaaccccgucgaggcccaccgcuggaagaugcccuaccagcuggacgagcugcucaacuuccacaucccguacuacguggggccccugaucacccccaagcagcaggcggaguccggcgagaacguguucgccuggaugguccggaaggaccccagcgggaacaucaccccguacaacuucgacgagaagguggaccgcgaggccuccgccaacaccuucauccagcggaugaagacgaccgacaccuaccugaucggcgaggacgugcuccccaagcagagccugcuguaccagaaguacgagguccucaacgagcugaacaacgugcgcaucaacaacgagugccugggcaccgaccagaagcagcggcucauccgcgagguguucgagcggcacuccagcgucacgaucaagcaggucgccgacaaccugguggcgcacggggacuucgcccgccggcccgagauccgcggccuggccgacgagaagcgguuccucuccagccuguccaccuaccaccagcugaaggagauccuccacgaggccaucgacgaccccaccaagcugcuggacaucgagaacaucaucaccuggagcacgguguucgaggaccacaccaucuucgagaccaagcucgccgagaucgaguggcuggacccgaagaagaucaacgagcuguccgggauccgcuaccggggcugggggcaguucagccgcaagcuccuggacggccugaagcucggcaacgggcacaccgugauccaggagcugaugcuguccaaccacaaccucaugcagauccuggcggacgagacccugaaggagacgaugaccgagcucaaccaggacaagcugaagaccgacgacaucgaggacgucaucaacgacgccuacaccagccccuccaacaagaaggcccugcgccaggugcuccggguggucgaggacaucaagcacgccgcgaacggccaggaccccagcuggcuguucaucgagacggccgacgggaccggcaccgccgggaagcgcacccagucccggcagaagcagauccagacgguguacgccaacgccgcgcaggagcugaucgacagcgccgugcgcggcgagcucgaggacaagaucgccgacaaggccuccuucaccgaccggcugguccuguacuucaugcagggcgggcgcgacaucuacaccggcgcgccccucaacaucgaccagcugagccacuacgacaucgaccacauccugccgcagagccucaucaaggacgacucccuggacaaccgggugcuggugaacgccaccaucaaccgcgagaagaacaacgucuucgccagcacgcuguucgccgggaagaugaaggccaccuggcggaaguggcacgaggccggccugaucuccggccgcaagcugcggaaccucaugcugcgccccgacgagaucgacaaguucgcgaagggguucguggcccggcagcugguggagacccgccagaucaucaagcucaccgagcagaucgccgccgcgcaguaccccaacacgaagaucaucgccgucaaggccggccugagccaccagcugcgggaggagcucgacuucccgaagaaccgcgacgugaaccacuaccaccacgccuucgacgccuuccuggcggcccggaucgggaccuaccugcucaagcgcuaccccaagcuggcccccuucuucaccuacggcgaguucgccaagguggacgucaagaaguuccgggaguucaacuucaucggggcccugacccacgcgaagaagaacaucaucgccaaggacacgggcgagaucgugugggacaaggagcgcgacauccgggagcucgaccgcaucuacaacuucaagcgcaugcugaucacccacgagguguacuucgagaccgccgaccuguucaagcagaccaucuacgccgccaaggacuccaaggagcggggcgggagcaagcagcucauccccaagaagcagggcuacccgacgcaggucuacgggggcuacacccaggaguccgggagcuacaacgcgcuggugcgcguggccgaggccgacaccaccgccuaccaggucaucaagaucuccgcccagaacgcgagcaagaucgccuccgccaaccucaagagccgggagaagggcaagcagcuccugaacgagaucguggugaagcagcuggccaagcgccggaagaacuggaagcccuccgcgaacagcuucaagaucgucaucccccgcuucggcauggggacgcuguuccagaacgccaaguacggccuguucauggugaacuccgacaccuacuaccggaacuaccaggagcuguggcucagccgcgagaaccagaagcugcugaagaagcuguucuccaucaaguacgagaagacccagaugaaccacgacgcccuccagguguacaaggccaucaucgaccaggucgagaaguucuucaagcuguacgacaucaaccaguuccgggccaagcugagcgacgcgaucgagcgcuucgagaagcugcccaucaacaccgacgggaacaagaucggcaagacggagacccugcggcagauccucaucgggcugcaggccaacggcacccgcagcaacgugaagaaccugggcaucaagaccgaccucgggcugcuccaggugggcuccgggaucaagcuggacaaggacacgcagaucgucuaccagagcccguccggccuguucaagcggcgcaucccccuggccgaccucuga

SEQ ID NO: 1921 - RNA, 4095 nt, Artificial Sequence
  Cas9 variant
augggcgaccgcaaguacaaccuggggcucgacaucggcaccagcuccaucggguucgccgccguggacgagaacaaccagcccauccgggucaagggcaagaccgcgaucggggugcgccuguucgaggagggcaagacggccgccgaccggcgcggcuuccggaccacccgccggcgccugagccggcgccgguggcgcaucaaccuccugaacgagaucuucgacgcccaccuggccgagguggacccgaccuuccucgcgcggcugaaggaguccaaccgcagcaaccuggaccccaagaaguccuuccaggggagccuccuguuccccgagcggaaggacuaccaguucuacgaggaguaccccacgaucuaccaccuccgcaaggcccugauggagaaggaccggaaguucgacuuccgcgagaucuaccuggccguccaccacaucaucaaguaccggggcaacuuccugaacgggaccccgaugcgcuccuucaagguggagaacaucgagcucgacacccuguucgaccagcugaaccagcucuacgccgagaucgugcccgacaacgagcuggcguucgaccuggcccaggucgccgacgugaaggacgugcucagcuccaccacgaucuacaagauggacaagaagaagcagcuggucaagaugaugcugcuccccgccagcaacaaggcccugcaguccgagaacaagaagaucgugacccaguucgugaacgcgauccugaacuacaaguucaagcucgacguccugcuccagguggagaccgacgccgacuggagccugaagcugaacgacgagggcgccgacgacaagcuggaggaguucaccggggaccucgacgagaaccggcuggagaucaucgaccugcuccagcgccugcacaacugguucucccugaacgagaucacgaaggacggcaacagccucuccgccgccaugguggagaaguacgagaaccaccaccaccaccugggccugcucaagaaggucaucgagaaccaccccgacgcgaagaaggccaaggcccugaaggagaccuacaccgccuacguggggaagaccgacgacaagacgcagaaccaggacgacuucuacaaggccguggagaagaaccuggacgacagcccggacgcgaaggagaucaagcgccucauccagcuggaccaguucaugcccaagcagcggaccggccagaacggggccaucccccaccagcugcaccagcaggagcucgaccagaucaucgagaagcaguccaaguacuaccccuuccuggccgagccgaaccccaacgucaagcgccggaaggacgcccccuacaagcuggacgagcugaucgccuucaagauccccuacuacgugggcccgcucgugacccccgaggagcaggcgcagaacggcgagaacgucuucgccuggaugaagcgcaaggccgccgggcccaucacccccuggaacuucgacgagaagguggaccggauggagagcgcgaaccgcuucauccggcgcaugacgaccaaggacaccuaccuguucggcgaggacgugcugccggccgaguccaugaucuaccagaaguucgucgugcucaacgagcugaacaaccugaagaucaacgggcggcaccucagccugaaggacaagcaggacgucuacaacgaccuguucaagcagcagaagaccgugagcaucaaggcccuccagaacuacuacgugacgaagaagaaggccgccaccgcgcccaccgucggcgggcuggccgaccccaagaaguuccuguccagccucuccaccuacaucgacuucaagaacauguucggcgagcgcgugaacgacccccaguuccaggaggaccuggagcagaucguggaguggagcacgaucuucgaggaccggggcaucuucaaggccaagcugcaggcccucggguggcuguccgagaagcagauccagcagcuggucgccaagcgcuacaagggcugggggcggcucagcaagaagcugcugaccggccucaagaacgcggagggguacuccauccuggacgagauguggcgcagcaccggcaacuucaugcagauccagucccggccggaguucgccgcccugauccagcaggccaacgagaagcaguucgagggcaacgaccccgacaacgugugggagaacaucgagaacauccucggggacgccuacaccagcccccagaacaagaaggcgauccgccagguggucaagguggugcaggacaucgagaaggccgucggcaacccgcccgagaagaucgccaucgaguucacgcgggaggccgcggccaacccccagcgcacccagucccggcugcgcacccuggagaagcucuacgagagcgccgaggaggugguggacgccgggcugaccgccgagcuggcggaguucaaggagaacaagcacguccucuccgacaaguacuaccuguacuucacgcagcugggccgcgacguguacaccggggacaccaucagccucgacaagcugaacgacuacgacguggaccacauccugccccaguccuucaucaaggacgacagccucgacaaccggguccugaccauccgcgccgugaacaacggcaaguccgacaacgugccggccaagauguucggcaagaagauggggagcuucuggcgguaccugcucgacaacggcaugaucuccaagcgcaaguacaacaaccugaucaccgaccccgacaacaucagcaaguacgcccagaagggguucaucaaccggcagcuggucgagacgagccaggugaucaagcucaccgccaacauccugaacggcaucuacgacaaggacaccgagaucaucgaggugcccgcgaagaugaacucccagaugcgcaagauguucgaccuggucaaggugcgggaggugaacgacuaccaccacgccuucgacgccuaccucaccaucuucaucggcaacuaccuguacaagugcuaccccaagcugcagccguacuucgucuacgacaacuucaagaaguucgggaacaaggaggacaucggccacaagcgcuucaacuuccucgggaagaucgagcgggagaagaaggugguggcccccgagacgggcgagauccuguggagcaacgucgcccccaacgagaccaucaagcagaucaagaagguguacgacuacaaguucaugaucgugucccgcgagaucaccacccggcgcgcggagcuguucaaccagacggucuaccccaagaacuaccacgggaagcucaucccgaucaaggaggaccggcccaccgaccuguacggcggcuacagcgggaacaccgacgccuaccuggccaucguggcccucgaggacaagaagaagggcaaguacuucaagguggucgggauccccacccgcguggcggccaagcuggagaagcugaagcagcaggacucccagcaguaccuccaggcccugcacaaggugaucgcgccccaguucaccaagagcacgaagaagggcaucaagaagaccgaguucgagaucguccuggacaaggugcacuaccggcagcucgugcaggacgggccggucaagaugaugcugggcuccagcaccuacaaguacaacgccaagcagcuggugcucuccgagaaggcccuccaggugaucgccgacgaccgcaaguucgacgagacgcagaaggacgacaaccugaucgccgucuacgacgagauccugagcaucgugaaccaguccuucgaccuguacgacaucaacggcuuccggaagaagcugaacgacaaccgcgaccaguucaucgaccuccccgccgagaccaaguacgaggggcggaagguggucgcccacggcaagcgcgagaugauccuggagauccugaaggggcuccacgcgaacgccgccuucggcaaccugaagcccaucggguucagcaccgccuucggccagcuccaggugcccaacggcaucauccuguccaagaacgccauccugauccaccagagcccguccgggcuguucgagcggaagaucaagcucagcgaccuguga

SEQ ID NO: 1922 - RNA, 4095 nt, Artificial Sequence
  Cas9 variant
auggagaagcaggaguacuaccugggccucgacauggggaucagcuccgugggcugggccgucaccaacgacaaguacgagcugcugcgcaagaaggggaaggacauguggggcauccgggaguucgaggaggccgacagcuccgcggagcgccggacccaccgcgugaaccggcgccggcgccagcgccagguggcccggauggggcuccugaaggaguacuucagcgacgccaucgagaaggucgacuccaacuucuucauccggaucgagaacagcaaguacuucuucgaggacaaggacggccgccuguccagcaagaacggcaucuucgacgacgccgacuacaaggacguggacuacuacacggaguaccccaccaucuuccaccuccggaaggcccugcuggacaucgaggacaccgggaaggaguacgacgugcgccucgucuaccuggcgcuggugaacauguucaagcaccggggccacuuccuccugaacaccgagggggacgcccuguccagcgagcaggucaacacgaccuaccaggagcuccuggagauccuggagaacaacuacgacaucucccucgagagccgcgacaucaaggacgugaucgacaucaucuccagcuccgacaacggccggaagaagaagcacgagcagauccuggagcuguucggggugaagaaguccgacaagcgcgccaacgagcuccugaagugccugugcggccucagcgugaacgccaagcugaucuucgacgagaacuacgaggagaaggucgaccugugcuuccacgacuucagcuacaccgacaagaucccggaccucauggagaagcuguccgaggaggaguacuacgugguggagcagcucaagagcaucuacgacuacagcauccucgcgggcacccugaagggguacgacuaccuguccugcgcccgggucgagcucuacgagaagcaccgcgaggaccugaagcugcucaaggcccuguaccggcgcuacaagacgaacgaggaguacaacgacauguucaagagcgacaaggagggcaccuacuccgccuacgugaacagcuucaacuccagcgacuccagcgugaagaucaagaaguaccgcuggaacaugaaggggcggaccaucgacaaccuguacggcaccaucaagaaggccuucaaggacaacacggacgacaaggacguccaguccaugauggagagcaucgacaaggagcaguuccuccccaagcagcugaccggcgcgaacggggugauccccaaccaggugcacaagaaggagauggagcgcauccugaagaaggcccagaacuaccuccccuuccugaaggagaaggacgaguccgagcugaccgucagcgagcggauccuccgccuguucaccuuccagaucccguacuacgugggcccccugggggagaacuccaagacgggcugggugguccggcgcgagggcgggcgggugcuccccuggaacaucgacgagaagaucgacaugagcgccaccuccgaggccuucaucggcaaccugauccgcaagugcaccuaccugagcgacgagaaggucaugcccaaggccucccugagcuacgagcgguacugcgugcucaacgagaucaacaacaucugcaucgacggggagcgccuggacaccgagcugaagcagaagaucuacacggagugcuucaugaagggcaagcgggugacccgcaagcagaucugcaacuaccucgucgcgcaggggugcaucaaguccgacgagcaggucaccggcaucgacaucaacgugaacagcagccuguccagcuacgggaagauguucgccaucuucggcgagcaccugaaggaggacgccauccggaagguggccgaggagaucaucuacuggggcaccaucuucuccgacagcaagaagauguuccgcaagcaccucacgaaguacguggagcaggggauccugggcgagucccaggugaagcggauccugggguacaaguucaaggacuggggccgcuucagcaaggcccuccugacccugcaggggaucgacaaguccaccggcgagcuccugagccuggagaacgcgaugugggaguacucccucaacuucauggagcugaucaacagcgacgacuucaccuucaaggacgagcuggccaaccggcgcacguccgccaucaagagccucuccgaguucaccuacgaggaccuggaggacaccuacuucagcgucccggugaagcggaugaucuggcagaccauccuggugguccgcgagaucgagcagaucaugggcuacgcccccaagaagguguucguggagauggcccgcuccgaggaggagaagggggacaagggccggaaggacagccgcgggacgcagcuccuggagcuguacaagaacaucaagaacaccgagaaccacgacuggaagaaggagaucuccgaggcgaacgagagcggcaagcuccggagcaagaagcuguaccuguacuacacccagaugggccgcgacauguacaccggggaggagaucaacaucgacaugcucuacgacgacuccauguacgacaucgaccacaucuacccccggcacuacgucaaggacgacagcaucgugaacaaccuggugcuggucaaccgccgggccaaccaggacaucaagaaggaccucuaccccaucccggacaagaucaucuccaaccccaaggugcaggagcuguggaagaugcugcacaagcagaaccucaucacggacgagaaguacaagcgccugaugagccggucccccuucaccgagaagcagcugggcgacuucaucgcccgccagcucguggagacccggcaggggaccaagggcaucgccgagcugcuggggcagcuguucaaggacaccgagaucgucuacgcgaaggccacgaacgugagcgacuuccgccgggacaacggcuucgugaagucccgccuggucaacgacuuccaccacgcccaggacgccuaccugaacaucguggugggcaacgucuacuacaccaaguucaccaagaaccccuggaacuucaucaagaaggacuucgacaaggaccggaacaagaacggguacaaccucgccaagauguucgaccgcgacguggugcggggcgacgacaccgcguggaucgccagcaagaaggacacgcaggggaccaucgagaccguccgcaagaugaugcggaagaacaccccgcugaugacgcgcauguccuucgagcagcacggcgggaucgccaacgccacccuguacagcgccaagaaggcgaagguggagaacuacaucccccucaaguccagcgacauccggcuguccgacgugaagaaguacggcggcuucaccagcgccaccgucgccuacuacuucaucgugcaccacaaggaggggaagaaggagaacacgaccaucgaggcccugccccucuacugcaagcgcaagguggagaacgaggagaacggccugcugaaguacugcgaggagguccucggguacggcgacgugaagauccuguucaacaagcugaagauccagucccuccuggacaucaacggguaccaggcccaccugagcggcaagaccggcaaccagcucacccugcgcaacgcgaugaaccugugcgugcccgagaaguggacggccuacaucaagaagcucgagaagcuggucguggggcacgugaaggagcaggagaucuccagcgaggccaacaucgagcuguacgaccuccugaccgacaagcaccugaacuccgucuacgccaagcggccgaacgcguacggccagaagcucaucgacaaccgcagccgguucgugaaccugaagcccgagagccagugcgaggccauccugcagauccucaagcugaccaagaucgggaacaacgagaccaaccugaagcucaucggcgaguccgagcacagcgggaagaugcugaucuccaagaaccugaaggacacggacaagcccgccaucaucugccagagcgugaccggccucuacgagcgcaagaucuacaucuucgacgagcagcuggacaaguga

SEQ ID NO: 1923 - RNA, 4095 nt, Artificial Sequence
  Cas9 variant
augaacaagcgcuacaacaucggccuggacaucgggaccaacagcaucggcugguccguggucaacgaccagagccagcucgugcggaucaaggggaagcugggcuacggggugcgccuguacgacgagggccagaccgccgaggaccggcgccucuuccggacgacccgccggcgccugaagcggcgcaaguggcggcugggccuccugcgcgagaucuucgagcccuacaucaccccgcaggacgccaccuucuuccugcggcagaagcaguccaaccucagccccaaggaccugcagaagcagcagccccagaucgggcuguucaacgaccgccucgacuccgacuuccacuaccaguaccccacgaucuaccaccuccgguacgcgcugaugaccgagaagcgccaguucgaccuccgggagaucuaccuggccaugcaccacaucgucaaguaccgcggccacuuccugaacgccgccgccgcgagcuccuucaagagcggggagaucgaccucgccaaggacuucgccgcccugaaccagaucuucggcaccaucuucuccgaggugggguucagccuguccgagagcaaccucgacgagaucaaguccauccugcuggacaacaaccucagcgcguccgugcggcagcgcaaggcccugccgcugaucuaccagaccgccgccagcaaggacuccgagaagcaguacaaggccaucgcgacggagcuccugaaggccauccugggccucaaggccaaguucaaccugaucaccggcaucgaggucgaggacgugaaggccuggacccugagcuucaacgccgaggacuucgacgcgaagcucuccgaccugaacaucgccgacaacgacgacgccgugcagaucaucgagauccugcgggcccucuacagcgggguccugcugaccggcaucgugcccgaggggcagagcaucucccaggccaugaucgacaaguacgaggcgcacaaggcccaccucaucaugcugcgcagcauccgcgagcagcuguccgacaaggagaacaaggcccucgagaaggccuacgacgacuacaucgaccaccccgaggacaagcagcacggcagccgggaggacuucuacgccgcgaucacgaaggugcugaagaaggacuccgaggacaccaacaucaucgagauccugaagcucaucgagcuggaccaguucaugcccaagcagcgcaccaaggacaacggcgccaucccgcaccagcugcaccagcaggagcucgaccagaucaucgagaaccagaagcaguacuaccccuggcuggccgacaucaaccccaacgagcagcggcagaagauggcccccuacaagcuggacgagcuggucaccuuccgcgugccguacuacguggggcccaugaucacggcggaggagcaguuccagaccagcaacaagaaguucgccuggaugauccggaaggagcccggcgccaucacccccuggaacuucgaccagaaggucgaccgccaggccuccgccaacgaguucaucaagcggaugaccacgaccgacaccuaccuccuggcggaggacgugcugccgaagcagagccuccuguaccagcgcuucgaggugcugaacgagcucaacgggaucaagaucgacgaccagcccaucaccgucgagcagaagcaggccaucuucaacgacaaguucaugcagcaggcccacgugacggugaagaacauccaggccuaccuggucuccgagggccaguacgccagccggcccaacaucaccgggcuguccgacggcgagaaguucaacagcucccucagcaccuaccacgaccugaagaagaucuucggcgacaugaucgacgaccccaacaagcagaccgacuucgagaagaugaucgagugguccacgaucuucgaggacgggaagaucuucgcggacaagcugcgcgagaucaacuggcucaccgacgagcagcggcagcgccugagcaacaagcgguaccgcggcugggggcagcuguccaccaagcuccugaccaagaucguggaccagaacggccagcggaucaucgacauccuguggaacacgaacgacaacuucaugcgcaucauccacagcgacgacuucgaccaggccgugacccaggccaaccagaugcuccuggccgacaacgacacccaggacgucaucaacgagcuguacaccuccccgagcaacaagaaggcccuccggcagauccugcugguggucgcggacauccagaaggccaugaaggggcaggcccccgcccgcauccucaucgaguucgcgcgggagaagcaggccaacccccgccugagcacgcagcgccggcgccagguggagcaggucuaccaggagcugaacaacgaccagcucaacaaggagcuggccgacccccaguacgccaaccuguccaaggaccggcuguuccuguacuucaugcagggcggccgcgacauguacaccggggagagccugaacaucgaccggcucuccgaguacgacaucgaccacauccugccgcaggccuucaucaaggacaacagccuggacaaccgcgugcucguguccgcgaagaugaaccggagcaaguccgaccacgugccccuggacuucaccgaggagcgcuucggccagaagaugcggagccagugggagcagaugcugcgcgccgggcuccugacccggcgcaaguacaacaaccugacccucaaccccgacucccugaacaaguacacgaugagcggcuucaucaaccggcagcuggucgagacccgccaggugaucaagcucgccaccaaccugcugguggaccaguacgccgacgaggacguccagcucgugaccgugaaguccgggcugacgcaccagaugcgggaggacuucgacuuccccaagaaccgcaaccugaacaacuaccaccacgccuucgacgcguaccucaccgccuucgucggccuguaccugcucaagaaguacccgaagcuggcccacuacuucguguacggccaguaccagcagggguucaaggccaacgaccaguggcggaacuucaacuuccugaacggccuccgccaggagcagcaggucgacgccgagaccggggagcugaucuggcagaaggaccacgaccuggcguacaugaacaagaucuacgacuucaagaagauccucgugacccgggaggugcacacgaaccacggcgcccuguacaaccagacccuguacaaggccaaggacgacaaggccagcggccagggcgggcgccagcucaucgcggccaaggagaaccggcccaccgccaucuacgggggcuacuccgggaagaccguggccuacaugugccugguccgcaucacggagaagaagggcgacuucuaccgcaucugcggcgugcagaccgccuggguggacgagcuggagcacaucgaggacgcgaccaucaagcuccagcggcugaccgcccugcucacgccccaguucagcgccaccaagaagcagaaggacgaggucgugaccguggucaagccguucgaggugcugcugcccaagauccucaucaaccagcgcuucuacgacgggggccaggagcugacccuggccuccgccacguacaagaacaacgcgcaggagcucgugcuggacaagaaggccguccaggugcugaacgggcagcuccccaaggccgagcuggaggcccaggccaccguggucuacgaccagauccuggagcgggugcagaaguacuucccccucuacgacaugaacagcuuccgcgagaagcuguucgugggccgggacaaguucaacgagcugccguggcaggaccagugggagaaccacaagcucauccaggucgggcagaagaccauccuggaccgcauccugaucggccuccacgcgaacgccgccaugggcgaccugaaggcccugaacauguccacccccuucgggaagcuccagaaguccaacggcaucagccugagccccgagacgcagaucaucuaccagagccccaccgggcuguucgagcggcgcguggcccucaaggaccuguga

SEQ ID NO: 1924 - RNA, 4095 nt, Artificial Sequence
  Cas9 variant
augaagaaccugaaggaguacuacaucggccucgacaucgggaccgccagcgugggcugggccgucaccgacgaguccuacaacauccccaaguucaacgggaagaagauguggggcgugcgccuguucgacgacgcgaagacggccgaggagcggcgcacccagcgggggagccgccggcgccugaaccggcgcaaggagcggaucaaccuccugcaggaccuguucgccaccgagaucuccaagguggacccgaacuucuuccuccgccuggacaacagcgaccuguaccgggaggacaaggacgagaagcucaaguccaaguacacccuguucaacgacaaggacuucaaggaccgcgacuaccacaagaaguaccccacgauccaccaccugaucauggaccucaucgaggacgagggcaagaaggacauccggcugcuguaccucgccugccacuaccugcugaagaaccgcggccacuucaucuucgaggggcagaaguucgacaccaagaacagcuucgacaaguccaucaacgaccucaagauccaccuccgggacgaguacaacaucgaccuggaguucaacaacgaggaccugaucgagaucaucaccgacaccacgcugaacaagaccaacaagaagaaggagcugaagaacaucgucggcgacaccaaguuccucaaggccaucagcgcgaucaugaucggguccagccagaagcugguggaccuguucgaggacggcgaguucgaggagaccacggugaaguccgucgacuucagcaccaccgccuucgacgacaaguacuccgaguacgaggaggcccucggggacaccaucagccugcugaacauccucaaguccaucuacgacagcuccauccuggagaaccugcucaaggacgccgacaagagcaaggacggcaacaaguacaucuccaaggcguucgugaagaaguucaacaagcacggcaaggaccugaagacgcugaagcgcaucaucaagaaguaccuccccagcgaguacgccaacaucuuccggaacaagagcaucaacgacaacuacguggccuacaccaaguccaacaucaccagcaacaagcgcaccaaggccuccaaguucacgaagcaggaggacuucuacaaguucaucaagaagcaccuggacaccaucaaggagaccaagcugaacagcuccgagaacgaggaccucaagcugaucgacgagaugcugaccgacaucgaguucaagacguucauccccaagcucaagagcuccgacaacggggucaucccguaccagcugaagcugauggagcucaagaagauccuggacaaccagagcaaguacuacgacuuccugaacgaguccgacgaguacggcaccgugaaggacaagguggagagcaucauggaguuccggauccccuacuacgucgggccccucaaccccgacuccaaguacgccuggaucaagcgcgagaacaccaagaucaccccguggaacuucaaggacaucguggaccuggacagcucccgggaggaguucaucgaccgccugaucggccgcugcacguaccugaaggaggagaaggugcuccccaaggcgagccugaucuacaacgaguucaugguccugaacgagcucaacaaccugaagcugaacgaguuccucaucaccgaggagaugaagaaggccaucuucgaggagcuguucaagaccaagaagaaggugacccugaaggccguguccaaccuccugaagaaggaguucaaccugacgggcgacauccuccugagcgggaccgacggcgacuucaagcaggggcugaacuccuacaucgacuucaagaacaucaucggcgacaaggucgaccgggacgacuaccgcaucaagaucgaggagaucaucaagcucaucgugcuguacgaggacgacaagaccuaccugaagaagaagaucaagagcgccuacaagaacgacuucaccgacgacgagaucaagaagaucgccgcgcucaacuacaaggacugggggcggcuguccaagcgcuuccugacgggcaucgagggcguggacaagaccaccggggagaagggcagcaucaucuacuucaugcgggaguacaaccucaaccugauggagcugaugagcgggcacuacaccuucaccgaggaggucgagaagcucaaccccguggagaaccgcgagcugugcuacgagaugguggacgagcuguaccucucccccagcgucaagcggaugcuguggcagucccugcgcguggucgacgagaucaagcggaucaucggcaaggacccgaagaagaucuucaucgagauggcccgcgccaaggaggccaagaacagccggaaggagucccgcaagaacaagcuccuggaguucuacaaguucgggaagaaggccuucaucaacgagaucggcgaggagcgguacaacuaccugcucaacgagaucaacagcgaggaggaguccaaguuccgcugggacaaccuguaccuguacuacacgcagcucggccggugcauguacagccuggagcccaucgaccuggcggaccucaaguccaacaacaucuacgaccaggaccacaucuaccccaagagcaagaucuacgacgacucccuggagaaccgcgugcuggugaagaagaaccucaaccacgagaaggggaaccaguaccccaucccggagaagguccugaacaagaacgccuacggcuucuggaagauccuguucgacaaggggcucaucggccagaagaaguacacccggcugacccgccggacccccuucgaggagcgcgagcuggccgaguucaucgagcgccagaucguggagacgcggcaggccaccaaggagaccgccaaccuccugaagaacaucugccaggacagcgagaucguguacuccaaggcggagaacgccagccgcuuccggcaggaguucgacaucaucaagugccgcaccgucaacgaccugcaccacaugcacgacgccuaccucaacaucgugguggggaacgucuacaacacgaaguucaccaagaacccccugaacuucaucaaggacaaggacaacgugcgguccuacaaccuggagaacauguucaaguacgacgugguccgcggcagcuacaccgccuggaucgcggacgacuccgagggcaacgugaaggccgccaccaucaagaaggugaagcgggagcucgaggggaagaacuaccgcuucacgcggaugagcuacaucggcaccgggggccuguacgaccagaaccugaugcgcaagggcaaggggcagaucccccagaaggagaacaccaacaagagcaacaucgagaaguacggcggguacaacaaggccuccagcgccuacuucgcgcucaucgaguccgacggcaaggccgggcgggagcgcacccuggagacgaucccgaucauggucuacaaccaggagaaguacggcaacaccgaggccguggacaaguaccugaaggacaaccucgagcugcaggaccccaagauccugaaggacaagaucaagaucaacagccucaucaagcuggacggcuuccuguacaacaucaaggggaagaccggcgacucccucagcaucgccggguccgugcagcugaucgucaacaaggaggagcagaagcugaucaagaagauggacaaguuccucgugaagaagaaggacaacaaggacaucaaggugaccagcuucgacaacaucaaggaggaggagcugaucaagcuguacaagacgcucuccgacaagcugaacaacggcaucuacagcaacaagcggaacaaccaggccaagaacaucuccgaggcgcuggacaaguucaaggagaucagcaucgaggagaagaucgacguccucaaccagaucauccugcuguuccaguccuacaacaacgggugcaaccucaagagcaucggccuguccgccaagaccggcgugguguucauccccaagaagcugaacuacaaggagugcaagcucaucaaccagagcaucaccgggcuguucgagaacgaggucgaccugcucaaccuguga

SEQ ID NO: 1925 - RNA, 4098 nt, Artificial Sequence
  Cas9 variant
auguacaagaaggacuacaccgugggccuggacaucgggagcaccuccgucggcuucgccgccaucgacgacgacuaccagcccauccgccucaaggggaagcgggugaucggcgugcgccuguucgaggaggggaagacggcggccgagcggcgcaacuuccggaccacccgccggcgccugaaccggcgcaaguggcggcucagccugcuggaggagaucuucgacccguacauggccaaggucgaccccaccuucuucgcccgccucaagcaguccaaccuguuccccaaggacaagaacaagaaguucacgggcagccuccucuuccccaagaccaccgacuccaaguucuacgacgaguacccgaccaucuaccaccuccgguaccaccugaugaacgacagccgcaaguucgaccuccgggagaucuuccuggccauccaccacaucgugaaguaccgcggcaacuuccugaacuccgcgcccaucgccagcuucuccacggacaagaucaaccucguggacgacuucgagaccgucaacgccgccuaccugcagaucaacagcuccaaccccgugcagcuggacaccgaccaggcggaccaggugagccggauccuccuggacaacaagcuguccaaccucgacaagcagaagcaggccgccaaggcccuggcccagaaguccggggacaagaagcaggacaagaucaacaacaccacgaucaagcagaucugcaaggcgcugcucggcuacaaguucgaccuggccgucgugcugaacaucgacagcgacgaccacaacaaguggaagcuccagcugagcgacgagaacaucgacucccgccuggccgagcucaccggggagcugaacgaggcccagcuggacauccucaacgugcugagccggcuguacucccagaucacccucaacgacaucguccccagcggcaugacccugagcgaggccaugaucgagaaguacaaggcgcacaagaagcaccugaagaugcucaaggacuucgcccgcucccugagcaagaaggacuacggccaggugauggaggccuacgccgaguacaucgggaacaucccggaguccgccagcuccaaggcgcagaagaagaucagccaggacgacuucuacaagaagaucaagcgguaccuggacgacuccaagcucggccagaagaucgccgagcugaucgccaagaacgaguucaugcccaagcagcgcacgaaccagaacggggugauccccuaccagcugcaccucaaggagcugaaccagaucaucgagaaccagagcaaguacuaccccuggcuggccgagcucaacccgaacgagaagcgccggggcaaggccaaguacaagcuguccgagcuggucgcguuccgcauccccuacuacguggggccccugaucacccaggaggagcagcagaagaccagcaacgccaacuucgccuggaugauccggaaguccgagggccgcaucacccccuggaacuucgacgagaagguggaccggaucgccacggcgaaccgcuucaucaagcggaugaccaccaaggacaccuaccucaucggcgaggacguccugccggcccacagccugcucuacgagcgcuucaaggugcugaacgagcugaacaugauccgggugaacaaccaccgccucuccgucgggcagaagcaggacguguucgagaagcuguuccagaagcacaagacggugaagacccgggagcugaucaagcagcucauggccagcggccugcccacccagccccgcaucaccgggcuguccgaccccgccaaguucaacacgagccucggcaccuacaacaacuucgccaagauccugggggacgagaucaaccagccggaccggcaggaggacuucgagaagaucaucgaguggaucaccaucuucgacgacaaggacauccugaagaccaagcucuccgagcugagcuggcuggacgagaagcagaucaacgcgcucaucaacaagaacuacuccggcuggggccgccugagccggaagcugcucacggagcugaccaacaagaaggggcagagcaucaucgaccgcauguggaacacccagaaguccuucaucgagaucaucaacgagcccgucuucgccgagcagaucaaggacgccaaccaggaccagcuggacgaggacgacuacgagaccgugcuccacgacgccuacacgagcccccagaacaagaaggccauccggcaggucaucaaggugguggacgacaucguccgcgcggccggccgggcccccaaguucaucucccuggaguucgcccgcgaggaccaggagagccgccggacccagucccgccugagccggaucaagaagaucuacgagaccaccaccaaggagcucguggccaacgaccagauccgcgaggagcuggggaacgugaaggaccugaacgaccggcuguuccuguacuucacgcagcugggccgcgacgcguacaccggggagcggaucaacaucgacgacaucuccaccaaguacgacaucgaccacaucuucccgcgcgccuucaucaaggacgacagccucgacaacaagguccuggugaagcgggccgugaacaacggcaaguccaacaacgucccccugaagcuguucggcgccaagaugaagcccaucuggaagauguggaaggaccaccagcugaucagcaagcgcaaguacgagcaccugaugaccaaccccgacgcgaucgacaaguacaaggccaacggguucaucaaccggcagcucaucgagacgcgccagaucaucaagcuggccgccaacauccuggccaaccgguacuccaccgaggacaccaagaucaucgaggugaaggcgaaccucaaccaccagcugcgccagagccugcaccucuacaagaaccgccaggugaacgacuaccaccacgccgucgacggcuaccuguccgccuucguggggcaguaccuguaccaccgguacccgagccuccaguccuacuucguguacggccaguaccagcgguucuucgacaagcagguccaggagaacaugaaguucaaccgcuucaacuuccuguacgaccugaccgaccgggacaacgaccagaucguggucaagagcacgggggagaucgugggcgagaaguccaagcucaucgagcagaucaaguggguguaccgcuacaaguucaugcuggugagccaggaggucuucaccaagaccggcccccuguucgaccagaccaucuaccccgccgggagcaacaagucccggcucaucccgaucaagaaggaccgccccacggacaucuacggcggguacagcuccagcaccgacgccuacaugucccugauccgcgugcccgacaagaaggaggacaaguacaagguggucggcgugcccagccggucccuggcgagccucaaccgcgccgagaagcggggccacgacgccuaccuggaccagcugcgccaggugaucgccaagucccagaagaaggaguuccagaucaucaucccgaagcuccgguaccgccagcugaucaucgacgggggccugaaguacacccucgggagcuccgccuaccaguacaacgcgcggcagcugguccugagcgagaaguccauggaggugcucgugaccgacuucagcaaggucacgaccgaccuggacaagcagaaccagaagcugaucgccguguacgacgacauccucgacaaggugaaccgcugccugccccuguacgacaagaaccaguuccggaaggcccucaacggcgcccgcgacaaguucguccagcugcccauccugcccaaguucaacgggaacaagaaggaggaggcgggcaagguggagauccucaacgagauccugcugggccuccacgacgacgccuccaccgggaaccugaagccgcugggcaucaagacccccuucgggaugcuccagacgcagagcggcaucaccauguccagcaacgccgugaucgucaaccagucccccaccgggcuguucgagcaccggaucuaccugaaggcccuccugaacaagcugaacaaguga

SEQ ID NO: 1926 - RNA, 4098 nt, Artificial Sequence
  Cas9 variant
augaccaagcugaaccagcccuacggcaucgggcucgacaucggcagcaacuccaucggguucgccguggucgacgccaacagccaccuccugcgccucaagggcgagaccgcgaucggggcccggcuguuccgcgagggccaguccgccgccgaccggcgcggcagccggacgacccgccggcgccugucccggacccgcuggcggcucagcuuccugcgcgacuucuucgccccgcacaucaccaagaucgaccccgacuucuuccugcggcagaaguacuccgagaucagccccaaggacaaggaccgcuucaaguacgagaagcggcuguucaacgaccgcacggacgcggaguucuacgaggacuaccccuccauguaccaccuccggcugcaccugaugacccacacccacaaggccgacccgcgcgagaucuuccuggccauccaccacauccucaagagccgggggcacuuccugacccccggcgccgcgaaggacuucaacacggacaagguggaccuggaggacaucuuccccgcccugaccgaggccuacgcccagguguaccccgaccucgagcugaccuucgaccuggccaaggcggacgacuucaaggccaagcuccuggacgagcaggccaccccguccgacacgcagaaggcccuggucaagcuccugcugagcuccgacggggagaaggagaucgugaagaagcgcaagcagguccucaccgaguucgccaaggcgaucaccggccugaagaccaaguucaaccuggcccucgggacggagguggacgaggccgacgccagcaacuggcaguucuccaugggccagcuggacgacaaguggagcaacaucgagaccuccaugaccgaccagggcaccgagaucuucgagcagauccaggagcuguaccgggcccgccuccugaacgggaucgugcccgcgggcaugagccugucccaggccaagguggccgacuacgggcagcacaaggaggaccucgagcuguucaagacguaccugaagaagcucaacgaccacgagcuggccaagaccauccgcggccuguacgaccgguacaucaacggcgacgacgccaagcccuuccuccgcgaggacuucgucaaggcgcugaccaaggaggugaccgcccaccccaacgaggugagcgagcagcugcucaaccggauggggcaggccaacuucaugcugaagcagcgcacgaaggccaacggcgcgaucccgguccagcugcagcagcgggagcucgaccagaucaucgccaaccagagcaaguacuacgacuggcuggccaagcccaaccccguggagaagcaccgcgccuccaagcccuaccagcuggacgagcugcucaccuuccggaucccguacuacguggggccccugaucacccccaagcagcaggccgagagcggcgagaacgucuucgcguggauggugcgcaagaaccccuccgggaacaucaccccguacaacuucgacgagaagguggaccgggaggccagcgccaacacguucauccagcgcaugaagaccaccgacaccuaccugaucgacgaggacguccuccccaagcagucccugcuguaccagaaguacgaggugcucaacgagcugaacaacgugcggaucaacaacgaggcccugagcacggaccagaagcagcgccucauccacgaggucuucgagcggcacuccagcgugaccaucaagcaggucguggacaaccugguggcccacggcgacuucgcgcagcgccccgagauccggggccuggccgacgagaagcgcuuccucuccagccuguccaccuaccaccagcugaaggagauccuccacggggccaucgacgacagcaccaagcugcacgacaucgagaacaucaucacgugguccaccgucuucgaggacgccgccaucuucaagaccaagcuggcggagaucgacuggcucgaccccgccaccaucaagaagcugagcaacauccgguaccgcggcugggggcaguucucccggaagcugcucgacggccugaagcuggggaacggccacaccgugauccaggagcucaugcugagcaaccacaaccugaugcagauccucgccgacgagacgcugaaggagaccaugaccgagcugaaccaggacaagcucaagaccgacgacaucgaggacgugaucaacgacgccuacacguccccgagcaacaagaaggcgcugcgccagguccugcgcgugguggaggacaucaagcacgccgccaacggccaggaccccuccuggcucuacaucgagaccgccgacgggaccggcaccgccgggaagcggacgcagagccgccagaagcagauccagaccgucuacgcgaacgccgcccaggagcugaucgacagcgccgugcggggcgagcuggaggacaagaucgccgacaaggcguccuucaccgaccgccucgugcuguacuucaugcagggcgggcgggacaucuacaccggcgcgccccugaacaucgaccagcucagccacuacgacaucgaccacauccugccccagucccugaucaaggacgacagccucgacaaccgcguccuggugaacgccacgaucaaccgggagaagaacaacguguucgccuccacccuguucgccagcaagauggccgccaccuggcgcaaguggcacgaggccgggcucaucuccggccggaagcugcgcaaccugaugcuccggccggacgagaccgacaaguucgcccacggguucgucgcgcgccagcugguggagacgcggcagaucaucaagcugaccgagcagaucgccgccgcccaguaccccaacaccaagaucaucgccgugaaggcgggccucagccaccagcugcgcgaggagcuggacuuccccaagaaccgggacgucaaccacuaccaccacgccuucgacgccuuccucgccgcccgcaucggcaccuaccugcugaagcgguacccgaagcucgcgcccuucuucacguacggggaguucgccaagguggacgugaagaaguuccgcgaguucaacuucaucggcgcccugacccacgccaagaagaacaucaucgccaaggacaccggggagaucgucugggacaaggagcgggacauccaggagcuggaccgcaucuacaacuucaagcggaugcucaucacccacgaggugcacuucgagacggcggaccuguucgaccagaccaucuacgccgccaaggacuccaaggagcgcggcgggcgcaugagccugauccccaagaagcucggcuaccugaccggcaucuacgggggcuaccagaccgagcggggguccuacgugagcaucauccgcacguucaagaagggcgagaccaucuacaaggucgugaacauccugaccgccgacgugucccuccugagcgagaaggagaaggucuccaagacccuggccgacaucuaccucaaggagcugaucgcgaagaagcugagcaaggggaaguccggcaagaacaucgccagcgagcccuucgagaucgugcucccgcgggugggcaaggacagccuguucaagaacaagaaguacgggcuguuccucaucgaguccgccacggagcugcacaacuaccaggagcuguggcucccccgcaacgaccagcugcugaucaagcggauccaggcccgccagaucgaggagagcaaggcggacuacgagcucacccggauguaccgcaacaucgccuggcaggucgaccacuacuuccggcuguacaagauccgcaaguucgccgagaagcugcaggccuccguggaggacuucgccggccuccccguguacaagaacgagaccagcgacgggaaggucgaggugcuggcguccgugcugaagcggcucaacggcgccgccgacaaggggcgcaccaaccccacgaccgucaagcugcagagcgacuucggccggacccugcucaccaacggcaucgugcuggaggacgacuccagcaucguguaccaguccccgaccgggcuguucaagcgcagcgucaagcucguggaccuguga

SEQ ID NO: 1927 - RNA, 4098 nt, Artificial Sequence
  Cas9 variant
augaccaaggaguacuaccugggccucgacguggggaccaacagcgucggcugggccgugacggacucccaguacaaccugugcaaguucaagaagaaggacaugugggggauccgccuguucgagagcgccaacaccgcgaaggaccggcgccuccagcggggcaaccgccggcgccuggagcggaagaagcagcgcaucgaccugcuccaggagaucuucucccccgagaucugcaagaucgacccgaccuucuucauccggcugaacgagagccgccugcaccucgaggacaaguccaacgacuucaaguacccccuguucaucgagaaggacuacagcgacaucgaguacuacaaggaguuccccaccaucuuccaccuccggaagcaccugaucgaguccgaggagaagcaggacauccgccugaucuaccuggcccuccacaacaucaucaagacgcgggggcacuuccugaucgacggcgaccugcagagcgccaagcagcuccgccccauccuggacaccuuccugcucucccugcaggaggagcagaaccugagcgugucccucagcgagaaccagaaggacgaguacgaggagauccugaagaaccgguccaucgccaagagcgagaaggucaagaagcugaagaaccucuucgagaucuccgacgagcuggagaaggaggagaagaaggcccagagcgcggugaucgagaacuucugcaaguucaucgugggcaacaagggggacgucugcaaguuccugcgcguguccaaggaggagcucgagaucgacagcuucuccuucagcgagggcaaguacgaggacgacaucgugaagaaccuggaggagaaggucccggagaagguguaccuguucgagcagaugaaggccauguacgacuggaacauccucguggacauccuggagaccgaggaguacaucagcuucgccaaggucaagcaguacgagaagcacaagaccaaccugcggcuccugcgcgacaucauccugaaguacugcacgaaggacgaguacaaccggauguucaacgacgagaaggaggccggguccuacaccgcguacgugggcaagcucaagaagaacaacaagaaguacuggaucgagaagaagcgcaaccccgaggaguucuacaagagccuggggaagcugcucgacaagaucgagccccugaaggaggaccuggaggugcucaccaugaugaucgaggagugcaagaaccacacccugcugcccauccagaagaacaaggacaacggcgucaucccgcaccaggugcacgagguggagcucaagaagauccuggagaacgccaagaaguacuacuccuuccugacggagaccgacaaggacggcuacagcgucgugcagaagaucgaguccaucuuccgguuccgcauccccuacuacguggggccccugagcacccgccaccaggagaagggcuccaacgucuggauggugcggaagcccgggcgcgaggaccggaucuacccguggaacauggaggagaucaucgacuucgagaaguccaacgagaacuucaucacccgcaugacgaacaagugcaccuaccucaucggcgaggacgugcugcccaagcacagccugcucuacagcaaguacaugguccugaacgagcugaacaacgugaagguccggggcaagaagcuccccaccucccugaagcagaagguguucgaggaccuguucgagaacaagagcaaggugaccgggaagaaccuccuggaguaccugcagauccaggacaaggacauccagaucgacgaccucuccggcuucgacaaggacuucaagacgagccugaaguccuaccuggacuucaagaagcagaucuucggggaggagaucgagaaggagagcauccagaacaugaucgaggacaucaucaaguggaucaccaucuacggcaacgacaaggagaugcucaagcgcgucauccgggccaacuacuccaaccagcugaccgaggagcagaugaagaagaucaccggguuccaguacagcggcuggggcaacuucuccaagauguuccugaaggggaucagcggcagcgacguguccacgggggagaccuucgacaucaucaccgccaugugggagaccgacaacaaccucaugcagauccugagcaagaaguucacguucauggacaacguggaggacuucaacuccggcaaggucgggaagaucgacaagaucaccuacgacagcaccgugaaggagauguuccugucccccgagaacaagcgcgccguguggcagaccauccaggucgcggaggagaucaagaaggugaugggcugcgagccgaagaagaucuucaucgagauggcccggggcggggagaaggugaagaagcgcaccaagagccggaaggcccagcuccuggagcuguacgccgccugcgaggaggacugccgcgagcucaucaaggagaucgaggaccgggacgagcgcgacuucaacuccaugaagcuguuccuguacuacacgcaguucggcaagugcauguacagcggggacgacaucgacaucaacgagcucauccggggcaacuccaagugggaccgcgaccacaucuacccccagagcaagaucaaggacgacuccaucgacaaccugguccuggugaacaagaccuacaacgcgaagaaguccaacgagcuccugagcgaggacauccagaagaagaugcacagcuucuggcugucccuccugaacaagaagcugaucaccaagagcaaguacgaccggcucacgcgcaagggggacuucaccgacgaggagcuguccggcuucaucgcccggcagcugguggagacccgccagagcaccaaggccaucgccgacaucuucaagcagaucuacagcuccgaggucguguacgucaagagcucccucgugagcgacuuccgcaagaagccccugaacuaccugaagucccggcgcgugaacgacuaccaccacgccaaggacgcguaccucaacaucguggucggcaacguguacaacaagaaguucaccagcaaccccauccaguggaugaagaagaaccgggacacgaacuacucccugaacaagguguucgagcacgacgucgugaucaacggggaggugaucugggagaagugcaccuaccacgaggacaccaacaccuacgacggcgggacgcuggaccgcauccggaagaucgucgagcgcgacaacauccucuacaccgaguacgccuacugcgagaagggcgagcuguucaacgccaccauccagaacaagaacggcaacagcaccgugucccugaagaaggggcucgacgugaagaaguacggcggguacuucagcgccaacacguccuacuucagccugaucgaguucgaggacaagaagggcgaccgggcccgccacaucaucggggucccgaucuacaucgcgaacaugcuggagcacucccccagcgccuuccucgaguacugcgagcagaagggcuaccagaacgugcggauccugguggagaagaucaagaagaacucccugcucaucaucaacggcuacccccugcgcauccgcggggagaacgaggucgacaccagcuucaagcgggccauccagcugaagcucgaccagaagaacuacgagcuggugcggaacaucgagaaguuccuggagaaguacguggagaagaagggcaacuaccccaucgacgagaaccgcgaccacaucacccacgagaagaugaaccagcucuacgagguccugcuguccaagaugaagaaguucaacaagaaggggauggccgacccgagcgaccggaucgagaaguccaagcccaaguucaucaagcucgaggaccugaucgacaagaucaacgugaucaacaagaugcugaaccuccugcgcugcgacaacgacaccaaggcggaccugagccucaucgagcugcccaagaacgccggcagcuucguggucaagaagaacacgaucgggaaguccaagaucauccuggugaaccagagcgugaccggccucuacgagaaccggcgcgagcuguga

SEQ ID NO: 1928 - RNA, 4098 nt, Artificial Sequence
  Cas9 variant
auggacaccgccaagaccaacaagcagcccuacuacaucggccuggacauggggacgagcuccgugggcugggccgucaccgacgcgagcuacaacguggugaagaagcacgggaaggcccucuggggcguccgccuguucgaggaggcccagaccgccgccgaccggcgccugcaccggaccgcgcgccggcgcauccagcggcgcaagcagcggcucgcccugcugcaggagcuguucgccaaggagaucugcaagguggacccgggguucuucauccgccugcacgagucccggcuguggcaggaggacaagagcaucgaccagcccaacacccucuucaacgacgaggacuucgacgacaaggccuaccacaaggcguaccccaccaucuaccaccuccgcuacgcccugaugaccgagaacaaguccuucgacgugcggcucgucuaccuggccauccaccacaucaucaagcaccgcggccacuuccugcucgagaacuacgaccugagcaaccaggagaccuccggcuucgacgagagcuacaucgcccugacgaacgccaucaaggagcuccugcagaaggagauccccguggggcacguggagaagauccagaucauccugaaggacaagucccucagcaagcgggagaagaccgagaagauccugcaggucugggacgugaucaaggacaagcagcugaaggaggugguccagcucaucugcggcgggaccgcgaaccuguccacccuguucauggacgagagccucaaggaggcccugaagguguucgagaucaaggacuccaagaucagcuucuccacggccguguacgaggagaaggagagcgaccugcaguccguccucgagcagcgcuucgaccugguguacgccgccaagaugcuguacgacuggagccuccuggcggagcugaugggcgaccggaagacccucuccgaggccaagaucgccaucuacgagacccacaagaaggaccuggaggugcugaagcgccucacccggcaggacaagagccuguaccgcaagcuguuccgggggacggacaaggacagcuacuccgccuacgucggcagcugcaugauccacggcgagaagcucgugaucgagaagcgcggguccaccgaggaguucuacaaguuccugaagaaggagaucagcaagcugccggacugcgaggacaagaucuacgugcucuccaagaucgaggccgagaacuuccugcccaaggcggucagcaccaucaacggcaucauccccuaccagcugcaggagcaggagcucgacaucauccugaagaaggccgagcaguaccugcccuuccugauggagaaggacgccuacgggaccaucuccgagaagaucaagcagcuccugacguuccgcaucccguucuacgugggcccccugaaccggcacagcgacaaguccugggccgugcacaccgacaaggagggccgcauccuccccuggaacuucaacgagcggaucaacgaggagaaguccgccgagaaguucaucacccgcaugaccaacaagugcacguaccugcuggggaaggacguccuccccaagaacagccugcuguacaccgaguacaugcuguucaacgagcucaacaacgugaagaucggcaaggcggggaccuaccugaccgaggagcagaaggagaagcucuggaaggagcuguuccugacgaccaagaaggucacccucagcaaguucuccaaguuccugaucaaggagggcaucgacaaggaggaggccguggagaucaaggggcuggacggcggcuucaagagcucccucgccccguggaucgaccugaagaacauccugggggaggacuucacccgggacaaggccgaggagaucaucaaggcgaucacccucuucagcauggacaagaagauccugaagaaguaccugaugcgcaucguguccgagcccgucgccaagcagcucagcaagcugcgguacacgggcugggggcgcuucuccaaggaguuccugaccgagaucacgccccgggugacggacgacgugcagguccucguggacaccagcaccggcgagaucaugaacaucaucaccgcccugaagaagaccagccugaaccucauggagauccuguccagcacguacggguacuccgccgccaucagcgaggcgaacaaggagcuggugggcaacaccguccucuccuacgagaccgugaaggagcugaccgugagccccgccgucaagcgcccgaucuggcagacgcugaagaucaucaaggagaucacccacaucaugggcgccgagcccgcccggaucuucaucgagauggcccgcgacaagcagcccgacaaggggcggaccgacucccgcaagaagcagcucaucgagcuguacaagaagugcaaggaggacgugcggagcugguccaaccgcgagagcaaggacuggguggaggagaucgaguccaagagcgacucccagcugcggagcaacaagcuguuccucuacuacacccagaugggcaagugcauguacacggggaagcccaucgaccugggcgcgcuccugaaggggcagcuguacgaccgcgaccacaucuacccgcagucccagaccaaggacgacagccucgacaaccuggucaucguggacaaccgggagaaccgcgacaaguccaacaccuacccccugagcaagaacauccgcgagcggcagaucggcuucuggaagcuccugcgcgacaagggcuucaucagcaaggagaaguacuuccggcugacccgcaacacgcccuucuccgacgccgagaaggccgaguucaucgcccggcagcucguggagacccgccagagcaccaaggccgucgcggagauccugaagcgggugcugcccaaguccaucaucguguacgucaaggccgggcucaccagccgcuuccggcaguacggcgaguucaucaaggugcgcgaccugaacgacuaccaccacgccaaggacgccuaccugaacaucgugacggggaacguccacuacaccaaguucaccuccaacccgauccgguucgugaaggacugccagaucuacagccucaacgagcacgcgcuguacaaguacaccguggagcgcaacggcgucguggccugggcccccaacgaggagggcaugaugcccuccgugacgcgguggaugaacaagaacaacauccuggucacccgcaugagcuacguggggcagggcgagcuguucgaccagcucccccugaagaaggggaagggccaggugucccucaagaaggagggggccaucagcgacaucuccaaguacggcggcuacaacagcgccuccaccgcguacuucauguacgucgagggggaggacaacaagggcaagccgguguacgugaucgagaccaugccccugcaccuggccgcccggcucacgacccuggaggagaagcagaaguacugcgaggagcuguggaugagcaccgggggcaagcucaagaaccccaagguccugaucgagcagaucccgauccagucccuguucagcguggacggguuccgcgugaccaucgccggcaagacgggcaagcaguacgggugccggcucgccgaggagcugguccugaacaacggcuacgcgaugacccucaaggccgugcugaaguucgugaaccgccggaagaugaacaaggaggcccugaucaccuccuacgaccaccucgaggagagccagcugcuggcccucuacgacgucuuccuggacaagcuggagcacuccugcuucagcaagcgcuucagcacccagcgggacgugcucaagaacgggcgcgaguccuacaucgcccugagccuggaggacaagugccagauccucuccgagauccugcaccuguuccagugcaacgcgacgcucagcaaccugucccugcucggcagcuccaagcagagcgggcgccuguacauguccaagaaccugagcgacaaggacuccugguacaucauccaccagagcgugaccggcuucuacgagcagcacaucccccuggcccccuacaagaaguccuga

SEQ ID NO: 1929 - RNA, 4098 nt, Artificial Sequence
  Cas9 variant
auggugaagaagaaguacgccaucggcaucgacaucgggaccaacagcgucggcugguccguggugaccgacgacuacaagguccccagcaagaagaugaagguguucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaagaaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacguccagcaccuguucaacgacuucguggagauguucgacaagaccguggagggguccuaccugagcgagaaccuccccaacgucgccgacgugcugguggagaaggucuccaagagccggcgccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacggacagcaccaccaaggcgccccucuccagcuccauggugaaccgguacgaggagcacaagaaggaccuggcccugcucaagaacuucauccaccagaaccugagcgacagcuacaaggagguguucaacgacaagcugaaggacggcuacgccggcuacaucgaggggaagaccacgcaggagaacuucuaccgcuucaucaagaaggccaucgagaagaucgagggcuccgacuacuucaucgacaagaucgaccgggaggacuuccuccgcaagcagcggaccuucgacaacgggagcaucccccaccagauccaccuccaggagaugcacgccaucauccgccgccaggcggaguucuaccccuuccuggucgagaaccaggacaagaucgagaagauccucaccuuccggaucccguacuacgugggcccccuggcccgcgggaaguccgaguucgccuggcugaaccgcaagagcgacgagaagauccggcccuggaacuucgacgagaugguggacaaggagaccuccgccgagaacuucaucacgcggaugaccaacuacgaccaguaccuccccgaccagaagguccugccgaagcacagccugcuguacgagaaguucgccguguacaacgagcucaccaaggugaaguucaucgcggagggcaugcgcgacuaccaguuccuggacuccggccagaagaaggacaucgucaagacccuguucaagacgaagcggaaggugaccgccaaggacaucaaggccuaccucgagaacagcaacggguacgccggcguggagcugaaggggcuggaggagcaguucaacgccucccuccccaccuaccacgaccugcugaagauccuccgcgacaaggcguucaucgacgccgaggagaaccaggagauccuggaggacaucguccugacccucacgcuguucgaggaccgggagaugauccgcaagcggcuggagaaguacaaggacauccucaccgaggagcagcgcaagaagcuggagcggcgccacuacaccggcugggggcggcugagcgccaagcucaucaacggcauccuggacaaggugacccgcaagacgauccugggcuaccucaucgacgacgggaccuccaaccggaacuucaugcagcugaucaacgacgacacccugagcuucgucgacgagauccgccucgcccagggcuccggggaggcggaggacuaccgggccgaggugcagaaccuggccggcagccccgccaucaagaaggggauccugcagucccucaagaucguggacgagcugaucgaggucaugggcuacgaccccgagcacaucgugguggagauggcccgcgagaaccaguucaccaaccagggccgccggaacagccagcagcgcuacaagaagaucgagaacgcgaucaagaaccuggacuccaaccucaacagcaagauccugaaggaguacccgacgaacaaccaggcccugcagaacgaccggcuguuccuguacuaccugcagaacgggaaggacauguacaccgacgaggagcucgacaucgaccagcugucccaguacgacaucgaccacaucaucccccaggccuucaucaaggacgacagccuggacaacaagguccucaccaagagcgccaagaaccgcggcaaguccgacgacgugcccagccuggagaucgugcacaagaagaagaacuucuggaagcagcugcucgacucccagcugaucagccagcggaaguucgacaaccugaccaaggccgagcgcgggggccucaccaacgaggacaaggcgcgguucauccagcgccagcuggucgagacgcggcagaucaccaagcacguggcccgcauccuggacacccgguucaacaccaagcucgacgaggccggcaaccgcauccgggaccccaaggugaacaucaucacgcugaaguccaaccuggucagccaguuccgcaaggacuaccagcucuacaaggugcgggagaucaacaacuaccaccacgcccacgacgccuaccugaacgcgguggucgccaccgcccugcucaagaaguacccgcagcuggcccccgaguucguguacggggacuaccccaaguacaacuccuacaagagccgcaaguccgcgaccgagaaggugcuguucuacagcaacaucaugaacuucuuccggcgcguccucguguacuccaagaccggcgaggugcggauccgccccgucaucgaggugaacaaggagacgggggagaucgugugggacaagaaguccgacuuccggaccguccgcaaggugcugagcuacccccaggugaacgucgugaagaagguggagaugcagaccggcggguucagcaaggaguccauccugcagcacggcgacagcgacaagcucaucccccgcaagaccgagaaguucuaccuggacacgaagaaguacggcggguucgacucccccaccaucgccuacagcguccugcucaucgccgacaucgagaagggcaaggccaagaagcugaagcgggugaaggagcugaucgggaucaccaucauggagcgcauggccuucgagaagaaccccaucgaguuccucgagcacaagggcuacaagaacauccuggagaagaacaucaucaagcugccgaaguacagccucuucgagcuggagaacgggcggcgccggcugcucgcguccgccaaggagcugcagaagggcaacgagaugauccugccgccccaccucgugacccugcuguaccacagcuccaacauccacaagaucacggagccgauccaccucaacuacgucaacaagaacaagcacgaguucaaggagcugcugcgccacaucagcgacuucuccacccgguacauccucgcccaggaccgccugagcaagaucgaggagcuguacgacaagaacgacggcgacgacaucuccgaccucaccagcuccuucgugaaccugcugaccuucacggccaucggggcccccgcggccuucaaguuccucggcagcgugaucgaccggaagcgcuacaccuccaucgccgagauccuggaggccacccugauccaccagagcgucaccgggcucuacgagacgcggaucgaccuguccaagcugggcggggacuga

SEQ ID NO: 1930 - RNA, 4101 nt, Artificial Sequence
  Cas9 variant
augaagaagcccuacagcaucggccuggacaucgggaccaacuccgugggcugggccgucaucaccgacgacuacaaggugccggccaagaagaugaaggugcucgggaacacgaacaagaagaccaucaagaagaaccugaucggcgcgcugcuguucgacgccgggaacaccgccgccgaccgccggcugaagcgcaccgcccggcgccgguacacgcgccggcgcaaccggauccuguaccuccaggagaucuucgcggccgagaugaacaagcuggacgagagcuucuuccaccgccuggacgacuccuuccucguccccgaggacaagggcggcagcaaguaccccaucuucgggacccuggaggaggagaaggaguaccacaagcaguuccccaccaucuaccaccuccggaagucccucgccgacagcaaggagaaggccgaccugcgccugaucuaccucgcgcuggcccacaucaucaaguaccggggccacuuccuguacgaggacaccuucgacaucaagaacaacgacauccagaagaucuucaacgaguucacguccaucuacaacaacaucuucgaggagagcucccucagcaacgagaacgcccagguggaggagaucuucaccgacaagaucuccaagagcgccaagaaggaccgcgugcugaagcuguucccggacgagaaguccaccgggcuguucagcgaguuccugaagcugaucgucggcaacaaggccgacuucaagaagcacuucgaccucgaggagauggcgccccugcaguucuccaaggacaccuacgacgaggaccuggagagccuccuggggcagaucggcgacgacuacgccgaccuguucgugguggccaagaagcucuacgacgccauccugcuggccggcauccucuccgucaaggaccccgcgacgaaggcgccccugagcgccuccaugaucgagcgguacgacaaccaccagaacgaccugagcgcccucaagcaguucauccgcagcaaccugccggagaaguacgccgagguguucuccgacgacagcaaggacggguacgccggcuacaucgacgggaagaccacccaggagggcuucuacaaguacaucaagaaccagaucuccaaguucgagggcaccaaguacuuccuggagaagaucgagcgggaggacuuccuccgcaagcagcggacguucgacaacgggagcaucccccaccagauccaccuccaggagaugaacgccauccugcagaaccagggcggguacuaccccuuccucaaggccaacaaggagcgcaucgagcagauccugaccuuccggauccccuacuacgugggcccgcuggcccgcgggaacuccgacuucgccuggcucacccgcaacagcgacgacgcgauccggcccuggaacuucgaggaggucguggacaaggccuccagcgccgaggacuucaucaacaagaugaccaacuacgaccuguaccugcccgaggagaaggugcuccccaagcacucccugcuguacgagacguucgccgucuacaacgagcugaccaaggugaaguucaucgcggaggccaugaaggacuacgaguuccucgacagcggccagaagcgcaagaucguggagaacaucuucaagaaccaccggaaggucaccgagaaggacaucaucaacuaccugcacaacguggacggcuacgacgggaucgagaucaagggcaucgagaagcaguucaacgccucccugagcaccuaccacgaccuccugaagaucaucaaggacaaggaguucauggacaacccgaagaacggggagauccuggaguccaucauccacacgcucaccaucuucgaggaccgcgagaugaucaagcagcugcuggcccaguacaacagcguguucgacgagaaggucaucaaggcccucucccggaagcacuacaccggcugggggaagcugagcgcgaagcugaucaacggcauccgcgacaagcagaccggcaacuccauccucgacuaccugauggacgacggcaagagcaaccggaacuucaugcagcugaucaaggacgacgggcucuccuucaaggagaucaucgacaaggcccagguggugggggagacggacaaccugcgccaggucgugcagaaccugcccggcagccccgccaucaagaaggggauccuccagagcaucaagcuggucgacgagcuggugaaggugaugggcuccgaccccgagagcaucgucaucgagauggcccgggagaaccagaccaccaacaagggcaaguccaagagccagcagcgccucaagacccuguccgacgccaucagcgagcugggguccaacauccucaaggagcacccgacggacaacauccagcugcagaacgaccggcuguuccucuacuaccugcagaacggcaaggacauguacaccggggaggcgcuggacaucaaccagcucagcaacuacgacaucgaccacaucaucccccaggccuucaucaaggacgacucccuggacaacagcgugcugaccuccagcaaggacaaccgcggcaaguccgacaacgugcccagccucgagaucgucgagaagaugaagggcuucuggcagcagcugcuggacuccaagcucaucagcgagcggaaguucaacaaccugaccaagguggagcgcgggggccuggacgagcgggacaaggugggguucaucaagcgccagcucgucgagacgcggcagaucaccaagcacguggcccagauccuggacgcccgcuucaacgccgaggugaacgagaagaaccagaagcugcgguccgucaagaucaucacccucaagagcaaccuggugagcaacuuccgcaaggaguucggccuguacaaggugcgcgagaucaacgacuaccaccacgcgcacgacgccuaccucaacgccgucaucgccaaggcgauccugaaggaguaccccaagcuggagccggaguucguguacggggacuaccagaaguacgaccucaagcgguacaucucccgcaccaaggaccccaaggagaucgagaaggccaccgagaaguacuucuucuacagcaaccugcugaacuucuucaaggacaagguguacuacgccgacggcacgaucauccagcggggcaacgucgaguacuccaaggacaccggggagaucgccuggaacaagaagcgcgacuucgccaucgugcggaaggugcucagcuacccccaggucaacaucgugaagaagaccgaggagcagaccggcggguucuccaaggagagcauccugcccaagggcaacuccgacaagcugaucccgcgcaagacgaagaacauccagcucgacaccaccaaguacgggggcuucgacagccccgugaucgcguacuccauccugcuggucgccgacguggagaagggcaagagcaagaagcucaagaccgugaagucccugaucgggaucacgaucauggagaaggucaaguucgaggccaaccccguggccuuccuggagggcaagggguaccagaacguggucgaggagaacaucauccggcucccgaaguacagccuguucgagcuggagaacggccgccggcgcaugcucgccuccagcaaggagcugcagaaggggaacgagauggugcugcccuccuaccuccuggcgcugcucuaccacgccaagaagauccagaagaaggacgagcccgagcaccuggaguacaucaagcagcaccacagcgaguucaacgaccugcucaacuucguguccgacuucagccagaaguacguccuggccgaguccaaccuggagaagaucaagaaccucuacaucgacaacgagcagaccaaccuggaggagaucgccaacagcuucaucaaccugcucaccuucaccgccuucggcgcgcccgccguguucaaguucuucggcaaggacaucgagcggaagcgcuacagcacggugaccgagauccugaaggccacccugauccaccaguccaucaccgggcucuacgagacgcggaucgaccugagcaagcugggcgaggaguga

SEQ ID NO: 1931 - RNA, 4101 nt, Artificial Sequence
  Cas9 variant
auggacaagaaguacaacaucggccuggacaucgggaccagcuccaucggcuucguggccaccgacgaggacaaccacgucauccgcgccaaggggaagaacgugaucggcgugcggcuguucgacgaggggcagagcgcggccgagcgccggggcuuccgcacgacccggcgccggcugaaccgccggaaguggcgccugaaccuccugcgggagaucuucgagccccacaucuacccgaucgacgccuccuucuucaugcgccagaaguacagcaaccuguccaagcaggaccccaaccagaagaucgaguucaaggacauccucuucagcgacaaguccgacgccgaguucuaccggcaguaccccaccaucuaccaccuccgccaggcccugaugaccgagaagcggcaguucgaccuccgcgagaucuaccuggcgauccaccacaucgucaaguaccggggccacuuccuggacgagacgcccaccgacaaguucagcuucgaccagcucgaccugacccaggaguucgagcgccugaacguccucuucuccgagcagaacccggaggagcccuucgagaucguggugaaccagaaccagagcaucgaggacauccuguccaaccagagcaugaccgccuccgaccggcgcaagcaggcccuggugguguucuaccagcagagcgagaacaaggagaacgagaagcaguacaaggccaucgcgacggagauccucaaccugcugcucgggaacaaggccaagcugaacgucauccuggcccaggagguggacaaggaggccgccaaggacuggucccucagccuguccagcgagaccuucgacgacgaccuggagaaggcguccagcggccucaacgacagccagcuggagaugguggggaucuucgagcggaucuacuccagccugauccucaaguccaucaucggcgaccacaacagccuguccgccgccauggucgacaaguucaagacccacgcccagcaccgcgaccugcucaaggacgugaucaagaacagcgacgccaccaagggggagcagcugcaguucgcguacgaccacuaccugcagcgccacuccgccgacggcaaggccuacggcaaggacgacuucuacaaggaggugaagaagaaccucgacgacagcgacgccgcccagcagauccagcagcugaucgacacggaccaguucaugcccaagcagcggaccaaggcgaacggggccaucccccaccagguccagcagaaggagcuggaccucaucaucgagaaccagugccaguacuacccguggcuggccgaggagaaccccaacuccgagcgccacaacguggccaaguacaagcuggacgagcucgugagcuuccggguccccuacuacgugggcccccugaucuccccggccgacgacgagaccgacccccaggcgauccagaacaccaaguucgccuggaugauccgcaaggacgcccaggggcggaucacgcccuggaacuucgacgacaagguggaccgcgagaaguccgccgacaaguucaucaagcggaugaccaccaccgacacguaccugaucggcgaggacguccuccccgaccagagccugaucuaccagcgcuacaaggugcugaacgagcucaacaacgugcggaucaacggccgcccgaucgagguccagaucaagcagaacaucuacaccgaccuguucaagaaguucaagagcguguccgucaagaagcugcggagcuaccuggaggagauguccuacuaccccgggagcuucaagaucuccggccucaccaaccccgggaaguucgacaacggccugaccagcuaccuggacuacaagaacauccucggggacagcguggacgcgaacgacaagcgcgccgacaucgagcagaugaucgagugguccacgaucuucgaggacaacaagaucuucgcccagaagcuggagagcaugaccuggcugaccgccgagcagcggaaggccaucucccgcaagcgguacaccggcuggggccgccucagcaacaagcugcugacgcagcucaagaaccaggacaaccgguccaucauggaccugcugugggagaccgaggagaacuucaugaagauccagagcgcgcccgacuucuccaagaugaucgaggcccacaaccagcaguucaucaagaacgaggccaacauccagcaggucaucagcgaccucuacaccuccccgcagaacaagaaggccauccgccagauccugcuggugguggacgacauccagaaggccguggggcacgcgcccgagcacaucgccaucgaguucgccaagggcgaggacaagaacccccggcgcaccaucagccgcgagaugaagauccaggacgucuaccagcagaucuccgacgacauccucgugagccccgaggugcgggcccagcugaacgagaagaucgagaaccgccacgggcggcuguccgaccgccucuuccuguacuucaugcagggcgggcgggacauguacacgggcaagccgaucaacaucaacaacaucagccacuacgacaucgaccacauccugccccaggccuucaucaaggacgacucccucgacaaccgcguccuggugagcgacaagcugaaccgggagaaguccgacaccgugccccgcgaccucuucggccgggagaugaugagcaccugggagaagauggcggaccgcgggcugaucaccaagcggaagcuggccaaccucaagacgauccccggcagcaucgacgcccacaaggcccagggguucaucaaccgccagcuggucgagacccgccaggugaucaagcuggcggugggcaucaugaucgaccaguacccggagacccagaucgucuccgugaaggccaaccucacccacgagaugcgggagauguucgaccuggugaagaaccgggacgucaacgacuaccaccacgccuucgacgccuaccugaccgccuucguggggaacuaccuccugcagcgcuaccccaagcuggagcccuacuucguguacgacaaguucaagaagcucaaggaccagaacaucagcaugcgggacuucaaccugcuguacgaccucaagaagaacgaggacgucuacgaccagcgcacgggccacuccgcgcacaagaucugggaccagcacggcagcaucgacuacauccggcaccuguucgccuacaagaagauccuggugucccacgaggugcaccagaacgggggcgcccucuacaacaugaccgucuacgggaaggccgacgacgccaagcgcaagcugaucccgaucaaggcggacaagcccaccgagcuguacggcggcuacaccagccggaagcucgccuacauggccaucgugaagacgaagaaggggaagaaggagcaguaccaggugaccggcguccccguguccgcccugaccacccugcgccaguucaaggaggacagccccgagcagaagcaggcccucgaggagaucgugcgccggaacuucgacgagaagacggaggucgagaucaucgugccgaaggugcuguucaaccagcugaucgucgacgagaagugccgcuucauggugggguccgacaccuaccgguacaacgcgcagcagcucgugcugagcgccgacgaccuggagaucaucaacgccucccacaaggacauccagaccaucgacagcuccgacuacagccagcagcucgaccaggucuaccagaacauccugaccaucguggacaagcacuuccccauguacgacaucaacaaguuccgcacgaagcugcacgacaucuacgagcaguacaucgagcuccccaacgaggacgugugggagaacaacaagcugaccacccugggcaagcacaccaucaucauccggauccuccaggggcugcacgccaacgcgacggucguggaccugaagcagcucggcaucaagacccccuucggcuucaugcagcaggcccgcgggaucguggucuccccggacgcccagcugaucuaccagagccccaccggccuguacgagcggcgcgugcggcucggggaccuguga

SEQ ID NO: 1932 - RNA, 4101 nt, Artificial Sequence
  Cas9 variant
augggcgaccgcaaguacaaccuggggcucgacaucggcaccagcuccaucggguucgccgccguggacgagaacaaccagcccauccgggucaagggcaagaccgcgaucggggugcgccuguucgaggagggcaagacggccgccgaccggcgcggcuuccggaccacccgccggcgccugagccggcgccgguggcgcaucaaccuccugaacgggaucuucgacgcccaccuggccgagguggacccgaccuuccucgcgcggcugaaggaguccaaccgcagcaaccuggaccccaagaaguccuuccagggcagccuccuguuccccgagcggaaggacuaccaguucuacaaggaguaccccacgaucuaccaccuccgcaaggcccucauggaggaggaccggaaguucgacauccgcgagaucuaccuggccguccaccacaucaucaaguaccgggggaacuuccugaacggcaccccgaugcgcuccuucaagguggagaacaucgagcucgacacccuguucgaccggcugaaccagcucuacgaggagaucauccccgacaacgagcuggccuucgaccuggagcaggucgcggacgugaaggaggugcucagcuccaccacgaucuacaagauggacaagaagaagcagcuggugaagaugaugcugcuccccaccagcaacaaggcccugcaguccgagaacaagaagaucgucacccaguucgugaacgccauccugaacuacaaguucaagcucgacgugcugcugcaggucgagaccgacgccgacuggagccucaagcugaacgacgagggggccgacgacaagcuggaggaguucacgggcgaccucgacgagaaccgccuggagaucaucgaccugcuccagcgccugcacaacugguucucccugaacgagaucaccaaggacggcaacagccucuccgcggccaugguggagaaguacaaggaccaccggcaccaccuggagcugcucaagaaggugaucgaggaccaccccgacgccaagaaggccaaggcccugaaggagaccuacaccgcguacgucgggaagacggacgacaagacccagaaccaggacgacuucuacaaggccguggagaagaaccuggacgacagcccggacgccaaggagaucaagcgccucauccagcuggaccaguucaugcccaagcagcggaccggccagaacggggccaucccccaccagcugcaccagcaggagcucgaccagaucaucgagaagcaguccaaguacuaccccuuccuggccgagccgaaccccaacgugaagcgccggaaggacgcgcccuacaagcuggacgagcugaucgccuucaagauccccuacuacgucggcccgcucgugacccccgaggagcaggcccagaacggcgagaacguguucgccuggaugaagcgcaaggucgccgggcccaucacgcccuggaacuucgacaagaagguggaccggauggagagcgcgaaccgcuucauccggcgcaugaccaccaaggacaccuaccuguucggcgaggacgugcugccggccgaguccaugaucuacgagaaguucgucgugcucaacgagcugaacaaccugaagaucaacgggcggcaccucagccugaaggacaagcaggacaucuacaacgaccuguucaagcagcagaagacggucagcaucaaggcccuccagaacuacuacgugaccaagaagaaggccgcgaccgcccccaccgugggcgggcuggccgaccccaagaaguuccuguccagccucuccacguacaucgacuucaagaacauguucggcgagcaggucaacgacccccaguuccaggaggaccuggagcagaucguggaguggagcaccaucuucgaggaccgcggcaucuucaaggccaagcugcaggcccucggguggcuguccgagaagcagauccagcagcugguggcgaagcgguacaagggcugggggcgccucagcaagaagcugcugaccggccucaagaacgccgagggguacuccauccuggacgagauguggcggagcaccgagaacuucaugcagauccagucccgcccggaguucgccgcccugauccagcaggccaacgagaagcaguucgagggcaacgaccccaacaacgucugggagaacaucgagaacauccucggcgacgcguacacgagcccccagaacaagaaggccauccgccagguggugaaggucgugcaggacaucgagaaggccguggggaacccgcccgagaagaucgccaucgaguucacccgggaggccgcggccaacccccagcggacccagucccgccugcgcacccuggagaagcucuacgagagcgccgaggaggucguggacgcccggcugacggcggagcuggccgaguucaaggagaacaagcacgugcucuccgacaaguacuaccuguacuucacccagcugggccgcgacgucuacaccggggacaccaucagccucgaccggcugaacgacuacgacguggaccacauccugccccaguccuucaucaaggacgacagccucgacaaccgcgugcugaccauccgggccgucaacaacggcaaguccgacaacgugccggccaagauguucgggaagaagaugggcagcuucuggcgcuaccugcucgacaacggcaugaucuccaagcggaaguacaacaaccugaucacggaccccgacaacaucagcaaguacgcccagaagggguucaucaaccgccagcugguggagaccagccaggucaucaagcucaccgcgaacauccugaacggcaucuacgacaaggacaccgagaucaucgaggugcccgccaagaugaacucccagaugcggaagauguucgaccuggugaagguccgcgaggugaacgacuaccaccacgccuucgacgccuaccucacgaucuucaucgggaacuaccuguacaagugcuaccccaagcugcggccguacuucguguacggcaaguucaagaaguucagcgacaacgaggacaucgaggucggcgacgggcgcuucaacuuccucaaccggaucgagcgccugaagaacgugaccgaccccgagaccggcgagauccugugguccaacguggcccccaacgagaccaucaagcggaucaagaaggucuacaacuacaaguucaugaucgugagccgcgagaucacgacccggcgcgcggagcuguucaaccagaccguguaccccaagaacuaccgggggaagcugaucccgaucaaggaggaccgccccaccgaccuguacggcggguacuccggcaacacggacgccuaccucgccaucgucgcccuggaggacaagaagaagggcaaguacuucaaggugguggggauccccacccgggccgcggccaagcuggagaagcucaagcagcaggacagccagcaguaccugcaggccguccacgaggugaucgcgccccaguucaccaaguccaccaagaagggcaucaagaagacggaguuccgcaucgugcuggacaagguccacuaccgccagcucgugcaggacgggccggugaagaugaugcugggcagcuccaccuacaaguacaacgccaagcagcugguccucagcgagaaggcccuccaggugaucaaggacgaccggaaguucgacgagacccagaaggacgacaaccugaucgccguguacgacgagauccuguccaucgucaaccagagcuucgaccuguacgacaucaacggguuccgcaagaagcugaacgacaaccggaaccaguucaucgaccuccccgccgagaccaaguacgagggccgcaaggugguggcccacggcaagcgggagaugauccuggagauccugaaggggcuccacgcgaacgccuccuucggcaaccugaagcccaucggguucgccacgcccuucggccagaugcagagcaagaacgggaucgagcuguccgagaacgccuuccucauccaccagagcccguccggccuguucgagcacaagaucaagcugagcgaccucuga

SEQ ID NO: 1933 - RNA, 4101 nt, Artificial Sequence
  Cas9 variant
augaccaagcugggcaagcccuacgggaucggcguggacaucgggagcaacuccaucggcuucgccgccgucgacgagaacagccaccucauccgccugaaggggaagaccgugaucggcgcgcggcuguucgaggagggcaaggccgccgccuaccgccgggccucccgcacgacccggcgccggcucagccgcaaccgguggcgccuguccuuccugcgggacuucuucgagagccacaucaccccgaccgaccccaacuucuucaugcgccagaaguacuccgagaucagccccaaggacaaggcgcgguacaaguacgagaagcgccucuucaacgaccggacggacgccgaguucuaccagcaguaccccaccauguaccaccuccgcacccggcugcucaccgacccguccaaggccgacgugcgcgagaucuacuucgccauccaccacauccucaagagccgggggcacuuccugacgcccggcuacgcgaaggacuucaacaccaacaaggucgcccugaacgagaucuuccccgcccugcaggacgccuacgcccagguguaccccgaccuggacaucaccuucgacgagaacaaggugaacgaguucaagaccguccuccugaacgagaaggcgacgccguccgacacccagcgcgcccuggugaaccuccugcuggccaaggagggggaccgggacauccucaagcagcagaagcagguccugaccgaguucgccaaggccguggugggccugaagaccaagcucaacguggcgcuggggacggaggucgacagcuccgaggccaccgccuggaacuucagccugggccagcucgacgacaagugggccggcaucgaguccgccaugaccgacgaggggaccgagauccuggaccagauccgcgaccuguaccgcgcgcggcuccugaacggcaucgugcccgccgggaagacgcugagccaggccaagguggacgacuacgcccagcaccacgaggaccucgagcuguucaaggacuaccugaagcagcucgaggacgacggcaccgccaaggcgauccgccagcuguacgaccgguacaucgacggcgacgacgccaagcccuucguccgcgaggacuucgugaaggcccugaccaaggaggugaccgcccaccccaacgcgaaguccccggagcuccuggagcggcuggcccagcccgacuucaugcucaagcagcgcaacaaggccaacggggccauccccguccagaugcagcagcgggagcuggaccagaucaucaagaaccaggccguguacuacgacuggcuggcggcccccaacccgguggagaagcaccgccagagcaugacguaccagcucgacgagcugcugaacuuccggauccccuacuacgucggcccccucgugaccgccaaggagcagaaggccgcccagggcgggguguucgcguggaugguccgcaaggaccccgacgggaacaucaccccguacaacuucgacgagaagguggaccgggaggccuccgccaacaccuucauccagcgcaugaagacgaccgacaccuaccugaucggcgaggacguccugcccaagcagagccugcucuaccagagcuacgaggugcugaacgagcugaacaacgugcgggucaacgacaacaagcucuccuucgaccagaagcagcagguccugggcgagcuguucgagcgccacaacaccgugacgaucaagcaguucguggacaaccuccuggcccacggggacuacgaccggauccccgaggugcgcggccuggccgacgagaagcgguuccucagcucccugagcaccuacaaccagcugaaggggauccuccacgaggcgaucgacgacgccgacaagcagaccgacaucgagaacaucaucgccugguccaccaucuucgaggacaaggccaucuucaagacgaagcugaacgagaucagcuggcugaacgcgggcaugaucaacucccucgccaacauccgcuaccggggguggggccaguucagccacaagcugcugaacgagcucacccuguccaccggccgcaccguguucgaggagcugcucaucagcucccgcaaccugaugcagauccugaccgacgagguccucaagcagaagaucgccgagcugaacgcccacgagcugaaggccagcgggaucuacgcggccaucgacgacgccuacacgucccccagcaacaagaaggcccuccgccaggugcuguccgugaucgacgacaucaccaacgccgcgggccaggccccgaacuggcuguacaucgagaccgccgacggggacggcguccccgggaagcggaccaacagccggcagcgcaagauccaggagaucuacgccaacgccgcgcaggagcucaucacgggcuccgugcggggcgaguucgaggacaagaucgccagccgcgccgacuucaccgaccggcuggugcuguacuucaugcagggcgggcgcgacaucuacaccggggagccccucaacaucgacaaccuguccagcuacgacaucgaccacauccugccccagagccucaucaaggacaacucccuggacaaccggguccuggugcacccgcucgugaaccgcgagaaggacaccaucuucgccagcacgcgguucgcgaagcagaugaacggcauguggcgccaguggcacgccgccggccugaucuccagccggaagcugcgcaaccuccagaugcggcccgacgagaucgacaaguacgccuccggguucgucgcccgccagcugguggagacccggcagaucaucaagcugaccgagcagaucguggcggaccaguaccccgacaccaagaucaucgccgucaaggccggccucagcucccagcugcgcaaggagcuggacuucccgaagaaccgggaggugaaccacuaccaccacgccuucgacgccuuccucgcggcccgcaucgggacguaccugcugaagcgguaccccaaccucgagcccuucuucaccuacggcaaguucaagaagaccgaggugaagaagcucaagagccugaagucccucaagagcuucaacuucauccgcgacaugacccacgccaaggacaagaucgucgccaaggagacgggggagaucgugugggacaacgccuccgacaucaacgagcuggaccgcaucuacaacuucaagcggaugcugaucacccacgaggugcgcuucgagaccgcgagccuguucaagcagacccuguacgccgccaagaacuccaagaaccggggcggcagccgccagcugauccccaagaagaagggguaccucgucgacaucuacggcggguacacgcaggagaccggcuccuaccugagcguggugcggcugaccaagaaggccauguacgccgucgugaagguguccacccgcgacgcggccaagcucgccgucgccaagagcaucagcgagcagaaggagaacgagacgcugaagaagaucaucgacgggaagcuguccaagaccagcaagaagggcaagaccacccaccagcuguucgagaucgugcugccgcgggugggccagaagacgcuguucaagaacuccaaguacaaccaguuccucgucaacagcgacaccuacaugcacaacuaccaggagcuguggaugccccgcgaguaccagcggauguggaaggacauccugcucuccaaccacggggacgcgcagaucgagggccagcuggaccagaucuucaaguucaucgugagccaggugaacuccuacuucaaccuguacgacaucaaccaguuccgcaagaagaucgccgacgccaccgacaaguucgccaagcuccccacccacgacacggacaacgcccgggggaagaucgcgaccaucggccagcugcugaucgggcuccaggccaacgccaugcgcagcgaccugcggaaccuggacaucaagacccccuucggccuccugcagaucggcaccgggaucacgcuggaccucgacaccuccaucaucuaccagagcccgaccggccuguucgagcgcgaggucccccugaccgaccucuga

SEQ ID NO: 1934 - RNA, 4101 nt, Artificial Sequence
  Cas9 variant
augaccaaggacuacagccugggccucgacaucgggaccggcuccgugggguucgccgcccuggacacgaacuaccgccugcuccgggcgaagggcaacaacgucaucggggugcgccuguucacccccgccgagaccgccgaggagcggcgcggcuuccggaccgcccgccggcgccugagccggcgccgguggcgccucggcgcccugaacgggaucuucgcgccggagcuggccaagguggaccccaacuuccuccaccggcugaaguacgccuggguccaccccgccgaccagcagaacaagggcaaguacuccgcggcgccccuguucaacgacgccgcccucgaccgccaguuccacgacgacuacccgacgaucuaccaccuccggcugaagcugaugaccgacaccagccagcacgaccugcgcgagguguaccuggccauccaccacaucaucaaguuccgggggaacuuccuccgcggcgaggggcccaucaacgccuccgaggccuucgacaucaacaccuucaucgaccagaugacggccuucuacgaccaggccuuccccgacuucaagaucguggaccaggucgaccagcagaucaucuucaagggccugaccgacaugacccugagccccgccgaccgggcgaacaaggcccucaugggcuucaacaacgccgcccagcagccgaacaagcgcaucuucaaggccauccuguccgggcuggugggcaaccagguggaccucauggcgaucuuccagcuggacgggauccccaaggaggaccagaaggaguucaaguucaaguucgucgacaacgacaucgaggagaagcuggccgcccucggcgacaaccccgcccugagcgacgagcagaacgaguuccugaccacgcucuacgccgcguucuccggccugacccugaaggggcuccugggcgacgccaccagcaucuccgccgccaugguggcgcgguacgccagccaccgcaccgacuggacguacaucaaggaccacgugcugacgccccagaacaaccgcgagcuccggcuggccuacgccgaccugaugaccgacaacgaggacguccgccucaaggccgggaagaaguucgcgaaggccaucgaggccgccgacaucccggccgcgaagaaguccgaguucagccugaagaucgacaacaacgaguuccugccccggcagcgcaccaaggccaacggcaccaucccccaccagcuccaccugaacgagcugcagcagaucaucgagaaccaggggcaguacuaccccuuccucaaggccaccuucgagcaggacggccacacccugaacaagaucgagggccuggugaaguuccgggugccguacuacgucgggccccucgugcccaagcacaagguggccggcaacaacgccaaccacuggaugguccccaaggagccgggggcgaucacccccuggaacuacacggagaagguggaccgcgacaaguccggcaacgaguucauccggcgcaugaccgggaccgacaccuaccugcugggcgagcccacgcugcccaagaacagccucguguaccaggaguucaacguccugcaggagcugaacaaccuccggaucgagaagcgccggcuggacaucgccgugaagcaggacaucuucgagcacguguucaagaccaacaagaccgucaccgugaagcgcaucgaggaguaccugacgaccgaguucggcuccccggucacccucagcggguucgccaacgugaacgagcggaagcugaacuccagccugagcaccuaccacuacuucgugggcaucuucggggccgaguucgucgacgaccccaagaaccucacgcugcuggagcagaucguggagcuccagaccguguucgaggaccgcaaggcgcugcagcggcagcugaagcuccgccccgagcuguccgagaagcaggucaagcagcuggcccggacccacuacaccggcugggggcgccucagccagaagcugcugaccuccaagaucgugcacguggcccucgagggcgagcgggagcccggccaguacagcauccuggagacgcuguacgggacccagaugaacuucauggagaucgucaacgacaugaaggaccgcuacggcgugaaguccuggcucgaccaggagaacagcggguccgagaacaaccugagccugaagcagcgcauccucgacaugccgggccccaagaacaucaagcggggcaucaaccaggccuuccacaucaucgacgagaucacccgcgccguggggaacgcgcccucccggaucuacaucgaguucgcccgcgagagccagcaguccaaccugaccaacgcccgggucaaccgccugaagcagcucuacagcaaccaggcccugaagaaggaguucgccaagcuggcguccgagaucaaggaccucacgaaggagcagcugaaggacgaccggcuguaccucuacuaccugcagcagggcaaggacauguacaccgagaccgacaucgacaucaccaagaucagcuccaacuaccagaucgaccacaucaucccgcaggccuacacgaagaacaacagccuggacaaccgcgugcucgugaacuccgagaugaacgcccgcaagagcgacucccccaccuuccugcccagccugauccaggagcggaaggccugguggcggcagcuccgcgacaccgggcugaugagcaccaucaaguacaacaaccugacgcggaccuccgacgacuucagcgccgaccagaaggagcgcuucaucgcgcggucccucgucgagacccgccaggugaucaagaacguggccacccugaucaaggaguacuacgacgacagccaggucgaggcccugcccuccgagaucacggccgagaugcggcgcuaccucaacgugcggaagaaccgcgacaucaacgacuaccaccacgcgcacgacgcccugcuguucgccaccgccggcgaguucagccggaagguggggaucauggagaagggccgcgucuccgacggcgccgggaacaucuacaaccgcuacaccaaggacaucauccagcgggcgcgcgccaaggccggccaggacaagaaggugcggccguucaccuucaucguggggagcauggccaaccccgacacgaaguuccagaccaaccagaccaccggcgagaucgucuggacgcccgaggacguggccuaccuccgcaaggugaucgacuacaagaagaugcuggucaccaagaugacccuggaccagaccgggacgcucuacaacgagacccgguacggcuccggcgacaagcacguggcgguggcccugagcaaggacaaggccgccgaccuguacgggggcuucgggucccucaagcccgccuacgcggcccuggucuacagcaagaagaaguuccgccuggugaacgugcuccggcuguggcugccggagaucaagaagaacgccuccguccucgagcgcaaggugcagagcgugcugggcgacgacaacgccaaggucauccgggcccacgugcccugcgggcagcugcucaucaaggacggcgcgcuggugaccgucuccagcgccaccgagcugcacaacuuccgccagcucuggcugcccaaggccgacuaccaggacaucuccauccugcucggcgcccccgacaaggugacggcggagaaccggcugcaggccgagagccacuucgacgacguggaccagcgcuucgagagccugcucaaggacgucaucgaccaggcccggcaguacuacccgcugaagacccaccagaccucccuggagaagcucaucgggaagaucggcaaguucgacgagcugaaguucgcccagaagcagcaggucuucagccgccugcucuccgcccugcacgcgaacgccaccaacagcgaccugaagcagaucgggcucuccacggccuggggccggcugaucuaccccaagggggugagccugaccgacgaggacaagcucaucaacuccagcuucaccggccuguucaacgacgugauguccaucaaggaguuccacgacuucagcaucaacuga

SEQ ID NO: 1935 - RNA, 4104 nt, Artificial Sequence
  Cas9 variant
augaagaagcagaaguucagcgacuacuaccugggcuucgacaucgggaccaacuccgugggcuggugcaucaccgaccucgacuacaacguccugcgcuucaacaagaaggacaugugggggagccggcuguucgaggaggccaagacggccgcggagcgccgggugcagcgcaacucccggcgccggcucaagcgccggaaguggcgccugaaccugcucgaggagaucuucagcaacgagauccugaagaucgacuccaacuucuuccggcgccugaaggagagcucccucuggcuggaggacaagagcuccaaggagaaguucacccuguucaacgacgacaacuacaaggacuacgacuucuacaagcaguaccccaccaucuuccaccuccggaacgagcugaucaagaacccggagaagaaggacauccgccugguguaccucgccauccacagcaucuucaagucccggggccacuuccuguucgaggggcagaaccugaaggagaucaagaacuucgagacccucuacaacaaccugaucgccuuccuggaggacaacggcaucaacaagaucaucgacaagaacaacaucgagaagcucgagaagaucgucugcgacagcaagaagggccugaaggacaaggagaaggaguucaaggagaucuucaacuccgacaagcagcugguggccaucuucaagcucagcgugggguccagcgucucccugaacgaccuguucgacacggacgaguacaagaagggcgagguggagaaggagaagaucagcuuccgcgagcagaucuacgaggacgacaagcccaucuacuacuccauccucggggagaagaucgagcugcuggacaucgccaagagcuucuacgacuucauggugcucaacaacauccuggcggacagccaguacaucuccgaggccaaggucaagcuguacgaggagcacaagaaggaccucaagaaccugaaguacaucauccggaaguacaacaagggcaacuacgacaagcuguucaaggacaagaacgagaacaacuacagcgccuacaucgggcucaacaaggagaagggcaagaaggaggugguggagaagucccgccugaagaucgacgaccugaucaaggucaucaagggcuaccuccccaagcccgagcggaucgaggagaaggacaagaccguguucaacgagauccugagcaagaucgagcugaagaccauccucccgaagcagcgcaucuccgacaacgggacccugcccuaccagauccacgagguggagcuggagaagauccucgagaaccagagcaaguacuacgacuuccugaacuacgaggagaacggcgucuccacgaaggacaagcugcucaagaccuucaaguuccggauccccuacuacguggggccccugaacagcuaccacaaggacaagggcggcaacuccuggaucgugcgcaaggaggaggggaagauccugccguggaacuucgagcagaaggucgacaucgagaaguccgccgaggaguucaucaagcgcaugaccaacaagugcaccuaccugaacggcgaggacgugauccccaaggacacguuccucuacagcgaguacgugauccugaacgagcugaacaagguccaggugaacgacgaguuccucaacgaggagaacaagcggaagaucaucgacgagcuguucaaggagaacaagaaggugagcgagaagaaguucaaggaguaccugcucgucaagcagaucguggacgggaccaucgagcugaagggcgucaaggacuccuucaacagcaacuacaucuccuacauccgcuucaaggacaucuucggggagaagcugaaccucgacaucuacaaggagaucagcgagaaguccauccuguggaagugccuguacggcgacgacaagaagaucuucgagaagaagaucaagaacgaguacggcgacauccucaccaaggacgagaucaagaagaucaacaccuucaaguucaacaacugggggcggcugagcgagaagcugcucacgggcaucgaguucaucaaccuggagaccggggagugcuacuccagcgugauggacgcgcugcgccggaccaacuacaaccucauggagcugcugagcuccaaguucacccuccaggagagcaucaacaacgagaacaaggagaugaacgaggccuccuaccgcgaccugaucgaggagagcuacgugucccccagccugaagcgggccaucuuccagacgcucaagaucuacgaggagauccgcaagaucaccggccggguccccaagaagguguucaucgagauggcccgcgggggcgacgaguccaugaagaacaagaagaucccggcccggcaggagcagcugaagaagcuguacgacagcugcggcaacgacaucgcgaacuucuccaucgacaucaaggagaugaagaacagccucaucuccuacgacaacaacagccugcgccagaagaagcuguaccucuacuaccugcaguucgggaagugcauguacaccggccgggagaucgaccuggaccgccuccugcagaacaacgacaccuacgacaucgaccacaucuacccccgguccaaggugaucaaggacgacagcuucgacaaccugguccucgugcugaagaacgagaacgccgagaaguccaacgaguaccccgugaagaaggagauccaggagaagaugaaguccuucuggcgcuuccugaaggagaagaacuucaucagcgacgagaaguacaagcggcucacggggaaggacgacuucgagcugcgcggcuucauggcccggcagcuggucaacgugcgccagaccaccaaggagguggggaagauccuccagcagaucgagcccgagaucaagaucgucuacagcaaggccgagaucgccagcuccuuccgcgagauguucgacuucaucaaggugcgggagcugaacgacacccaccacgcgaaggacgccuaccugaacaucguggccggcaacgucuacaacacgaaguucaccgagaagccguaccgcuaccuccaggagaucaaggagaacuacgacgugaagaagaucuacaacuacgacaucaagaacgccugggacaaggagaacagccuggagaucgugaagaagaacauggagaagaacaccgucaacaucacccgguucaucaaggaggagaagggccagcuguucgaccucaaccccaucaagaagggggagacguccaacgagaucaucagcaucaagcccaagguguacaacggcaaggacgacaagcugaacgagaaguacggguacuacaagucccugaaccccgccuacuuccucuacguggagcacaaggagaagaacaagcgcaucaagagcuucgagcgggucaaccugguggacgugaacaacaucaaggacgagaagucccuggucaaguaccucaucgagaacaagaagcugguggagccgcgcgugaucaagaaggucuacaagcgccaggugauccugaucaaccacuaccccuacagcaucgugacccucgacuccaacaagcugauggacuucgagaaccugaagccccucuuccuggagaacaaguacgagaagauccugaagaacgucaucaaguuccucgaggacaaccagggcaagagcgaggagaacuacaaguucaucuaccugaagaagaaggaccgguacgagaagaacgagacccuggaguccgugaaggaccgguacaaccucgaguucaacgagauguacgacaaguuccuggagaagcuggacagcaaggacuacaagaacuacaugaacaacaagaaguaccaggagcuccuggacgugaaggagaaguucaucaagcugaaccucuucgacaaggcguucacccugaaguccuuccuggaccucuucaaccgcaagacgauggccgacuucagcaaggucggccugaccaaguaccuggggaagauccagaagaucuccagcaacgugcucuccaagaacgagcuguaccugcucgaggagagcgugaccggccuguucgucaagaagaucaagcuguga

SEQ ID NO: 1936 - RNA, 4104 nt, Artificial Sequence
  Cas9 variant
augaagaagcagaaguucagcgacuacuaccugggcuucgacaucgggaccaacuccgugggcuggugcgucaccgaccucgacuacaacgugcugcgcuucaacaagaaggacaugugggggagccggcuguucgacgaggccaagacggccgcggagcgccgggugcagcgcaacucccggcgccggcucaagcgccggaaguggcgccugaaccugcucgaggagaucuucagcgacgagaucaugaagaucgacuccaacuucuuccggcgccugaaggagagcucccuguggcucgaggacaagaacagcaaggagaaguucacccuguucaacgacgacaacuacaaggacuacgacuucuacaagcaguaccccaccaucuuccaccuccgggacgagcucaucaagaacccggagaagaaggacauccgccugaucuaccuggcccuccacuccaucuucaagagccggggccacuuccuguucgaggggcagaaccugaaggagaucaagaacuucgagacccucuacaacaaccugaucuccuuccuggaggacaacggcaucaacaagagcaucgacaaggacaacaucaagaagcucgagaagaucaucugcgacuccggcaaggggcugaaggacaaggagaaggaguucaaggagaucuucaacagcgacaagcagcuggucgccaucuucaagcucuccgugggcagcuccgugagccugaacgaccuguucgacacggacgaguacaagaaggaggaggucgagaaggagaagaucuccuuccgcgagcagaucuacgaggacgacaagcccaucuacuacagcauccucggggagaagaucgagcugcuggacaucgccaagagcuucuacgacuucauggugcucaacaacauccuguccgacagcaacuacaucuccgaggccaaggugaagcuguacgaggagcacaagaaggaccucaagaaccugaaguacaucauccggaaguacaacaaggagaacuacgacaagcuguucaaggacaagaacgagaacaacuaccccgcguacaucggccucaacaaggagaaggggaagaaggaggucguggagaaguccggccugaagaucgacgaccugaucaaggugaucaagggcuaccuccccaagccggagcgcaucgaggagaaggacaagaccaucuucaacgagauccugaacaagaucgagcugaagaccauccuccccaagcagcggaucagcgacaacgggacccugcccuaccagauccacgaggucgagcuggagaagauccucgagaaccagagcaaguacuacgacuuccugaacuacgaggagaacggcguguccacgaaggacaagcugcucaagaccuucaaguuccgcauccccuacuacguggggccgcugaacagcuaccacaaggacaagggcggcaacuccuggaucguccggaaggaggaggggaagauccugcccuggaacuucgagcagaagguggacaucgagaaguccgccgaggaguucaucaagcgcaugaccaacaagugcaccuaccugaacggcgaggacgugauccccaaggacagcuuccucuacagcgaguacaucauccugaacgagcugaacaagguccaggugaacgacgaguuccucaacgaggagaacaagcgcaagaucaucgacgagcuguucaaggagaacaagaagguguccgagaagaaguucaaggaguaccugcucgucaaccagaucgccaaccggacgguggagcugaaggggaucaaggacagcuucaacuccaacuacgugagcuacaucaaguucaaggacaucuucggcgagaagcugaaccucgacaucuacaaggagaucuccgagaaguccauccuguggaagugccuguacggggacgacaagaagaucuucgagaagaagaucaagaacgaguacggcgacauccucaacaaggacgagaucaagaagaucaacagcuucaaguucaacaccuggggccgccugagcgagaagcugcucaccgggaucgaguucaucaaccuggagaccggcgagugcuacagcuccgucauggaggcccugcggcgcacgaacuacaaccucauggagcugcugagcuccaaguucacccuccaggagagcaucgacaacgggaacaaggagaugaacgagguguccuaccgggaccugaucgaggagagcuacgucucccccagccugaagcgcgcgauccuccagacccugaagaucuacgaggagaucaagaagaucaccggccgggugccgaagaagguguucaucgagauggcccgcgggggcgacgagacgaugaagaacaagaagauccccgcccggcaggagcagcugaagaagcucuacgacuccugcggcaacgacaucgccaacuucagcaucgacaucaagaagaugaaguccagccuguccagcuacgacaacaacucccugcgccagaagaagcucuaccuguacuaccugcaguucgggaagugcauguacaccggccgggagaucgaccucgaccgccugcugcagaacaacgacaccuacgacaucgaccacaucuacccccggagcaaggucaucaaggacgacuccuucgacaaccucgugcuggugcugaagaacgagaacgccgagaaguccaacgaguaccccgucaagaaggagauccaggagaagaugaaguccuucuggcgcuuccucaaggagaagaacuucaucagcgacgagaaguacaagcggcugaccgggaaggacgacuucgagcugcgcggcuucauggcgcggcagcucgugaacgugcgccagacgaccaaggaggucgggaagauccugcagcagaucgagccggagaucaagaucguguacagcaaggccgagaucgccagcagcuuccgggagauguucgacuucaucaaggugcgcgagcugaacgacacccaccacgccaaggacgccuaccucaacaucgucgcgggcaacguguacaacaccaaguucacggagaagcccuaccgcuaccugcaggagaucaaggagaacuacgacgugaagaagaucuacaacuacgacaucaagaacgccugggacaaggagaacucccuggagaucgucaagaagaacaugaagaagaacaccgugaacaucacccgguucaucaaggaggagaagggccagcuguucgaccugaaccccaucaagaagggggagaccagcaacgagaucaucuccaucaagcccaagcuguacaacggcaaggaggagaagcucaacgagaaguacggguacuacaagagccugaacccggccuacuuccuguacguggagcacaaggagaagaacaagcgcaucaaguccuucgagcgggucaaccucguggacgugaacaacaucaaggacgagaagucccuggucaaguaccugaucgagaacaagaagcucguggagccccgccugaucaagaagguguacaagcggcaggucauccugaucaacgacuaccccuacagcaucguggcccucgacagcaacaagcugauggacuucgagaaccugaagccccucuuccuggagaacaaguacgagaagauccugaagaacgugaucaaguuccucgaggacaaccagggcaaguccgaggagaacuacaaguucaucuaccugaagaagaaggaccgcuacgagaagaacgagacgcuggagagcgucaaggaccgguacaaccucgaguucaacgagauguacgacaaguuccuggagaagcuggacuccaaggacuacaagaacuacaucaacaacaagaaguacaagaaccuccuggacgugaaggagaaguucaucaagcugaaccucuucgacaaggccuucacccucaagagcuuccuggaccuguucaaccgcaagaccauggcggacuucuccaaggugggccugaccaaguaccuggggaagauccagaagaucagcuccaacguccucagcaagaacgagcuguaccugcucgaggagagcgugacgggccuguucgugaagaagaucaagcuguga

SEQ ID NO: 1937 - RNA, 4104 nt, Artificial Sequence
  Cas9 variant
augaagaagcagcaguucagcgacuacuaccugggcuucgacaucgggaccaacuccgugggcuggugcgucaccgacuucaacuacaacgugcuccgcuucaacaagaaggacaugugggggagccggcuguucgacgaggccaagacggccgcggagcgccgggugcagcgcaacucccggcgccggcugaagcgccggaaguggcgccucaaccugcuggaggagaucuucagcgacgagauccucaagaucgacuccaacuucuuccggcgccugaaggagagcucccuguggcucgaggacaagagcuccaaggagaaguucacccuguucaacgacgacaacuacaaggacuacgacuucuacaagcaguaccccaccaucuuccaccuccggaacgagcugaucaagaacccggagaagaaggacauccgccuggucuaccuggcccuccacagcaucuucaagucccggggccacuuccuguucgaggggcagaaccugaaggacaucaagaacuucgagacccucuacaacaaccugauggccuuccuggaggacaacgacaucuacaagaacaucgacagcuccuacaucggcaaccucgagaacaucaucugcgacagcaagaagggccugaaggacaaggagaaggaguucaaggagaucuucaacuccgacaagcagcuggugggguucuucaagcucagcgugggcuccagcgucucccugaacgaccuguucgacacggacgaguacaagaagggggagguggagaaggagaagaucagcuuccgcgagcagaucuacgaggacgacaagcccaucuacuacagcauccucggcgagaagaucgaguuccuggacaucgccaaguccuucuacgacuucauggugcugaacaacauccucgccgacagccaguacaucuccgaggcgaaggucaagcuguacgacgagcacaagcgggaccugaagaaccucaaguacaucauccgcaaguacaacaaggagaacuacgacaagcuguucaaggacaagaacgagagcaacuacuccgccuacaucgggcugaacaaggagaagggcaagaaggaggugaucgagaagucccggcucaagaucgacgacuucgccaagaucaucaagggcuaccugcccaaggccgagaagaucgacgagaaggaccgcagcaucuucaacgagauccuggacaagaucgagcucaagaccauccugcccaagcagcggaucagcgacaacgggacccugccguaccagauccacgaggcggagcucgagaagauccuggagaaccaggccaaguacuacgacuuccugaaccacgaggagaacggcaucuccaccaaggacaagcuccugaugacguucaaguuccgcauccccuacuacguggggccccugaacagcuaccacaagaacaagggcggcaacuccuggaucguccgcaaggaggaggggaagauccuccccuggaacuucgagcagaagguggacaucgagaaguccgccgaggaguucaucaagcggaugaccaacaagugcaccuaccugaacggcgaggacgugaucccgaaggacagcuuccuguacagcgaguacaucauccugaacgagcucaacaagguccaggugaacgacgaguuccugaacaaggagaucaagaagaagaucaucgaggaccuguucaagaaguccaagaagaucagcgagaagaacuuccgcgaguaccuccuggugaaccagaucaccaacaagacggucgagcugaagggggugaaggacgccuucaacuccaacuacgugagcuacaucaaguucaaggacaucuucggcgacaagcucaaccuggacaucuacaaggagaucuccgagaaguccauccuguggaagugccucuacggggacgacaagaagaucuucgagaagaagaucaagagcgucuacggcgacauccugaccaaggacgagaucaagaagaucaacagcuucaaguucaacaccuggggccggcugagcgagaagcuccugaccgagaucgaguucaucgaccuggagacgggggagugcuacuccagcgugauggacgcccuccgccggaccaacuacaaccugauggagcugcucuccagcaaguucacccugcaggagaacaucgacaacgagaacaaggagguguccgaguucagcuaccgcgaccuggucgaggaguccuacgugagccccucccucaagcgggcgauccugcagacccugaagaucuacgaggagauccgcaagaucacgggccggauccccaagaaggucuucaucgagauggcccgcgggggcgacgagaccaugaagaacaagaagauccccgcccggcaggagcagcucaagaagcuguacgacagcugcgggaaggacaucuccaacuucagcaucgacaucaaggagaugaagaacucccugaacagcuacgacaacaacucccuccgccagaagaagcuguaccuguacuaccuccaguucggcaagugcauguacaccggcaaggagaucgaccugaaccggcugcuccagaacaacgacaccuacgacaucgaccacaucuacccgcgcagcaaggugaucaaggacgacagcuucgacaaccuggugcugguccucaagaacgagaacgccgagaaguccaacgaguacccccugaagaaggagauccaggagaagaugaaguccuucuggaaguuccugaaggagaagaacuucaucagcgacgagaaguacaagcggcucacggggaaggacgaguucgagcugcgcggcuucauggcccggcagcuggugaacgugcgccagaccaccaaggaggcggggaagauccuccagcagaucgagcccgagaucaagaucgucuacagcaaggccgagaucgccuccagcuuccgggagauguucgacuucaucaaggugcgcgagcugaacgacacccaccacgccaaggacgccuaccugaacaucguggcgggcaacgucuacaacacgaaguucaccgagaagcccuaccgcuaccuccaggagaucaaggagaacuacgacgugaagaagaucuacaacuacgacaucaagaacgccugggacaaggagaagucccuggagaucgugaagaagaacauggagaagaacaccgucaacaucacccgguucaucaaggaggagaaggggcagcuguucgaccucaacccgauccgcaagggcgagacgagcaacgagaucaucgccaucaagcccaaguucuacgagggcuccaccgagaagcugaacgagaaguacggguacuacaagagccugaaccccgccuacuucaucuacguggagcacaaggagaagaacaagaucauccgguccuucgagcgcgugaaccucgucgacgugaacaagaucaaggacgagaagucccugaucaaguaccugaucgagaacaagggccucaucgagcccaaggugaucaagaaggucuacaagcgccaggugauccugaucaacaacuucccguacagcaucguggcccuggacagcaacaagcucauggacuucgagaaccugaagccccuguuccucgagcggaaguacgagaagauccugaagaacgcgaucaaguuccuggaggacaaccaggggaagaccgaggaguacuacaaguuccucuaccugaagaagaaggaccggaacgagaagaacgagaccaucgacuccgucaaggagcgcuacaacaucgaguucaacgagauguacgacaaguuccuggagaagcucgacagcaaggacuacaagaacuacaucaacaacaagaaguacuccgagcuggugaacgugaaggagaaguucaucaagcugaaccucuucgacaaggccuucacgcucaagagcuuccuggaccuguucaaccggaagaccauggccgacuucuccaaggucggccugaccaaguaccugggcaagauccagaagaucagcagcaacgugcucuccaagaacgagcugcaccuccuggaggagagcgugaccgggcuguucgucaagaagaucaagcuguga

SEQ ID NO: 1938 - RNA, 4104 nt, Artificial Sequence
  Cas9 variant
augaaggacuacuaccugggccucgacauggggagcuccagcgugggcugggcccuguccgacgagcgcuacaaccugcuccgggccaaggggaaggaccuguggggcguccgccuguucgacgaggcgaagaccgccgccgagcggcgcaccuuccggagccagcgccggcgccucgagcgguccaaguggcgccugagccugcucacgucccuguucgaggaggagaucagcaagaucgacgacaaguucuucgaccggcugaaggacuccaaguucuucaucgacgacaagagcgaccagcagcccaacacccucuucaacgacgugaacuucaccgacaaggaguaccacaagcgcuacccguccaucuaccaccuccggaacgcccuguucaaccagaacgacaaguucgacauccgccucaucuuccuggcccugagccacaucgugaagaagcgggggcacuuccucuucgacggcgacaaggcgggcuucggggaggacaucgacgucauccuggacgagcugaaggccuaccuccaggacgccuuccacaccaagcuggaguucacguccgaguucaagagcaucaugcuggacaagaaccuccgcaagaagcagaaggaggaggagcugaagaacuccaucaagaucagcuccgacaccaucaacagcaaggacggcaaguccauccugaucaagcuguuccugggguacgaggccaaccugaagcccuucuuccucgaguacaagguggagaaggacaacgaguacaagaucaacuucagcaaggaggacuacgaggagaagcugcuggacaugaccagcaaguucgaggagaccacguacuucaucgagaucgcgaagaagauccacgacuacuuccuccuggaggagaucaugcugggcuucaagaacaucuccgccagcaagguguccaucuaccagaagcacaagaacgaccucaagacccugaagaacaucgucaagaaccagaucaacaacagcuacaacgccaucuucaaggacaucgggcuggacaacuaccccgccuacguguccugcuggaacagcaagaagcacaaggagaagcagaagggcugcaccaaggacaaguucuacgccuuccucaagaccaagcugaagaacaucaacaacgcgaaggagauccuggacuccaucgacaacgacgacuuccucccccggcugguggacaagaacagcaucaucccgcaccagauccaccuggccgagcucaucaagaucaucgacaaccagucccaguacuaccccuuccugaaggagaucaaggacaagaucaucagcaucuucaaguuccgcauccccuucuacgucggcccccugaacaacuuccacaaggacaagggcgggaacgccuggaucgagaagcucaaggacgagcggaucuucccguggaacuucaacgacgugguggaccugaacaaguccgccgccaacuucaucgagaagaugaucaacgagugcagcuaccugaagggggagaagguccuggcgaagaacucccuccuguacacgaaguacagcgugcugaaccucaucaacaagcugaagaucaacggcaccgccguguccgucgagaccaagcagaagaucuacaacgagcugcuccugaagcagaagaacaucaagaagaccgccaucaagaaguuccugaucaacaacagcaucaucgacaagaacgacgagaucuccggcaucgacgacagccucacguccaaccuggccguguucaucgacuucgagaagaucagcaaccgccugcgguacgaccagaaggaggacaucaucaagagcaucucccucuucggguacgacaacgccaugcugaagaagcagaucaucaccaucgcgcccgaccugagcgaggacgagcucgagaagcuguccaagcugcgcuacagcggcuucgggcgccucuccaagcggcugcugaccagcaucaagcacaacggcaaguccaucaucgagaugcucugggacaccaacgacaaccugauggagcugcucagcgaccgcuacacguucaucgagcagaucaacaagcacaacgacggguucaaggaggacaucaaccugaacuuccagaacguggacacccuguacgucucccccagcgugaagcggcagaucuggcaggccuucaaggugaucaacgagcucaucuccgucaugggccgcgagcccaagaagaucuucguggagauggcccgggaggagggcgagaagaagcgcacccaggcccggaaggacaaggugcuggagcuguacaagagcaucaagaacaacgagaucuccaccuuccucacgaacuucaaggacaucaagaccaagcuggagggggagagcaaccugaacuccaagaagcucuaccuguacuaccugcagcucggcgucgacaucuacaccggggagaagaucccguucgagaagcuguucgaccagaacaucuacgacaucgaccacgugaucccccgcagccugaagaaggacgacuccuucgacaaccucguccugaccagcaagacgaacaacgccaagaagaccgacgaguuccccgugagcuccgagauccagagcaagaugcagaccuucuggaaggugcugaaggacaaggaccucauguccgagaucaaguacaccaaccugacgcggaagacccaccugagcgacgacgagcucggcgacuucaucgcgcgccagcuggucgagacccggcaguccaccaaggcccugacgcagauccucaagaacguguacgccaacagcgacaucguguacgucaaggccgggaucguguccgaguuccgccagcaguucgacaugcugaagauccgggagcugaacgacuuccaccacgcgaacgacgccuaccucaacaucgugaucggcaacgucuacaacaucaaguucaccaagaacccccgcaacuacgugaaggaguacuacaagaagggcgagcacuacaaccugaagaucgagaagaugcuggagaaggacaucgcccgcgggggcaacuucgggugggacaagaagcacagcaucgagaccgugcagaagaccaugaagaagcaguccccgcucaucaccuaccggacguucgagaacaagggcgaguucuucaaccagcagcccagcaaggccuccgccaaccugcuggcgcucaagagcuccgacaagcggcugcuggacaccguccgcuacgggggcuacaagggcacccaguacgcccacauguuccucguggagcacuucaacgggaagaucaucaaggagaucaugggcgugcccaucuaccugagcaaggagaucaaggacgacaaggccaagcugcucgaguacugcaacgacguccugaagcugaagaaccccaagauccucuucuccaagaucccguacaacagccugaucguguacaacggguaccccauccugcuccggggccugaccggcgugcgcggggccgcccagcugaagcucgaccagacguccacccaggucgugaagaacaucgugaagcuguacgacuggcugagccagaagcagaaggagcucuccgaccugagcaagaagaucgaguucuuccaggagaacaacaagaaggacgaggucaaggcggccaugcuggaggccgacaacauccucuucauccugaacgaccgcuucaagaacaccaagaucggcaaggacaucaugaacgacaaccaccugaacaaccucuacgacaccuucaucaacaagcuggagaacagcaucuacaagaacaagcccgggggcaagcaggacgugcugaugaaggagaagcgggaccucuuccuguccuucagcauguccaagaagugcaucacgcuguacaagaucaucaagaucuucgggagcugcgaccagggcguggacuucuccgacaucgccgagaagaucagcaaguccggcgggaucggcgggaagaaccucggcaagaacaccuucgaccuggucuucaaggagaacagcaccuacacccuggugcaguccagcgugacggggcucuacgccaagaagaccgaccugcacaagcuguga

SEQ ID NO: 1939 - RNA, 4104 nt, Artificial Sequence
  Cas9 variant
augaagaagcagaaguucagcgacuacuaccugggcuucgacaucgggaccaacuccgugggcuggugcgucaccgaccucgacuacaacgugcugcgcuucaacaagaaggacaugugggggagccggcuguucgaggaggccaagacggccgcggagcgccgggugcagcgcaacucccggcgccggcucaagcgccggaaguggcgccugaaccugcucgaggagaucuucagcaacgagauccugaagaucgacuccaacuucuuccggcgccugaaggagagcucccucuggcuggaggacaagagcuccaaggagaaguucacccuguucaacgacgacaacuacaaggacuacgacuucuacaagcaguaccccaccaucuuccaccuccggaacgagcugaucaagaacccggagaagaaggacauccgccuggucuaccucgccauccacagcaucuucaagucccggggccacuuccuguucgaggggcagaaccugaaggagaucaagaacuucgagacccucuacaacaaccugaucgccuuccuggaggacaacggcaucaacaagaucaucgacaagaacaacaucgagaagcucgagaagaucgugugcgacagcaagaagggccugaaggacaaggagaaggaguucaaggagaucuucaacuccgacaagcagcugguggccaucuucaagcucagcgucggguccagcgugucccugaacgaccuguucgacacggacgaguacaagaagggcgagguggagaaggagaagaucagcuuccgcgagcagaucuacgaggacgacaagcccaucuacuacuccauccucggggagaagaucgagcugcuggacaucgccaagaccuucuacgacuucaugguccucaacaacauccuggcggacagccaguacaucagcgaggccaaggugaagcuguacgaggagcacaagaaggaccucaagaaccugaaguacaucauccggaaguacaacaagggcaacuacgacaagcuguucaaggacaagaacgagaacaacuacuccgccuacaucgggcucaacaaggagaaguccaagaaggaggugaucgagaagucccgccugaagaucgacgaccugaucaagaacaucaagggcuaccuccccaaggucgaggagaucgaggagaaggacaaggccaucuucaacaagauccugaacaagaucgagcugaagaccauccuccccaagcagcggaucagcgacaacggcacccugccguaccagauccacgaggcggagcuggagaagauccucgagaaccagagcaaguacuacgacuuccugaacuacgaggagaacgggaucaucacgaaggacaagcugcucaugaccuucaaguuccgcauccccuacuacgugggcccccugaacagcuaccacaaggacaagggcgggaacuccuggaucgugcggaaggaggagggcaagauccugcccuggaacuucgagcagaaggucgacaucgagaaguccgccgaggaguucaucaagcgcaugaccaacaagugcaccuaccugaacggggaggacgugaucccgaaggacacguuccucuacagcgaguacgugauccugaacgagcugaacaagguccaggugaacgacgaguuccucaacgaggagaacaagcgcaagaucaucgacgagcuguucaaggagaacaagaaggugagcgagaagaaguucaaggaguaccugcucgucaagcagaucguggacggcaccaucgagcugaagggggugaaggacuccuucaacagcaacuacaucuccuacauccgguucaaggacaucuucggcgagaagcugaaccucgacaucuacaaggagaucagcgagaaguccauccuguggaagugccuguacggggacgacaagaagaucuucgagaagaagaucaagaacgaguacggcgacauccucaccaaggacgagaucaagaagaucaacaccuucaaguucaacaacuggggccgccugagcgagaagcugcucacggggaucgaguucaucaaccuggagaccggcgagugcuacuccagcgucauggacgcccugcggcgcaccaacuacaaccucauggagcugcuguccagcaaguucacccuccaggagagcaucaacaacgagaacaaggagaugaacgaggccuccuaccgggaccugaucgaggagagcuacgugucccccagccugaagcgcgccaucuuccagacgcucaagaucuacgaggagauccggaagaucaccgggcgcguccccaagaagguguucaucgagauggcgcggggcggggacgaguccaugaagaacaagaagauccccgcccgccaggagcagcugaagaagcuguacgacagcugcggcaacgacaucgccaacuucuccaucgacaucaaggagaugaagaacagccucaucuccuacgacaacaacagccugcggcagaagaagcuguaccucuacuaccugcaguucggcaagugcauguacaccgggcgcgagaucgaccuggaccggcuccugcagaacaacgacaccuacgacaucgaccacaucuacccgcgcuccaaggugaucaaggacgacagcuucgacaaccugguccucgugcugaagaacgagaacgccgagaaguccaacgaguaccccgugaagaaggagauccaggagaagaugaaguccuucuggcgguuccugaaggagaagaacuucaucagcgacgagaaguacaagcgccucacgggcaaggacgacuucgagcugcggggguucauggcccgccagcuggucaacgugcggcagaccaccaaggaggugggcaagauccuccagcagaucgagcccgagaucaagaucgucuacagcaaggcggagaucgccuccagcuuccgcgagauguucgacuucaucaaggugcgcgagcugaacgacacccaccacgccaaggacgccuaccugaacaucguggccgggaacgucuacaacacgaaguucaccgagaagcccuaccgguaccuccaggagaucaaggagaacuacgacgugaagaagaucuacaacuacgacaucaagaacgcgugggacaaggagaacagccuggagaucgugaagaagaacauggagaagaacaccgucaacaucacccgcuucaucaaggagaagaagggccagcuguucgaccucaacccgaucaagaagggcgagacguccaacgagaucaucagcaucaagcccaagguguacaacgggaaggacgacaagcugaacgagaaguacggcuacuacaagucccugaaccccgccuacuuccucuacguggagcacaaggagaagaacaagcggaucaagagcuucgagcgcgucaaccugguggacgugaacaacaucaaggacgagaagucccuggucaaguaccucaucgagaacaagaagcugguggagccccgggugaucaagaaggucuacaagcgccaggugauccugaucaacgacuacccguacagcaucgugacccucgacuccaacaagcugauggacuucgagaaccugaagccccucuuccuggagaacaaguacgagaagauccugaagaacgucaucaaguuccucgaggacaaccagggcaagagcgaggagaacuacaaguucaucuaccugaagaagaaggaccgguacgagaagaacgagacccuggaguccgugaaggaccgcuacaaccucgaguucaacgagauguacgacaaguuccuggagaagcuggacagcaaggacuacaagaacuacaugaacaacaagaaguaccaggagcuccuggacgugaaggagaaguucaucaagcugaaccucuucgacaaggccuucacccugaaguccuuccuggaccucuucaaccggaagacgauggccgacuucagcaaggucgggcugaccaaguaccugggcaagauccagaagaucuccagcaacgugcucuccaagaacgagcuguaccugcucgaggagagcgugaccgggcuguucgucaagaagaucaagcuguga

SEQ ID NO: 1940 - RNA, 4104 nt, Artificial Sequence
  Cas9 variant
augaagaagcagaaguucagcgacuacuaccugggcuucgacaucgggaccaacuccgugggcuggugcgucaccgacaugaacuacaacgugcuccgcuucaacaagaaggacaugugggggagccggcuguucgaggaggccaagacggccgcggagcgccgggugcagcgcaacucccggcgccggcugaagcgccggaaguggcgccucaaccugcuggaggagaucuucagcaacgagauccucaagaucgacuccaacuucuuccggcgccugaaggagagcucccuguggcucgaggacaagagcuccaaggagaaguucacccuguucaacgacgacaacuacaaggacuacgacuucuacaagcaguaccccaccaucuuccaccuccggaacgagcucaucaagaacccggagaagaaggacauccgccuggucuaccuggccauccacagcaucuucaagucccggggccacuuccucuucgaggggcagaaccugaaggagaucaagaacuucgagacccuguacaacaaccucaucgccuuccuggaggacaacggcaucaacaagagcaucgacaaggacaaccuggagaagcucgagaagaucgugugcgacuccggcaaggggcugaaggacaaggagaaggaguucaaggagaucuucaacagcgacaagcagcugguggccaucuucaagcucuccgucggccugagcgugucccugaacgaccucuucgacacggacgaguacaagaagggggagguggagaaggagaagaucagcuuccgcgagcagaucuacgaggacgacaagcccaucuacuacuccauccugggcgagaagaucgagcugcucgacaucgccaagagcuucuacgacuucaugguccugaacaacauccuggcggacagccaguacaucuccgaggccaaggugaagcucuacgaggagcacaagcgggaccugaagaaccugaaguacaucauccgcaaguacaaccgggagaacuacgacaagcuguucaaggacaagaacgagagcaacuaccccgccuacaucgggcugaacaaggagaaguccaagaaggaggugaucgagaaguccaagcugaagaucgacgaccucaucaagagcaucaagggcuaccugcccaaggucgaggagaucgaggagaaggacaaggccaucuucaacgagauccugaacaagaucgagcucaagaucauccugccgaagcagcgcaucagcgacaacggcacccugcccuaccagauccacgaggcggagcucgagaagauccuggagaaccaguccaaguacuacgacuuccugaacuacgaggagaacgggaucaucaccaaggacaagcuccugaugaccuucaaguuccggauccccuacuacgugggcccccugaacagcuaccacaaggacaagggcgggaacuccuggaucgugcgcaaggaggagggcaagauccugccguggaacuucgagcagaaggucgacaucgagaaguccgccgaggaguucaucaagcgcaugacgaacaagugcaccuaccucaacggggaggacgugauccccaaggacagcuuccuguacagcgaguacaucauccugaacgagcucaacaaggugcaggucaacgacgaguuccugaacgaggagaacaagcggaagaucaucgaggagcuguucaagggcaacaagaagguguccgagaagaaguucaaggaguaccuccuggugaaccagaucaccaccgggacgaucgagcugaagggcaucaaggacagcuucaacuccaacuacaucagcuacaucaaguucaaggacaucuucggggagaagcucaaccuggacaucuacaaggagaucuccgagaaguccauccuguggaagugccucuacggcgacgacaagaagaucuucgagaagaagaucaagaacgaguacggcgacauccugaccaaggacgagaucaagaagaucaacaccuucaaguucaacaacugggggcgccugagcgagaagcuccugaccggcaucgaguucaucaaccuggagacgggggagugcuacagcagcgucauggaggcccuccggcgcaccaacuacaaccugauggagcugcucuccagcaaguucacccugcaggagaacaucgacaacgagaacaaggacaucucccaguucagcuaccgggaccugguggaggaguccuacgugagccccucccucaagcgcgccauccugcagacccugaagaucuacgaggagaucaagaagaucacgggccggguccccaagaagguguucaucgagauggcccgcgggggcgacgagagcaugaagaacaagaagaucccggcgcggcaggagcagcucaagaagcuguacgacuccugcggcaacgacaucgccaacuucagcaucgacaucaaggagaugaaguccagccugucccucuacgacaacaacagccugcgccagaagaagcuguaccucuacuaccugcaguucgggaagugcauguacaccggccgggagaucgaccuggaccgccuccugcagaacaacgacaccuacgacaucgaccacaucuacccccgguccaaggucaucaaggacgacagcuucgacaaccuggugcucgugcugaagaacgagaacgccgagaaguccaacgaguaccccgucaagaaggagauccaggagaagaugaaguccuucuggcgcuuccugaaggagaagaacuucaucagcgacgagaaguacaagcggcucaccgggaaggacgacuucgagcugcgcggcuucauggcccggcagcuggugaacgugcgccagacgaccaaggaggucgggaagauccuccagcagaucgagcccgagaucaagaucguguacagcaaggccgagaucgcgagcuccuuccgggagauguucgacuucaucaaggugcgcgagcugaacgacacccaccacgccaaggacgccuaccugaacaucgucgccggcaacguguacaacaccaaguucacggagaagccguaccgcuaccuccaggagaucaaggagaacuacgacgugaagaagaucuacagcuacgacaucaagaacgccugggacaaggagaacucccuggagaucgucaagaagaacauggagaagaacaccgugaacaucacccgguucaucaaggaggagaagggccagcuguucgaccucaaccccaucaagaagggggagaccagcaacgagaucaucuccaucaagcccaagguguacaacggcaaggacgacaagcugaacgagaaguacggguacuacaagagccugaaccccgcguacuuccucuacgucgagcacaaggagaagaacaagcgcaucaaguccuucgagcgggugaaccugguggacgucaacaacaucaaggacgagaagucccugaucaaguaccucguggagaacaagaagcugguggagccgcgcgucaucaagaagguguacaagcgccaggugauccugaucaacgacuaccccuacagcaucgucgcccucgacagcaacaagcugauggacuucgagaaccugaagccccucuuccuggagcggaaguacgagaagauccugaagaacgugaucaaguuccucgaggacaaccagggcaaguccgaggagaacuacaaguucaucuaccugaagaagaaggaccgguacgagaagaacgagacgcuggagagcgugcgcgagcgguacaacaucgaguucaacgagauguacgacaaguuccucgagaagcugaacuccaaggacuacaagaacuacaucaacaacaagaaguaccaggaccugcucgacgucaaggagaaguucaucaagcugaaccuguucgacaaggccuucacccucaagagcuuccuggaccuguucaaccgcaagaccauggccgacuucuccaaggugggccucaccaaguaccuggggaagauccagaagaucagcuccaacgugcugagcaagaacgagcucuaccugcuggaggagagcgucacgggccucuucgugaagaagaucgagcuguga

SEQ ID NO: 1941 - RNA, 4104 nt, Artificial Sequence
  Cas9 variant
auggugaagaagaaguacgccaucggcaucgacaucgggaccaacagcgucggcugguccguggugaccgacgacuacaagguccccagcaagaagaugaagguguucgggaacacggagaagcgcuacaucaagaagaaccugcugggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacguccagcaccuguucaacgacuucguggagauguucgacaagaccguggagggguccuaccugagcgagaaccuccccaacgucgccgacgugcugguggagaaggucuccaagagccggcgccuggagaacauccuccacuacuuccccaacgagaagaagaacggccuguucgggaacuuccugacgcucgcccugggccugcagccgaacuucaagaccaacuucgagcucgccgaggacgcgaagauccaguucuccaaggagaccuacgaggaggaccuggaggagcugcucggcaagaucggggacgacuacgccgaccuguucaucgccaccaagagccuguacgacggcauccuccuggccgggauccuguccacgaccgacagcaccaccaaggcgccccucuccagcuccauggugaaccgguacgaggagcaccagaaggaccuggcccugcucaagaacuucauccaccagaaccugagcgacagcuacaaggagguguucaacgacaagcugaaggacggcuacgccggcuacaucgaggggaagacgacccaggagaacuucuaccgcuucaucaagaaggccaucgagaagaucgagggcuccaacuacuucaucgacaagaucgaccgggaggacuuccuccgcaagcagcggaccuucgacaacgggagcaucccccaccagauccaccuccaggagaugcacgccaucauccgccgccaggccgaguucuaccccuuccuggucgagaaccaggacaagaucgagaagauccugaccuuccggaucccguacuacgugggcccccuggcgcgcgggaaguccgaguucgccuggcugaaccgcaagagcgacgagaagauccggcccuggaacuucgacgagaugguggacaaggagacguccgccgagaacuucaucacccggaugaccaacuacgaccaguaccuccccgaccagaagguccugccgaagcacagccugcuguacgagaaguucgccguguacaacgagcucaccaaggugcgcuacgucacggagcagggcaaguccuucuucuucgacgccaacaugaagcaggagaucuucgacggcguguucaagguguaccggaaggucaccaaggagaagcugauggacuuccuggggaaggaguucgacgaguuccgcaucguggaccuccugggccuggacaaggacaacaagagcuucaacgcgucccucgggaccuaccacgaccugaagaagaucgucagcaaggaccugcucgacaaccccgagaacgaggacauccuggagaacguggugcugacccucacgcuguucgaggaccgggagaugauccgcaagcggcuggagaaguacaaggacguccucaccgaggagcagcgcaagaagcuggagcggcgccacuacaccggcugggggcggcuguccgccaagcucaucaacggcauccgcgacaaggugacccggaagacgauccuggacuaccugaucgacgacggcaccagcaaccgcaacuucaugcagcucaucaacgacgacacccuguccuucguggacgagauccggcuggcccaggggagcggcgaggccgaggacuaccgcgccgagguccagaaccucgcggggucccccgccaucaagaagggcauccugcagagccugaagaucguggacgagcucaucgaggugaugggguacgaccccgagcacaucgucguggagauggcccgcgagaaccaguucaccaaccagggccggcgcaacucccagcagcgguacaagaagaucgagaacgccaucaagaaccuggacagcaaccugaacuccaagauccucaaggaguacccgacgaacaaccaggcgcugcagaacgaccgccuguuccucuacuaccugcagaacggcaaggacauguacaccgacgaggagcuggacaucgaccagcucagccaguacgacaucgaccacaucaucccccaggccuucaucaaggacgacagccuggacaacaaggugcugaccaaguccgccaagaaccgggggaaguccgacgacguccccagccucgagaucgugcacaagaagaagaacuucuggaagcagcugcuggacagccagcucaucucccagcgcaaguucgacaaccugaccaaggccgagcggggcgggcugaccaacgaggacaaggcccgcuucauccagcggcagcucguggagacgcgccagaucaccaagcacgucgcgcggauccuggacacccgcuucaacaccaagcuggacgaggccggcaaccggauccgcgaccccaaggugaacaucaucacgcucaagagcaaccuggugucccaguuccggaaggacuaccagcuguacaagguccgcgagaucaacaacuaccaccacgcccacgacgccuaccucaacgccgugguggcgaccgcccugcugaagaaguacccgcagcucgcccccgaguucgucuacggcgacuaccccaaguacaacagcuacaagucccgcaagagcgccaccgagaaggugcuguucuacuccaacaucaugaacuucuuccggcgggugcuggucuacagcaagaccggggaggugcgcauccggcccgugaucgaggucaacaaggagacgggcgagaucgugugggacaagaaguccgacuuccgcaccgugcgcaagguccucagcuacccccaggugaacguggucaagaagguggagaugcagaccgggggcuucuccaaggagagcauccugcagcacggggacuccgacaagcugaucccccggaagaccgagaaguucuaccucgacacgaagaaguacggcggcuucgacagccccaccaucgccuacagcgugcugcugaucgcggacaucgagaaggggaaggccaagaagcucaagcgcgucaaggagcugaucggcaucaccaucauggagcggauggccuucgagaagaaccccaucgaguuccuggagcacaagggguacaagaacauccucgagaagaacaucaucaagcugccgaaguacucccuguucgagcucgagaacggccgccggcgccugcuggccagcgcgaaggagcuccagaaggggaacgagaugauccugccgccccaccuggugacccuccuguaccacuccagcaacauccacaagaucacggagccgauccaccugaacuacgugaacaagaacaagcacgaguucaaggagcuccugcggcacaucuccgacuucagcacccgcuacauccuggcccaggaccggcucuccaagaucgaggagcuguacgacaagaacgacggcgacgacaucagcgaccugaccuccagcuucgucaaccuccugaccuucacggccaucggcgcccccgccgcguucaaguuccugggguccgugaucgaccgcaagcgguacaccagcaucgccgagauccucgaggccacccugauccaccaguccgugaccggccuguacgagacgcgcaucgaccucagcaagcucgggggcgacuga

SEQ ID NO: 1942 - RNA, 4104 nt, Artificial Sequence
  Cas9 variant
auggugaagaagaaguacgccaucggcaucgacaucgggaccaacagcgucggcugguccguggugaccgacgacuacaagguccccagcaagaagaugaagguguucgggaacacggagaagcgcuacaucaagaagaaccugcugggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacguccagcaccuguucaacgacuucguggagauguucgacaagaccguggagggguccuaccugagcgagaaccuccccaacgucgccgacgugcugguggagaaggucuccaagagccggcgccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacggacagcaccaccaaggcgccccucuccagcuccauggugaaccgguacgaggagcaccagaaggaccuggcccugcucaagaacuucauccaccagaaccugagcgacagcuacaaggagguguucaacgacaagcugaaggacggcuacgccggcuacaucgaggggaagaccacgcaggagaacuucuaccgcuucaucaagaaggccaucgagaagaucgagggcuccaacuacuucaucgacaagaucgaccgggaggacuuccuccgcaagcagcggaccuucgacaacgggagcaucccccaccagauccaccuccaggagaugcacgccaucauccgccgccaggcggaguucuaccccuuccuggucgagaaccaggacaagaucgagaagauccugaccuuccggaucccguacuacgugggcccccuggcccgcgggaaguccgaguucgccuggcugaaccgcaagagcgacgagaagauccggcccuggaacuucgacgagaugguggacaaggagaccuccgccgagaacuucaucacgcggaugaccaacuacgaccaguaccuccccgaccagaagguccugccgaagcacagccugcuguacgagaaguucgccguguacaacgagcucaccaaggugcgcuacgucaccgagcagggcaaguccuucuucuucgacgcgaacaugaagcaggagaucuucgacggcguguucaagguguaccggaaggucacgaaggagaagcugauggacuuccuggggaaggaguucgacgaguuccgcaucguggaccuccugggccuggacaaggacaacaagagcuucaacgccucccucgggaccuaccacgaccugaagaagaucgucagcaaggaccugcucgacaaccccgagaacgaggacauccuggagaacguggugcugacccucacccuguucgaggaccgggagaugauccgcaagcggcuggagaaguacaaggacguccucacggaggagcagcgcaagaagcuggagcggcgccacuacaccggcugggggcggcuguccgccaagcucaucaacggcauccgcgacaaggugacccggaagaccauccuggacuaccugaucgacgacggcacgagcaaccgcaacuucaugcagcucaucaacgacgacacccuguccuucguggacgagauccggcuggcccaggggagcggcgaggccgaggacuaccgcgcggagguccagaaccucgccgggucccccgccaucaagaagggcauccugcagagccugaagaucguggacgagcucaucgaggugaugggguacgaccccgagcacaucgucguggagauggcccgcgagaaccaguucaccaaccagggccggcgcaacucccagcagcgguacaagaagaucgagaacgcgaucaagaaccuggacagcaaccugaacuccaagauccucaaggaguacccgaccaacaaccaggcccugcagaacgaccgccuguuccucuacuaccugcagaacggcaaggacauguacacggacgaggagcuggacaucgaccagcucagccaguacgacaucgaccacaucaucccccaggccuucaucaaggacgacagccuggacaacaaggugcugaccaaguccgccaagaaccgggggaaguccgacgacguccccagccucgagaucgugcacaagaagaagaacuucuggaagcagcugcuggacagccagcucaucucccagcgcaaguucgacaaccugaccaaggccgagcggggcgggcugaccaacgaggacaaggcgcgcuucauccagcggcagcucguggagacccgccagaucacgaagcacgucgcccggauccuggacacccgcuucaacaccaagcuggacgaggccggcaaccggauccgcgaccccaaggugaacaucaucacccucaagagcaaccuggugucccaguuccggaaggacuaccagcuguacaagguccgcgagaucaacaacuaccaccacgcccacgacgccuaccucaacgcggugguggccacggcccugcugaagaaguacccgcagcucgcccccgaguucgucuacggcgacuaccccaaguacaacagcuacaagucccgcaagagcgccaccgagaaggugcuguucuacuccaacaucaugaacuucuuccggcgggugcuggucuacagcaagaccggggaggugcgcauccggcccgugaucgaggucaacaaggagaccggcgagaucgugugggacaagaaguccgacuuccgcacggugcgcaagguccucagcuacccccaggugaacguggucaagaagguggagaugcagaccgggggcuucuccaaggagagcauccugcagcacggggacuccgacaagcugaucccccggaagaccgagaaguucuaccucgacaccaagaaguacggcggcuucgacagccccacgaucgcguacagcgugcugcugaucgccgacaucgagaaggggaaggccaagaagcucaagcgcgucaaggagcugaucggcaucaccaucauggagcggauggccuucgagaagaaccccaucgaguuccuggagcacaagggguacaagaacauccucgagaagaacaucaucaagcugccgaaguacucccuguucgagcucgagaacggccgccggcgccugcuggcgagcgccaaggagcuccagaaggggaacgagaugauccugccgccccaccuggugacccuccuguaccacuccagcaacauccacaagaucaccgagccgauccaccugaacuacgugaacaagaacaagcacgaguucaaggagcuccugcggcacaucuccgacuucagcacgcgcuacauccuggcccaggaccggcucuccaagaucgaggagcuguacgacaagaacgacggcgacgacaucagcgaccugaccuccagcuucgucaaccuccugaccuucaccgccaucggcgcccccgcggccuucaaguuccugggguccgugaucgaccgcaagcgguacacgagcaucgccgagauccucgaggccacccugauccaccaguccgugaccggccuguacgagacccgcaucgaccucagcaagcucgggggcgacuga

SEQ ID NO: 1943 - RNA, 4107 nt, Artificial Sequence
  Cas9 variant
auggacaagaaguacagcaucggccuggacaucgggaccuccagcaucggcuucgugggggucgacgagaacggcuggccccucaacaucaaggggaagcgcgccaucggcgcccaccuguuccgggagggcgaggcggccgccgagacccgcggguuccggacgacccgccggcgcuacaaccggcgcaaguggcggcugcgccuccugcgggagaucuucgacgagccgaucucccgcguggaccccaccuucuucgcccggaugaaggagagcuccgugagccccaaggaccccaacuacgacggccuggccaaggagauccucaucccgcgcgacaaggacgggaagauccuguaccccaccaucuaccaccuccggcacgcgcucauguacgaggaccaccaguucgacauccgcgagaucuaccuggccauccaccacaucgucaaguaccggggccacuuccugcucgacggggccgccaagaacuucgaguccagcaaccuggaccugaaguccgacauccacgagaucaacgcgauccucgugggcaucuucggcaacgagcagguccaguucaacgaccaguacguggagaagcugaaggaggugcugcucgacagcacgcagucccgcagcgaccggcagaaggccgccgccaaggugcugcugcccaccaacgaccucgacaaggacaccaccaagauccugaagacggucuccaccgagaucaccaaggccaucaccgggcugaaggcgaaguucuucgugaucacgggcaacgacaucgccaaggaccagcagaaggacuggaccuucagcaucgacacccucgacgagaagauguccgugaucgagcccagcuucuccgagaagaacuucagccugaucaccauccugcagaagcucuacuccagcgucacgcuggccgggaucgugccgaacggccugagccucuccgaggccaugauccagaaguacgaccgccacgccagcgaccuggugcugcucaagaaguacugggacaccaagcccaagguccugaagcaccagcugcagaacaccuacgcggaguacaucgagauccaccaggugguggacgaguucuacuccgaccucagcaagcugaucaagaacgacgacgacacccuggcccaggagaucaaguccaagaucacgaucggcaacuuccuccccaagcagcggaccaccgagaacggggucauccccuaccagcugcagcagcgcgagcuggacaccaucaucaagaaccagcaggaguacuacccguggcucgccgaggagaaccccguggccgaccaccagaucgccuuccccuacaagcuggacgagcuggugggcuuccgcauccccuacuacgucgggccgaugaucgcgaaggaggacacgagcaacuccaagaacagcaaguucgccuggaugauccggaagcaguccggcgaggugacccccuggaacuucgacgagaagaucgaccgcaccgccagcgccaccgccuucaucgaccggaugacgaccaccgacaccuaccucaucggggaggacgugcugcccaagcagucccugaucuaccagcgcuucgagguccucaacgagcugaacaagaucagcaucgacggccagcccaucacgcggaagcagaagcaguccguguacacccacgucuucgagaagaagaagaccguccaggugaaggacgugcagaaguuccuggugagcuccggcgaggugaugagccugccgaagaucgggggccucgcgaacgagaagcaguucaacuccagccuguccacccuguacgacuacaacaagaucauccccgacgcccucgaggaccgcaacaaggucgacgacaucgagaagaucauccuguggagcacgaucuucgaggacaacagcaucuucguggagaagcuggacuccaucgacuggcucaccagcucccagcggaagcgccuggcccagaagcgguaccgcggguggggccggcugagccuccgccugcugaccaccuucaagaacaaggacggguacuccauccucgacgagcuguggaacagcaaccacaacuucauggagauccaggcccaguccgacuucagcgagcagaucgcgaccgccaacaacaacaaccugucccaggugcuccccgccaagugggagcccggccggaagaaccuggccagccuggacgaguucaucuccaaccucuacacgagcccgcagaacaagaaggcccugcgcaaggcgauccgggucgugcaggacaugaugaccgccgccggccacaugcccgagaagaucuucaucgagguggcccgcgacaccuccaacagccaccagcagaccaucgcccggcagcgccagcugcagcagcucuaccaguccgaggcgaaggaggucaucgacagcuccgugcggagcgagcuggacgacauccugaagaaccgcgccaacaucaaggaccagcuguuccuguacuuccagcagggcgggcgcgaccuguacacggggaaggccaucaacaucgacaagcucagccuguaccacaucgaccacauccugccccagucccucgugaaggacgacagccuggacaaccggguccuggugucccagaagaccaacgaggacaagggcgugaccuucgucagcgacaaguacaugaacaacaugcuccccaccuggaagcgcuggcacgagauggggcugaucuccgcccggaagcugaagaaccucacgaugcgcccggacgagaucgacaaguacgcccccggcuucauccagcggcagcugguggagacccgccaggugaccaagcuggucaucgagcuccuggacgcgcugcucggcaacagccagaccgagaucaucacgaucaaggccucccugagccaccaguuccggcagcaguucgaccuggugaagauccgcgaggugaacgacaaccaccacgccuucgacgccuuccucgcggcccggaucgggaccuaccuguacaagcgcuaccccaagcugcggccguacuucgucuacggccaguacaugcagaaccacaagaaccucaaguccaucaaccugaucaagacccuggacagcgacaaggccaucguggacgaggggaccggcgagauccucugggacaagaaguccgaccuggccaagaugaucaagaucuacaacuaccagcgccugcucaucacgcacgagagccggaccuccuucggcgccauguacaagcagaagauccugaaggcgaccgacgccaagcagaacgggggcggguucaagcuggugcccaccaagcgcaacuggcccgucgacaucuacggcggguacacgggccagaccgccgccuaccucaccaucgugcggguguacagcaagaagaccuccgagcugcgcguccugcccaucuacacgaacaaggugcagcagaucgagaaggccaugacccagggcgacaaggcgaccaugcucgccuucaagaaggugaucgccccgcagcuggggaaggagaacaagaagacccacgagaucaagauccccgaguucgacgucgugauccccaaggugcugcucgaccagcuggucaucgacgacaucgccggcagcccccaccgguuccgccuggggacggacaccuacuaccacaacucccagcagcuguuccucccgcugagcaugcagcggcagcucauggaccgcgaguccgacgacaagguguaccuggacaucuucaacgacgugcugaagcaggucgacagcuacuucaaccucuacgacgugaacggcuuccgggccgcgcugcagaaguccaagaaggccuucgagcagcugcccaucaacgacuuccccaaggacgugcccgacaacaagaagaagaaggggaagcgcagcauccucaaggagaucuucaucggccugcacgccaacgccacccugggcaaccucaagcagauggggaucaagaccgacuucggcaagcugcagaaguccaacgggcugcgcaucacggagaacugcaagaucauccaccagagcccgaccggccucuucgagcggaucguccccaucaaguga

SEQ ID NO: 1944 - RNA, 4107 nt, Artificial Sequence
  Cas9 variant
augagccgccccuacaacaucggccuggacaucgggaccuccagcaucggcugguccguggucgacgaccagagcaagcucguguccgugcgggggaaguacggcuacgggguccgccuguacgacgagggccagaccgccgccgagcggcgcagcuuccggacgacccgccggcgccugaagcggcgcaaguggcggcucggccugcugcgcgagaucuucgagccguacaucacccccguggacgacaccuucuuccuccggcagaagcaguccaaccugagccccaaggaccagcgcaagcuguacccccagacgucccucuucaacgaccggaccgaccgcgcguucuacgacgacuacccgaccaucuaccaccuccgguacaagcugaugaccgagaagcgccaguucgacauccgggagaucuaccuggccaugcaccacaucgugaaguaccgcgggcacuuccugaacgaggcccccgucagcuccuucaagagcuccgagaucaaccugguggcccacuucgaccggcucaacacgaucuucgccgaccuguucagcgaguccggcuuccagcuggagaccgacaagcucgcggaggugaaggcccugcugcucgacaaccagcagagcgccuccaaccgccagcgccaggcccugagccugaucuacacccccuccaccaacaaggcggucgagaagcagaacaaggccaucgccacggagcuccugaaggccauccuggggcucaaggccaaguucaacgugcugaccggcaucgaggcggaggacgugaaggccuggacccugaccuucaacgccgagaacuucgacgaggagauggucaagcucgagagcagccuggacgacaacgcccaccagaucaucgagucccugcaggagcucuacagcggggugcugcuggccggcaucgugcccgagaaccagucccucagccaggcgaugaucacgaaguacgacgaccaccagaagcaccugaagaugcugaaggccguccgggaggcccucgccccggaggaccgccagcggcugaagcaggccuacgaccaguacguggacggccaggagaacaccaaggcguacuccaaggaggacuucuacggggacaucaccaaggcccugaagaacaaccccgaccaccccaucgugagcgagaucaagaagcucaucgagcuggaccaguucaugcccaagcagcgcaccaaggacaacggcgccaucccgcaccagcugcaccagcaggagcucgaccggaucaucgagaaccagcagcaguacuaccccuggcuggccgagcugaaccccaacuccaagcgccagacggucgccaaguacaagcucgacgagcugguggcguuccgggugcccuacuacgucgggccgcugaucaccgccgagcagcagcgccagagcuccgacgccaaguucgccuggcugauccggaaggcggagggccgcaucacccccuggaacuucgacgacaagguggaccggcaggccagcgccaacgaguucaucaagcgcaugaccacgaccgacaccuaccuccuggccgaggacgugcugcccaagcagucccucaucuaccagcgguucgagguccugaacgagcugaacggccucaagaucgacgaccagcccaucaccacggagcugaagcaggccaucuucaccgaccuguucaugcagaagaucagcgugaccgucaagaacauccaggacuaccucguguccgagaagcgcuacgcgagccggccggccaucaccgggcuguccgacgagaacaaguucaacagccgccuguccacguaccacgaccucaagaugaucgugggcgacgccgucgacgacguggacaagcaggccgaccuggagaagugcaucgaguggagcaccaucuucgaggacgggaagaucuacuccgccaagcugaacgagaucgacuggcucaccgaccagcagcgggugcagcuggcggccaagcgcuaccggggcugggggcgccugagcgccaagcuccugacccagaucgucaacgccaacggccagcgcaucauggaccugcucugggacacgaccgacaacuucaugcggaucgugcacagcgaggacuucgacaagcugaucaccgaggccaaccagaugaugcuggcggagaacgacgugcaggacgucaucaacgaccucuacaccagcccccagaacaagaaggcccugcgccagauccugcucguggugaacgacauccagaaggccaugaagggccaggcccccgagcggauccugaucgaguucgcgcgcgaggacgaggucaacccccggcuguccgugcagcgcaagcgccagguggagcaggucuaccagaacaucuccaacgagcuccugaacaacaccgagauccggaacgagcugaaggaccucagcaacuccgcccugagcaacacgcggcuguuccucuacuucaugcagggcgggcgcgacauguacaccggggacucccugaacaucgaccggcugagcaccuacgacaucgaccacauccucccgcaguccuucgugaaggacaacagccuggacaaccgcgugcuggucucccagaagaugaaccggagcaaggccgaccaggugcccaccgacuucacguccguggagcucggcaagaagaugcagcugcagugggagcagaugcugcgcgccgggcucaucaccaagaagaaguacgacaaccugacccugaaccccgaccacaucagcaaguacgccaugaagggcuucaucaaccggcagcucgucgagacccgccaggugaucaagcuggcgacgaaccugcucauggagcaguacggcgaggacaacaucgagcugaucaccgugaaguccgggcugacccaccagaugcggaccgaguucgacuuccccaagaaccgcaaccucaacaaccaccaccacgccuucgacgccuaccugacggccuucgucggccuguaccuccugaagcgguacccgaagcugaagcccuacuucguguacggggaguaccagaaggccagccagcaggacaaguggcgcaacuucaacuuccucaacggccugaagaaggacgagcugguggacgagaacaccgaggcggucaucugggacaaggaguccgggcucgccuaccugaacaagaucuaccaguucaagaagauccuggugacccgggaggugcacgagaacagcggcgcccucuucaaccagacccuguacgccgccaaggacgacaaggcgagcggccagggcgggaagcagcugauccccgccaagcaggaccgcccgacggcccucuacgggggcuacuccggcaagaccagcgccuaccugugccuggucaagaucaagaacaaguccgaguacaucuaccgcaucuucggggugaacaccagcugguccagcgagcucaagcagauccaggaccccgcggagcggcuggugcgccuggagaagcuccugacgccccagcugaccaucaacaagaagaagaagggcgagcccgucccggugaccaaggacuucaagaucauccucccccggauccugaucaaccagaaguucuacucccgcgggcaggacaucagcaucgccuccgaguucuaccugcacaacgagcaggagcucgugcuggacaagagcgacaucaagauccugaacggcgccaucaaggucaacaacuccaacaagcaggucaucaaccucuucaaccacauccuggagcaggucaaccaguacuuccccguguacgacaucuacaagagccgggaggugcugaacuccagcaaggagaucuucgagaaccucaccuggaacgaccaguggcgcaaccggaagcugaucaacguggggcagaagaccauccugaaccgcauccucaucggccugcacgccaacgccgcgcggaucaagaucuccgagcugggcuucaagaacgacuucgggcuccugacgcagaccagcggcaucaccuucacccccgacacgcagaucaucuaccaguccccgaccgggcuguucgagcgccggguggcccugcgcgaccucuga

SEQ ID NO: 1945 - RNA, 4107 nt, Artificial Sequence
  Cas9 variant
augaagcgcagcuacaacaucggccuggacaucgggaccaacuccaucggcugggccaucguggacgaccagagcaagcucaucuccgucaaggggaaguacggcuacggggugcggcuguacgacgagggccagaccgccgcggagcgccggagcuuccgcacgacccggcgccggcugaagcgccggaaguggcgccucggccugcugcgggagaucuucgagcccuacaucaccccgaucgacuccaccuucuuccuccgccagaagcagagcaaccugucccccaaggaccagcggaagcuguacccccagacgagccucuucaacgaccgccccgacgccgacuucuaccagcaguacccgaccaucuaccaccuccgguaccagcugaugaccgagaagcgccaguucgacauccgggagaucuaccucgccaugcaccacaucgugaaguaccgcgggcacuuccugaacgaggcccccgucgccuccuucaagagcuccgagaucaaccuggcggagcacuucgaccagcucaacaccaucuucgccgaccuguuccgggagagcggcuuccagcuggagacggacgagcucguggccgugaaggcccugcugauggacaaccagcaguccgcgagcaaccgccagcggaaggcccuccccaagcuguacacccccuccgccgacaagagcaucgagaagcagcgcaaggccaucgccaccgagauccugaaggcgauccucgggcugaaggccaaguucaacgucgugaccggcaucgaggccgaggacgugaaggccugggcccugacguucaacgcggagaacuucgacgaggagcucgccaagcuggaguccagccuggacgacaacgggcacgaggucaucggcauccuccaggagcuguacuccggcauccugcucgccgggaucgugccggagaaccagagccugagccaggccaugaucaccaaguacgaggagcaccaggcccaccugaagaugcucaaggcggugcgcgacgaccuggccaccgccgaccagcagaagcugaagaaggccuacgaccaguacaucgacggccaggagaacaccaaggccuacuccaaggaggcguucuacgacgacgucacgaaggcccucaaggacuacagcgagcagccccugguguccgagauccagaagcugaucgagcucgaccaguucaugcccaagcagcggaccaaggacaacggggccaucccccaccagcugcaccagcaggagcuggaccgcaucaucgagaaccagcagcaguacuacccguggcucgccgagcugaaccccaaccccaagcggcagaccguggcgaaguacaagcuggacgagcucgucgccuuccgcgugcccuacuacgugggcccgcugaucaccgccgagcagcagcagcagagcuccaacgccaaguucgccuggaugauccggaagacggagggccgcaucacccccuggaacuucgacgacaaggucgaccggcaggcgagcgccaacgaguucaucaagcgcaugaccaccacggacaccuaccugcuggccgaggacgugcuccccaagcagucccugaucuaccagcgguucgaggugcugaacgagcucaacgggcugaagaucgacgaccagcccaucaccaacgagcugaagcaggccaucuucaacgaccucuucaugcagaagaccagcgucuccgugaagaacauccaggacuaccuggugagcgagaagcgcuacgccucccggccggcgaucacgggccugagcgacgagaagaaguucaacucccgccucagcaccuaccacgaccugaaggucaucgugggggacgccgucgacgacguggacaagcaggccgaccuggagaagugcaucgagugguccaccaucuucgaggacggcaagaucuacagcgccaagcucaacgagaucaccuggcugacggagcagcagcgggggcagcuggccaccaagcgcuaccggggcuggggccgccucuccgcgaagcugcugacccagaucgugaacgccaacgggcagcggaucauggaccuccugugggacaccacggacaacuucaugcgcaucguccacuucgaggacuucgacaagcugaucaccgaggccaaccagauggugcucgccgagaacgacgugcaggacgucaucaacgaccuguacaccagcccccagaacaagaaggcgcugcggcagauccuccugguggugaacgacauccagaaggccaugaagggccaggcccccgagcgcauccugaucgaguucgcccgcggggcccagaaggacaagucccucaccguccggcgcaagcggaagcuggacgagauguacagccagaucagcgacgcggugcuggccgacgaguccgugcgccaggagcucaagagcuccaaccaggacgaccuggucaaggagaagguguaccuguacuucaugcagggcgggcgggaccucuacaccggcaacgcccugaacaucgaccgccugagcgacuaccacguggaccacaucaucccccaggccuacaucaaggacgacucccucgacaacaaggcccuggucagcucccggaugaacgagaucaaggcggaccgcgugccgcuccaggugguccagaagcaguucggcaagaacauggccagcgaguggggguacaugcaccgggccggccugaucucccgcaagaaguacgacaaccugauguucaaccccgagaaccugaacaaguaccagaucaaccgguucaucagccgccagcucguggagacgcagcaggucaucaagcugguggccaaccugcucuccaaccaguacgagggggacaacgugaagaucaucaccgucaagagcaagcugacccagaccauccgguccgaguucgacuuccccaagaaccgcgaggugaacaacuaccaccacgccuucgacgcguaccugacggccuucgugggcauguaccuccugaagcgguaccccaagcugagcuccuacuucaccuacggggaguaccucaagggcaaccagcaggacaaguggagcuccuucaacuuccugaacgaccugaagcgcgccaagcucgaggacaagaccaacaaggagaucuucuggcacaaggagagcggccuggccuaccugaacaagaucuaccaguucaagaagauccucgugacccgggagguccacgagaacagcggggcgcuguucaaccagacgcuguacgccgccaaggacgacaaggccuccggccagggcgggaagcagcucaucccggccaagcaggcgcgccccaccgcccuguacggcggguacagcggcaagaccguggccuacaugugcaucgugcggaucaagaacaagaagggggaccuguacaaggucugcggcguggagaccuccuggcucgcccagcugaagcagcugaaggacgaggacagccagaaggccuuccucaagcagaagaucagcccccaguucacgaaggcgaagaagcagaaggggaccaucgugaaggucguggaggacuucgaggugaucgccccgcacauccugaucaaccagcgccuguucgacaacggccaggagcucacccugggcagcgccaccuacaagcacaacgagcaggagcugauccucgacaagacggccgucaagcugcugaacggggagcucccccuggcccaguccgaggagcuggcggagcucguguacgacgagauccuggaccaggugaugcacuacuucccccuguacgacaccaaccaguuccgggccaagcuccuggccggcaagaccgccuucaugcagcugcccuggaaguccaacccggacgacaacaagaccguccagaucacgcagcccaucgugcucaagaagauccugcaggggcugcacgccgacgcgggccgcgugucccucaaggagcuggggaugaccaccgacuucggcaugcugcagaaggccaccggcaucacguucacccccgacacccagaucaucuaccagagccccaccgggcuguucgagcgccgggucgcccugcgcgaccuguga

SEQ ID NO: 1946 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcuggggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucguggacagcaccgacaaggcggaccugcgccugaucuaccucgcccuggcccacaugaucaaguuccggggccacuuccugaucgagggggaccucaaccccgacaacuccgacguggacaagcuguucauccagcugguccagaccuacaaccagcuguucgaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgggugaacaccgagaucaccaaggccccgcuguccgccagcaugaucaagcgcuacgacgagcaccaccaggaccucacgcugcugaaggcccucguccggcagcagcugcccgagaaguacaaggagaucuucuucgaccagagcaagaacggguacgcgggcuacaucgacgggggcgccucccaggaggaguucuacaaguucaucaagccgauccuggagaagauggacggcaccgaggagcuccuggugaagcugaaccgcgaggaccugcuccggaagcagcgcaccuucgacaacgggagcaucccccaccagauccaccugggcgagcugcacgccauccuccgccggcaggaggacuucuaccccuuccugaaggacaaccgcgagaagaucgagaagauccugaccuuccggauccccuacuacguggggccgcucgcccgcggcaacucccgguucgccuggaugacgcgcaagagcgaggagaccaucacccccuggaacuucgaggaggucguggacaagggggcguccgcccagagcuucaucgagcggaugaccaacuucgacaagaaccugcccaacgagaaggugcugcccaagcacucccuccuguacgaguacuucacggucuacaacgagcugaccaaggugaaguacgugaccgagggcaugcgcaagccggccuuccucagcggcgagcagaagaaggccaucgucgaccugcuguucaagaccaaccggaaggugacggugaagcagcucaaggaggacuacuucaagaagaucgagugcuucgacuccgucgagaucagcgggguggaggaccgcuucaacgcgucccugggcaccuaccacgaccugcucaagaucaucaaggacaaggacuuccuggacaacgaggagaacgaggacauccuggaggacaucguccucacccugacccuguucgaggaccgggagaugaucgaggagcgccucaagacguacgcccaccuguucgacgacaaggugaugaagcagcugaagcggcgccgguacaccggguggggccgccucagccggaagcugaucaacgggauccgcgacaagcaguccggcaagaccauccuggacuuccucaagagcgacggcuucgccaaccggaacuucaugcagcugauccacgacgacucccugaccuucaaggaggacauccagaaggcccaggugagcgggcagggcgacucccuccacgagcacaucgccaaccuggcggggagccccgccaucaagaagggcauccugcagacggucaaggugguggacgagcucgucaaggugauggggcgccacaagcccgagaacaucgugaucgagauggcccgcgagaaccagaccacccagaagggccagaagaacucccgggagcgcaugaagcggaucgaggagggcaucaaggagcuggggagccagauccugaaggagcaccccgucgagaacacccagcuccagaacgagaagcuguaccuguacuaccuccagaacggccgcgacauguacguggaccaggagcuggacaucaaccggcugagcgacuacgacguggaccacaucgucccgcaguccuuccucaaggacgacagcaucgacaacaaggugcugacgcgcuccgacaagaaccggggcaagagcgacaacgugcccuccgaggaggucgugaagaagaugaagaacuacuggcgccagcugcucaacgccaagcugaucacccagcggaaguucgacaaccugaccaaggccgagcgcgggggccucagcgagcuggacaaggcgggguucaucaagcggcagcugguggagacccgccagaucaccaagcacgucgcccagauccucgacucccggaugaacacgaaguacgacgagaacgacaagcugauccgcgaggugaaggugaucacccucaagagcaagcucgucuccgacuuccggaaggacuuccaguucuacaaggugcgcgagaucaacaacuaccaccacgcccacgacgccuaccugaacgccguggucggcaccgcgcugaucaagaaguaccccaagcucgagagcgaguucguguacggggacuacaagguguacgacguccggaagaugaucgccaaguccgagcaggagaucggcaaggccaccgccaaguacuucuucuacagcaacaucaugaacuucuucaagacggagaucacccuggcgaacggggagauccgcaagcggccccugaucgagaccaacggcgagaccggcgagaucgugugggacaaggggcgcgacuucgccacggugcggaagguccucuccaugccccaggugaacaucgugaagaagaccgagguccagaccggcggguucagcaaggaguccauccugcccaagcgcaacagcgacaagcugaucgcccgcaagaaggacugggaccccaagaaguacggcggguucgacucccccaccguggccuacagcgugcucgucguggccaagguggagaagggcaagagcaagaagcugaaguccgucaaggagcugcucggcaucacgaucauggagcggagcuccuucgagaagaacccgaucgacuuccuggaggcgaagggguacaaggaggugaagaaggaccugaucaucaagcuccccaaguacagccuguucgagcuggagaacggccgcaagcggaugcucgccuccgccggggagcugcagaagggcaacgagcuggcccuccccagcaaguacgugaacuuccuguaccuggccucccacuacgagaagcucaaggggagcccggaggacaacgagcagaagcagcuguucgucgagcagcacaagcacuaccuggacgagaucaucgagcagaucuccgaguucagcaagcgcgugauccucgcggacgccaaccuggacaaggugcuguccgccuacaacaagcaccgggacaagcccauccgcgagcaggccgagaacaucauccaccucuucacccugaccaaccugggcgcccccgcggccuucaaguacuucgacaccacgaucgaccggaagcgcuacaccagcaccaaggagguccucgacgccacccugauccaccaguccaucacgggccuguacgagacccggaucgaccucagccagcucgggggcgacuga

SEQ ID NO: 1947 - RNA, 4107 nt, Artificial Sequence
  Cas9 variant
auggacaagaaguacagcaucggccuggacaucgggaccaacuccgugggcugggccgucaucaccgacgacuacaaggugcccagcaagaagcucaaggggcugggcaacacggaccgccacgggaucaagaagaaccugaucggcgcccuccuguucgacuccggcgagaccgcggaggccacccggcugaagcgcaccgcccggcgccgguacacgcgccggaagaaccgcaucugcuaccuccaggagaucuucagcaacgagauggccaagguggacgacuccuucuuccaccggcuggaggagagcuuccuggucgaggaggacaagaagcacgagcgccacccgaucuucgggaacaucguggacgagguggccuaccacgagaaguaccccaccaucuaccaccuccggaagaagcuggcggacuccaccgacaaggucgaccugcgccucaucuaccuggcccuggcccacaugaucaaguuccggggccacuuccucaucgagggggaccugaaccccgacaacagcgacguggacaagcuguucauccagcucgugcagaccuacaaccagcuguucgaggagaaccccaucaacgccucccgcgucgacgcgaaggccauccugagcgcccggcucuccaagagccgccggcuggagaaccugaucgcccagcucccgggcgagaagaagaacgggcuguucggcaaccugaucgcccucucccugggccugacgcccaacuucaagagcaacuucgaccucgcggaggacgccaagcugcagcuguccaaggacaccuacgacgacgaccucgacaaccugcuggcccagaucggggaccaguacgccgaccucuuccuggccgcgaagaaccugagcgacgccacccuccuguccgacauccugcgcgugaacagcgagaucaccaaggcgccccucuccgccagcaugaucaagcgguacgacgagcaccaccaggaccugacgcugcucaaggcccuggugcgccagcagcugcccgagaaguacaaggagaucuucuucgaccagagcaagaacggcuacgccggguacaucgacggcggcgccucccaggaggaguucuacaaguucaucaagccgauccucgagaagauggacgggaccgaggagcugcuggccaagcugaaccgggaggaccuccugcgcaagcagcgcaccuucgacaacggcagcauccccuaccagauccaccugggggagcuccacgccauccugcggcgccaggaggacuucuaccccuuccugaaggacaaccgggagaagaucgagaagauccucaccuuccgcauccccuacuacgucggcccgcuggcccgggggaacucccgcuucgcguggaugacgcgcaagagcgaggagaccaucacccccuggaacuucgaggaggugguggacaagggcgccuccgcccagagcuucaucgagcggaugaccaacuucgacaagaaccugcccaacgagaagguccuccccaagcacucccugcuguacgaguacuucacgguguacaacgagcucaccaaggugaaguacgucaccgagggcaugcggaagccggccuuccugagcggggagcagaagaaggcgaucguggaccugcuguucaagaccaaccgcaaggugacggucaagcagcugaaggaggacuacuucaagaagaucgagugcuucgacuccguggagaucagcggcguggaggaccgguucaacgccucccuggggaccuaccacgaccuccugaagaucaucaaggacaaggacuuccuggacaacgaggagaacgaggacauccucgaggacaucguccugacccugacccucuucgaggaccgcgagaugaucgaggagcggcugaagacguacgcccaccuguucgacgacaaggugaugaagcagcucaagcgccggcgcuacaccggcugggggcggcugagccgcaagcugaucaacggcauccgggacaagcaguccggcaagaccauccucgacuuccucaagagcgacggguucgccaaccgcaacuucaugcagcugauccacgacgacucccucaccuucaaggaggacauccagaaggcccaggucagcggccagggggacucccugcacgagcacaucgcgaaccuggccggcagccccgccaucaagaaggggauccuccagacggugaagguggucgacgagcuggugaaggugaugggccgccacaagcccgagaacaucgucaucgagauggcccgggagaaccagaccacccagaagggccagaagaacucccgcgagcggaugaagcgcaucgaggaggggaucaaggagcugggcagcgacauccucaaggaguaccccguggagaacacccagcugcagaacgagaagcuguaccucuacuaccugcagaacgggcgggacauguacguggaccaggagcuggacaucaaccgccucagcgacuacgacgucgaccacaucgugccgcaguccuuccugaaggacgacagcaucgacaacaaggugcugacgcgguccgacaagaaccgcggcaagagcgacaacguccccuccgaggagguggugaagaagaugaagaacuacuggcggcagcuccugaacgccaagcugaucacccagcgcaaguucgacaaccucaccaaggcggagcggggcgggcugagcgagcuggacaaggucggcuucaucaagcgccagcucguggagacccggcagaucaccaagcacguggcccagauccuggacucccgcaugaacacgaaguacgacgagaacgacaagcugauccgggagguccgcgugaucacccucaagagcaagcugguguccgacuuccggaaggacuuccaguucuacaagguccgcgagaucaacaacuaccaccacgcccacgacgccuaccugaacgccgugguggggaccgcgcucaucaagaaguaccccaagcuggagagcgaguucgucuacggcgacuacaagguguacgacgugcggaagaugaucgccaaguccgagcaggagaucgggaaggccaccgccaaguacuucuucuacagcaacaucaugaacuucuucaagacggagaucacccuggcgaacggcgagauccgcaagcggccccucaucgagaccaacggcgagaccggggagaucgucugggacaagggccgcgacuucgccacggugcgcaaggugcuguccaugccgcaggucaacaucgugaagaagaccgaggugcagaccgggggcuucagcaaggaguccauccugcccaagcggaacagcgacaagcucaucgcccgcaagaaggacugggaccccaagaaguacgggggcuucgacucccccaccgucgccuacagcgugcugguggucgccaagguggagaagggcaagagcaagaagcugaaguccgugaaggagcuccuggggaucacgaucauggagcggagcuccuucgagaaggacccgaucgacuuccuggaggcgaagggcuacaaggagguccgcaaggaccucaucaucaagcugcccaaguacagccuguucgagcucgagaacgggcggaagcgcaugcuggccuccgccggcgagcugcagaaggggaacgagcucgcccugcccagcaaguacgugaacuuccuguaccucgccucccacuacgagaagcugaagggcagcccggaggacaacgagcagaagcagcuguucguggagcagcacaagcacuaccucgacgagaucaucgagcagaucuccgaguucagcaagcgggucauccuggcggacgccaaccuggacaaggugcucuccgccuacaacaagcaccgcgacaagcccauccgggagcaggccgagaacaucauccaccuguucacccugaccaaccucggcgcccccgcggccuucaaguacuucgacaccacgaucgaccgcaagcgguacaccagcaccaaggaggugcuggacgccacccugauccaccaguccaucacggggcucuacgagacccgcaucgaccugagccagcugggcggggacuga

SEQ ID NO: 1948 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccuccucuucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucgcggacagcaccgacaaggccgaccugcgccugaucuaccucgcccuggcccacaugaucaaguuccggggccacuuccugaucgagggggaccucaaccccgacaacuccgacguggacaagcuguucauccagcuggugcagaccuacaaccagcuguucgaggagaaccccaucaacgcgagccgcgucgacgccaaggccauccuguccgcccggcugagcaagucccgccggcucgagaaccugaucgcccagcugccgggcgagaagcgcaacgggcuguucggcaaccugaucgcgcugagccucgggcugacgcccaacuucaaguccaacuucgaccuggccgaggacgccaagcuccagcugagcaaggacaccuacgacgacgaccuggacaaccuccuggcccagaucggcgaccaguacgccgaccuguuccucgcggccaagaaccuguccgacgccauccugcucagcgacauccugcgggugaacuccgagaucaccaaggccccgcugagcgccagcaugaucaagcgcuacgacgagcaccaccaggaccucacccugcugaaggcgcucgugcggcagcagcugcccgagaaguacaaggagaucuucuucgaccaguccaagaacggcuacgccggguacaucgacggcggggccagccaggaggaguucuacaaguucaucaagccgauccuggagaagauggacggcacggaggagcuccuggccaagcugaaccgcgaggaccugcuccgcaagcagcggaccuucgacaacggcuccaucccccaccagauccaccugggggagcugcacgccauccuccgccggcaggaggacuucuaccccuuccugaaggacaaccgcgagaagaucgagaagauccugaccuuccggauccccuacuacgucggcccgcucgcgcgcgggaacagccgguucgccuggaugacccgcaaguccgaggagacgaucacccccuggaacuucgaggaggugguggacaagggcgccagcgcccaguccuucaucgagcggaugaccaacuucgacaagaaccugcccaacgagaagguccugcccaagcacagccuccuguacgaguacuucaccguguacaacgagcugacgaaggugaaguacgucaccgaggggaugcgcaagccggaguuccucuccggcgagcagaagaaggcgaucguggaccugcuguucaagaccaaccggaaggugaccgucaagcagcucaaggaggacuacuucaagaagaucgagugcuucgacagcguggagaucuccggcguggaggaccgcuucaacgccagccuggggacguaccacgaccugcucaagaucaucaaggacaaggacuuccuggacaacgaggagaacgaggacauccuggaggacaucguccucacccugacccuguucgaggaccgggagaugaucgaggagcgccucaagaccuacgcccaccuguucgacgacaaggugaugaagcagcugaagcggcgccgguacacgggcugggggcgccucucccggaagcugaucaacggcauccgcgacaagcagagcgggaagaccauccuggacuuccucaaguccgacggcuucgccaaccgcaacuucaugcagcugauccacgacgacagccugaccuucaaggaggacauccagaaggcccaggucuccggccagggggacagccuccacgagcacaucgcgaaccuggccggcucccccgccaucaagaaggggauccugcagaccgugaagguggucgacgagcucgugaaggugaugggccggcacaagcccgagaacaucgucaucgagauggcccgcgagaaccagacgacccagaaggggcagaagaacagccgggagcgcaugaagcggaucgaggagggcaucaaggagcugggcagcgacauccugaaggaguaccccguggagaacacccagcuccagaacgagaagcuguaccuguacuaccuccagaacgggcgcgacauguacguggaccaggagcuggacaucaaccggcuguccgacuacgacgucgaccacaucgugccgcagagcuucaucaaggacgacuccaucgacaacaaggugcucacccgcagcgacaagaaccggggcaaguccgacaacguccccagcgaggagguggugaagaagaugaagaacuacuggaagcagcugcugaacgccaagcucaucacgcagcgcaaguucgacaaccugaccaaggcggagcgcgggggccuguccgagcucgacaaggccggcuucaucaagcggcagcuggucgagacccggcagaucaccaagcacguggcccagauccuggacagccgcaugaacaccaaguacgacgagaacgacaagcucauccgggaggugaaggucaucacgcugaaguccaagcuggugagcgacuuccgcaaggacuuccaguucuacaaggugcgggagaucaacaacuaccaccacgcccacgacgccuaccucaacgcggucguggggaccgcccugaucaagaaguaccccaagcuggaguccgaguucguguacggcgacuacaaggucuacgacgugcgcaagaugaucgccaagagcgagcaggagaucgggaaggccaccgcgaaguacuucuucuacuccaacaucaugaacuucuucaagaccgagaucacgcucgccaacggcgagauccggaagcgcccccugaucgagaccaacggggagaccggcgagaucgugugggacaagggccgggacuucgccaccguccgcaaggugcugagcaugccccaggugaacaucgucaagaagacggaggugcagaccgggggcuucuccaaggagagcauccuccccaagcgcaacuccgacaagcugaucgcccggaagaaggacugggaccccaagaaguacgggggcuucgacagccccaccguggccuacagcguccuggugguggcgaaggucgagaaggggaaguccaagaagcucaagagcgugaaggagcugcugggcaucaccaucauggagcgcuccagcuucgagaagaacccgaucgacuuccucgaggccaagggcuacaaggaggugcggaaggaccugaucaucaagcugcccaaguacucccucuucgagcuggagaacgggcgcaagcggaugcuggccagcgccggcgagcuccagaaggggaacgagcuggcccugcccuccaaguacgucaacuuccucuaccuggcgagccacuacgagaagcugaagggcuccccggaggacaacgagcagaagcagcuguucguggagcagcacaagcacuaccuggacgagaucaucgagcagaucagcgaguucuccaagcgcgugauccuggccgacgccaaccucgacaagguccugagcgccuacaacaagcaccgggacaagcccauccgcgagcaggccgagaacaucauccaccuguucacgcucaccaacuucggggcgcccgccgccuucaucuacuucgacaccaccaucggccggaaccgcuacaaguccaucaaggaggugcuggacgccacgcugauccaccagagcaucaccggccucuacgagacccggaucgaccugucccagcucgggggcgacuga

SEQ ID NO: 1949 - RNA, 4107 nt, Artificial Sequence
  Cas9 variant
augaaguacgagagcgaggaguacuacaucggccuggacauggggaccuccagcgugggcugggccgucaccgacccccacuaccaccucauccgcaagaaggggaaggaccuguggggcgcccggcuguucgagaaggcgaacacggcccaggagcgccggaccaaccgcaucaaccggcgccggaaccagcgccggaagcagcgcaucgccuucauccgggaggccuuccgcaaggagguggagaagguggacgucaacuucuuccggcgccucgacgagucccagcuguaccuggaggacaagagcaucaaggagccguaccuccuguucaacgaccugaacuacaccgacaaggacuucuaccaccaguaccccaccguguuccaccucaucacggaccugcugaccuccgaccggaaguucgacauccgcgagaucuacaucgccgugagcucccucuacaaccaccgggggaacuuccugaacaagagccugggcaacgagacccaggacgaggaccucgucuucaagaaccuggacgaggcguucuccgccugcggcaugaacuggaacaccaaggccgagaacaucgagguggugaagcagauccugugcgaccgcagccucaacaagaaggagaagcaggaccagcuggcccacugccuggagaucaacaagaagacggagaaggagaagaucgaguuccucaagcugcugaccgggggcaaggcggacuccaagaagauguucccccaguaccacuacgagcgggacgagaagcucagcuucgccuucgccgacgagaacggggacgagaacugggaggagacccugaacgccaucgaggagcgccugaccuccgacgaguacggccucauccuggcccucaagagcgucuacgacugguccauccucgcggaccugaugaagaacgagaagacgggggagaccuaccccuaccugagcauggcccggaaggacuccuacgagaagcacaaggccgaccuccgccugcucaagagcgugaucaagcgccucaucccgaacgaguacaaccacuucuuccggcaguacgacggcaagggcaagaccuacaccaacuacaucggguccgugcaguaccacgagaagcgccaccgguucaagcacaucacgaccaaggaguucuacgacggccugaagaagcugcucaagcccuacagcgaggacgaggagaucaagcagauccugcaggacaucgagagcgagaccuuccugcccaagcagaucaccaacaugaacggggucauccccaaccaggugcacgccaaggagcucaaggugauccuggagaaggccucccagcacuacgacuuccugaacgagacgaacgagagcggccucaccgucaaggagcagaucaugcagauguucaccuuccagaucccguacuacgugggcccccuggcgaaccugaacgggaagggcaacgggugggccgugcgcuacgucggcaaggagcggaccaagguguaccccuggaacauggacgaggugaucgacgagaaggagacggccgaccaguucaucaagcgcaugaucuccacgugcaccuaccucggggacgaguacguccugcccaagagcuccauccuguacgagaaguucgccgugcugaacgagcucaacagccugaagaucaacggccagccgguguccgucgaccugaagcagaagaucuaccgggaccucuucaccaagggcaagcgcgugacccagaaggggcugcugcucuaccugaagcgggagggcgucaucagcaaguccgaggagaccauccugagcggguucgacaucgacuucaagaacacccucuccagcuaccgcaaguucugcgagguguucgccaccaacgagcugaacgacgagcagauccggauggcggaggacaucaucgaguggcugacgguguucggcgacuccaagaaguucguccgcgagaagauccacgggaacuacccccagaucaccgccaaccagcucaagcggauccugagcuucaacuucaaggacuggggcaagcuguccaagcaguuccucgagcuggagggcgaggaccgcgagaccggcaagagcugcucccugauccaggcccucugggacaccaacaacaaccugaaccagcugcucagcucccgguucacguacaaggagaaccuggagaagaagcgcaagaagaucgagauggaccuguucgaguucacccacgaggaccucgacgaccuguacaucagcgcccccgugaagcggaugaucuggcaggcccugaagaucaugaaggacaucgugaucgucaugaaggagagccccaccaagcuguucaucgagaugacccgcaacaacgagaacgagaagacccggacggugucccgcaagaacaagcugguggaccuguacaagaagaucaagggggagagccgcgacuggaucaaggagcucgagcgguacgaggagaaggacuuccgcuccaagaagcuguaccuguacuacacccagaugggcaagagcgcguacuccggggagccgaucgacauggacaagcuguucgacaagaacgucuacgacaucgaccacaucuaccccaagagcaaggugaaggacgacucccugcugaacaacugcgugcucgucaagcggaaggagaacauggacaaggggaacaacuuccccaucgaccccgacauccagaccaagcaggagcaccuguggaaguucuggcuggagaagggccucaucacccaggagaaguucaaccgccugacgcggaagaagccguucaccaacgacgagcuggccgacuucgugaaccgccagcucguggagaccggccaggccaccaagacgaucgccgaccuguucaagaugaccuuccccaacagcgacaucgucuacgugaaggcggggaacgugaccgacuuccggcaguacaucgaggucuacaagugccgcgaggugaacaaccugcaccacgccuacgacgccuaccucaacguggucgugggcaacguguacgacaccaaguucacgaagaaccccaugaacuacaucaaggagcagcggaaggagaacuccaacgagcgcuaccacauggacaagaucuucgaguuccccgucauccggaacgggaaggaggccuggaucaccaagaaggacgagagcaucaacaucgugcgcaagacccuggcccggaagaccccgcuggugacgaagcgcaacuucgaggcgaacggcaccaucgccaaggccaccaucuaccccaagggcaacgucaaggaccagggguaccucccccggaagaccuccauccccgcccugcgcgacaugaagaaguacggcggggugacgagcauccagaucgccuacuucuuccugguggagcacgaggucaagaagaagcggauccgcaccaucgagugcgugccgaucuaccggaaggaggagcucaagaccaaggagcagcuggagcgcuacugccgggaggagcugaagcucaucaaccccuccauccgccuggagaagaucaagcccuacagccugcucaagaugaacggcaacuucuucuacaucaccgggaagacgaacgaccgcuucucccuggcgaacgccauggagcuguacguggacaaggucagcgagaaccacauccgggaccucgugaaguacaagaacugcggcuacuucaacguggacgacaaggaggcccgcaagcggaacgagcgccuguacaccauccugaccaagaagcaccucaccgucuucaagggcuccccgaagcccaugggggagaagcugcagcaguaccagcagcuguuccucgagcuggaggugagcaagcaggucuacgugcugcuccagauccugcagcugacggccaccaacgugaagaccaaggccgaccucaccgcgaucggcgggaaggccaacgagggcacgauggacaucagcaagaaccuggagaacgugaucaagaaccagaucaagaaggggcugguccccgagcucaugcugaucaaccagucccccaccggccuguucgagagcgagaucgaccuccugaccaucuga

SEQ ID NO: 1950 - RNA, 4107 nt, Artificial Sequence
  Cas9 variant
augagccgccccuacaacaucggccuggacaucgggaccuccagcaucggcugguccguggucgacgaccagagcaagcucguguccgugcgggggaaguacggcuacgggguccgccuguacgacgagggccagaccgccgccgagcggcgcagcuuccggacgacccgccggcgccugaagcggcgcaaguggcggcucggccugcugcgcgagaucuucgagccguacaucacccccguggacgacaccuucuuccuccggaagaagcaguccaaccugagccccaaggaccagcgcaagcuguacccccagacgucccucuucaacgaccggaccgaccgcgcguucuacgacgacuacccgaccaucuaccaccuccgguacaagcugaugaccgagaagcgccaguucgacauccgggagaucuaccuggccaugcaccacaucgugaaguaccgcgggcacuuccugaacgaggcccccgucagcuccuucaagagcuccgagaucaaccugguggcccacuucgaccggcucaacacgaucuucgccgaccuguucagcgaguccggcuuccagcuggagaccgacaagcucgcggaggugaaggcccugcugcucgacaaccaccagagcgccuccaaccgccagcgccaggcccugcugcucaucuacacccccagcaccaacaaggcggucgagaagcagaacaaggccaucgccacggagcugcugaaggccauccucgggcugaaggccaaguucaacgugcugaccggcaucgaggcggaggacgugaagaccuggacccucacguucaacgccgagaacuucgacgaggagauggucaagcuggaguccagccuggacgacaacgcccaccagaucaucgagagccuccaggagcuguacuccggggugcugcucgccggcaucgugcccgagaaccagagccugucccaggccaugaucaccaaguacgacgaccaccagaagcaccugaagaugcucaaggcgguccgggaggcccuggccccggaggaccgccagcggcugaagcaggccuacgaccaguacguggacggccaggagaacaccaaggccuacagcaaggaggacuucuacggggacaucaccaaggcgcucaagaacaaccccgaccaccccaucguguccgagaucaagaagcugaucgagcuggaccaguucaugcccaagcagcgcacgaaggacaacggcgccaucccgcaccagcuccaccagcaggagcuggaccggaucaucgagaaccagcagcaguacuaccccuggcuggccgagcucaaccccaacagcaagcgccagaccgucgccaaguacaagcuggacgagcugguggccuuccgggugcccuacuacgucgggccgcugaucaccgcggagcagcagcagcaguccagcgacgccaaguucgccuggaugauccgcaaggccgagggccagaucacccccuggaacuucgacgacaagguggaccggcaggcguccgccaacgaguucaucaagcgcaugacgaccaccgacaccuaccuccuggccgaggacgugcugcccaagcagagccucaucuaccagcgguucgagguccugaacgagcugaacggccucaagaucgacgaccagcccaucacgaccgagcugaagcaggccaucuucaccgaccuguucaugcagaagaccuccgugacggucaagaacauccaggacuaccucgugagcgagaagcgcuacgccucccggccggcgaucaccgggcugagcgacgagaacaaguucaacucccgccugagcaccuaccacgaccucaagaccaucgugggcgacgccgucgacgacguggacaagcaggccgaccuggagaagugcaucgagugguccacgaucuucgaggacgggaagaucuacagcgccaagcugaacgagaucgacuggcucaccgaccagcagcgggugcagcuggccgcgaagcgcuaccggggcugggggcgccuguccgccaagcuccugacccagaucgucaacgccaacggccagcggaucauggaccugcucugggacaccaccgacaacuucaugcgcaucgugcacagcgaggacuucgacaagcugaucacggaggccaaccagaugaugcuggccgagaacgacgugcaggacgucaucaacgaccucuacaccagcccccagaacaagaaggcgcugcgccagauccugcucguggugaacgacauccagaaggccaugaagggccaggcccccgagcggauccugaucgaguucgcccgcgaggacgaggucaacccccggcuguccgugcagcgcaagcgccagguggagcaggucuaccagaacaucagcaacgagcuccugaacaacaccgagauccggaacgagcugaaggaccucuccaacagcgcgcuguccaacacccggcuguuccucuacuucaugcagggcgggcgcgacauguacacgggggacagccugaacaucgaccggcuguccaccuacgacaucgaccacauccucccgcagagcuucaucaaggacaacucccuggacaaccgcgugcuggugagccagcggaugaaccgcuccaaggccgaccagguccccaccgacuucaccagcguggagcucggccagaagaugcagauccagugggagcagaugcugcgggccgggcugaucacgaagaagaaguacgacaaccucacccugaaccccgaccacaucuccaaguacgccaugaagggcuucaucaaccgccagcugguggagacccggcaggucaucaagcucgccaccaaccugcugauggagcaguacggcgaggacaacaucgagcucaucacggugaaguccgggcugacccaccagaugcgcaccgaguucgacuuccccaagaaccggaaccugaacaaccaccaccacgcguucgacgccuaccucaccgccuucgugggccuguaccugcucaagcgcuacccgaagcugaagcccuacuucgucuacggggaguaccagaaggccucccagcaggacaaguggcggaacuucaacuuccugaacggccucaagaaggacgagcugguggacgagaacacggaggccgugaucuggaacaaggagagcgggcuggcguaccucaacaagaucuaccaguucaagaagauccuggucacccgcgaggugcacgagaacuccggcgcccuguucaaccagacccucuacgccgccaaggacgacaaggccagcggccagggcgggaagcagcugauccccgcgaagcaggaccggccgaccgcccuguacgggggcuacagcggcaagacgguggccuacaugugcaucguccgcaucaagaacaagaagggggaccucuacaaggugugcggcguggagaccuccuggcuggcccagcugaagcagcucaccgacgaggacagcaagaaggcguuccugaagcagaagaucagcccccaguucaccaaggucaagaagcagaaggggacgaucgugaagguggucgaggacuucgaggugaucgcgccccacauccugaucaaccagcgcuucuucgacaacggccaggagcucacccuggggagcgccaccuacaagcacaacgagcaggagcugauccucgacaagaccgccgugaagcugcugaacggcgcccucccccugacgcaguccgaggagcuggccgagcaggucuacgacgagauccucgaccaggugaugcacuacuucccgcuguacgacaccaaccaguuccgggccaagcugagcgccggcaaggccgccuucaugaagcuccccuggaagucccagugggacgggaacaagauggugcaggucggccagcaggucauccuggaccgcgugcugaucgggcuccacgcgaacgccgccgugagcgaccugggcgugcugaagaucuccacgccccucgggaagaugcagcagcccagcggcaucucccugagcccggacacccagaucaucuaccagucccccaccggccuguucgagcggcgcguggcccugcgggaccucuga

SEQ ID NO: 1951 - RNA, 4107 nt, Artificial Sequence
  Cas9 variant
augagccgccccuacaacaucggccuggacaucgggaccuccagcaucggcugguccguggucgacgaccagagcaagcucguguccgugcgggggaaguacggcuacgggguccgccuguacgacgagggccagaccgccgccgagcggcgcagcuuccggacgacccgccggcgccugaagcggcgcaaguggcggcucggccugcugcgcgagaucuucgagccguacaucacccccguggacgacaccuucuuccuccggcagaagcaguccaaccugagccccaaggaccagcgcaagcuguacccccagacgucccucuucaacgaccggaccgaccgcgcguucuacgacgacuacccgaccaucuaccaccuccgguacaagcugaugaccgagaagcgccaguucgacauccgggagaucuaccuggccaugcaccacaucgugaaguaccgcgggcacuuccugaacgaggcccccgucagcuccuucaagagcuccgagaucaaccugguggcccacuucgaccggcucaacacgaucuucgccgaccuguucagcgaguccggcuuccagcuggagaccgacaagcucgcggaggugaaggcccugcugcucgacaaccagcagagcgccuccaaccgccagcgccaggcccugagccugaucuacacccccuccaccaacaaggcggucgagaagcagaacaaggccaucgccacggagcuccugaaggccauccuggggcucaaggccaaguucaacgugcugacccggaucgaggcggaggacgugaaggccuggacccugaccuucaacgccgagaacuucgacgaggagauggucaagcucgagagcagccuggacgacaacgcccaccagaucaucgagucccugcaggagcucuacagcggcauccugcuggccgggaucgugcccgagaaccagucccucagccaggcgaugaucaugaaguacgacgaccaccagaagcaccugaagaugcugaaggccgugcgcgaggcccucgccccggaggaccggcagcgccugaagcaggccuacgaccaguacgucgacggccaggagaacacgaaggcguacuccaaggaggacuucuacggcgacaucaccaaggcccugaagaacaaccccgaccaccccaucgugagcgagaucaagaagcucaucgagcuggaccaguucaugcccaagcagcggaccaaggacaacggggccaucccgcaccagcugcaccagcaggagcucgaccgcaucaucgagaaccagcagcaguacuaccccuggcuggccgagcugaaccccaacuccaagcggcagaccguggccaaguacaagcucgacgagcuggucgcguuccgcgugcccuacuacgugggcccgcugaucacggccgagcagcagcggcagagcuccgacgccaaguucgccuggcugauccgcaaggcggaggggcggaucacccccuggaacuucgacgacaaggucgaccgccaggccagcgccaacgaguucaucaagcggaugaccaccacggacaccuaccuccuggccgaggacgugcugcccaagcagucccucaucuaccagcgcuucgaggugcugaacgagcugaacggccucaagaucgacgaccagcccaucaccaccgagcugaagcaggccaucuucacggaccuguucaugcagaagaccagcgucuccgugaagaacauccaggacuaccucgucagcgagaagcgguacgcgucccgcccggccaucaccggccugagcgacgagaacaaguucaacucccggcugagcaccuaccacgaccucaaggccaucgugggggacgccguggaggacgucgacaagcaggucgaccuggagaagugcguggagugguccacgaucuucgaggacggcaagaucuacagcgccaagcugaacgagaucgacuggcucaccgaccagcagcgcgugcagcuggcggccaagcgguaccgcggguggggccgccugagcgccaagcuccugacccagaucgugaacgccaacgggcagcggaucauggaccugcucugggacaccacggacaacuucaugcgcaucgugcacuccgaggacuucgacaagcugaucaccgaggccaaccagaugaugcuggcggagaacgacguccaggacgugaucaacgaccucuacaccagcccccagaacaagaaggcccugcggcagauccugcucguggucaacgacauccagaaggccaugaagggccaggcccccgagcgcauccugaucgaguucgcgcgggaggacgaggugaacccccgccuguccgugcagcggaagcgccaggucgagcaggucuaccagaacaucagcaacgagcuccugaacaacaccgagauccggaacgagcugaaggaccucuccaacagcgcccuguccaacacccgccuguuccucuacuucaugcagggcgggcgggacauguacacgggcgacagccugaacaucgaccgccuguccaccuacgacaucgaccacauccucccgcagagcuucaucaaggacaacucccuggacaaccgggugcuggugagccagaagaugaaccgcuccaaggccgaccaggugcccaccgacuucaccagcguggagcucgggaagaagaugcagcugcagugggagcagaugcugcgggccggccucaucacgaagaagaaguacgacaaccugacccugaaccccgaccacaucuccaaguacgccaugaagggguucaucaaccgccagcucgucgagacccgccaggugaucaagcuggcgaccaaccugcucauggagcaguacggcgaggacaacaucgagcugaucacggugaaguccggccugacccaccagaugcggaccgaguucgacuuccccaagaaccggaaccucaacaaccaccaccacgccuucgacgccuaccugaccgccuucgucgggcuguaccuccugaagcgcuacccgaagcugaagcccuacuucguguacggcgaguaccagaaggccucccagcaggacaaguggcggaacuucaacuuccucaacgggcugaagaaggacgagcugguggacgagaacacggaggcggucaucugggacaaggagagcggccucgccuaccugaacaagaucuaccaguucaagaagauccuggugacccgcgaggugcacgagaacagcggggcccucuucaaccagacccuguacgccgccaaggacgacaaggcguccggccagggcgggaagcagcugauccccgccaagcaggaccgcccgaccgcccucuacggcggguacagcggcaagacggucgccuacaugugcaucgugcggaucaagaacaagaagggcgaccuguacaaggugugcggggucgagaccuccuggcuggcgcagcucaagcagcugaccgacgaggacagccagaaggccuuccugaagcagaagaucagcccccaguucaccaaggugaagaagcagaagggcacgaucgugaaggucguggaggacuucaaggugaucgcgccccacauccucaucaaccagcgcuucuucgacaacgggcaggagcugacccugggcagcgccaccuacaagcacaacgagcaggagcucauccuggacaagaccgccgucaagcugcucaacggggcccugccccugacgcaguccgaggagcucgccgagcaggucuacgacgagauccuggaccaggugaugcacuacuucccgcuguacgacaccaaccaguuccgggccaagcucagcgccggcaaggccgcguucaugaagcugcccuggaaguccaucugggacggcaacaagaugacccagaucgggcagcagaucauccuggaccgcauccucaucggccugcacgccaacgccgccgugagcgaccugggggugcucaagaucuccacgccccugggcaagaugcagcagcccagcgggaucucccugagcccggacacccagaucaucuaccagucccccaccggccuguucgagcggcgcguggcccuccgggaccuguga

SEQ ID NO: 1952 - RNA, 4107 nt, Artificial Sequence
  Cas9 variant
augguggagaagaaguccuacagcaucggccuggacaucgggaccaacagcgucggcugggccgugaucaccgacgacuacaaggugcccgccaagaagaugaagguccucgggaacacgucccgccagagcaucaagaagaacaugaucggcgcgcugcuguucgacgagggcgggccggccgccuccacccgggugaagcgcaccacccggcgccgguacacgcgccggaagaaccgccucugcuaccugcgggacaucuucgagagcgagaugcacaccaucgacaagcacuucuuccugcgccucgaggacuccuuccugcacaagagcgacaagcgguacgaggcccaccccaucuucggcacccugcaggaggagaaggccuaccacgacaacuaccccaccaucuaccaccuccgcaaggcgcuggccgacaacacggagaaggccgaccugcggcucaucuaccuggcccuggcgcacaucaucaaguuccgcgggcacuuccucaucgagggcgcccuguccgccaacaacaccgacgugcagcagcugguccacgcccucguggacgccuacaacaucauguucgaggaggaccagcuggacaucgaggcgaucgacgugaaggccauccugaccgagaagaucagcaagacccggcgccucgagaaccugaucuccaacauccccgggcagaagaagaacggccuguucgggaaccucaucgcccugagccugggccucacgccgaacuucaagucccacuucaaccugcccgaggacgccaagcugcagcucgccaaggacaccuacgacgaggagcugaacaaccugcucacccagaucggcgacgaguacgcggaccuguuccugagcgccaagaaccucuccgacgccauccugcugagcgacauccucaccgucaacggggacggcacgcaggcgccccuguccgccagccugaucaagcgguacgaggagcaccgccaggaccucgcccugcugaagcagauguucaaggagcagcuccccgaccuguaccgggacguguucaccgacgagaacaaggacggguacgccggcuacaucuccggcaagaccagccaggaggccuucuacaaguacaucaagccgauccuggagacccucgacggggccgaggacuuccugacgaagaucaaccgcgaggacuuccugcggaagcagcgcaccuucgacaacggcagcaucccccaccagauccaccugggggagcuccaggccauccuggagcgccagcaggcguacuaccccuuccugaaggacaaccaggagaagaucgagaagauccucaccuuccggauccccuacuacaucggcccgcuggcccgcgggaacucccgguucgccuggcugacccgcacgagcgaccagaagaucacccccuggaacuucgacgagaugguggaccaggaggccuccgcgcaggccuucaucgagcggaugaccaacuucgacgaguaccucccccaggagaagguccugcccaagcacagccugaccuacgaguacuucacgguguacaacgagcucaccaaggugaaguacgucaccgagggcaugaccaagccggaguuccuguccgccggccagaaggagcagaucguggagcuccuguucaagaaguaccgcaaggugacggucaagcagcugaaggaggacuucuucagcaagaucgagugcuucgacaccguggacaucuccgggguggaggacaaguucaacgccagccugggcaccuaccacgaccuccugaagaucaucaaggacaaggccuuccuggacaacuccgagaacgagaacaucaucgaggacaucauccucacccugacgcuguucgaggacaaggagaugaucgcgaaccggcucgccgucuacgaggaccuguucgaccagaacgugcugaagcagcucaagcgccggcacuacaccggguggggccgccugagcaagcagcugaucaacgggaugcgggacaagcacaccggcaagaccauccucgacuuccugaaggccgacggcuucaucaaccgcaacuucaugcagcugaucaacgacgacaaccucuccuucaaggaggagaucaagaaggcccaggagggcgggcugaaggacagcaucaacgaccagauccgggaccuggccgggucccccgcgaucaagaagggcauccuccagaccaucaacaucguggacgagaucgucaagaucauggggaaggcgccccagcacaucguggucgagauggcccgcgacgugcagaagacggacaucggcgugaagcagagccgggagcgcaugaagcggguccaggaggugcugaagaagcugggcucccagcuccugaaggagcaccccguggagaacuuccagcugcagaacgagcgccucuaccuguacuaccugcagaacgggaaggacauguacaccggcgaggagcucagcaucuccaaccugagccacuacgacaucgaccacaucaucccgcgguccuucaucaaggacgacagcaucgacaacaagguccugacccgcagcgagcacaaccgcgggaagaccgacaacgugcccuccaucgagguggucaagcggaugaagcccuacuggcagaagcuccuggacacgaaggugaucagccagcgcaaguucgacaaccugaccaaggccgagcggggcggccuccaggaguccgacaaggccaacuucauccagcgccagcugguggagacccggcagaucaccaagcacgucgcccagauccuggacagccgcuucaacacggagcgggacgagaaggaccgccccauccggcgcgugaaggugaucacccucaaguccaaguucgucagcgacuuccggcaggacuucggguucuacaagcugcgcgagaucaacgacuaccaccacgcccacgacgccuaccugaacgccguggugggcaccgcgcuccugaagauguacccgaagcuggccuccgaguucgucuacggggacuaccagaaguacgaccucaagcggauggugggcaagagcgggaaggccuccggccacgccaccgccaaguacuucuucuacagcaaccugaugaacuucuucaaguccgaggugaagcuggcgaacggcaacaucaucaagcgcagccccaucgaggucaacgaggagacgggggagaucgugugggacaagaccaaggacuucggcaccgugcggaagguccucuccgcgccccaggugaacaucgugaagaagaccgagauccagaccgggggcuucagcaacgagacgauccuguccaagggcaagagcuccaagcugaucccccgcaagaacaaguggcgggacaccaccaaguacgggggcuucaacacgccgaccgucgccuacagcgugcucguggucgccaagguggagaaggggaaggccaagaagcugaagcccgugaaggagcuggucggcaucaccaucauggagcgcaccaaguucgaggccaaccccaucgccuuccucgagagcaagggguaccacgacauccaggagcaccugaugaucacgcugccgaaguacucccucuucgagcuggagaacggccggcgccggcugcucgccagcgccaccgagcugcagaaggggaacgagauggugcugccccagcaccucgugaccuuccuguaccgcgucuccaagcgcgacaagggcacccagagcgagaacauggaguacaucuccaaccacaaggagaaguucaucgagaucuuccacuacaucauccgguacgccgagaagaacgugaucaagcccaaggugaucgagcgccugaacgacacguucaaccagaaguucaacgacagcgaccucaccgagcuguccaucagcuuccugaaccucuucaaguucaccuccuucggcgcgcccgagaaguucaccuuccugaacagcgagaucaagcaggacgacguccgguaccgcuccacgaaggagugccugaacagcacccucauccaccaguccgugaccgggcuguacgagacccggaucgaccugagccaguucggcggggacuga

SEQ ID NO: 1953 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagaucgccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucgcggacagcaccgacaaggccgaccugcgccugaucuaccucgcccuggcccacaugaucaaguuccggggccacuuccugaucgagggggaccucaaccccgacaacuccgacguggacaagcuguucauccagcuggugcagaccuacaaccagcuguucgaggagaaccccaucaacgcgagccgcgucgacgccaaggccauccuguccgcccggcugagcaagucccgccggcucgagaaccugaucgcccagcugccgggcgagaagcgcaacggccucuucgggaaccugaucgcgcugagccucgggcugacgcccaacuucaaguccaacuucgaccuggccgaggacgccaagcuccagcugagcaaggacaccuacgacgacgaccuggacaaccuccuggcccagaucggcgaccaguacgccgaccuguuccucgcggccaagaaccuguccgacgccauccugcucagcgacauccugcgggugaacaccgagaucaccaaggccccgcuguccgccagcaugaucaagcgcuacgacgagcaccaccaggaccucacgcugcugaaggcgcucgugcggcagcagcugcccgagaaguacaaggagaucuucuucgaccagagcaagaacggcuacgccggguacaucgacggcggggccucccaggaggaguucuacaaguucaucaagccgauccuggagaagauggacggcaccgaggagcuccuggccaagcugaaccgcgaggaccugcuccgcaagcagcggaccuucgacaacggcagcaucccccaccagauccaccugggggagcugcacgccauccuccgccggcaggaggacuucuaccccuuccugaaggacaaccgcgagaagaucgagaagauccugaccuuccggauccccuacuacgucggcccgcucgcgcgcgggaacucccgguucgccuggaugacgcgcaagagcgaggagaccaucacccccuggaacuucgaggaggugguggacaagggcgccuccgcccagagcuucaucgagcggaugaccaacuucgacaagaaccugcccaacgagaagguccugcccaagcacucccuccuguacgaguacuucacgguguacaacgagcugaccaaggugaaguacgucaccgaggggaugcgcaagccggcguuccucagcggcgagcagaagaaggccaucguggaccugcuguucaagaccaaccggaaggugacggucaagcagcucaaggaggacuacuucaagaagaucgagugcuucgacuccguggagaucagcggcguggaggaccgcuucaacgccucccuggggaccuaccacgaccugcucaagaucaucaaggacaaggacuuccuggacaacgaggagaacgaggacauccuggaggacaucguccucacccugacccuguucgaggaccgggagaugaucgaggagcgccucaagacguacgcccaccuguucgacgacaaggugaugaagcagcugaagcggcgccgguacaccggcugggggcgccucagccggaagcugaucaacggcauccgcgacaagcaguccgggaagaccauccuggacuuccucaagagcgacggcuucgccaaccgcaacuucaugcagcugauccacgacgacucccugaccuucaaggaggaccuccagaaggcgcaggucagcggccagggggacucccugcacgagcacaucgccaaccuggccggcagccccgccaucaagaaggggauccuccagacggugaagguggucgacgagcuggugaaggugaugggccggcacaagcccgagaacaucgucaucgagauggcccgcgagaaccagaccacccagaaggggcagaagaacucccgggagcgcaugaagcggaucgaggagggcaucaaggagcugggcagcgacauccucaaggaguaccccguggagaccacgcagcugcagaacgagaagcuguaccucuacuaccugcagaacgggcgcgacauguacguggaccaggagcuggacaucaaccggcucagcgacuacgacgucgaccacaucgugccgcaguccuuccugaaggacgacagcaucgacaacaaggugcugacccgcuccgacaagaaccggggcaagagcgacaacguccccuccgaggagguggugaagaagaugaagaacuacuggaagcagcuccugaacgcgaagcugaucacccagcgcaaguucgacaaccucaccaaggccgagcgcgggggccugagcgagcuggacaaggccggcuucaucaagcggcagcucgucgagacccggcagaucacgaagcacguggcccagauccuggacucccgcaugaacaccaaguacgacgagaacgacaagcugauccgggaggugcgcgucaucacccucaagagcaagcugguguccgacuuccggaaggacuuccaguucuacaaggugcgcgagaucaacaacuaccaccacgcccacgacgcguaccugaacgccgucguggggaccgcccucaucaagaaguaccccaagcuggagagcgaguucguguacggcgacuacaaggucuacgacauccggaagaugaucgccaaguccgagcaggagaucgggaaggcgacggccaaguacuucuucuacagcaacaucaugaacuucuucaagaccgagaucacccuggccaacggcgagauccgcaagcggccccucaucgagaccaacggggagacgggcgagaucgugugggacaagggccgcgacuucgccaccgugcgcaagguccuguccaugccccaggugaacaucgugaagaagaccgagguccagaccgggggcuucagcaaggaguccauccugcccaagcggaacagcgacaagcucaucgcccgcaagaaggacugggaccccaagaaguacgggggcuucgacucccccacgguggcguacagcgugcuggucguggccaagguggagaagggcaagagcaagaagcugaaguccgucaaggagcucguggggaucaccaucauggagcggagcuccuucgagaaggacccgguggacuuccuggaggccaagggcuacaaggagguccgcaaggaccugaucaucaagcuccccaaguacagccuguucgagcuggagaacgggcggaagcgcaugcucgccuccgccggcgagcugcagaaggggaacgagcuggcgcuccccagcaaguacgugaacuuccuguaccuggccucccacuacgagaagcucaagggcagcccggaggacaacgagcagaagcagcuguucguggagcagcacaagcacuaccuggacgagaucaucgagcagaucuccgaguucagcaagcgggucauccucgccgacgccaaccuggacaaggugcuguccgccuacaacaagcaccgcgacaagcccauccgggagcaggcggagaacaucauccaccucuucacccugaccaaccugggggcccccgccgccuucaagugcuucgacacgaccaucggccgcaaccgguacaagagcaucaaggaggugcucgacgcgacccugauccaccaguccaucaccggccuguacgagacgcgcaucgaccucagccagcucgggggcgacuga

SEQ ID NO: 1954 - RNA, 4107 nt, Artificial Sequence
  Cas9 variant
auggacaagaaguacagcaucggccuggacaucgggaccuccagcaucggcuucgugggggucgacgagaacggcuggccccucaacaucaaggggaagcgcgccaucggcgcccaccuguuccgggagggcgaggcggccgccgagacccgcggguuccggacgacccgccggcgcuacaaccggcgcaaguggcggcugcgccuccugcgggagaucuucgacgagccgaucucccgcguggaccccaccuucuucgcccggaugaaggagagcuccgugagccccaaggaccccaacuacgacggccuggccaaggagauccucaucccgcgcgacaaggacgggaagauccuguaccccaccaucuaccaccuccggcacgcgcugauguacgaggaccaccaguucgacauccgcgagaucuaccuggccauccaccacaucgucaaguaccggggccacuuccugcucgacggggccgccaagaacuucgaguccagcaaccuggaccugaaguccgacauccacgagaucaacgcgauccucgugggcaucuucggcaacgagcagguccaguucaacgaccaguacguggagaagcugaaggaggugcugcucgacagcacgcagucccgcagcgaccggcagaaggccgccgccaagcugcugcuccccaccaacgaccuggacaaggacaccaccaagauccugaagacgguguccaccgagaucaccaaggccaucaccgggcucaaggcgaaguucuucgucaucacgggcaacgacaucgccaaggaccagcagaaggacuggaccuucagcaucgacacccuggacgagaagauguccgugaucgagcccagcuucuccgagaagaacuucagccugaucaccauccuccagaagcuguacuccagcgugacgcuggccgggaucgucccgaacggccucagccuguccgaggccaugauccagaaguacgaccgccacgccagcgaccuggugcuccugaagaaguacugggacaccaagcccaaggugcugaagcaccagcuccagaacaccuacgcggaguacaucgagauccaccaggucguggacgaguucuacuccgaccugagcaagcugaucaagaacgacgacgacacccucgcccaggagaucaaguccaagaucacgaucggcaacuuccugcccaagcagcggaccaccgagaacggggugauccccuaccagcugcagcagcgcgagcucgacaccaucaucaagaaccagcaggaguacuacccguggcuggccgaggagaaccccgucgccgaccaccagaucgccuuccccuacaagcuggacgagcucgugggcuuccgcauccccuacuacguggggccgaugaucgcgaaggaggacacgagcaacuccaagaacagcaaguucgccuggaugauccggaagcaguccggcgaggucacccccuggaacuucgacgagaagaucgaccgcaccgccagcgccaccgccuucaucgaccggaugacgaccaccgacaccuaccugaucggggaggacgugcugcccaagcagucccucaucuaccagcgcuucgaggugcugaacgagcugaacaagaucagcaucgacggccagcccaucacgcggaagcagaagcaguccgucuacacccacguguucgagaagaagaagaccguccaggugaaggacgugcagaaguuccuggucagcuccggcgaggugaugagccucccgaagaucgggggccuggcgaacgagaagcaguucaacuccagccuguccacccucuacgacuacaacaagaucauccccgacgcccuggaggaccgcaacaagguggacgacaucgagaagaucauccuguggagcacgaucuucgaggacaacagcaucuucgucgagaagcucgacuccaucgacuggcugaccagcucccagcggaagcgccuggcccagaagcgguaccgcggguggggccggcucagccugcgccugcucaccaccuucaagaacaaggacggguacuccauccuggacgagcuguggaacagcaaccacaacuucauggagauccaggcccaguccgacuucagcgagcagaucgcgaccgccaacaacaacaaccucucccaggugcugcccgccaagugggagcccggccggaagaaccuggccagccucgacgaguucaucuccaaccuguacacgagcccgcagaacaagaaggcccugcgcaaggcgauccgggugguccaggacaugaugaccgccgccggccacaugcccgagaagaucuucaucgagguggcccgcgacaccuccaacagccaccagcagaccaucgcccggcagcgccagcuccagcagcuguaccaguccgaggacaaggaggugaucgacagcuccguccggagcgagcuggacgacauccucaagaaccgcgcgaacaucaaggaccagcuguuccuguacuuccagcagggcgggcgcgaccucuacacggggaaggccaucaacaucgacaagcugagccuguaccacaucgaccacauccucccccagucccuggugaaggacgacagccuggacaaccgggugcucgucucccagaagaccaacgaggacaagggcgugaccuucgugagcgacaaguacaugaacaacaugcugcccaccuggaagcgcuggcacgagauggggcugaucuccgcccggaagcucaagaaccugacgaugcgcccggacgagaucgacaaguacgcccccggcuucauccagcggcagcuggucgagacccgccaggugaccaagcucgugaucgagcugcuggacgcccuccugggcaacagccagaccgagaucaucacgaucaaggcgucccugagccaccaguuccggcagcaguucgaccucgucaagauccgcgaggugaacgacaaccaccacgccuucgacgccuuccuggccgcgcggaucgggaccuaccuguacaagcgcuaccccaagcuccggccguacuucguguacggccaguacaugcagaaccacaagaaccugaaguccaucaaccugaucaagacccucgacagcgacaaggccaucgucgacgaggggaccggcgagauccugugggacaagaaguccgaccuggccaagaugaucaagaucuacaacuaccagcgccuccugaucacgcacgagagccggaccuccuucggcgccauguacaagcagaagauccugaaggccaccgacgcgaagcagaacgggggcggguucaagcucgugcccaccaagcgcaaccggcccguggacaucuacggcggguacacgggccagaccgccgccuaccugaccaucguccgcguguacagcaagaagaccuccgagcugcgggugcuccccaucuacacgaacaagguccagcagaucgagaaggccaugacccagggcgacaaggccaccaugcuggcguucaagaaggugaucgccccgcagcuggggaaggagaacaagaagacccacgagaucaagauccccgaguucgacguggucauccccaaggugcuccuggaccagcuggugaucgacgacaucgccggcagcccccaccgcuuccggcucgggacggacaccuacuaccacaacucccagcagcuguuccugccgcucagcaugcagcgccagcugauggaccgggaguccgacgacaaggucuaccuggacaucuucaacgacgugcucaagcaggucgacagcuacuucaaccuguacgacgugaacggcuuccgcgccgcccugcagaaguccaagaaggcguucgagcagcuccccaucaacgacuuccccaaggacgugcccgacaacaagaagaagaaggggaagcgcagcauccugaaggagaucuucaucggccugcacgccaacgccacccucggcaaccugaagcagauggggaucaagaccgacuucggcaagcugcagaaguccaacgggcuccggaucacggagaacugcaagaucauccaccagagcccgaccggccuguucgagcgcaucgugcccaucaaguga

SEQ ID NO: 1955 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaucgcggaggccacccggcugaagcgcaccgcccggcgccgguacacccgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccacgaucuaccaccuccggaagaagcucguggacagcaccgacaaggcggaccugcgccugaucuaccucgcccuggcccacaugaucaaguuccggggccacuuccugaucgagggggaccucaaccccgacaacuccgacguggacaagcuguucauccagcugguccagaccuacaaccagcuguucgaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacccccaacuucaaguccaacuucgaccuggcggaggacgccaagcuccagcugagcaaggacacguacgacgacgaccuggacaaccuccuggcccagaucggcgaccaguacgccgaccuguuccucgccgcgaagaaccuguccgacgccauccugcucagcgacauccugcggcugaacuccgagaucaccaaggcgccccucagcgccagcaugaucaagcgcuacgacgagcaccaccaggaccugacccugcucaaggcccuggugcggcagcagcugcccgagaaguacaaggagaucuucuucgaccaguccaagaacggguacgccggcuacaucgacgggggcgccagccaggaggaguucuacaaguucaucaagccgauccucgagaagauggacggcaccgaggagcugcuggccaagcugaaccgcgaggaccuccugcggaagcagcgcacguucgacaacggguccaucccccaccagauccaccugggcgagcuccacgccauccugcgccggcaggaggacuucuaccccuuccugaaggacaaccgcgagaagaucgagaagauccucaccuuccggauccccuacuacgucgggccgcuggcccgcggcaacagccgguucgcguggaugacccgcaaguccgaggagaccaucacgcccuggaacuucgaggaggugguggacaagggggccagcgcccaguccuucaucgagcggaugaccaacuucgacaagaaccugcccaacgagaagguccuccccaagcacagccugcuguacgaguacuucaccguguacaacgagcucaccaaggugaaguacgucacggagggcaugcgcaagccggccuuccuguccggcgagcagaagaaggcgaucguggaccuccucuucaagaccaaccggaaggugaccgucaagcagcugaaggaggacuacuucaagaagaucgagugcuucgacagcguggagaucuccgggguggaggaccgcuucaacgccagccugggcaccuaccacgaccuccugaagaucaucaaggacaaggacuuccuggacaacgaggagaacgaggacauccucgaggacaucguccugacgcugacccucuucgaggaccgggagaugaucgaggagcgccugaagaccuacgcccaccuguucgacgacaaggugaugaagcagcucaagcggcgccgguacaccgucugggggcgccugucccggaagcugaucaacggcauccgcgacaagcagagcgggaagacgauccucgacuuccugaaguccgacggcuucgccaaccggaacuucaugcagcugauccacgacgacagccucaccuucaaggaggacauccagaaggcccagguguccggccagggggacagccugcacgagcacaucgcgaaccuggccggcucccccgccaucaagaaggggauccuccagaccgugaaggucguggacgagcuggugaaggucaugggccgccacaagcccgagaacaucgugaucgagauggcccgcgagaaccagaccacgcagaaggggcagaagaacagccgggagcgcaugaagcggaucgaggagggcaucaaggagcugggcagccagauccucaaggagcaccccguggagaacacccagcugcagaacgagaagcuguaccucuacuaccugcagaacgggcgcgacauguacgucgaccaggagcuggacaucaaccggcucuccgacuacgacguggaccacaucgugccgcagagcuucaucaaggacgacuccaucgacaacaagguccugacccgcagcgacaagaaccggggcaaguccgacaacgugcccagcgaggagguggucaagaagaugaagaacuacuggcgccagcugcucaacgccaagcugaucacccagcggaaguucgacaaccugacgaaggcggagcgcgggggccucuccgagcuggacaaggccggcuucaucaagcggcagcugguggagacccgccagaucaccaagcacguggcccagauccucgacagccggaugaacaccaaguacgacgagaacgacaagcugauccgcgaggucaaggugaucacccugaaguccaagcucgugagcgacuuccggaaggacuuccaguucuacaagguccgcgagaucaacaacuaccaccacgcccacgacgccuaccugaacgcggugguggggacggcccugaucaagaaguaccccaagcucgaguccgaguucgucuacggcgacuacaagguguacgacgugcggaagaugcuggccaagagcgagcaggagaucgggaaggccaccgcgaaguacuucuucuacuccaacaucaugaacuucuucaagaccgagaucacccuggccaacggcgagauccgcaagcggccccucaucgagacgaacggggagaccggcgagaucgucugggacaagggccgcgacuucgccaccgugcggaaggugcugagcaugccgcaggucaacaucgugaagaagaccgaggugcagaccgggggcuucuccaaggagagcauccugcccaagcgcaacuccgacaagcucaucgcccgcaagaaggacugggaccccaagaaguacgggggcuucgacagccccacggucgccuacagcgugcugguggucgcgaagguggagaaggggaaguccaagaagcucaagagcgugaaggagcugcugggcaucaccaucauggagcgguccagcuucgagaagaacccgaucgacuuccuggaggccaagggcuacaaggagguccgcaaggaccucaucaucaagcugcccaaguacucccuguucgagcucgagaacgggcggaagcgcaugcuggccagcgccggcgagcugcagaaggggaacgagcucgcccugcccuccaaguacgugaacuuccuguaccucgcgagccacuacgagaagcugaagggcuccccggaggacaacgagcagaagcagcuguucguggagcagcacaagcacuaccucgacgagaucaucgagcagaucagcgaguucuccaagcgggucauccuggccgacgccaaccuggacaaggugcucagcgccuacaacaagcaccgcgacaagcccauccgggagcaggccgagaacaucauccaccuguucacccugacgaaccucggggcgcccaccgccuucaaguacuucgacaccaccaucgaccgcaagcgguacacguccaccaaggaggugcuggacgccaccuucauccaccagagcaucaccggccuguacgagacgcgcaucgaccucucccagcugggcggggacuga

SEQ ID NO: 1956 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucguggacagcaccgacaaggcggaccugcgccugaucuaccucgcccuggcccacaugaucaaguuccggggccacuuccugaucgagggggaccucaaccccgacaacuccgacguggacaagcuguucauccagcugguccagaccuacaaccagcuguucgaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcggcugaacuccgagaucaccaaggccccgcucagcgccagcaugaucaagcgcuacgacgagcaccaccaggaccugacccugcucaaggcccuggugcggcagcagcugcccgagaaguacaaggagaucuucuucgaccaguccaagaacggguacgcgggcuacaucgacgggggcgccagccaggaggaguucuacaaguucaucaagccgauccucgagaagauggacggcacggaggagcugcuggccaagcugaaccgcgaggaccuccugcggaagcagcgcaccuucgacaacggguccaucccccaccagauccaccugggcgagcuccacgccauccugcgccggcaggaggacuucuaccccuuccugaaggacaaccgcgagaagaucgagaagauccucaccuuccggauccccuacuacgucgggccgcuggcccgcggcaacagccgguucgcguggaugacccgcaaguccgaggagacgaucacccccuggaacuucgaggaggugguggacaagggggccagcgcccaguccuucaucgagcggaugaccaacuucgacaagaaccugcccaacgagaagguccuccccaagcacagccugcuguacgaguacuucaccguguacaacgagcucacgaaggugaaguacgucaccgagggcaugcgcaagccggccuuccuguccggcgagcagaagaaggcgaucguggaccuccucuucaagaccaaccggaaggugaccgucaagcagcugaaggaggacuacuucaagaagaucgagugcuucgacagcguggagaucuccgggguggaggaccgcuucaacgccagccugggcacguaccacgaccuccugaagaucaucaaggacaaggacuuccuggacaacgaggagaacgaggacauccucgaggacaucguccugacccugacccucuucgaggaccgggagaugaucgaggagcgccugaagaccuacgcccaccuguucgacgacaaggugaugaagcagcucaagcggcgccgguacacgggguggggccgccugucccggaagcugaucaacgggauccgcgacaagcagagcggcaagaccauccucgacuuccugaaguccgacggcuucgccaaccggaacuucaugcagcugauccacgacgacagccucaccuucaaggaggacauccagaaggcccaggucuccgggcagggcgacagccugcacgagcacaucgcgaaccuggccgggucccccgccaucaagaagggcauccuccagaccgugaagguggucgacgagcuggugaaggugauggggcgccacaagcccgagaacaucgucaucgagauggcccgcgagaaccagacgacccagaagggccagaagaacagccgggagcgcaugaagcggaucgaggagggcaucaaggagcuggggagccagauccucaaggagcaccccguggagaacacccagcugcagaacgagaagcuguaccucuacuaccugcagaacggccgcgacauguacguggaccaggagcuggacaucaaccggcucuccgacuacgacgucgaccacaucgugccgcagagcuucaucaaggacgacuccaucgacaacaaggugcugacccgcagcgacaagaaccgggggaaguccaacaacguccccagcgaggagguggugaagaagaugaagaacuacuggcgccagcugcucaacgccaagcugaucacgcagcggaaguucgacaaccugaccaaggcggagcgcggcggccucuccgagcuggacaaggccggguucaucaagcggcagcuggucgagacccgccagaucaccaagcacguggcccagauccucgacagccggaugaacaccaaguacgacgagaacgacaagcugauccgcgaggugaaggucaucacgcugaaguccaagcucgugagcgacuuccggaaggacuuccaguucuacaaggugcgcgagaucaacaacuaccaccacgcccacgacgccuaccugaacgcggucgugggcaccgcccugaucaagaaguaccccaagcucgaguccgaguucguguacggggacuacaaggucuacgacgugcggaagaugaucgccaagagcgagcaggagaucggcaaggccaccgcgaaguacuucuucuacuccaacaucaugaacuucuucaagaccgagaucacgcuggccaacggggagauccgcaagcggccccugaucgagaccaacggcgagaccggcgagaucgugugggacaaggggcgcgacuucgccaccguccggaaggugcucagcaugccccaggugaacaucgucaagaagacggaggugcagaccggcggguucuccaaggagagcauccugcccaagcgcaacuccgacaagcugaucgcccgcaagaaggacugggaccccaagaaguacggcggguucgacagccccaccguggccuacagcguccucgugguggcgaaggucgagaagggcaaguccaagaagcucaagagcgugaaggagcugcugggcaucaccaucauggagcgguccagcuucgagaagaacccgaucgacuuccuggaggccaagggguacaaggaggugcgcaaggaccugaucgucaagcuccccaaguacucccuguucgagcuggagaacggccggaagcgcaugcucgccagcgccggggagcugcagaagggcaacgagcuggcccuccccuccaaguacgugaacuuccuguaccuggcgagccacuacgagaagcucaagggguccccggaggacaacgagcagaagcagcuguucguggagcagcacaagcacuaccuggacgagaucaucgagcagaucagcgaguucuccaagcgggucauccucgccgacgccaaccuggacaaggugcugagcgccuacaacaagcaccgcgacaagcccauccgggagcaggccgagaacaucauccaccucuucacgcugaccaaccugggcgcgcccgccgccuucaaguacuucgacaccaccaucgaccgcaagcgguacacguccaccaaggaggugcucgacgccaccuucauccaccagagcaucaccggccuguacgagacgcgcaucgaccugucccagcucgggggcgacuga

SEQ ID NO: 1957 - RNA, 4107 nt, Artificial Sequence
  Cas9 variant
augagccgccccuacaacaucggccuggacaucgggaccuccagcaucggcugguccguggucgacgaccagagcaagcucguguccgugcgggggaaguacggcuacgggguccgccuguacgacgagggccagaccgccgccgagcggcgcagcuuccggacgacccgccggcgccugaagcggcgcaaguggcggcucggccugcugcgcgagaucuucgagccguacaucacccccaucgacgacaccuucuuccuccggcagaagcaguccaaccugagccccaaggaccagcgcaagcuguacacgcagaccucccucuucaacgaccggaccgaccgcgcguucuacgacgacuaccccaccaucuaccaccuccgguaccgccugaugacggagaagcggcaguucgacauccgcgagaucuaccuggccaugcaccacaucgugaaguaccgggggcacuuccugaacgaggccccggugagcuccuucaagagcuccgagaucaaccuggucgcccacuucgaccgccucaacaccaucuucgccgaccuguucagcgaguccggcuuccagcuggagaccgacaagcucgcggaggugaaggcccugcugcucgacaaccagcagagcgccuccaaccgccagcggcaggcccugagccugaucuacacccccuccacgaacaaggcgguggagaagcagaacaaggccaucgccaccgagcuccugaaggccauccuggggcucaaggccaaguucaacguccugaccggcaucgaggcggaggacgugaaggccuggacccugacguucaacgccgagaacuucgacgaggagauggugaagcucgagagcagccuggacgacaacgcccaccagaucaucgagucccugcaggagcucuacagcgggguccugcuggccggcaucgugcccgagaaccagucccucagccaggcgaugaucaccaaguacgacgaccaccagaagcaccugaagaugcugaaggccgugcgcgaggcccucgcccccggcgaccggcagcgccugaagcaggccuacgaccaguacgucgacgggcaggagaacaccaaggcguacuccaaggaggacuucuacggcgacaucaccaaggcccugaagaacaacccggaccaccccaucgugagcgagaucaagaagcucaucgagcuggaccaguucaugcccaagcagcggacgaaggacaacggggccaucccccaccagcugcaccagcaggagcucgaccgcaucaucgagaaccagcagcaguacuacccguggcuggccgagcugaaccccaacuccaagcggcagaccguggccaaguacaagcucgacgagcuggucgcguuccgcgugcccuacuacgugggcccccugaucaccgccgagcagcagcggcagagcuccgacgccaaguucgccuggcugauccgcaaggcggagggccggaucaccccguggaacuucgacgacaaggucgaccgccaggccagcgccaacgaguucaucaagcggaugacgaccaccgacaccuaccuccuggccgaggacgugcugcccaagcagucccucaucuaccagcgcuucgaggugcugaacgagcugaacgggcucaagaucgacgaccagcccaucacgaccgagcugaagcaggccaucuucaccgaccuguucaugcagaagaucagcgucaccgugaagaacauccaggacuaccucgucuccgagaagcgguacgcgagccgccccgccaucacgggccuguccgacgagaacaaguucaacagccggcuguccaccuaccacgaccucaagaugaucgugggggacgccguggacgacgucgacaagcaggccgaccuggagaagugcaucgaguggagcaccaucuucgaggacggcaagaucuacuccgccaagcugaacgagaucgacuggcucaccgaccagcagcgcgugcagcuggcggccaagcgguaccgcggguggggccgccugagcgccaagcuccugacgcagaucgugaacgccaacggccagcggaucauggaccugcucugggacaccaccgacaacuucaugcgcaucguccacagcgaggacuucgacaagcugaucaccgaggccaaccagaugaugcuggcggagaacgacgugcaggacgugaucaacgaccucuacaccuccccgcagaacaagaaggcccugcggcagauccugcucgucgugaacgacauccagaaggccaugaaggggcaggcccccgagcgcauccugaucgaguucgcgcgggaggacgaggugaacagccgccuguccguccagcggaagcgccagguggagcaggucuaccagaacaucagcaacgagcuccugaacaacacggagauccggaacgagcugaaggaccucuccaacagcgcccuguccaacacccgccuguuccucuacuucaugcagggcgggcgggacauguacaccggcgacagccugaacaucgaccgccuguccaccuacgacaucgaccacauccucccccagagcuucaucaaggacaacucccuggacaaccgggugcuggugagccagaagaugaaccgcuccaaggccgaccaggugcccacggacuucaccagcgucgagcucgggcagaagaugcagauccagugggagcagaugcugcgggccggccugaucaccaagaagaaguacgacaaccucacccugaacccggaccacaucuccaaguacgccaugaagggcuucaucaaccgccagcugguggagacgcgccaggugaucaagcucgcgaccaaccugcugauggagcaguacggggaggacaacaucgagcucaucaccgucaagagcggccugacccaccagaugcggacggaguucgacuuccccaagaaccggaaccugaacaaccaccaccacgccuucgacgccuaccucaccgccuucguggggcuguaccugcucaagcgcuaccccaagcugaagcccuacuucguguacggcgaguaccagaaggccucccagcaggacaaguggcggaacuucaacuuccugaacgggcucaagaaggacgagcuggucgacgagaacaccgaggcggugaucugggacaaggagagcggccuggccuaccucaacaagaucuaccaguucaagaagauccuggugacccgcggcguccacgagaacagcggggcccuguucaaccagacgcucuacgccgccaaggacgacaaggcguccggccagggcgggaagcagcugaucccggccaagcaggaccgcagcaccgcccuguacggcggguacuccggcaagaccguggccuacaugugcaucgugcggaucaagaacaagaagggggaccucuacaaggucugcggcguggagaccagcuggcuggcgcagcugaagcagcucacggacgaggacucccagaaggccuuccuggagcagaagaucagcccccaguucaccaaggugaagaagcagaaggggaacaucaucgaggccgucgaggaguucgaggugaucgcgccccacauccugaucaaccagcgcuucuucgacaacggccaggagcucacccugggcuccgccaccuacaagcacaacgagcaggagcugauccucgacaagacggccgugaagcugcugaacggggcccucccgcugacccagagcgaggagcuggccgagcaggucuacgacgagauccucgaccaggugaugcacuacuucccccuguacgacaccaaccaguuccgggccaagcuguccaccggcaaggccgcguucaugaagcuccccuggaagucccagugggacgggaacaagauggugcaggucggccagcaggucauccuggaccgcauccugaucgggcuccacgccaacgccgccaugagcgaccugaaggugcugaagaugacgacccccuucggcaugauccagcagagcaccggcaucacccucuccgccgacacgcagaucaucuaccagagcccgaccgggcuguucgagcggcgcguggcgcugcgggaccuguga

SEQ ID NO: 1958 - RNA, 4107 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucguggacagcaccgacaaggcggaccugcgccugaucuaccucgcccuggcccacaugaucaaguuccggggccacuuccugaucgagggggaccucaaccccgacaacuccgacguggacaagcuguucauccagcugguccagaccuacaaccagcuguucgaggagaaccccaucaacgccagcggcguggacgcgaaggccauccuguccgcccgccugagcaagucccggcgccucgagaaccugaucgcccagcugccgggggagaagaagaacggccucuucgggaaccugaucgcccugagccucggccugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcggcugaacuccgagaucaccaaggccccgcucagcgccagcaugaucaagcgcuacgacgagcaccaccaggaccugacccugcucaaggcccuggugcggcagcagcugcccgagaaguacaaggagaucuucuucgaccaguccaagaacggguacgcgggcuacaucgacgggggcgccagccaggaggaguucuacaaguucaucaagccgauccucgagaagauggacggcacggaggagcugcuggccaagcugaaccgcgaggaccuccugcggaagcagcgcaccuucgacaacggguccaucccccaccagauccaccugggcgagcuccacgccauccugcgccggcaggaggacuucuaccccuuccugaaggacaaccgcgagaagaucgagaagauccucaccuuccggauccccuacuacgucgggccgcuggcccgcggcaacagccgguucgcguggaugacccgcaaguccgaggagacgaucacccccuggaacuucgaggaggugguggacaagggggccagcgcccaguccuucaucgagcggaugaccaacuucgacaagaaccugcccaacgagaagguccuccccaagcacagccugcuguacgaguacuucaccguguacaacgagcucacgaaggugaaguacgucaccgagggcaugcgcaagccggccuuccuguccggcgagcagaagaaggcgaucguggaccugcuguucaagaccaaccggaaggugaccgucaagcagcugaaggaggacuacuucaagaagaucgagugcuucgacagcguggagaucuccgggguggaggaccgcuucaacgccagccugggcacguaccacgaccuccugaagaucaucaaggacaaggacuuccuggacaacgaggagaacgaggacauccucgaggacaucguccugacccugacccucuucgaggaccgggagaugaucgaggagcgccugaagaccuacgcccaccuguucgacgacaaggugaugaagcagcucaagcggcgccgguacacgggguggggccgccugucccggaagcugaucaacgggauccgcgacaagcagagcggcaagaccauccucgacuuccugaaguccgacggcuucgccaaccggaacuucaugcagcugauccacgacgacagccucaccuucaaggaggacauccagaaggcccaggucuccgggcagggcgacagccugcacgagcacaucgcgaaccuggccgggucccccgccaucaagaagggcauccuccagaccgugaagguggucgacgagcuggugaaggugauggggcgccacaagcccgagaacaucgucaucgagauggcccgcgagaaccagacgacccagaagggccagaagaacagccgggagcgcaugaagcggaucgaggagggcaucaaggagcuggggagccagauccucaaggagcaccccguggagaacacccagcugcagaacgagaagcuguaccucuacuaccugcagaacggccgcgacauguacguggaccaggagcuggacaucaaccggcucuccgacuacgacgucgaccacaucgugccgcagagcuucaucaaggacgacuccaucgacaacaaggugcugacccgcagcgacaagaaccgggggaaguccgacaacguccccagcgaggagguggugaagaagaugaagaacuacuggcgccagcugcucaacgccaagcugaucacgcagcggaaguucgacaaccugaccaaggcggagcgcggcggccucuccgagcuggacaaggccggguucaucaagcggcagcuggucgagacccgccagaucaccaagcacguggcccagauccucgacagccggaugaacaccaaguacgacgagaacgacaagcugauccgcgaggugaaggucaucacgcugaaguccaagcucgugagcgacuuccggaaggacuuccaguucuacaaggugcgcgagaucaacaacuaccaccacgcccacgacgccuaccugaacgcggucgugggcaccgcccugaucaagaaguaccccaagcucgaguccgaguucguguacggggacuacaaggucuacgacgugcggaagaugaucgccaagagcgagcaggagaucggcaaggccaccgcgaaguacuucuucuacuccaacaucaugaacuucuucaagaccgagaucacgcuggccaacggggagauccgcaagcggccccugaucgagaccaacggcgagaccggcgagaucgugugggacaaggggcgcgacuucgccaccguccggaaggugcucagcaugccccaggugaacaucgucaagaagacggaggugcagaccggcggguucuccaaggagagcauccugcccaagcgcaacuccgacaagcugaucgcccgcaagaaggacugggaccccaagaaguacggcggguucgacagccccaccguggccuacagcguccucgugguggcgaaggucgagaagggcaaguccaagaagcucaagagcgugaaggagcugcucggccugaccaucauggagcgguccagcuucgagaagaacccgaucgacuuccuggaggccaagggguacaaggaggugaagaaggaccucaucaucaagcugcccaaguacucccuguucgagcucgagaacggccgcaagcggaugcuggccagcgccggggagcugcagaagggcaacgagcucgcccugcccuccaaguacgucaacuuccuguaccucgcgagccacuacgagaagcugaagggguccccggaggacaacgagcagaagcagcuguucguggagcagcacaagcacuaccucgacgagaucaucgagcagaucagcgaguucuccaagcgcgugauccuggccgacgccaaccuggacaagguccucagcgccuacaacaagcaccgggacaagcccauccgcgagcaggccgagaacaucauccaccuguucacgcugaccaaccucggcgcgcccgccgccuucaaguacuucgacaccaccaucgaccggaagcgcuacacguccaccaaggaggugcuggacgccacccugauccaccagagcaucaccggccucuacgagacgcggaucgaccugucccagcucgggggcgacuga

SEQ ID NO: 1959 - RNA, 4110 nt, Artificial Sequence
  Cas9 variant
augaagcgcauccugggccucgaccuggggaccaacagcaucggcugggcccuggugaacgaggccgagaccgucaacgagaaguccagcaucgugaagcucggggugcgggucaacccccugacgguggacgagcagaagaacuucgaggcgggcaaguccaucccgaccaacgccgggcgcacccugaagcggggcaugcgccggaaccuccagcgcuacaagcugcggcgcgacuaccugauccagugccucaaggaguacggcuggaucaccagcgacacgcugcuguacgagugcgggaaccggaccaccuucgagaccuaccgccuccgggccaaggccguggacgaggagaucgcccuggaggagcugggccgcguccuccugaugaucaacaagaagcggggguacaaguccaaccgcaaggcgaaguccuccgacgagggccagcugaucgacgggauggccaucgccauggacauguaccacaacggcacgacccccggcgaguacguguacagccuccuguccaaggggaagaaguacauccccguguucuaccggagcgaccugcucgacgaguucgaccgcaucugggacuaccagugcgccuacuaccccgacauccugaccucccaguucaaggagcugauccggggcaagagcucccaggucaccagcaagcuguucaagcagcaguacaaccuguucacggcggacaacaaggagaaggacaagcgccugcaggccuacugccggcgcgccgacgcccucaagaagcggcugccgguggaggagguggccgcggcccugugcgacgucaaccgcgacgugaacgccuccagcggguaccucggcaccaucuccgaccgcagcaagaagcuguucuucaacaagcagaccgugggccaguaccugaugcucgagcuggacaaggacucccacuucagcgucaagaacgagguguucuaccggcaggacuaccugaacgaguucgaggccaucugggagaagcaggccgaguaccaccccgagcucacccccgaccgcaagaagauccugcgggacguggucaucuucuaccagcgcccccucaagagccagaaggaccucguggcgugcugcgagcuggagcggcgccggaucgaggugaugaaggacgggaagguccgcuccguggagaucggcccgaaggugugccccaagagcagcccccuguuccaggacuucaagaucuggcacguccucaacaaccugaaggugcgggacaaggccacgggggacgagcgcuuccuggagcucgacgagaaggagauccuguucagcgagcuggccaucaaguccaagcucagcaagaccgaggcccugaagcugcuguaccagaagcccaagggccucgaccugaacuacgacuccgucgaggggaacaccacccaggccgcgcuguucgaggccuaccagacggugaucgccaugaccggccacggcgaguacguguucagcaagauguccgccagcgaggucauguccgugguggagggggucuucggcgggcucggcuucaacaccagcgugcugcgguucgacucccugcuccaggggaaggagcuggagaagcaggacagcuaccgccuguggcaccuccuguacuccuacgagggcgacaacagcgugaccggcacggacgggcuggucgccaagguggcgucccuccugcggugcgacgaggaguacgccaagguggucgccggcgugaccuuccagccggacuacgggagccuguccgccaaggcgauccgccggauccucccccacaugcgcgccggcaacgaguacagccuggccugcgaguacgccggguacaagcacagccggcgcucccugaccaaggaggagcucgagcagaaggacuacaaggaccaccuggagcugcucccccggaacagccugcgcaaccccguggucgagaagauccugaaccagauggugaacguggucaacgccgugguggacgcguacggcaagccggacgagauccgcaucgagauggcccgggagcucaagaaguccgccaaggagcgcgaggagaugaccgccgccaucaacaaggcgacgagcgagcacgagcggaucaaggagauccugaacaaggaguucggcauccagcacgucucccacaacgacaucgugcgcuacaagcuguacugcgagcucaagaacaacggguacaagacccuguacagcgacaccuacaucccccaggagaagcuguucuccaaggagguggacaucgagcacauccucccccaggcccggcuguucgacgacagcuucuccaacaagacccuggaguaccgcagcgucaacaucgagaaguccaaccagacggccugggacuacguggccgccaaguggggcgaggaggggagccuccgguacaagaagcgcguggacgaccugcuggcggccggcgucaucggcaaguccaagcacgacaagcuccugaugaagcaggaggacauccccaccgacuucaucaaccgggaccugcgcgacacccaguacaucgcccggaaggcccgcgagauccucgaggaccuggugccgaugguggucagcaccacgggggcggugaccgaccggcugcgcgaggacuggcagcucguggacgucaugcaggagcugaacugggacaaguacgccaugaagggccugaccgaggaguggaccgacaaggacgggcggcgcaucucccggaucaaggaguggaccaagcgcaacgaccaccggcaccacgccauggacgcccucacgaucgccuucaccaagcacagcuucauccaguaccugaacaaccugaacgcgcgcuccgacaagagcggcagcaucuacgccaucgagcagaaggagcucuaccgggacaaccacgggaagcugcgcuucaucaugcccuucgagggcuuccgcuccgaggccaagcggcagcuggagaacauccucgugagcaucaaggccaagaacaagguggucacccgcaacgugaacaacgcccggcgcggcuccgggcggcaggcgaaggugcagcugacgccccgcggccagcugcacaacgagaccaucuacgggagcauccaccgguacgucaccaagcucgagaaggugggcgggaacuucgacggcgagcagaucgccaagguggccaaccugcgcuaccgggaggcccugcaggcccgccacgaggcguucggcggggacgccaagaaggccuucaccggcaagaacgcccucgacaagaacccccuguaccugaaggacacccggacggaggucccgcucaaggugaagaccguguccaccgagacccuguacacgauccgcaaggcggucgcccccgaccugaacguggacaaggugaucgacgccaagguccggaaggugcucgaggagcgccugcaggaguacgggggcgaccccaagaaggccuucgugaaccuggacgagaaccccaucuaccucaacaaggccaaggggaucaccaucaagcgggucgcgaucaccggcgugaacaacgccaucgcccugcacgacaagaaggacgucggcgggcacgugaugcuggacgccagcggccgcaagcagccgguggacuucgucaacaccgggaacaaccaccacguggccaucuaccgggacgcggagggcucccuccaggagguggucgugagcuucuacgaggccguggcccgcgucucccuggggcugcccgugaucgaccgggaguaccgcaaggaggacggcuggcaguuccucuucacgaugaagcagaacgaguacuucguguuccccaacccggagaccggcuucaacccccaggaggucgaccugaccgacgagaccaacuacgcccugaucagccccaaccucuuccgcgugcagaaguucacgaucaaggacuacuucuuccggcaccaccuggagaccaccguggaggaccgcaaggagcugaaggacaugaccuggaagcggugcgggcucggcgggaucaucggcaucgucaaggugcgcgugaaccacaucggccggaucgucuccgugggggaguacuga

SEQ ID NO: 1960 - RNA, 4110 nt, Artificial Sequence
  Cas9 variant
auggccaagaccuacaacaucggccuggacaucgggaccaacagcaucggcugggccguggucgacgaccagaaccaccucauguccaucaaggggaaguacggcuacggggugcgccuguacgacgagggcaagacggcggaggagcggcgcagcuuccggaccacccgccggcgccugaagcggcgcaaguggcggcucucccugcugcgcgagaucuucgagccccagaucaccccgcucgacaacacguucuuccugcggcagaagcagagcucccugagcuccaaggacaaccgcaagcucuaccccgagaugagccuguucaacgaccggaccgacaccgacuucuacacccaguaccccacgaucuaccaccugucccgcgaccucaugaccaagaacaagcaguucgacauccgggagaucuaccuggccauguaccacaucgugaaguaccgcggccacuuccugaacgagagccccgucuccagcuucaaguccagcgagaucaagcucgccgagaacuucgagacccugaaccagaucuucaacgagcgguucaacgaguccauguuccagcuggccgugaacgacuucgacgaccucaaggcccugcugcucaacgaccagcagagcgcguccaaccgccagaagaaggcccuggggaugaucuacgugccgaacgagaacaagagccuggagaagcagaacaaggccaucgccaccgagcuccugaaggcgauccugggccucaaggccaaguucaacguccugacggggaucgagguggacgacgccaagcccuggacccuguccuucaacagcgagagcuucgacgaggacaucgacaaggccgccaccaacaucgacgacgacucccgggagaucaucgcgauccuccagggccuguacagcgggauccugcucgccggcaucauccccgagaaccagucccugagcgaggccaugguggagaaguacgaccagcacgccgcccaccugaagcagcucaaguccaucuacccccugcugagcaucuccgacaagaaggcgauccagcaggccuacaacuacuacaucgacggccaggacaacgccaaggccuacagccgcgaggacuucuacgccgcgaccacgaaggcccucaaguccuaccaggacaacgagaccaucgccgagauccugaagcugaucgagcucgagcaguucaugccgaagcagcggaccaaggacaacggggccaucccccaccagcugcaccagcaggagcuggagcgcaucaucgagaaccagcagaaguacuaccccuggcucgccgagcugaaccccaacgagagccgccggaagaucgcgaaguacaagcuggacgagcucgucgccuuccgcgugccguacuacgugggcccccugaucaccuccgagcagcagcagcagagcuccaacaagaaguucgccuggaugauccggaaggccgaggggaagaucacgcccuggaacuucgacgagaaggucgaccgccaggcgagcgccaacgaguucaucaagcggaugaccaccaccgacacguaccugcuggccgaggacgugcuccccaagcagucccugguguaccagcgcuucgagguccugaacgagcucaacggcaucaagaucgacgacgugccgaucaccguggagcagaagcagcggaucuucaacgaccuguucaugaugcaggccagcgucuccgugaagaacauccaggacuaccuggugagcaagggcuacuucgccucccgccccgagaucaccgggcucagcgacgagaacaaggucaucagccggcuguccaccuaccacgaccugaaggcgauccucggcgggaucguggacgaggccaacaagcaggccgaccuggagaagugcguggaguggagcacgaucuucgaggacggcaagaucuucgucgagaagcugaacgagaucgaguggcucaccgacgagcagcgcaagcggcuguccagcaagcgcuaccggggguggggccgccuguccaacaagcuccugaaccagaucgugaacgagaacggccagcggaucauggaccugcucugggacaccaccgacaacuucaugcgcaucguccacagcgaggaguucgacaagcugaucuccgccgccaaccagacgcugcucagcaagaacgacgugcaggacgugaucaacgaccuguacaccuccccgcagaacaagaaggcgcugcggcagauccuccuggucgugagcgacauccagaaggccaugaagaaccaggcccccuccaagauccugaucgaguucgcccgcgaggacgaggccaacccgcggcucagcgugcagcgcaagcgccaggucgagcaggucuaccagaacaucuccaaggacauccugagcgacuccgacgugaaggcggagcugaaggaccucaccaacaccgcccuggccaacacgcggcuguuccucuacuucaugcagggcgggcacgacauguacaccggggagacccugaacaucgaccgccugagcgaguacgacaucgaccacauccucccccaggccuucaucaaggacaacucccuggacaaccgggugcuggugagcgcgaagaugaaccgcagcaaguccgaccaggugccccucaacgacuacaccgaggagcgguucggcagcaagaugcgcguccagugggagcagaugcugcgggccgggcugaucaccaagcgcaaguacgacaaccucacgcugaaccccgaccggaucuccaaguacgccaugaagggcuucaucaaccgccagcugguggagacccgccaggugaucaagcucgucaccaaccugcugauggaccacuacgaggacgacgaggugcagcucaucaccgucaagagcggccugauccaccagaugcgggagauguucgacuucccgaagaaccggaaccugaacaaccaccaccacgccuucgacgccuaccucacggcguucguggggaucuaccugcugaagcgcuaccccaagcucacccccuucuucguguacggcuccuaccagaagaacaacaccaacgacaaguggcggaacuucaacuuccugaacgaccugaagaaggaggaggugaucgacagcgacucccacgaggucaucuggaacaaggcccaggggcucguggagcuggacaagaucuaccaguucaagaagauccuggugacccgcgagguccacgagaacacgggcgcccucuacaaccagacccuguacagcgccaaggacgacaaggccuccgggcagggcggcaagcagcugauccccgcgaagcaggaccggccgaccgcccucuacgggggcuacagcgggaagaccguggccuacaugugcaucgugcgcaucaaguccaagaaggaggacacguacaaggucugcggcgugaagaccagcuggguggccgagcuggagcggcuguccgacagcaacgagcagcucgccucccugaaggcgaagcugaugcccaaguucaccaagaacaagaagcagaagggcaagaccauccaggucacggaggacuucgagaucaucgugccccgcgugcucaucaaccagcgguucuacgacaacgggcaggagaucacccugggcagcgccaccuacaagcacaacgagcaggagcugaugcucaacaagaaggccgucaagcugcugaacgggcagcucucccugguggaggccgagacccuggcgccccagguguacgacgagauccucaagcaggucaugaaguacuucccccuguacgacacgaaccaguuccgcaccaagcugaagaugggcaaggagcaguucaucaagcuccccuggaagaacaagugggacgggaacaagcugauccacgugggccagcagaccgugcuggaccgcauccucaucggccugcacgccaacgccgccgucagcgaccuguccacccucaaggugacgacccccuucgggaagcugcagcagccgagcggcaucgcccugagccucaacaccaagaucaucuaccagucccccaccgggcuguucgagcggcgcguggcgcugcggggccucuga

SEQ ID NO: 1961 - RNA, 4110 nt, Artificial Sequence
  Cas9 variant
auggacaagcccuacaacaucggccuggacaucgggagccacuccaucggcuggaccguggucgacgacaacagcaagcucgugcgcaucaaggggaagcugggcuacggggugcggcuguucgacgagggcaagaccgccgaggagcgccggcaguuccgcacgacccggcgccggcucaagcgccggaaguggcgccugcggcugcuccgcgagaucuucgagccgcacaucgcgccccuggacgagaccuucuuccugcggcagaagcaguccaaccucguccccacccagaagaagcugccccagcugagccucuucaacgaccgcuccgacgccgaguucuaccacaaguacccgacgaucuaccaccuccggaacgcccugaugaccgagaagcgccaguucgaccuccgggagaucuaccuggccauccaccacaucgugaaguaccgcggccacuuccugaacgccgcccccgcggccagcuucaaguccgggaaguucgaccucgagaacaaguucgaccagcugaaccugcuguucgccagcgccuacuccgaccuggacuucacccugcggaccgacaacguggaccaggucaaggcgauccuccugaacgaggaccugagcgccuccacgcgccagcggcaggcccucccccugaucuaccagaccagcgccgaccagaaggccgcgaagaagcugaccaagucccucgccaccgagcugcugaaggccauccucggccugaaggccaaguucgacgugcugacggggaucgagaccgacgacaccaaggccuggcgccucaccuucaacgcggaggacuucgacgacaagcugaacgagcugaacgugacggacaacgaggccgccacccagaucaucgagauccuccgcgagcuguacagcuccauccugcucgccgccaucguccccgagaacuacacccugagccaggcgaugauggccaaguacaacgcccacaagcagcaccugucccuccugcgccaggugaagaccacgcugccggccaagaagcagaaggagcuccaggccgcguacgacgacuacaucgaccagcaccucccccuggacaaguucuacgccaagcugaccaaggugcuccccaaggagaaggacaccgacaacccccagaucauccagauccugaaccugaucgaccucgaccaguuccugccgaagcagcggaccaaggacaacggcgccaucccccaccagcugcaccagcaggagcucgaccagaucaucgacaaccagaaggccuacuaccccuggcuggcgcagcugaaccccaacgagaagcggcagaagaucgccaaguacaagcucgacgagcuggucgccuuccgcgugccguacuacguggggccccugaucgaggccaagacgcagcagaagaccagcggcgccaacuucgcguggaugauccggaaggagcccggcaccaccacgcccaucaccccguggaacuucgacgagaaggucaaccgccaggccuccgccaacgaguucaucaagcggaugaccaccacggacaccuaccuccugggggaggacgugcugcccaagcacagccuccuguaccagcgcuucgaggugcugaacgagcucaacggcaucaagaucgaccagaagcgggucaccgugcgccagaagcaggccaucuucaacgaccuguuccugaagcagcccaacgugaccgucaagaagcuccagcaguaccugcaggccaagggggaguacgcgagcgcccccaucaucacgggccuguccgacccgaagaaguucaacagccagcucuccaccuaccacgaguacaagaagaucuucggcgggcugaucgacgaccccgacaagcaggccgacuucgagaagugcaucgaguggagcaccaucuucgaggacucccagauccugaaggacaagcucaaggagaucaacuggcugacccccgagcagcggcacaagguggccaacaagcgcuaccagggcugggggcggcugagcaagaagcuccugacccagcugguggacuacaacggccagcgcaucaucgacauccucuggaacacgaccgacaacuucaugcagaucguccacuccgaggccuucgacaaggcgaucaucaaggagaaccaggcccugcugacccaguacaacccccaggccgugaucgacgaccucuacaccagcccgcagaacaagaaggcccugcggcagauccugcucgucgugaacgacauccagaaggcgcugaaggggcaggcccccucccgcauccugaucgaguucgcccgggagggccaggagaacccccgccucagcacgcagcggaagcagcaggucgagaacgccuacaaggaggccuccgacgcgcugcugagcuccgccgaggugcgccaggagcucaagggccuggacaacaaggcccuggccaacacccgccucuuccuguacuucaugcagggcgggcgggacaucuacaccggcaagagccugaacaucgacgaccucuccaaguacgacaucgaccacauccugccgcaggccuucaucaaggacaacagccuggacaaccgcgugcucguguccgcgaagaugaaccggagcaaguccgaccaggucccccugaacgacuucgccgagauccgcuacgggaagcagaugcggcagcagugggagaagaugcugcgcgccgggcucaucacccggaagaaguaccacaaccugacgcugaaccccgagagcaucaacaaguacaccgccaagggcuucaucaaccgccagcucguggagacccgccaggugaccaagcuggccacgaaccugcucgucgaccaguacgcggaggacgacgugcagcugaucaccgucaagagcaaccugacccaccagaugcgggaggaguucgacuuccccaagaaccggaacgugaacaaccaccaccacgccuucgacgccuaccucaccgccuucgugggccuguaccugcucaagcgcuacccgaagcuggcgcccuacuucguguacggggacuaccagaagggcgccucccagaacagcaaguggcggaacuucaacuuccuggggaaccuccaccgcgagaaggucguggacaagaacacgggcgagaucaucuggcagcgggacgccgggcugggcgagcugaaccgcaucuacaacuucaagaagauccucgugacccgggcccugcgcgucaaccggggccccauguucaagcagaccaucuacaaggccgaggaggacaaguccagcgggcgcggcuccaagcagcugauccccaccaagaagaaccggccgacggagcucuacgggggcuacaccaacaaggagaccgcguaccugugccuggugaaggagccccacaagaagggcgacaucuaccgcaucugcagcgugcucaacauguggcugaccgagcuggaccgcaucgccgaccccaucgccaaggcccagaagcucacggagcugcugacgccccaguucaccaccaccaagaagaagcaggggcagaagaucccggucgugaagcccuucaagguggucauccccaagauccucaucaaccagcgguucuucucccgcggccaggagcugaccguggccagccccauguacaugcacaacgagcaggagcuguuccucaacaagaagaccaucaagcugcugaacgggcagcucgcgaagaacgaggcccacgagcuggccccgaagaucuaccagcagauccuggaccaggugaacgacuacuucccccuguacgacauguacaaguuccgggacacccucaacgccuccaaggagaucuucgucaaccugcccuggcaggaccagcgccaggacaagaagaucagccaguccggccagaaguccauccugaacaagauccucaucgggcugcacgccaacgcggcccggaucaagcugacggagcucaacuucaagagcgacuucggccugcugagccagcgcuccggcaucgccuucagccccgacgaccagaucaucuaccaguccccgaccgggcuguucgagcggcgcgugacccugaaggaccuguga

SEQ ID NO: 1962 - RNA, 4110 nt, Artificial Sequence
  Cas9 variant
augaaggugaacaacuaccacaucggccuggacaucgggaccagcuccaucggcugggucgccaugggggaggacggcaagccccuccgcgugaaggggaagaccgccaucggcgcgcggcuguuccgcgagggcaacccggccgccgaccggcgcauguuccggacgacccgccggcgccugaaccggcgcaaguggcggcucaagcugcuggacgagaucuucgaccccuacaucacccccguggacagcaccuucuucgcccgccucaagcaguccaacuggagccccaaggacucccggaaggccuucaaggacagcacgcuguucccggaccugaccgacaagcaguaccaccucgacuaccccaccaucuaccaccuccgccacgcgcugaugacccaggacaagcaguucgacauccggauggucuaccuggcccugcaccacaucgugaaguaccgcgggaacuuccugaacuccacgcccguggacagcuucaaggccuccaaggucaacuucgacgaccaguucaagaagcucaacgagcuguacaccgccaucaaccccgaggagagcuuccagaucaacuucgcgaacuccgagaagaucggccagcaguuccuggacccgagcauccggaaguucgacaagaagaagcagaucuccaagaucgugcccgugaccauggacgacaaggccgucgacaagcucaacgggaagaucgccagcgagaucgugaacgccauccugggcuacaaguccaagcuggacguggccguccagugcgaccccgaggacagcaagcccugggcggugaaguucgacgacgaggacaucgacgccaagcuccagaagauccugccggagauggacgagaaccagcaguccaucaucgggaucauccaggaccuguacagccaggugacccucaaccagaucguccccaacggcaugucccugagcgagagcaugaucaagaaguacaacgaccaccacgaccaccugaagcucuacaagaagcugaucggccagaucuccgacagcaagaagaagacggcccugaagaaggccuacgaccaguacguggggaacgacggcaaggugaucgagcaggacgacuucuacuccagcgucaagaagaaccucgacgacuccgagcugagcaagcagaucauggaccugaucgacgccgacaaguucaugcccaagcagcgcaccucccagaacggggugaucccccaccagcuccaccagcgggagcuggacgagaucaucgagcaccagagcaaguacuacccguggcuggcggaguccaaccccaacaagcacgaccuccaccuggccaaguacaagaucgaggagcugguggccuuccgcauccccuacuacgucggccccaugaucaccccggaggaccagaagaaguccggcgccgccguguucagcuggaugaagcggaaggagcccgggcagaucacccccuggaacuucgaccagaagguggaccgcauggagagcgcgaacaaguucaucaagcgcaugacgaccaaggacaccuaccucaucggcgaggacguccugcccgacgagucccugcucuacgagaaguucaaggugcugaacgagcugaacaugguccgggugaacggggacagccucaagguggccgacaagcaggccaucuaccaggaccuguucgagaacuacaagcacaucuccgucaagaagaugcagaacuacaucaaggacaagaccggccugccgaacaaccccgacaucagcgggcucuccgaccccgaccacuucaacaacagccugggcacguacaacgacuucaagaagcuguucggcgacaagguggacgaccccgaccugcaggacgacuucgagaagaucguggagugguccaccgucuucgaggacaagaagauccuccgcgccaagcugaacgagaucagcuggcugagcgacaagcagaaggacgaccucgaguccagccgguaccagcgcugggggcggcuguccaagaagcugcucaccggcaucgugaacgaccagggggagcgcaucaucgacgagcuguggaacaccaacaagaacuucaugcagauccagagcgacgacgacuucgccaagcggauccacgaggcgaacgccgaccagaugaaggccacggacguggaggacguccuggccgacgcguacaccuccccgcagaacaagaaggccauccgccagguggugaaggucguggacgacauccagcgggccaugggcgggguggcccccaaguucaucagcaucgaguucacccgcuccgaggaccggaacccccgccggaccaucagccgcgagcggcagcucgaggacacgcugaaggacaccgccaagacccuggucaaguccaugaacccggacauccucagcgagcuggacaacgcguccaagagcaagaagggccugaccgaccgccucuaccuguacuucacgcagcugggccgggacauguacaccgggaagcccaucaacaucgacgagaucuccaacuacgacaucgaccacauccucccccaggccuucaucaaggacgacagccuguccaaccgcgugcuggugagcaaggccgucaacaacggcaaguccgccaacgugccccucaagcuguucggggugaagauggcccacuucuggaagcagcuggcggaggccggccucaucaacaagcggaagcugaagaaccugcagaccaacccggacaccaucagcaaguucgccaugcacggguucauccgccgccagcucgucgagacgagccaggugaucaagcugguggccaacauccugggcgacaaguaccggaacgacgacaccaagaucaucgagaucaccgcccgcaugaaccaccagaugcgggacgaguucgcguucaucaagaaccgcgagaucaacgacuaccaccacgccuucgacgccuaccucaccgccuuccugggccgguaccuguaccaccgcuacaucaagcuccggcccuacuucgucuacggggacuucaagaaguuccgcgaggacaaggugaccaugcggaacuucaacuuccugcacgaccugacggacgacacccaggcgcgcaucgccgacaccgagaccggcgaggugaucugggaccgggagacguccaucaagcagcuccgcgacgucuaccacuacaaguucaugcugaucagccaggagguguacacccugcgcggggccauguucaaccagaccaucuaccccgccgacgaggccggccggaagaagcucauccccaccaaggcggacaaggccguggacgucuacggcggguacuccggcagcaacgacgccuacauggccaucgugcggauccacgacaagaagggggacaaguacaagguggucggcgugccgaugcgcgcccuggaccggcugaacgcggccaagaacguguccgacgccaaguacgaccagguccucaaggacgugcugacgccccaguucaccaagagcaagaagucccgcaagaccggggagaucagccagaccguggaggacuucgaggucgugcugggcaaggugauguaccggcagcucgucaucgacggcgacaagaaguucaugcugggguccagcacguaccaguacaacgccaagcagcuggugcucuccgacgagagcgugaagacccuggccuccaagggcaagcuggacgaggcgcaggagagcgccgccuacgacaacgucuacgacgagauccucgacaagguggaccgcuacuucgcccuguacgaccagcggaacuaccgcaccaaccugcacgagggggagcagaaguucaucggccucccccugcacgacaccuucgacggguccaagaagguggcgaacggcaagcgcgagacgaucagcgacauccugaacggccuccacgccaacgccaccaugaccaaccugaagguccuggggaucuccagccccuucggcauguuccagucccacgggccgaucaaccucaaccccgagaccaucauccugugccagagccccacgggccuguucgagcggcgcaucauccuccgggaccuguga

SEQ ID NO: 1963 - RNA, 4113 nt, Artificial Sequence
  Cas9 variant
augaagaagcgcaacuacaacaucgggcuggacaucgggaccagcuccaucggcuggaccaucguggacgacaacgcccagaucaugcgggccaaggggaagaacggcuacgggguccgcaucuucgcggagggcaagacggccgccgaccggcgcggcuuccggaccacccgccggcgccucaagcggcgcaaguggcggcugcgccugcuccaggaguucuucgagcccuacauccugccgaucgacgagaacuucuucaugcggcagaaggagagcaaccuggugccccaggaccccaacaagcacuucaagggguccauccucuucaacgaccgcaccgaccaggaguuccacgagcaguaccccacgaucuaccaccuccgguacgcccugaugaccgagcaccgccaguucgacgugcgggagaucuacugggccauccaccacaucgucaaguaccgcggccacuuccucaacagcacccuggcguccaaguucaagggcggggagcugcggcucgccgacaaguucgagagccugaacaagcuguuccuccgcgugcaggccgagaccggguucgagcuguccgaggacaacguggacaagaucaagacgguccugcucgacaacggcaagagccggcuggaccgccagcgcgaggugcugaagaucguguaccucaccuccgaggacaaggacaccgagaagaagcggaaggccgucgcgaccgaguucaucaaggccgugcugggccugaagacgaagcuguucaucgugcuggccaagaacccgaccgccgagaccgacuggaaguucagcuucgacgccgaggacaucgacgacaagcuggacuccaucagcgagcagcucaccgacgacgaccacgagaucgucgagcugaucuccgagauccacagcaucaucacgcugaccgggguggugcccgagggcauggggcucuccgagagcaugaucgcgaaguacgaccagcaccagcuggaccugaagaagcucaagucccugaugcgcgaccuggacgucaagcaggcccggaagcuccaggacgccuacgacgaguacaucgacggccugaagcccagcgaggaggccuucuacuccgccgugagcagcgugauccagaagauggacgacccccgcgcgaagaagaucaccgccgagaucgagcuggaggaguucaugccgaagcagcggaccaaggccaacggccagaucccccaccagcuccaccagcaggagcuggaccagaucaucgagaaccagaaggaguacuaccccuggcuggccgaggagaaccccaacaagcgcgagcacaacgccgcgccgcacaagcucgacgggcuggucacguuccgggugcccuacuacgugggcccccugaucgaggccuccguccagcagaagaccagcaacuccaacuucgccuggauggagcgcaaggugaagaacgacaccagccggaucacccccuggaacuucgaggagaagguggaccgcaacgccuccgccgagaacuucaucaagcggaugacgaccaaggacaccuaccuccugaacgaggacguccugccgcagcagagccuccuguaccagcgcuacgaggugcugaacgagcugaacaacguccgggugaacgacaagaagcucgagaacaacugcaagcaggacguguacaaggaccuguucaagaacaacaccacggucuccaucaagaaguucaaggacuaccugguggcgaacugcgaguacgccgacaaccccaagaucgaggggcucgccgacgagagcaucuuccuguccagccuguccaccgagaacaaguucaaggacaucuucggcgcccagaucgacgaccccaacuacuucgaggacuucgagcacaucaucgagugggcgaccaucuucgaggacaacaagauccuccgcgccaagcuggacgagaucagcuggcugaacgagucccagaagaaggagcucgccaagcugcggaugcgcggguggggccggcugagccgcaagcucaucgccgagaucaccgacgagaacggcucccggaucaucgaccugcugugggagcacauggacaacuucaugguggucgugaaccaggacguguucaaggagaagaucgucgccgagaacaagcaggucuucaaggagcucaacccccuggacaucaucaacgagcaguucacgagcccgcagaacaagaaggcgcugcgccagauccuccuggugguggccgacauccagaaggccaugaacggggugacccccuccaacaucuucaucgaguucgcccgcgaggacgagcggaacccccgccggagcauccagcgccugcgccagguggagaacauguaccgggacaucuccgacaccguccucgccgaccccgaggugcggaacgagcugagcaacaucaagaacaccgagcuggcgcgcgaccggguguuccucuacuuccugcagggcgggcgcgacgucuacacgggcgagccgcugaacaucgacaagcucagcgaguacgacaucgaccacauccugccccaggccuucaucaaggacaacucccuggacaaccgggugcucgugagcgccucccugaaccgcagcaaguccgacagcgucccccuggacgacuucaccuccgagauguucgggcggaagauggagccccucugggagcagaugcagcgcgccggccugaucagcaagaagaagcuggccaaccucaaguucaacccggagaacaucaacaaguacacccggaacggcuucaucaaccgccagcugguggagacccgccaggugaucaagcuggcggccaacauccucaaggaccacuacggggaggagaccgagaucgucaacgugaaggccggccugacgcaccaguuccggaaggacuucgacuuccccaagaaccggaacgugaacaacuaccaccacgccuucgacgcguaccugaccgcccucgucgggaccuaccugcugaagaaguaccccaagcucgaguccuacuucguguacggcaaguucaagaagggggacggcaucaccaaccugaagaacuucaacuuccugcacggcuucaacaagccggggaagaucaucaacaaggagacgggcgagauccucuucgaccgcgacaagcagcugggguacaugaacagcaucuacgaccugcggaaggugaucgucacccacgagcucuccacccgccacggcgccauguacgaccagacccuguacaaggccagcgacgacaaggacuccggccgcgggggcaagcagcugauccggaagaaggacaaccuccccacggagaucuacgggggcuacaccgggagcaccgacgccuucauguccaucauccgcaugaagaagaaggacaagcuguacuacaaggugaucggcgugcccacccgggucgcgcacgaggugcugcagagcgacggcaagaucaacaucuucacgcucaacaaguucaucgagcagaagcugaccaaggagaaggugaacaagaagaccggggccaucacccgcaucacggacugguucgagcuggucaucgccaaggugauguacggccaggugaucgacgacgggggccagcccuucaugcucggguccagcacccugccguacaacguccgggagcuguaccucgccaaggaccuggugaaggugaucaacaagggcagcaccuccaagagcuccuaccuggacgucuacgacgagcucgugaagucccugaacaaguacuuccccauguacgaccgcaacauguuccggcagaagaucaccgacgcccgcgacaaguucgagaagcugcccaagcgggacaaggugagcaacggcaagcuccagcagaucgggcaggucacgaucaucgaccgcauccugaucggccugcacaccaacgcgggggugagcaaccucaaggaccugggcaucgccacccccuucggguucaugcagcagggcaacggcaucucccugaccagcacggccaagaucaucuaccaguccagcaccggccucuucgagaaguccaaggcccuggacgaccugaacccgcucgccuga

SEQ ID NO: 1964 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccguuccugaaggagaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccuguaccucccggaggagaaggugcugcccaagcacagccugaucuacgagaaguucaccgucuacaacgagcucacgaaggugcgcuuccuggccgagggguucaaggacuuccaguuccugaaccggaagcagaaggagaccaucuucaacagccucuucaaggagaagcgcaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaagcugaucaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccacuccgacaaccugaaggagguggucggggagcuggccggcagccccgcgaucaagaagggcauccuccagucccugaagaucguggacgagcuggugaaggucaugggguacgagccggagcagaucguggucgagauggcccgggagaaccagaccacggccaagggccucagccgccugcggcagcgccugaccacccuccgggagagccuggccaaccugaaguccaacauccucgaggagaagaagcccaaguacgugaaggaccagguggagaaccaccaccugagcgacgaccgccuguuccucuacuaccugcagaacgggaaggacauguacaccgacgacgagcuggacaucgacaaccucucccaguacgacaucgaccugaucaucccccaggccuucaucaaggacgacagcaucgacaaccggguccugguguccagcgcgaagaaccgcggcaaguccgacgacgugcccagcgucgagaucgugaaggacugcaagguguucuggaagaagcuccuggacgccaagcugaugucccagcggaaguacgacaaccucaccaaggccgagcgcgggggccugacgagcgacgacaaggcccgguucauccagcgccagcuggucgagacccggcagaucaccaagcacguggcccgcauccucgacgagcgguucaacaacgagcuggacuccaagggccgccggauccgcaaggugaagaucgucacccucaagagcaaccucguguccaacuuccggaaggaguucggguucuacaagauccgcgaggugaacaacuaccaccacgcgcacgacgccuaccugaacgccgucguggccaaggcgauccugacgaaguacccgcagcucgagcccgaguucguguacggcgacuaccccaaguacaacagcuacaagacccggaaguccgccaccgagaagcuguucuucuacagcaacaucaugaacuucuucaagaccaaggucacgcuggccgacgggaccgugguggucaaggacgacaucgaggugaacaacgacaccggcgagaucgugugggacaagaagaagcacuucgccaccguccgcaaggugcucuccuacccccaggugaacaucgucaagaagacggagauccagaccggcggguucagcaaggagagcauccuggcccacggcaacuccgacaagcugaucccgcgcaagaccaaggacaucuaccucgaccccaagaaguacgggggcuucgacagccccaucguggcguacuccgugcuggucguggccgacaucaagaaggggaaggcccagaagcugaagaccgugacggagcuccugggcaucaccaucauggagcggagccgcuucgagaagaaccccuccgccuuccuggagagcaagggcuaccucaacauccgggacgacaagcugaugauccugccgaaguacucccucuucgagcuggagaacgggcgccggcgccugcucgccagcgcggacgagcugcagaagggcaacgagcuggcccuccccacccaguucaugaaguuccuguaccuggccucccgguacaacgagcucaaggggaagcccgaggagaucgagcagaagcaggaguucgucgugcagcacgugagcuacuucgacgacauccugcagaucaucaacgacuucuccaaccgcgucauccuggccgacgccaaccucgagaagaucaacaagcuguaccaggacaacaaggagaacaucccgguggacgagcuggcgaacaacaucaucaaccucuucaccuucacgagccugggcgcccccgccgccuucaaguucuucgacaagaucguggaccggaagcgcuacaccuccaccaaggagguccugaacagcacccucauccaccaguccaucacggggcuguacgagacccggaucgaccugggcaagcucggcgaggacuga

SEQ ID NO: 1965 - RNA, 4113 nt, Artificial Sequence
  Cas9 variant
augaccaagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccgaggagaugaccaaggucgacgaguccuucuucuaccggcuggacgagagcuuccucaccacggacgagaaggacuucgagcgccacccgaucuucggcaacaaggcggaggaggacgccuaccaccagaaguuccccaccaucuaccaccuccggaacuaccuggccgacuccagcgagaaggccgaccuccgccugguguaccuggcgcucgcccacaugaucaaguaccggggccacuuccugaucgaggggaagcugaacgccgagaacaccgacgugcagaagcuguucaccgacuucgucggcguguacgaccgcacguucgacgacucccaccugagcgagaucaccguggacgucgccuccacccugaccgagaagaucagcaagucccggcgccucgagaaccugaucaaguacuaccccacggagaagaagaacacccuguucgggaaccucaucgcccuggcgcugggccuccagcccaacuucaagaugaacuucaagcugagcgaggacgccaagcugcaguucuccaaggacaccuacgaggaggaccucgaggagcugcuggggaagaucggcgacgacuacgccgaccucuucaccagcgccaagaaccuguacgacgccauccugcucuccggcauccugacgguggacgacaacagcaccaaggcgccgcuguccgccagcaugaucaagcgguacguggagcaccacgaggaccucgagaagcugaaggaguucaucaaggccaacaaguccgagcuguaccacgacaucuucaaggacaagaacaagaacggguacgccggcuacaucgagaacggggucaagcaggacgaguucuacaaguaccucaagaacacccugagcaagaucgacggcagcgacuacuuccuggacaagaucgagcgcgaggacuuccuccggaagcagcgcaccuucgacaacggcuccaucccccaccagauccaccuccaggagaugcacgccauccugcggcgccagggggacuacuaccccuuccucaaggagaagcaggaccgcaucgagaagauccugacguuccggauccccuacuacgugggcccgcuggugcgcaaggacagccgguucgcgugggccgaguaccgcuccgacgagaagaucacccccuggaacuucgacaaggucaucgacaaggagaaguccgccgagaaguucaucacccggaugacccugaacgaccucuaccugcccgaggagaaggugcugcccaagcacagccacguguacgagacguacgccgucuacaacgagcucaccaagaucaaguacgugaacgagcaggggaaggagagcuucuucgacuccaacaugaagcaggagaucuucgaccacguguucaaggagaaccgcaaggucaccaaggagaagcugcugaacuaccucaacaaggaguucccggaguaccggaucaaggaccugaucggccuggacaaggagaacaagagcuucaacgccucccucgggaccuaccacgaccugaagaagauccuggacaaggcguuccucgacgacaaggugaacgaggaggugaucgaggacaucaucaagacgcugacccuguucgaggacaaggacaugauccacgagcgccuccagaaguacagcgacaucuucaccgccaaccagcugaagaagcuggagcggcgccacuacaccggcuggggccggcucuccuacaagcugaucaacgggauccgcaacaaggagaacaacaagacgauccuggacuaccucaucgacgacggcagcgccaaccggaacuucaugcagcugaucaacgacgacacccugcccuucaagcagaucauccagaagucccaggucgugggggacgucgacgacaucgaggccguggugcacgaccuccccggcagccccgcgaucaagaaggggauccugcaguccgucaagaucguggacgagcuggugaaggucaugggcgacaacccggacaacaucgugaucgagauggcccgcgagaaccagaccaccaaccggggccgcagccagucccagcagcggcucaagaagcugcagagcucccugaaggagcucgggagcaacauccugaacgaggagaagcccagcuacaucgaggacaagguggagaacucccaccuccagaacgaccagcuguuccuguacuacauccagaacggcaaggacauguacaccggggacgagcuggacaucgaccaccugagcgacuacgacaucgaccacaucaucccccaggccuucaucaaggacgacuccaucgacaaccgcguccugacgagcuccgccaagaaccggggcaagagcgacgacgugcccucccuggacaucgugcgcgcccgcaaggcggaguggguccggcucuacaagagcgggcugaucuccaagcgcaaguucgacaaccugaccaaggccgagcggggcggccucaccgaggccgacaaggccggguucaucaagcgccagcugguggagacccggcagaucacgaagcacguggcccagauccuggacgcgcgcuucaacaccgagcacgacgagaacgacaaggucauccgggacgugaaggugaucacccucaagagcaaccuggucucccaguuccgcaaggacuucgaguucuacaaggugcgggagaucaacgacuaccaccacgcccacgacgccuaccugaacgccguggucggcaccgcccuccugaagaaguacccgaagcuggcgagcgaguucguguacggggaguacaagaaguacgacauccgcaaguucaucacgaacuccagcgacaaggccaccgccaaguacuucuucuacuccaaccucaugaacuucuucaagaccaaggugaaguacgccgacggcaccgucuucgagcggcccaucaucgagacgaacgcggacggcgagaucgccuggaacaagcagaucgacuucgagaaggugcgcaaggugcugagcuacccccaggucaacaucgugaagaagguggagacccagaccgggggcuucuccaaggagagcauccugcccaagggggacagcgacaagcucaucccgcggaagaccaagaaggucuacugggacacgaagaaguacggcggguucgacucccccaccguggccuacagcguguucgucguggccgacguggagaagggcaaggccaagaagcugaagaccgucaaggagcuggugggcaucuccaucauggagcgcagcuucuucgaggagaaccccguggaguuccucgagaacaagggguaccacaacauccgggaggacaagcugaucaagcugcccaaguacucccucuucgaguucgagggcgggcgccggcgccugcuggcgagcgccuccgagcuccagaagggcaacgagaugguccugccgggguaccugguggagcuccuguaccacgcccaccgggccgacaacuucaacagcaccgaguaccugaacuacguguccgagcacaagaaggaguucgagaagguccucagcugcguggaggacuucgccaaccuguacguggacgucgagaagaaccuguccaagauccgcgcgguggccgacagcauggacaacuucuccaucgaggagaucagcaacuccuucaucaaccuccugacgcugaccgcccucggcgcccccgccgacuucaacuuccugggcgagaagaucccccggaagcgcuacaccagcaccaaggagugccugacggcgacccucauccaccaguccaucaccgggcuguacgagacccgcaucgaccugagcaagcucggcgaggaguga

SEQ ID NO: 1966 - RNA, 4113 nt, Artificial Sequence
  Cas9 variant
augaagaacgccaacaaggugaccggcaaguacuaccugggguucgacaucggcaccaacagcgucgggugggccgugacggacgagaacuacaaccucugcaaguucaagaagaaguccauguggggcauccgccuguucgaggacgcgaagaccgccgaggagcggcgcgggcagcgggccagccgccggcgccugcagcggcgcaagcagcggaucgaccuccugcaggagaucuucgccgaggagaucaacaagguggacgagaccuucuucauccgccugaacgagucccggcuccaccuggacgacaagaccgucagcgagaagcacccccuguucaucggcuccgaguacagcgagaaggaguacuaccgcgaguacccgacgaucuuccaccuccggaaggagcugauggaguccagcgagccccacgacauccgccugguguaccucgccauccaccacauccugaagaaccggggccacuuccugaucgacggggagcucuccaaggcgaacagcuucgacgccgccuucuaccagaugaaggaggugcugugcaacgagcuggaccucgagaucgacggcgagaacaccaccgaggucgagcgcacccugcgggaccgcaacaucuccaagagcgacaaggugaagcugcucgccgcgcugcuggccaugaaccagaacgagacggaguccaaggagaccaagaagaagaucgagaacaucugcaagcuccuggccgggaacaagggcgacaucagcaagaucuucgggcagacccccgagggcguggagaagaccuccuucagcuucggcgaggccgacuacgacgaguccauccggcccaaccuggaggagagcaucccggaccagugcuucgucaucgacuccaucaaggcccucuacgacuggaacgugcuggcggacauccugaacgggcagacguaccucagcugcgccaaggugaaccaguacgagacccacaagaacaaccugaaggagcugaagcuccuggucaaccgcuacugcagccgggaggaguacaagcgcuucuucaaguccgccguggagaaggccaacuacagcaacuacaucggcuccgccaagcaggggaacaagaucaucgacgugaagcgcugcgcggaggaggacuucuacaaggagcugaagauccuccugagcaagaucgagcccgaggaggccgaccgggagcuguacgagcgcaucaagcgggaggccgaggagggcucccuccugccccugcagcgcaacaaggacaacagcgucgugcccaaccagaugcacaaggccgagcucgcccugauccuggagaacgcgggcuccuaccucggguuccugaacgagaaggacgaggacggccugagcccggccgagaagaucaucgagcuguucuccuuccggauccccuacuacguggggccccugagcgaccgccacaaggaccggggcuccaacgccuggaucguccgcaaggccgaggggcggauccugcccuggaacuucgacgagaagguggaccgcgagaaguccaacgaggccuucaucgagcggaugaccaacaagugcaccuaccugcucggcaaggacguggucgcgaagaacagccugaucuacagccacuucauggugcugaacgagcucaacaaccuguccgugugcggcaacaagaucagcguccaggugaagcaggacaucuaccgcgagcuguuccagcggcacacgaaggucuccaagaagaugcuccugcaguacugccgcgagaagaugaugaacaaggaccuggaggaggaggaccucagcggguucgacggcgacuucaaggccaagcuguccagcuaccuggacuucgagaagaagguguucggggccaagauggaggaggaccggauccgcaagaucaccgaggacaucauccgguggaagaccaucuacggcgacgacgggaagaugcuccaggccguggucgagaaggaguacccgggcgagcuggacagcgaccagcugaaggcggugaagcaguuccgcuacuccggcugggggaacuucagcgaggaguuccucaacggcaucguggggaccgagaagcccacgggccagauguucaccaucaucgaggcccuguggcagaccaacugcaaccugaugcagcuccuguccaagaacuucaccuucauggaggagaucgagaagcacaaccgggagcuggccgggcagaucacggacaucagcuacgacaagcucgucaaggaccuguacaucucccccgccaacaagcgcgccguguggcagaccgugcgcaucgcggaggaggucaagaagaucaugggcugcgagcccgccaagaucuucguggagauggcccggggcggggagaaggagaagaagcgcaccaucagccggaagaagaagcugcucgagcuguacgccgccugcaagaaggacgcgcgcgacuggaaccgggagaucgaggaccgcgacgagcgggaguucaacuccgacaagcuguaccucuacuacacccagaugggccgcugcauguacagcggggagcggaucgaccugcacgagcugauguccgccaacagcaagugggacaucgaccacaucuacccgcaguccaaggugaaggacgacagccucgacaaccgcguccugucccugaagaagaucaacaacgagaagggcaacaagccccucagccgggacauccagcagucccagcagaagugguggacggagcugcugcagcucgaguucaucaccaagaagaaguacgaccgccugaugcaccggggcgagcugagcgaggaggagcucuccggguucaucaaccgccagcugguggagacccggcagagcaccaaggccgccgccgagcugcucggccgcauguacaacaacagcaagguggucuacgugaaggcgccccuggugucccaguuccggaaggacgaccugaacauccucaagagccgccuggccaacgacuaccaccacgccaaggacgccuaccugaacaucgcggucgggaacguguacaacgagaaguucacggacaacccccuccgguggaucgagaagcacgccggcgagaacuacuccaucaaccgcguguucgacuacgacaucgucgccggggacggcgccccggugugggccgcgccccugcgggacgagaagaacaagcugcgcaagaacgaggugggcgagaaguacgggggcaccaucgacgucauccgcaagaccgugaagcggaacgacgugcucuacaccgagcacacguacugcgggaagggcgagcuguucaacgccaccaucgccaagaaggacgggggcgccgagaucccccugaaggccggccuccagaccgggaaguacggcggguacaagagccccaacaccuccuacuucgcggccaucgaguucgacggcaagaagggggagcgcgucaagaacaucauggaggugccgguguacaucgccaacauccugcugcacgacaucgacgccuacauccgguacugcgagaccgucaagggccucaagaacgugaagauccugcgccccugcaucaagaagaacgcccugaucagcguggacggcuaccccaugcggauccgcggggcgaacgagaagaacauccuccugaagaacaaccugcagcccaucuucggccggcacgaggagacgguccgccggaucgagaaguacguggagaagaaccaggaguucgagguggacgagaaguucgacgggcucaacgaggccaaccugaccgaccuguacgacgacaucaccgagaagcucugcggcccguacgucgagcgccccuccaaccagggggaguaccugauggagaaccgggagaaguuccugaacaucagccucaaggagaaggccaagcugcuggcccagaugaucaagcucgugcgcugcgacaccgagacgaaggcggaccugcgguccaucggcgccagcaagaacgccggcgugaucuccgucaacaagaacacccucgggggcaagcgccucauccugaucaaccagagcgugaccgggcuguucgagaaccggaucgagcucuga

SEQ ID NO: 1967 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccguuccugaaggagaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccuguaccucccggaggagaaggugcugcccaagcacagccugaucuacgagaaguucaccgucuacaacgagcucacgaaggugcgcuuccuggccgagggguucaaggacuuccaguuccugaaccggaagcagaaggagaccaucuucaacagccucuucaaggagaagcgcaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaagcugaucaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccacuccgacaaccugaaggagguggucggggagcuggccggcagccccgcgaucaagaagggcauccuccagucccugaagaucguggacgagcuggugaaggucaugggguacgagccggagcagaucguggucgagauggcccgggagaaccagaccacggccaagggccucagccgcagccggcagcgccugaccacccugcgggagucccucgccaaccucaagagcaacauccuggaggagaagaagcccaaguacgugaaggaccagguggagaaccaccaccucuccgacgaccgccuguuccuguacuaccuccagaacgggaaggacauguacaccgacgacgagcuggacaucgacaaccugagccaguacgacaucgaccacaucaucccccaggccuucaucaaggacgacuccaucgacaaccggguccucgugagcuccgcgaagaaccgcggcaagagcgacgacgugcccuccgucgagaucgugaaggacugcaagguguucuggaagaagcugcuggacgccaagcucaugagccagcggaaguacgacaaccugaccaaggccgagcgcgggggccugacguccgacgacaaggcccgguucauccagcgccagcucgucgagacccggcagaucaccaagcacguggcccgcauccuggacgagcgguucaacaacgagcuggacagcaagggccgccggauccgcaaggugaagaucgucacccucaaguccaaccuggugagcaacuuccggaaggaguucggguucuacaagauccgcgaggugaacaacuaccaccacgcgcacgacgccuaccugaacgccgucguggccaaggcgauccucacgaaguacccgcagcuggagcccgaguucguguacggcgacuaccccaaguacaacuccuacaagacccgcaagagcgccaccgagaagcuguucuucuacuccaacaucaugaacuucuucaagaccaaggucacgcucgccgacgggaccgugguggucaaggacgacaucgaggugaacaacgacaccggcgagaucgugugggacaagaagaagcacuucgccaccguccggaaggugcugagcuacccccaggugaacaucgucaagaagacggagauccagaccggcggguucagcaaggaguccauccuggcccacggcaacagcgacaagcucaucccgcgcaagaccaaggacaucuaccuggaccccaagaaguacgggggcuucgacucccccaucguggcguacagcgugcuggucguggccgacaucaagaaggggaaggcccagaagcucaagaccgugacggagcugcugggcaucaccaucauggagcggucccgcuucgagaagaaccccagcgccuuccucgaguccaagggcuaccugaacauccgggacgacaagcugaugauccucccgaaguacagccuguucgagcuggagaacgggcgccggcgccuccuggccuccgcgggcgagcugcagaaggggaacgagcucgcccugcccacccaguucaugaaguuccuguaccucgccagccgguacaacgagcugaagggcaagcccgaggagaucgagcagaagcaggaguucgucgugcagcacguguccuacuucgacgacauccugcagaucaucaacgacuucagcaaccgcgucauccucgccgacgccaaccuggagaagaucaacaagcuguaccaggacaacaaggagaacaucccgguggacgagcucgcgaacaacaucaucaaccuguucaccuucacgucccugggggcccccgccgccuucaaguucuucgacaagaucguggaccggaagcgcuacaccagcaccaaggagguccucaacuccacccugauccaccagagcaucacgggccuguacgagacccggaucgaccucggcaagcugggggaggacuga

SEQ ID NO: 1968 - RNA, 4113 nt, Artificial Sequence
  Cas9 variant
augaccaagaucaaggacgacuacaucgugggccuggacaucgggaccgacagcugcggcugggucgccaugaacuccaacaacgacauccucaagcugcaggggaagacggccaucggcagccgccuguucgagggcgggaaguccgcggccgagcggcgccucuuccggaccacccaccgccggaucaagcgccggcgcuggcggcugaagcugcucgaggaguucuucgaccccuacauggccgagguggacccguacuucuucgcccgccugaaggagagcggccugagcccccucgacaagcggaagaccgugagcuccaucgucuuccccacgagcgccgaggacaagaaguucuacgacgacuaccccaccaucuaccaccuccgcuacaagcugaugaccgaggacgagaaguucgaccuccgggagguguaccuggcgauccaccacaucaucaaguaccgcgggaacuuccuguacaacaccuccgugaaggacuucaaggccagcaagaucgacgucaaguccagcaucgagaagcucaacgagcuguacgagaaccugggccucgaccugaacguggaguucaacaucuccaacacggccgagaucgagaaggugcugaaggacaagcagaucuucaagcgggacaaggucaagaagaucgccgagcuguucgcgaucaagaccgacaacaaggagcagagcaagcgcaucaaggacaucuccaagcaggucgccaacgccgugcugggguacaagacccgguucgacaccaucgcccugaaggagaucagcaaggacgagcucuccgacuggaacuucaagcugagcgacaucgacgccgacuccaaguucgaggcgcugaugggcaaccucgacgagaacgagcaggccauccugcugacgaucaaggagcuguucaacgaggugacccucaacgggaucguggaggacggcaacacccugagcgagagcaugaucaacaaguacaacgaccaccgcgacgaccucaagcugcugaaggaggugaucgagaaccacaucgaccggaagaaggccaaggagcucgcccuggccuacgaccuguacgucaacaaccgccacggccggcuccugcaggcgaagaagaagcuggggaagaucaagccgcgcuccaaggaggacuucuacaagguggugaacaagaaccucgacgacagccgcgccuccaaggagaucaagaagaagaucgagcuggacagcuucaugcccaagcagcggaccaacgccaacggcgucauccccuaccagcugcagcagcucgagcuggacaagaucaucgagaaccaguccaaguacuaccccuuccugaaggagaucaacccggugagcucccaccucaaggaggcccccuacaagcuggacgagcugauccgcuuccgggugcccuacuacgucgggccccugaucagcccgaacgaguccacgaaggacauccagaccaagaagaaccagaacuucgccuggaugauccgcaaggaggagggccggaucacccccuggaacuucgaccagaagguggaccgcaucgagagcgcgaacaaguucaucaagcggaugaccacgaaggacaccuaccucuucggcgaggacgugcugcccgccaacucccugcucuaccagaaguucaccguccugaacgagcugaacaacauccgcaucaacgggaagcggaucagcguggaccucaagcaggagaucuacgagaaccuguucaagaagcacaccacggucaccgugaagaagcuggagaacuaccucaaggagaaccacaaccuggugaaggucgagaucaagggccuggccgacgagaagaaguucaacuccgggcucaccaccuacaaccgcuucaagaaccugaacaucuucgacaaccagaucgacgaccugaaguaccggaacgacuucgagaagaucaucgaguggagcacgaucuucgaggacaaguccaucuacaaggagaagcuccgcagcaucgacuggcugaacgagaagcagaucaacgcccuguccaacauccggcuccagggcugggggcgccugagcaagaagcugcucgcccagcugcacgaccacaacggccagaccaucaucgagcagcugugggacucccagaacaacuucaugcagaucgugacccaggcggacuucaaggacgccaucgccaaggccaaccagaaccuccugguggcgaccagcgucgaggacauccugaacaacgccuacacgagccccgccaacaagaaggccauccgccaggugaucaagguggucgacgacaucgugaaggccgcguccggcaaggugccgaagcagaucgccaucgaguucacccgggacgccgacgagaaccccaagcggagccagacccgcggguccaagcuccagaaggucuacaaggaccugagcaccgagcuggccuccaagacgaucgccgaggagcucaacgaggcgaucaaggacaagaagcuggugcaggacaaguacuaccuguacuucaugcagcucggccgggacgccuacaccggggagcccaucaacaucgacgagauccagaaguacgacaucgaccacauccugccccagagcuucaucaaggacgacgcccuggacaaccgcgugcucgucucccgcgccgugaacaacggcaagagcgacaacgugccggucaagcuguucgggaacgagauggccgcgaaccugggcaugaccauccggaagaugugggaggaguggaagaacaucggccucaucuccaagaccaaguacaacaaccugcugaccgaccccgaccacaucaacaaguacaagagcgccggguucauccgccggcagcucguggagacgucccagaucaucaagcuggugagcaccauccugcagucccgcuaccccaacaccgagaucaucaccgucaaggccaaguacaaccacuaccuccgggagaaguucgaccuguacaagagccgcgaggugaacgacuaccaccacgccaucgacgcguaccuguccgccaucugcggcaaccuccuguaccagaacuaccccaaccugcggccguucuucguguacgggcaguacaagaaguucagcuccgaccccgacaaggagaaggagaucuucaacaagacgcgcaaguucagcuucaucagccagauccucaagaacaaguccgagaacagcaaggagaucgccgagaagcugaagcgggccuaccaguucaaguacaugcuggucucccgcgagaccgagaccaaggaccaggagauguucaagaugaccguguucccccgggagacgcccggcaaccucaucccgaagaagaaggggauggcccccgagaucuacggcggcuacaccaagaacagcgacgcguacauggugaucgucaagaucgacaagaagaaggagaccgaguaccgcauccuggggauccccacccgggagcuggugaaccucaagaaggccgagaaggaggaccacuacgaguccuaccugaaggagauccuggccccgcgcauccucuacaacaagaacggcaagcgggacaagaagaucacgagcuucgagaucgugaaguccaagauccccuacaagcaggucauccaggacggggacaagaaguucaugcugggcagcuccaccuacguguacaacgccaagcagcugacccucagcaccgaguccaugaaggccaucacgaacaacuucgacaaggacagcgacgagaacgacgcgcugaucaaggccuacgacgagauccuggacaagguggacaaguaccucccccuguucgacaucaacgccuuccgcaagaagcugcacuccggccgggagaaguucgucgagcucagccuggaggacaagaaggacaucauccugaaggugcucaucgggcugcacgacaaccccgccaccuccgaccugaagacccucggcuucagcuccaccgagcuggggaagaugcagaagaacagcggcaucgugcuguccgggaacgccaagcucaucuaccagagcccgacgggccuguucaagaaguccgucaagaucuccgaccuguga

SEQ ID NO: 1969 - RNA, 4113 nt, Artificial Sequence
  Cas9 variant
augaccaagaucaaggacgacuacaucgugggccuggacaucgggaccgacagcugcggcugggucgccaugaacuccgacaacgacauccucaagcugcaggggaagacggccaucggcagccaccuguucgaggcggggaaguccgccgccgaccgccgccucuuccggaccacccaccggcgcaucaagcggcgccgguggcgccugaagcugcucgaggaguucuucgaccccuacauggccaagguggacccguacuucuucgcccggcugaaggagagcggccugagcccccucgacaagcgcaagaacguguucuccaucgucuuccccaccgcggccgaggacaagaaguucuacgacgacuaccccacgaucuaccaccuccgguacaagcugaugaccgaggacgagaaguucgaccuccgcgagguguaccuggccauccaccacaucaucaaguaccggggcaacuuccuguacaacaccuccgugaaggacuucaaggccagcaagaucgacgucaaguccagcaucgagaagcucaacgagcuguacgagaaccuggggcucgaccugaacguggaguucaacaucuccaacaccgcggagaucgagaaggugcugaaggacaagcagaucuucaagcgcgacaaggucaagaagaucgccgagcuguucgccaucaagacggacaacaaggagcagagcaagcggaucaaggacaucuccaagcaggucgccaacgccgugcugggcuacaagacccgcuucgacaccaucgcgcugaaggaggugagcaaggacgagcucuccgacuggaacuucaagcugagcgacaucgacgccgacuccaaguucgaggcccugauggggaaccucgacgagaacgagcaggccauccugcugaccaucaaggagcuguucaacgccgugacgcucaacggcaucguggaggacgggaacacccugagcgaguccaugaucaacaaguacaacgaccaccgggacgaccucaagcugcugaaggaggucaucgagaaccacaucgaccgcaagaaggcggugaagcucgcccuggccuacgaccuguacgugaacaaccggcacggccagcucauccaggccaagaagaagcugggcaagaucaagccggggagcaaggaggacuucuacaaggucgugaacaagaaccuggacgacagccaggccuccaaggagaucaagaagaagaucgagcucgacagcuucaugcccaagcagcgcaccaacgcgaacggcgugauccccuaccagcugcaccagcuggagcucgacaagaucaucgagaaccaguccaaguacuaccccuuccugaaggagaucaacccggucagcucccaccugaaggaggcccccuacaagcucgacgagcugauccgguuccgcgugcccuacuacguggggccccugaucagcccgaacgaguccaccaaggacauccagacgaagaagaaccagaacuucgccuggaugauccgcaaggaggagggccggaucacccccuggaacuucgaccagaaggucgaccgcaucgagagcgccaacaaguucaucaagcggaugaccaccaaggacacguaccuguucggcgagaacgugcuccccgccaacucccugcuguaccagaaguucaccguccucaacgagcugaacaacauccgcaucaacgggaagcggaucagcguggaccugaagcaggagaucuacgagaaccucuucaagaagcacaccaccgugacggucaagaagcuggagaacuaccugaagcagaaccacaaccucgugaagguggagaucaagggccuggcggacgagaagaaguucaacuccgggcugaccaccuacaaccgcuucaagaaccucaacaucuucgacaaccagaucgacgaccugaaguaccggaaggacuucgagaagaucaucgaguggagcaccaucuucgaggacaaguccaucuacaaggagaagcugcgcagcaucgacuggcucaacgagaagcagaucaacgcccuguccaacauccggcugcagggcugggggcgccucagcaagaagcugcuggcccagcuccacgaccacaacggccagacgaucaucgagcagcugugggacucccagaacaacuucaugcagaucgucacccaggccgacuucaaggacgcgaucgccaaggccaaccagaaccugcucguggccaccagcguggaggacauccugaacgacgccuacaccucccccgcgaacaagaaggccauccggcaggucaucaaggugguggacgacaucgucaaggccgccagcggcaaggugccgaagcagaucgccaucgaguucacgcgcgacgcggacgacaaccccaagcggagccagacccgcggguccaagcugcagaagguguacaaggaccucagcaccgagcuggccuccaaggccaucgccgaggagcugaacgaggccaucaaggacaagaagcucguccaggacaaguacuaccuguacuucaugcagcugggccgggacgcguacaccggggagcccaucaacaucgacgagauccagaaguacgacaucgaccacauccucccccagagcuucaucaaggacgacgcccuggacaaccgcgugcugguguccaaggccgucaacaacgacaagagcgacaacgugccggugaagcuguucggcaacgagauggccgggaaccucggcaucacgauccggaagaugugggaggaguggaagaacaucggccugaucuccaagaccaaguacaacaaccuccugaccgaccccgaccacaucaacaaguacgagagcgcgggguucauccgccggcagcuggucgagaccucccagaucaucaagcucgugagcaccauccugcagucccgcuaccccaacacggagaucaucaccgugaaggccaaguacaaccacuaccugcgcgagaaguucgaccucuacaagagccgggaggucaacgacuaccaccacgccaucgacgccuaccuguccgccaucugcggcaaccugcucuaccagaacuaccccaaccugcgcccguucuucguguacgggcaguacaagaaguucagcuccgaccccgacaaggagaaggagaucuucaacaagacccggaaguucagcuucaucucccagauccugaagaacaagagcgagaacagcaaggagaucgcggagaagcucaagcgcgccuaccaguucaaguacaugcuggugucccgggagaccgagacgaaggaccaggagauguucaagaugaccgucuucccccgcgagacccccggcaaccugaucccgaagaagaaggggauggccaccgagaucuacggcggcuacacgaagaacagcgacgccuacauggugaucgugaagaucgacaagaagaaggagaccgaguaccggauccucgggauccccacccgcgagcuggucaaccugaagaaggccgagaaggaggaccacuacgaguccuaccucaaggagauccuggcgccccggauccuguacaacaagaacggcaagcgcgacaagaagaucaccagcuucgagaucgugaaguccaagaucccguacaagcaggucauccaggacggggacaagaaguucaugcucggcagcuccacguacguguacaacgccaagcagcugacccugagcaccgaguccaugaaggccaucaccaacaacuucgacaaggacagcgacgagaacgacgcccucaucaaggccuacgacgagauccuggacaagguggacaaguaccugccccucuucgacaucaacgcguuccggaagaagcugcacuccggccgcgagaaguucguggagcugagccucgaggacaagaaggacaucauccugaagguccugaucgggcuccacgacaaccccgccacguccgaccugaagacccugggcuucagcuccaccgagcucgggaagaugcagaagaacagcggcaucgugcuguccgggaacgccaagcugaucuaccagagccccaccggccucuucaagaaguccgugaagaucagcgaccuguga

SEQ ID NO: 1970 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccguuccugaaggagaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccuguaccucccggaggagaaggugcugcccaagcacagccugaucuacgagaaguucaccgucuacaacgagcucacgaaggugcgcuuccuggccgagggguucaaggacuuccaguuccugaaccggaagcagaaggagaccaucuucaacagccucuucaaggagaagcgcaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaagcugaucaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccacuccgacaaccugaaggagguggucggggagcuggccggcagccccgcgaucaagaagggcauccuccagucccugaagaucguggacgagcuggugaaggucaugggguacgagccggagcagaucguggucgagauggcccgggagaaccagaccacggccaagggccucagccgcagccggcagcgccugaccacccugcgggagucccucgccaaccucaagagcaacauccuggaggagaagaagcccaaguacgugaaggaccagguggagaaccaccaccucuccgacgaccgccuguuccuguacuaccuccagaacgggaaggacauguacaccgacgacgagcuggacaucgacaaccugagccaguacgacaucgaccacaucaucccccaggccuucaucaaggacgacuccaucgacaaccggguccucgugagcuccgcgaagaaccgcggcaagagcgacgacgugcccuccgucgagaucgugaaggacugcaagguguucuggaagaagcugcuggacgccaagcucaugagccagcggaaguacgacaaccugaccaaggccgagcgcgggggccugacguccgacgacaaggcccgguucauccagcgccagcucgucgagacccggcagaucaccaagcacguggcccgcauccuggacgagcgguucaacaacgagcuggacagcaagggccgccggauccgcaaggugaagaucgucacccucaaguccaaccuggugagcaacuuccggaaggaguucggguucuacaagauccgcgaggugaacaacuaccaccacgcgcacgacgccuaccugaacgccgucguggccaaggcgauccucacgaaguacccgcagcuggagcccgaguucguguacggcgacuaccccaaguacaacuccuacaagacccgcaagagcgccaccgagaagcuguucuucuacuccaacaucaugaacuucuucaagaccaaggucacgcucgccgacgggaccgugguggucaaggacgacaucgaggugaacaacgacaccggcgagaucgugugggacaagaagaagcacuucgccaccguccggaaggugcugagcuacccccaggugaacaucgucaagaagacggagauccagaccggcggguucagcaaggaguccauccuggcccacggcaacagcgacaagcucaucccgcgcaagaccaaggacaucuaccuggaccccaagaaguacgggggcuucgacucccccaagguggcguacagcgugcuggucguggccgacaucaagaaggggaaggcccagaagcucaagaccgugacggagcugcugggcaucaccaucauggagcggucccgcuucgagaagaaccccagcgccuuccucgaguccaagggcuaccugaacauccgggacgacaagcugaugauccucccgaaguacagccuguucgagcuggagaacgggcgccggcgccuccuggccuccgcgggcgagcugcagaaggggaacgagcucgcccugcccacccaguucaugaaguuccuguaccucgccagccgguacaacgagcugaagggcaagcccgaggagaucgagcagaagcaggaguucgucgugcagcacguguccuacuucgacgacauccugcagaucaucaacgacuucagcaaccgcgucauccucgccgacgccaaccuggagaagaucaacaagcuguaccaggacaacaaggagaacaucccgguggacgagcucgcgaacaacaucaucaaccuguucaccuucacgucccugggggcccccgccgccuucaaguucuucgacaagaucguggaccggaagcgcuacaccagcaccaaggagguccucaacuccacccugauccacaagagcaucacgggccuguacgagacccggaucgaccucggcaagcugggggaggacuga

SEQ ID NO: 1971 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagaaggccgaccuccgccugaucuacaucgcccuggcccacaucaucaaguuccgggggcacuuccucaucgaggacgacagcuucgacgugcgcaacaccgacaucuccaagcaguaccaggacuuccuggagaucuucaacaccacguucgagaacaacgaccugcucagccagaacguggacgucgaggcgauccugaccgacaagaucuccaagagcgccaagaaggaccggauccuggcccaguaccccaaccagaaguccaccggcaucuucgccgaguuccucaagcugaucguggggaaccaggccgacuucaagaaguacuucaaccuggaggacaagacgccccuccaguucgcgaaggacagcuacgacgaggaccuggagaaccugcucggccagaucggggacgaguucgccgaccuguucuccgccgccaagaagcuguacgacagcgugcuccuguccggcauccugacggucaucgaccucagcaccaaggccccgcuguccgcgagcaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggccuucuacaaguaccuguccaagcuccugaccaagcaggaggacagcgagaacuuccuggagaagaucaagaacgaggacuuccuccgcaagcagcggacguucgacaacggguccaucccccaccaggugcaccugaccgagcugaaggcgaucauccgccgccagagcgaguacuaccccuuccucaaggagaaccaggaccggaucgagaagauccugaccuuccgcaucccguacuacaucggcccccuggcccgggagaaguccgacuucgccuggaugacccgcaagacggacgacagcauccggcccuggaacuucgaggaccucgucgacaaggagaaguccgccgaggccuucauccaccgcaugaccaacaacgacuucuaccugcccgaggagaaggugcugccgaagcacagccugaucuacgagaaguucaccguguacaacgagcucaccaagguccgguacaagaacgagcagggcgagacguacuucuucgacuccaacaucaagcaggagaucuucgacgggguguucaaggagcaccgcaaggugagcaagaagaagcugcuggacuuccucgcgaaggaguacgaggaguuccggaucgucgacgugaucggccuggacaaggagaacaaggccuucaacgccucccuggggaccuaccacgaccucgagaagauccuggacaaggacuuccuggacaaccccgacaacgagagcauccucgaggacaucgugcagacccugacccuguucgaggaccgcgagaugaucaagaagcggcucgagaacuacaaggaccuguucacggagucccagcugaagaagcucuaccgccggcacuacaccggcugggggcgccugagcgccaagcugaucaacggcauccgggacaaggagucccagaagaccauccucgacuaccugaucgacgacggccgcagcaaccggaacuucaugcagcugaucaacgacgacgggcucuccuucaagagcaucaucagcaaggcgcaggccggcucccacagcgacaaccugaaggaggucgugggggagcuggccggcucccccgccaucaagaaggggauccuccagagccugaagaucguggacgagcuggucaaggugaugggcuacgagcccgagcagaucgucguggagauggcccgcgagaaccagaccacgaaccagggccggcgcaacucccgccagcgguacaagcuccuggacgacggggugaagaaccuggcgagcgaccucaacggcaacauccugaaggaguacccgaccgacaaccaggcccugcagaacgagcgccucuuccuguacuaccugcagaacgggcgggacauguacaccggcgaggcccucgacaucgacaaccugucccaguacgacaucgaccacaucaucccccaggccuucaucaaggacgacagcaucgacaaccgcguccugguguccagcgccaagaaccgggggaaguccgacgacgugcccagccucgagaucgucaaggacugcaagguguucuggaagaagcugcuggacgcgaagcucaugucccagcgcaaguacgacaaccugaccaaggccgagcggggcggccugacgagcgacgacaaggcccgcuucauccagcggcagcucguggagacccgccagaucaccaagcacgucgcccggauccuggacgagcgcuucaacaacgagcuggacuccaaggggcggcgcauccggaaggugaagaucgugacccucaagagcaaccuggucuccaacuuccgcaaggaguucggcuucuacaagauccgggaggugaacaacuaccaccacgcccacgacgcguaccugaacgccguggucgccaaggccauccucaccaaguacccccagcuggagccggaguucguguacggggacuaccccaaguacaacagcuacaagacgcgcaagagcgcgaccgagaagcuguucuucuacuccaacaucaugaacuucuucaagaccaaggugacccucgccgacggcacggucguggugaaggacgacaucgaggucaacaacgacaccggcgagaucgugugggacaagaagaagcacuucgccaccgugcggaagguccugagcuacccccagaacaacaucgugaagaagaccgagauccagaccgggggcuucuccaaggagagcauccuggcccacgggaacuccgacaagcucaucccccgcaagaccaaggacaucuaccuggacccgaagaaguacggcggguucgacagccccaucguggccuacuccguccuggugguggcggacaucaagaagggcaaggcccagaagcucaagaccgucaccgagcugcugggcaucacgaucauggagcggagccgcuucgagaagaaccccuccgccuuccucgagagcaagggguaccugaacauccgcgccgacaagcugaucauccuccccaaguacucccuguucgagcuggagaacggccggcgccggcuccuggccagcgcgggggagcugcagaagggcaacgagcucgcccugccgacccaguucaugaaguuccuguaccucgccucccgcuacaacgagagcaaggggaagcccgaggagaucgagaagaagcaggaguucgugaaccagcacguguccuacuucgacgacauccugcagcugaucaacgacuucagcaagcgggucauccucgccgacgccaaccuggagaagaucaacaagcuguaccaggacaacaaggagaacaucuccguggacgagcucgcgaacaacaucaucaaccuguucaccuucaccagccugggcgcccccgccgccuucaaguucuucgacaagaucguggaccgcaagcgguacacguccaccaaggagguccucaacagcacccugauccaccagagcaucaccggccuguacgagacgcgcaucgaccucgggaagcugggcgaggacuga

SEQ ID NO: 1972 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagaaggccgaccuccgccugaucuacaucgcccuggcccacaucaucaaguuccgggggcacuuccucaucgaggacgacagcuucgacgugcgcaacaccgacaucuccaagcaguaccaggacuuccuggagaucuucaacaccacguucgagaacaacgaccugcucagccagaacguggacgucgaggcgauccugaccgacaagaucuccaagagcgccaagaaggaccggauccuggcccaguaccccaaccagaaguccaccggcaucuucgccgaguuccucaagcugaucguggggaaccaggccgacuucaagaaguacuucaaccuggaggacaagacgccccuccaguucgcgaaggacagcuacgacgaggaccuggagaaccugcucggccagaucggggacgaguucgccgaccuguucuccgccgccaagaagcuguacgacagcgugcuccuguccggcauccugacggucaucgaccucagcaccaaggccccgcuguccgcgagcaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggccuucuacaaguaccuguccaagcuccugaccaagcaggaggacagcgagaacuuccuggagaagaucaagaacgaggacuuccuccgcaagcagcggacguucgacaacggguccaucccccaccaggugcaccugaccgagcugaaggcgaucauccgccgccagagcgaguacuaccccuuccucaaggagaaccaggaccggaucgagaagauccugaccuuccgcaucccguacuacaucggcccccuggcccgggagaaguccgacuucgccuggaugacccgcaagacggacgacagcauccggcccuggaacuucgaggaccucgucgacaaggagaaguccgccgaggccuucauccaccgcaugaccaacaacgacuucuaccugcccgaggagaaggugcugccgaagcacagccugaucuacgagaaguucaccguguacaacgagcucaccaagguccgguacaagaacgagcagggcgagacguacuucuucgacuccaacaucaagcaggagaucuucgacgggguguucaaggagcaccgcaaggugagcaagaagaagcugcuggacuuccucgcgaaggaguacgaggaguuccggaucgucgacgugaucggccuggacaaggagaacaaggccuucaacgccucccuggggaccuaccacgaccucgagaagauccuggacaaggacuuccuggacaaccccgacaacgagagcauccucgaggacaucgugcagacccugacccuguucgaggaccgcgagaugaucaagaagcggcucgagaacuacaaggaccuguucacggagucccagcugaagaagcucuaccgccggcacuacaccggcugggggcgccugagcgccaagcugaucaacggcauccgggacaaggagucccagaagaccauccucgacuaccugaucgacgacggccgcagcaaccggaacuucaugcagcugaucaacgacgacgggcucuccuucaagagcaucaucagcaaggcgcaggccggcucccacagcgacaaccugaaggaggucgugggggagcuggccggcucccccgccaucaagaaggggauccuccagagccugaagaucguggacgagcuggucaaggugaugggcuacgagcccgagcagaucgucguggagauggcccgcgagaaccagaccacgaaccagggccggcgcaacucccgccagcgguacaagcuccuggacgacggggugaagaaccuggcgagcgaccucaacggcaacauccugaaggaguacccgaccgacaaccaggcccugcagaacgagcgccucuuccuguacuaccugcagaacgggcgggacauguacaccggcgaggcccucgacaucgacaaccugucccaguacgacaucgaccacaucaucccccaggccuucaucaaggacgacagcaucgacaaccgcguccugguguccagcgccaagaaccgggggaaguccgacgacgugcccagccucgagaucgucaaggacugcaagguguucuggaagaagcugcuggacgcgaagcucaugucccagcgcaaguacgacaaccugaccaaggccgagcggggcggccugacgagcgacgacaaggcccgcuucauccagcggcagcucguggagacccgccagaucaccaagcacgucgcccggauccuggacgagcgcuucaacaacgagcuggacuccaaggggcggcgcauccggaaggugaagaucgugacccucaagagcaaccuggucuccaacuuccgcaaggaguucggcuucuacaagauccgggaggugaacaacuaccaccacgcccacgacgcguaccugaacgccguggucgccaaggccauccucaccaaguacccccagcuggagccggaguucguguacggggacuaccccaaguacaacagcuacaagacgcgcaagagcgcgaccgagaagcuguucuucuacuccaacaucaugaacuucuucaagaccaaggugacccucgccgacggcacggucguggugaaggacgacaucgaggucaacaacgacaccggcgagaucgugugggacaagaagaagcacuucgccaccgugcggaagguccugagcuacccccagaacaacaucgugaagaagaccgagauccagaccgggggcuucuccaaggagagcauccuggcccacgggaacuccgacaagcucaucccccgcaagaccaaggacaucuaccuggacccgaagaaguacggcggguucgacagccccaucguggccuacuccguccuggugguggcggacaucaagaagggcaaggcccagaagcucaagaccgucaccgagcugcugggcaucacgaucauggagcggagccgcuucgagaagaaccccuccgccuuccucgagagcaagggguaccugaacauccgcgacgacaagcugaugauccuccccaaguacucccuguucgagcuggagaacggccggcgccggcuccuggccagcgccggggagcugcagaagggcaacgagcucgcgcugccgacccaguucaugaaguuccuguaccucgccucccgcuacaacgagagcaaggggaagcccgaggagaucgagaagaagcaggaguucgugaaccagcacguguccuacuucgacgacauccugcagcugaucaacgacuucagcaagcgggucauccucgccgacgccaaccuggagaagaucaacaagcuguaccaggacaacaaggagaacaucuccguggacgagcucgccaacaacaucaucaaccuguucaccuucaccagccugggcgcgcccgccgccuucaaguucuucgacaagaucguggaccgcaagcgguacacguccaccaaggagguccucaacagcacccugauccaccagagcaucaccggccuguacgagacgcgcaucgaccucgggaagcugggcgaggacuga

SEQ ID NO: 1973 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccuccucuucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccgcugcugaaggagaaccucgaccgcaucgagaagauccugaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccucuaccugccggaggagaaggugcugcccaagcacagccucaucuacgagaaguucaccgucuacaacgagcugacgaaggugcgcuuccuggccgagggguucaaggacuuccaguuccucaaccggaagcagaaggagaccaucuucaacagccuguucaaggagaagcgcaaggugaccgagaaggacaucaucuccuuccugaacaaggucgacggcuacgaggggaucgccaucaagggcaucgagaagcaguucaacgccagccucuccaccuaccacgaccugaagaagauccuggggaaggacuuccucgacaacacggacaacgagcugauccuggaggacaucgugcagacccucacccuguucgaggaccgggagaugauccgcaagcggcuggacaucuacaaggacuucuucaccgagagccagcucaagaagcuguaccgccggcacuacacgggcuggggccgccuguccgcgaagcucaucaacgggauccggaacaaggagaaccagaagaccauccuggacuaccugaucgacgacggcagcgccaaccgcaacuucaugcagcucaucaaggacgccgggcuguccuucaagcccaucaucgacaaggcccgcaccggcagccacuccgacaaccugaaggagguggucggggagcucgccggcagccccgcgaucaagaagggcauccugcagucccugaagaucguggacgagcucgugaaggucaugggguacgagccggagcagaucguggucgagauggcccgggagaaccagaccacggccaagggccugagccgcagccggcagcgccugaccacccuccgggagucccuggccaaccucaagagcaacauccuggaggagaagaagcccaaguacgugaaggaccagguggagaaccaccaccuguccgacgaccgccuguuccucuacuaccugcagaacgggaaggacauguacaccgacgacgagcuggacaucgacaaccucagccaguacgacaucgaccacaucaucccccaggccuucaucaaggacgacuccaucgacaaccggguccuggugagcuccgcgaagaaccgcggcaagagcgacgacgugcccuccgucgagaucgugaaggacugcaagguguucuggaagaagcugcucgacgccaagcugaugagccagcggaaguacgacaaccugaccaaggccgagcgcgggggccucacguccgacgacaaggcccgguucauccagcgccagcuggucgagacccggcagaucaccaagcacguggcccgcauccuggacgagcgguucaacaacgagcucgacagcaagggccgccggauccgcaaggugaagaucgucacccugaaguccaaccuggugagcaacuuccggaaggaguucggguucuacaagauccgcgaggugaacaacuaccaccacgcgcacgacgccuaccucaacgccgucguggccaaggcgauccugacgaaguacccgcagcuggagcccgaguucguguacggcgacuaccccaaguacaacuccuacaagacccgcaagagcgccaccgagaagcuguucuucuacuccaacaucaugaacuucuucaagaccaaggucacgcuggccgacgggaccgugguggucaaggacgacaucgaggugaacaacgacaccggcgagaucgugugggacaagaagaagcacuucgccaccguccggaaggugcugagcuacccccaggugaacaucgucaagaagacggagauccagaccggcggguucagcaaggaguccauccucgcccacggcaacagcgacaagcugaucccgcgcaagaccaaggacaucuaccuggaccccaagaaguacgggggcuucgacucccccaucguggcguacagcgugcucgucguggccgacaucaagaaggggaaggcccagaagcugaagaccgugacggagcugcucggcaucaccaucauggagcggucccgcuucgagaagaaccccagcgccuuccuggaguccaagggcuaccuggacauccgggacgacaagcucaugauccugccgaaguacagccuguucgagcucgagaacgggcgccggcgccugcuggccuccgcgggcgagcuccagaaggggaacgagcuggcccugcccacccaguucaugaaguuccucuaccuggccagccgguacaacgagcugaagggcaagcccgaggagaucgagcagaagcaggaguucgucgugcagcacguguccuacuucgacgacauccuccagaucaucaacgacuucagcaaccgcgucauccuggccgacgccaaccuggagaagaucaacaagcucuaccaggacaacaaggagaacaucccgguggacgagcuggcgaacaacaucaucaaccuguucaccuucacgucccucggggcccccgccgccuucaaguucuucgacaagaucguggaccggaagcgcuacaccagcaccaaggagguccugaacuccacccugauccaccagagcaucacgggccucuacgagacccggaucgaccugggcaagcugggggaggacuga

SEQ ID NO: 1974 - RNA, 4113 nt, Artificial Sequence
  Cas9 variant
augaagaagcccuacagcaucggccuggacaucgggaccaacuccgugggcugggccgucgugaccgacgacuacaaggugccggccaagaagaugcgcgucuucggggacacggaccggagccacaucaagaagaaccuccugggcacccuccucuucgacgacgggaacaccgcggagucccgccggcugaagcgcaccgcccggcgccgguacacgcgccggcgcaaccggauccuguaccuccaggagaucuucaccgagagcaugaacgagaucgacgaguccuucuuccaccgccuggacgacagcuuccuggugcccgaggacaagcggggcuccaaguaccccaucuucgccacccuccaggaggagaaggaguaccacaagcaguuccccaccaucuaccaccuccgcaagcagcuggccgacagcaaggagaaguccgacgugcggcucaucuaccuggcccuggcgcacaugaucaaguaccgcggccacuuccucuacgaggagacguucgacaucaagaacaacgacauccagaagaucuucaacgaguucaucaacaucuacgacaacaccuucgaggggagcucccugagcggccagaacgcccaggucgaggccaucuucaccgacaagaucuccaagagcgccaagcgggagcgcgugcugaagcuguucccggacgagaaguccaccgggcuguucagcgaguuccugaagcucaucgugggcaaccaggcggacuucaagaagcacuucgaccuggaggagaaggccccgcugcaguucuccaaggacacguacgacgaggagcucgagaaccugcuggggcagaucggcgacgacuucgccgaccucuuccugaucgccaagaagcuguacgacgccauccuccugagcggcauccugaccgucaccgaccccuccaccaaggcgccccucagcgccagcaugaucgagcgguacgagaaccaccagaaggaccuggccgcccugaagcaguucaucaagaacaaccucccggagaaguacguggagguguucuccgaccagagcaaggacggguacgccggcuacaucgacgggaagacgacccaggaggcguucuacaaguacaucaagaaccugcuguccaaguucgagggcgccgacuacuuccucgacaagaucgagcgcgaggacuuccugcggaagcagcgcaccuucgacaacggcagcaucccccaccagauccaccuccaggagaugaacgccauccugcgccggcagggggagcacuaccccuuccugaaggagaaccgcgagaagaucgagaagauccugaccuuccggauccccuacuacgucggcccgcucgcccgcgacaaccgggacuucuccuggcugacgcgcaacagcgacgagcccauccggcccuggaacuucgaggaggugguggacaaggcccgcuccgcggaggacuucauccaccggaugaccaacuacgaccuguaccuccccgaggagaagguccugccgaagcacagccugcuguacgagaccuucgccguguacaacgagcucaccaaggugaaguucaucgccgaggggcugcgcgacuaccaguuccuggacuccggccagaagaagcagaucgucaaccagcuguucaaggagaagcggaaggugacggagaaggacaucauccacuaccugcacaacguggacggguacgacggcaucgagcugaagggcaucgagaagcaguucaacgccaaccucagcaccuaccacgaccugcugaagaucaccaaggacaaggaguucauggacgaccccaagaacgaggagauccucgagaacaucguccacacccugacgaucuucgaggaccgcgagaugaucaagcagcggcuggcccaguacgacacccucuucgacgagaaggugaucaaggcgcugacccgccggcacuacaccggguggggcaagcuguccgccaagcucaucaacgggauccgcgacaagcagagcggcaagacgauccuggacuaccugaucgacgacgacaagaucaaccggaacuucaugcagcucaucaacgacgacgggcuguccuucaaggagaucauccagaaggcccagguggucggcaagaccgacgacgugaagcaggucgugcaggagcugcccggcagccccgccaucaagaaggggauccuccaguccaucaagaucguggacgagcuggucaaggugaugggcuacgcgcuggagagcaucgugaucgagauggcccgcgagaaccagaccaccgcccgggggaagaagaacucccagcagcgcuacaagcgcaucgaggacgcccucaagaaccuggccccgggccuggacagcaacauccucaaggagaaccccacggacaacauccagcugaagaacgaccggcuguuccucuacuaccugcagaacgggaaggacauguacaccggcaagccccuggacaucaaccagcucuccagcuacgacaucgaccacaucaucccccaggcguucaucaaggacgacagcaucgacaaccgcguccugaccuccagcaaggacaaccggggcaaguccgacaacgugccgagccuggaggugguccagaagcgcaaggccuucuggcagcagcuccuggacuccaagcugaucagcgagcggaaguucaacaaccucaccaaggccgagcgcgggggccuggacgagcgggacaaggugggguucauccgccggcagcugguggagacccagcagaucacgaagaacgucgcccagauccucgacgcccgcuucaacaccgaggugaaggagaagaaccagaagauccggaccgugaagaucaucacccugaaguccaaccuggucagcaacuuccgcaaggaguucggccucuacaaggugcgggagaucaacaacuaccaccacgcgcacgacgccuaccugaacgccguggucgccaaggccauccugaagaaguaccccaagcucgagcccgaguucguguacggcgacuaccagaaguacgaccugaagaaguacaucucccgcuucaagcccagcaaggagaucgagaaggcgacggagaaguacuucuucuacuccaaccugcucaacuucuucaaggaggaggugcuguacgccgacgggaccauccggaagcgcgagaacaucgaguacagcaaggacaccggcgagaucgccugggacaaggagaaggacuucgccaccaucaagaagguccuguccuacccccaggugaacaucgugaagaagcgggagguccagaccgggggcuucagcaaggaguccauccuccccaaggggaacagcgacaagcugaucccccgcaagacgaaggacauccugugggacaccaccaaguacggcggcuucgacuccccggugaucgcguacagcauccuccugaucgccgacaucgagaaggggaaggccaagaagcugaagacggugaagacccucgucggcaucaccaucauggagaaggccgccuucgaggagaaccccaucaccuuccuggagaacaagggguaccacaacgugcggaaggagaacauccugugccuccccaaguacagccuguucgagcuggagaacggccgccggcgccuccuggcguccgccaaggagcugcagaaggggaacgagaucgugcuccccgucugccugacgacccugcucuaccacagcaagaaccugcacaagcuggacgagccggagcaccucgaguacauccagaagcaccgcaacgaguucaaggaccugcugaaccucguguccgaguucagccagaaguacauccuggccgaggccaaccuggagaagaucaaggaccucuacgccgacaacgagcaggcggacaucgagauccuggccaacuccuucaucaaccugcucaccuucaccgcccugggcgcccccgccgcguucaaguucuucggcaaggacguggaccggaagcgcuacacgaccgucagcgagauccugaacgccacccucauccaccaguccaucaccgggcuguacgagacgcggaucgaccugagcaagcucggcgaggaguga

SEQ ID NO: 1975 - RNA, 4113 nt, Artificial Sequence
  Cas9 variant
augaagaagcccuacagcaucggccuggacaucgggaccaacuccgugggcugggccgucaucaccgacgacuacaaggugccggccaagaagaugaaggugcucgggaacacggacaagaacuacaucaagaagaaccugcugggcgcgcuccuguucgacagcgggaacaccgccgaggaccgccggcugaagcgcaccgcccggcgccgguacacccgccggcgcaaccggcuccuguaccugcaggacaucuucuccgacgagaugaacaaggucgacgagagcuucuuccaccgccucgaggacuccuuccuggugagcgaggacaagcggggcgaccaccaccccaucuucggcaacguggucgacgaggugaaguaccacgagcaguuccccacgaucuaccaccuccgcaaguaccucgccgacacccccgagaaggccgaccugcggcugguguaccucgcgcuggcccacaugaucaaguuccgcgggcacuuccugaucgacgacccgaagcucgacgucaagaacaccgacucccaggagcuguucagccaguuccugaccgccuacgacgugacgcaggaggacucccaccucgccgacgugaagaucaacaucagcgacaucaucaccgagaagaugaacaagucccggaaggucgaggcgcugcuguuccacuuccccagccagaagaagaacuccuucuucggcaaccucgugagccugguguucgggcugcuccccaacuucaagaccaacuucaaccuggccgaggacgccaagcugcagcucuccaaggacagcuacgacgaggaccuggagaaccugcucggccagaucggggacgaguacaccgacgucuucguggccgcccgcaagcuguacgacuccauccugcucagcggcauccugacggugaacgaccuguccaccaaggcgauccucagcgccagcaugguccggcgcuacgaggagcacaacaaggaccuggccaagcugaaggccuucgugaaggccaacuucacccacgacguguucaaggaggucuucuccgacgcgagcaagaacggcuacgccggguacaucgagggcaagaccucccaggaggacuucuacaaguacgugaagaaccucaucgggaagguggacggcagcgccgacuucaucgagaagaucgaccgggaggacuuccugcgcaagcagcggacguucgacaacggcuccaucccccaccagguccaccuggccgagaugaaggccauccuccgccgccagggggaguacuacccguuccugaaggagcacgcggagaagauccagcagauccugaccuuccggauccccuacuacgugggcccccucgaccgccacgggcacagcgacuucgccugggccuccuucaacagcgaggagaaggucacccccuggaacuucgaggagaucaucgacaagaacaaguccgcccaggccuucaucgagcggaugaccaaccaggaccuguaccugccgaacgagaaggugcugcccaagcacagcccccucuacgagaaguacacgguguacaacgagcugaccaagaucaaguacgucaccgagaccggcacggcgaaguucuucgacgccaaccugaagcaggagaucuucgacgggcuguucaagaaggagcgcaaggugaccaagcggaagcugcugaccuuccucgagaagaacuucgacgaguuccgcaucguggacauccagggccuggacaaggagaccgagacguucaacgccuccuacggcaucuaccaggaccugcucaagaucaucaaggacaaggccuucauggacgacagcgagaacgcggacauccuggaggacaucguccugacccucacccuguucgaggaccgggagaugaucaagcagcgccuggccaaguacgccgaccucuucgacaagaaggugaucgacaaccuggcccggcgccgguacaccggguggggccgccuguccgccaagcuccugaacgggauccgggacaagcgcagccggaagacgaucauggacuaccugguggacgacggccgcuccaaccggaaccucaugcagcugaucaccgacgacaaccugaccuucaaggacgagaucgcgaaggcccaguacagcgacaacuccgacgaccuccaccaggucgugcaggaccuggccgggagccccgccaucaagaagggcauccugcaguccgugaagaucgucgacgagcucgugaaggugaugggcuacgagccggagcagaucgucguggagauggcccgcgagaaccagaccacggcgaaggggcggcgcaacagccagcagcgcuacaagcggcuggaggaggccaucaagaaccuggaccgcgaccucaacuacaagauccugaaggagcaccccaccgacaaccaggcccugcagaacgaccgccucuuccuguacuaccugcagaacggccgggacauguacaccggggagagccucgacaucaaccggcuguccgacuacgacaucgaccacaucaucccccaggccuucaucaaggacaacagcaucgacaaccgcgugcuggucuccagcgccaagaaccggggcaaguccgacgacgugcccagcgaggacguggucaaccgcaugcggccguucuggaacaagcuccugaacugcgggcugaucucccagcgcaaguacagcaaccucaccaagaaggagcugacccccaacgacaaggcgggcuucaucaagcggcagcugguggagacgcgccagaucaccaagcacguggcccggauccucgacgagcacuucaacaaggaguucgacgaggacaagaagcgcauccggaaggucaagguggugacccugaaguccaaccuggucagcaacuuccgcaaggaguucgagcucuacaaggugcgggagaucaacgacuaccaccacgcccacgacgccuaccugaacgcgguggucgccaaggcccugcucaugaaguaccccaagcuggagcccgaguucguguacggcgaguacccgaaguacaacuccuaccgcgagcggaagaccgccacgcagcgcauguucuucuacagcaacaucaugaacauguucaaguccaaggugaagcuggccgacgagcggaucaucgagcgccccaugaucgaggucaacgacgagaccggggagaucgcgugggacaagaccaagcacaucgccaccgugaagaaggugcucagcuacccccagaucaacaucgucaagaagguggaggagcagacgggcgggcugaccaacgagaccaucuacccccgcggcuccuucgacaagcugcucaaccggaagaacacccuggaggccagcaaguacggcggguucggcuccccgacgguggccuacugcguccuggugguggccgacagcaagaacgagaacgggaaggucaagaagcucaagcugggcagcgagcugcucgggaucaccauccuggagaagaacgacuucgagaacaacucccuggacuuccucagccgcaagggcuaccagggcgugcaggagaagaagaucaucaagcugcccaaguacucccuguucgaguuccaggacgggagccggcgcaugcucuccagcgugauggcgaacgacaacaagcggggcgaccugcagaaggccaacgagaugauccugcccgccuaccucgucaagcugcuguaccacgccaagcacaucaacuccgugggggagccggcccacaagaacuacaucaacgagcacugcagcgaguuccaggaccuccugaacuacauccgccaguucgcggacaaguucguggacgucgacaagaaccuguccaagauccggagccucuccaagagcauggccgaguacuccgugagcgagaucugcuccagcuucgugaaccugcugacccucaccgcccugggcgcccccgcggacuucaaguucuucgggacgaccaucccccgcaagcgguacggcagcccccaguccauccuguccgccacccucauccaccagagcaucaccggccuguacgagacgcgcaucgaccugagcaagcucggggaggacuga

SEQ ID NO: 1976 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccuccucuucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccguuccugaaggagaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccuguaccucccggaggagaaggugcugcccaagcacagccugaucuacgagaaguucaccgucuacaacgagcucacgaaggugcgcuuccuggccgagggguucaaggacuuccaguuccugaaccggaagcagaaggagaccaucuucaacagccucuucaaggagaagcgcaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaagcugaucaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccacuccgacaaccugaaggagguggucggggagcuggccggcagccccgcgaucaagaagggcauccuccagucccugaagaucguggacgagcuggugaaggucaugggguacgagccggagcagaucguggucgagauggcccgggagaaccagaccacggccaagggccucagccgccugcggcagcgccugaccacccuccgggagagccuggccaaccugaaguccaacauccucgaggagaagaagcccaaguacgugaaggaccagguggagaaccaccaccugagcgacgaccgccuguuccucuacuaccugcagaacgggaaggacauguacaccgacgacgagcuggacaucgacaaccucucccaguacgacaucgaccacaucaucccccaggccuucaucaaggacgacagcaucgacaaccggguccugguguccagcgcgaagaaccgcggcaaguccgacgacgugcccagcgucgagaucgugaaggacugcaagguguucuggaagaagcugcucgacgccaagcugaugucccagcggaaguacgacaaccugaccaaggccgagcgcgggggccucacgagcgacgacaaggcccgguucauccagcgccagcuggucgagacccggcagaucaccaagcacguggcccgcauccuggacgagcgguucaacaacgagcucgacuccaagggccgccggauccgcaaggugaagaucgucacccucaagagcaaccugguguccaacuuccggaaggaguucggguucuacaagauccgcgaggugaacaacuaccaccacgcgcacgacgccuaccugaacgccgucguggccaaggcgauccugacgaaguacccgcagcuggagcccgaguucguguacggcgacuaccccaaguacaacagcuacaagacccggaaguccgccaccgagaagcuguucuucuacagcaacaucaugaacuucuucaagaccaaggucacgcuggccgacgggaccgugguggucaaggacgacaucgaggugaacaacgacaccggcgagaucgugugggacaagaagaagcacuucgccaccguccgcaaggugcuguccuacccccaggugaacaucgucaagaagacggagauccagaccggcggguucagcaaggagagcauccucgcccacggcaacuccgacaagcugaucccgcgcaagaccaaggacaucuaccuggaccccaagaaguacgggggcuucgacagccccaucguggcguacuccgugcucgucguggccgacaucaagaaggggaaggcccagaagcugaagaccgugacggagcugcucggcaucaccaucauggagcggagccgcuucgagaagaaccccuccgccuuccuggagagcaagggcuaccugaacauccgggacgacaagcucaugauccugccgaaguacucccuguucgagcucgagaacgggcgccggcgccugcuggccagcgcggacgagcuccagaagggcaacgagcuggcccugcccacccaguucaugaaguuccucuaccuggccucccgguacaacgagcugaaggggaagcccgaggagaucgagcagaagcaggaguucgucgugcagcacgugagcuacuucgacgacauccuccagaucaucaacgacuucuccaaccgcgucauccuggccgacgccaaccuggagaagaucaacaagcucuaccaggacaacaaggagaacaucccgguggacgagcuggcgaacaacaucaucaaccuguucaccuucacgagccucggcgcccccgccgccuucaaguucuucgacaagaucguggaccggaagcgcuacaccuccaccaaggagguccugaacagcacccugauccaccaguccaucacggggcucuacgagacccggaucgaccugggcaagcugggcgaggacuga

SEQ ID NO: 1977 - RNA, 4113 nt, Artificial Sequence
  Cas9 variant
auggagaagaacaaggaguacgugaucggccuggacaucgggaccggcagcgucgggugguccgccaucagcaccgacaacuaccagcucauccgccagaagggcaagaaccugaucggggugcggcuguucaacuccgccgagacggcggaggagcgccggggcuaccgcaccacccggcgccggcucagccgccggcgcuggcggaugucccugcugaacgacaucuuccgccccgagcucaacgagaucgacgagaacuuccuggcccggcugaaguacagcuggguguccccgcucgaccagaagaacccccagcugaacgagcagggcaccaacgccagccuguacggggacaucgaggccgaccaggccuuccaccgcgcguaccccacgaucuaccaccuccggaagacccugauggaggacaaccagaagcacgaccugcgcgaggucuaccucgccauccaccacaucgugaaguaccggggccacuuccugacccccgacuucgacgccaacucccagaccaucgacaucaaggggcuguucaagcagcucggcgacgugagcggguccaucgagcugcaggccgaccagacgagcaccgucaucgcggccuuccaguccauccugcucgacuucaccaagaccccgacggagagcggccgccuggccggccagcuguucuccgaccagaacaaggacaagcaggccaagaagcaggucgaggagcuguucaagcuccugcgcgggggcaaggggagccucgccgacauguuccugcugaccgaccucgacaagguggugaagaaccagcugaaguucgcguucgacgacgccguggacgagaaccugaaccucaucuccaaccugaucaacgaggagcaguacgagcugcuccugaacauccagaagcugcggggcaccaucauccucaagcagauccugggcgacgacgagaccgugagcgacgccaagguccgguccuacgaggagcacgcccaccagcugaaggagcucaaggcccaggugcugacgaaggacaacaaggagaaguucgaggaggcguaccagcugauccagaagggggacgccagccgcaucgacggccucaagaagcugaagaccaucaucaaccaggagcacgaggcccugcgccucgacaaguacgaggccgacaagcugcugaagcugaucgagcucgaccagcugcugcccgugcagcggagcaagcgcaacggggagaucccccaccagcuccacgaguucgagcugaagaagaucaucgagaagcagggccgguacuaccccuuccugcgcgagaccuucgagcgggacgggcaggaguucaacaagaucggccagcucgucaacuuccgcaucccguacuacgugggcccccugguggacccccggcuggccgggauccaguccggcgaccagaccaaccacuggaugacgcagaagaaggcggggaagaucacccccuggaacuacaccgagcucaucgacaucgacaagagcgccgccgaguucaucaagcgcaugaccggcacggacaccuaccuggucggggagccgucccugcacaaggccagccucaucuaccaggacuacaacgugcugcaggagcugaacaaccuccgguacgacggcaagccccugcccguggacgccaagcaggagaucuacuccaaccugcaggucagccucaagaacgcgaccaagaacaagaucaacuccuuccugaucagcgagggcuaccugcaggacggggaggagcucaccggcuucgccgggaaggagcugaagaacaagcuguccagcuuccacuacuucaagaacaucuucggccccgagcgcaugaacacgcucgggaccgacaaccuggagaagaucaccgagcugcagaccguguucgaggaccggcacaugcucaagcgccagcugcagaagcugggcuuccucgacgacgacgagugcgagaagcuggccggcaagcacuucacgggguggggcaaccuguccaagaagcuccugaacaccccggccaucaucgaccccgagaucaacgagaacaagaucagccugaucgacgcgcucuacaaggggcagcggaaccuguccuucuacgugaacaacauggacgacaaguaccaguuccgcgacuggaucgagagcgagaaccagucccagcaggucgagaucagccuggacgagaagaucaagaaccucgccggcucccccgccaucaagcggggcaucacccagagcauggccgugauccaggacaucauccgcgccaacaacgggaucucccccaagcggaucuaccuggaguucgcgcgcgagagccagaacagcuaccagccgaacucccggaucaagcagaucgagaagaucuacgaccagaacaagaaggagcugaugaaggucuaccccgacguguucaaggacgugcagggcguccucaacaacguggacgagaacaacagccuguccgagaaggccuuccuguacuucaugcagcucgggaaggacauguacaccggcgaggcccuggacuucgacaagcuguacacguacgacaucgaccacaucaucccccaggccaugaccaaggacaacagcugggacaacaaggugcucgucaccgccaucaagaaccgcgagaaguccaaccaggugcuggacaacgcgauccaggccaagaugcacaacuucuggcugcagcucaagaaggugaaccugcugagccagcgcaaguacgacacccucaugaagaccaacuucuccaagggggacgagaagaaguucaucgcccggagccuggucgagacgcgccagaucaucaagaacguggccgagcugaucaaguccgaguucgaccacguggaggccauccccauccggcaggagcucaccagcgacaugcgccagcugauggacuacaagaagaaccggcuggucaacgacuaccaccacgcgcacgacgcccuccugaucgccaccgugggcgaguucaugcagaagcgcggcuucaugcaggggaugaacccgucccagaacguguaccacggcuacacccaguacgucaagaaguggcugagcauggccaagaaggcgcgguccgccgagaagcccgagcgcaucuucccccuccaguucgugguggggagcaugcggauggccguccgcgacggccagguggacaaggugacgcaccccgccaccggggagaucugcuggaccgccgacaacgaggcguaccugcggaagguccugggcuacaagaacauccucgugacccgcaaggugaagaacgccggcaagcuguaccagcgggucacggugaagccgaagggguccggcgaggcccccgugaaccaccagaaguccgacaucaacaucuacgggggcgucaccuccgagcaggccgccgagcuggugcucauccgcaucaaggcgaagaacaacgccaagaacauggugaucaagauccccaccgccaucgccaaccaggucgccaacaagaccacgaccuacgacgcguacgugcggagccugaacaucccgaacuacgccgggaucauccuggaccagaucccccucggccagcugguguucgacgagcgcaccagcuucuaccuggccuccgccgagaucaagcacaacgcgcggcagcucugggucaaccagcacaucaacaacgugcugaccaagaagaacaucaacgacgaggagcgcgacaacauccugaaccuccugacgaacgagaagaaccuggagcgguucaagcuccuggagcccgaccugaagcgcgugaaggccgccaagcagcagugggccagcugcgacgaccaggagcagaugcagauccuccggaucaucaucaacaagaugcacgacgacgccagcccccagaucccgggcaagaucgaccccuucaagaacuaccuggacaagcaggggaagggcuggcgcgaccugcgcaccaagaaggggaugaagcucagcgacaacgcggaguucgucuaccagucccccaccggccuguaccaccggaagaucagcaucaacgagcugcucaagcagaagcagcuggaguga

SEQ ID NO: 1978 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcgcaagcagcgcaccuucgacaacggcagcaucccccaccaggugcaccugaccgagcuccgggccaucauccgccggcaguccgaguacuacccguuccugaaggagaaccuggaccgcaucgagaagauccucaccuuccggauccccuacuacgucggcccccuggcccgcgagaaguccgacuucgccuggaugacgcggaagaccgacgacagcauccgccccuggaacuucgaggaccugguggacaaggagaaguccgccgaggcguucauccaccggaugaccaacaacgaccuguaccucccggaggagaaggugcugcccaagcacagccugaucuacgagaaguucaccgucuacaacgagcucacgaaggugcgcuuccuggccgagggguucaaggacuuccaguuccugaaccggaagcagaaggagaccaucuucaacagccucuucaaggagaagcgcaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgggagaugauccgcaagcggcuggacaucuacaaggacuucuucaccgagagccagcugaagaagcucuaccgccggcacuacacgggcuggggccgccuguccgcgaagcugaucaacgggauccggaacaaggagaaccagaagaccauccucgacuaccugaucgacgacggcagcgccaaccgcaacuucaugcagcugaucaaggacgccgggcucuccuucaagcccaucaucgacaaggcccgcaccggcagccaccuggacaaccugaaggagguggucggggagcucgccggcucccccgcgaucaagaagggcauccugcagagccugaagaucguggacgagcucgugaaggucaugggguacgagccggagcagaucguggucgagauggcccgggagaaccagaccacggccaagggccugucccgcagccggcagcgccugaccacccuccgggagagccuggccaaccugaaguccaacauccucgaggagaagaagcccaaguacgugaaggaccagguggagaaccaccaccugagcgacgaccgccuguuccucuacuaccugcagaacgggaaggacauguacaccgacgacgagcuggacaucgacaaccucucccaguacgacaucgaccacaucaucccccaggccuucaucaaggacgacagcaucgacaaccggguccugguguccagcgcgaagaaccgcggcaaguccgacgacgugcccagccuggagaucgucaaggacugcaagguguucuggaagaagcuccuggacgccaagcugaugucccagcggaaguacgacaaccucaccaaggccgagcgcgggggccugacgagcgacgacaaggcccgguucauccagcgccagcugguggagacccggcagaucaccaagcacgucgcccgcauccucgacgagcgguucaacaacgagcuggacuccaagggccgccggauccgcaaggugaagaucgugacccucaagagcaaccucgucuccaacuuccggaaggaguucggguucuacaagauccgcgaggugaacaacuaccaccacgcgcacgacgccuaccugaacgccguggucgccaaggcgauccugacgaaguacccgcagcucgagcccgaguucguguacggcgacuaccccaaguacaacagcuacaagacccggaaguccgccaccgagaagcuguucuucuacagcaacaucaugaacuucuucaagaccaaggugacgcuggccgacgggaccgucguggugaaggacgacaucgaggucaacaacgacaccggcgagaucgugugggacaagaagaagcacuucgccaccgugcgcaagguccucuccuacccccaggugaacaucgugaagaagacggagguccagaccggcggguucagcaaggagagcauccuggcccacggcaacuccgacaagcugaucccgcgcaagaccaaggacaucuaccucgaccccaagaaguacgggggcuucgacagccccaucguggcguacuccgugcuggucguggccgacaucaagaaggggaaggcccagaagcugaagaccgugacggagcuccugggcaucaccaucauggagcggagccgcuucgagaagaaccccuccgccuuccuggagagcaagggcuaccucaacauccggaccgacaagcugaucauccugccgaaguacucccucuucgagcuggagaacgggcgccggcgccugcucgccagcgcgggcgagcugcagaaggggaacgagcuggcccuccccacccaguacaugaaguuccuguaccuggccucccgguacaacgagcucaagggcaagcccgaggagaucgagcagaagcaggaguucgucgugcagcacgugagcuacuucgacgacauccugcagaucaucaacgacuucuccaaccgcgucauccuggccgacgccaaccucgagaagaucaacaagcuguaccaggacaacaaggagaacaucccgguggacgagcuggcgaacaacaucaucaaccucuucacguucaccagccugggggcccccgccgccuucaaguucuucgacaagaucguggaccggaagcgcuacaccuccaccaaggagguccugaacagcacgcucauccaccaguccaucaccggccuguacgagacccggaucgaccugggcaagcucggggagggcuga

SEQ ID NO: 1979 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagaaggccgaccuccgccugaucuacaucgcccuggcccacaucaucaaguuccgggggcacuuccucaucgaggacgacagcuucgacgugcgcaacaccgacaucuccaagcaguaccaggacuuccuggagaucuucaacaccacguucgagaacaacgaccugcucagccagaacguggacgucgaggcgauccugaccgacaagaucuccaagagcgccaagaaggaccggauccuggcccaguaccccaaccagaaguccaccggcaucuucgccgaguuccucaagcugaucguggggaaccaggccgacuucaagaaguacuucaaccuggaggacaagacgccccuccaguucgcgaaggacagcuacgacgaggaccuggagaaccugcucggccagaucggggacgaguucgccgaccuguucuccgccgccaagaagcuguacgacagcgugcuccuguccggcauccugacggucaucgaccucagcaccaaggccccgcuguccgcgagcaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggccuucuacaaguaccuguccaagcuccugaccaagcaggaggacagcgagaacuuccuggagaagaucaagaacgaggacuuccuccgcaagcagcggacguucgacaacggguccaucccccaccaggugcaccugaccgagcugaaggcgaucauccgccgccagagcgaguacuaccccuuccucaaggagaaccaggaccggaucgagaagauccugaccuuccgcaucccguacuacaucggcccccuggcccgggagaaguccgacuucgccuggaugacccgcaagacggacgacagcauccggcccuggaacuucgaggaccucgucgacaaggagaaguccgccgaggccuucauccaccgcaugaccaacaacgacuucuaccugcccgaggagaaggugcugccgaagcacagccugaucuacgagaaguucaccguguacaacgagcucaccaagguccgguacaagaacgagcagggcgagacguacuucuucgacuccaacaucaagcaggagaucuucgacgggguguucaaggagcaccgcaaggugagcaagaagaagcugcuggacuuccucgcgaaggaguacgaggaguuccggaucgucgacgugaucggccuggacaaggagaacaaggccuucaacgccucccuggggaccuaccacgaccucgagaagauccuggacaaggacuuccuggacaaccccgacaacgagagcauccucgaggacaucgugcagacccugacccuguucgaggaccgcgagaugaucaagaagcggcucgagaacuacaaggaccuguucacggagucccagcugaagaagcucuaccgccggcacuacaccggcugggggcgccugagcgccaagcugaucaacggcauccgggacaaggagucccagaagaccauccucgacuaccugaucgacgacggccgcagcaaccggaacuucaugcagcugaucaacgacgacgggcucuccuucaagagcaucaucagcaaggcgcaggccggcucccacagcgacaaccugaaggaggucgugggggagcuggccggcucccccgccaucaagaaggggauccuccagagccugaagaucguggacgagcuggucaaggugaugggcuacgagcccgagcagaucgucguggagauggcccgcgagaaccagaccacgaaccagggccggcgcaacucccgccagcgguacaagcuccuggacgacggggugaagaaccuggcgagcgaccucaacggcaacauccugaaggaguacccgaccgacaaccaggcccugcagaacgagcgccucuuccuguacuaccugcagaacgggcgggacauguacaccggcgaggcccucgacaucgacgaccugucccaguacgacaucgaccacaucaucccccaggccuucaucaaggacgacagcaucgacaaccgcguccugguguccagcgccaagaaccgggggaaguccgacgacgugcccagccucgagaucgucaaggacugcaagguguucuggaagaagcugcuggacgcgaagcucaugucccagcgcaaguacgacaaccugaccaaggccgagcggggcggccugacgagcgacgacaaggcccgcuucauccagcggcagcucguggagacccgccagaucaccaagcacgucgcccggauccuggacgagcgcuucaacaacgagcuggacuccaaggggcggcgcauccggaaggugaagaucgugacccucaagagcaaccuggucuccaacuuccgcaaggaguucggcuucuacaagauccgggaggugaacaacuaccaccacgcccacgacgcguaccugaacgccguggucgccaaggccauccucaccaaguacccccagcuggagccggaguucguguacggggacuaccccaaguacaacagcuacaagacgcgcaagagcgcgaccgagaagcuguucuucuacuccaacaucaugaacuucuucaagaccaaggugacccucgccgacggcacggucguggugaaggacgacaucgaggucaacaacgacaccggcgagaucgugugggacaagaagaagcacuucgccaccgugcggaagguccugagcuacccccagaacaacaucgugaagaagaccgagauccagaccgggggcuucuccaaggagagcauccuggcccacgggaacuccgacaagcucaucccccgcaagaccaaggacaucuaccuggacccgaagaaguacggcggguucgacagccccaucguggccuacuccguccuggugguggcggacaucaagaagggcaaggcccagaagcucaagaccgucaccgagcugcugggcaucacgaucauggagcggagccgcuucgagaagaaccccuccgccuuccucgagagcaagggguaccugaacauccgcgccgacaagcugaucauccuccccaaguacucccuguucgagcuggagaacggccggcgccggcuccuggccagcgcgggggagcugcagaagggcaacgagcucgcccugccgacccaguucaugaaguuccuguaccucgccucccgcuacaacgagagcaaggggaagcccgaggagaucgagaagaagcaggaguucgugaaccagcacguguccuacuucgacgacauccugcagcugaucaacgacuucagcaagcgggucauccucgccgacgccaaccuggagaagaucaacaagcuguaccaggacaacaaggagaacaucuccguggacgagcucgcgaacaacaucaucaaccuguucaccuucaccagccugggcgcccccgccgccuucaaguucuucgacaagaucguggaccgcaagcgguacacguccaccaaggagguccucaacagcacccugauccaccagagcaucaccggccuguacgagacgcgcaucgaccucgggaagcugggcgaggacuga

SEQ ID NO: 1980 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagcgcgccgaccuccggcugaucuacaucgcccuggcccacaucaucaaguuccgcgggcacuuccucaucgaggacgacagcuucgacgugcggaacaccgacaucuccaagcaguaccaggacuuccuggagaucuucaacaccacguucgagaacaacgaccugcucagccagaacguggacgucgaggcgauccugaccgacaagaucuccaagagcgccaagaaggaccgcauccuggcccaguaccccaaccagaaguccaccggcaucuucgccgaguuccucaagcugaucguggggaaccaggccgacuucaagaaguacuucaaccuggaggacaagacgccccuccaguucgcgaaggacagcuacgacgaggaccuggagaaccugcucggccagaucggggacgaguucgccgaccuguucuccgccgccaagaagcuguacgacagcgugcuccuguccggcauccugacggucaucgaccucagcaccaaggccccgcuguccgcgagcaugauccagcgguacgacgagcaccgcgaggaccugaagcagcucaagcaguucgugaaggccagccugcccgagaaguaccaggagaucuucgccgacuccagcaaggacggcuacgccggguacaucgagggcaagaccaaccaggaggccuucuacaaguaccuguccaagcuccugaccaagcaggaggacagcgagaacuuccuggagaagaucaagaacgaggacuuccuccggaagcagcgcacguucgacaacggguccaucccccaccaggugcaccugaccgagcugaaggcgaucauccgccggcagagcgaguacuaccccuuccucaaggagaaccaggaccgcaucgagaagauccugaccuuccggaucccguacuacaucggcccccuggcccgcgagaaguccgacuucgccuggaugacccggaagacggacgacagcauccgccccuggaacuucgaggaccucgucgacaaggagaaguccgccgaggccuucauccaccggaugaccaacaacgacuucuaccugcccgaggagaaggugcugccgaagcacagccugaucuacgagaaguucaccguguacaacgagcucaccaagguccgcuacaagaacgagcagggcgagacguacuucuucgacuccaacaucaagcaggagaucuucgacgggguguucaaggagcaccggaaggugagcaagaagaagcugcuggacuuccucgcgaaggaguacgaggaguuccgcaucgucgacgugaucggccuggacaaggagaacaaggccuucaacgccucccuggggaccuaccacgaccucgagaagauccuggacaaggacuuccuggacaaccccgacaacgagagcauccucgaggacaucgugcagacccugacccuguucgaggaccgggagaugaucaagaagcgccucgagaacuacaaggaccuguucacggagucccagcugaagaagcucuaccggcgccacuacaccggcugggggcggcugagcgccaagcugaucaacggcauccgcgacaaggagucccagaagaccauccucgacuaccugaucgacgacggccggagcaaccgcaacuucaugcagcugaucaacgacgacgggcucuccuucaagagcaucaucagcaaggcgcaggccggcucccacagcgacaaccugaaggaggucgugggggagcuggccggcucccccgccaucaagaaggggauccuccagagccugaagaucguggacgagcuggucaaggugaugggcuacgagcccgagcagaucgucguggagauggcccgggagaaccagaccacgaaccagggccgccgcaacucccggcagcgcuacaagcuccuggacgacggggugaagaaccuggcgagcgaccucaacggcaacauccugaaggaguacccgaccgacaaccaggcccugcagaacgagcgccucuuccuguacuaccugcagaacgggcgggacauguacaccggcgaggcccucgacaucgacgaccugucccaguacgacaucgaccacaucaucccccaggccuucaucaaggacgacagcaucgacaaccggguccugguguccagcgccaagaaccgcgggaaguccgacgacgugcccagccucgagaucgucaaggacugcaagguguucuggaagaagcugcuggacgcgaagcucaugucccagcggaaguacgacaaccugaccaaggccgagcgcggcggccugacgagcgacgacaaggcccgguucauccagcgccagcucguggagacccggcagaucaccaagcacgucgcccgcauccuggacgagcgguucaacaacgagcuggacuccaaggggcgccggauccgcaaggugaagaucgugacccucaagagcaaccuggucuccaacuuccggaaggaguucggcuucuacaagauccgcgaggugaacaacuaccaccacgcccacgacgcguaccugaacgccguggucgccaaggccauccucaccaaguacccccagcuggagccggaguucguguacggggacuaccccaaguacaacagcuacaagacgcgcaagagcgcgaccgagaagcuguucuucuacuccaacaucaugaacuucuucaagaccaaggugacccucgccgacggcacggucguggugaaggacgacaucgaggucaacaacgacaccggcgagaucgugugggacaagaagaagcacuucgccaccgugcggaagguccugagcuacccccagaacaacaucgugaagaagaccgagauccagaccgggggcuucuccaaggagagcauccuggcccacgggaacuccgacaagcucaucccccggaagaccaaggacaucuaccuggacccgaagaaguacggcggguucgacagccccaucguggccuacuccguccuggugguggcggacaucaagaagggcaaggcccagaagcucaagaccgucaccgagcugcugggcaucacgaucauggagcgcagccgcuucgagaagaaccccuccgccuuccucgagagcaagggguaccugaacauccgggccgacaagcugaucauccuccccaaguacucccuguucgagcuggagaacggccgccggcgccuccuggccagcgcgggggagcugcagaagggcaacgagcucgcccugccgacccaguucaugaaguuccuguaccucgccucccgguacaacgagagcaaggggaagcccgaggagaucgagaagaagcaggaguucgugaaccagcacguguccuacuucgacgacauccugcagcugaucaacgacuucagcaagcgcgucauccucgccgacgccaaccuggagaagaucaacaagcuguaccaggacaacaaggagaacaucuccguggacgagcucgcgaacaacaucaucaaccuguucaccuucaccagccugggcgcccccgccgccuucaaguucuucgacaagaucguggaccggaagcgcuacacguccaccaaggagguccucaacagcacccugauccaccagagcaucaccggccuguacgagacgcggaucgaccucgggaagcugggcgaggacuga

SEQ ID NO: 1981 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcguccgaccggcgccugaagcggaccgcccgccggcgcuacacccggcgccggaaccgcauccuguaccuccaggagaucuucgccgaggagaugagcaagguggacgacuccuucuuccaccggcuggaggacagcuuccuggucgaggacgacaagcgcggcuccaaguaccccaucuucgccacgaugcaggaggagaaggacuaccacgagaaguuccccaccaucuaccaccuccggaaggagcuggccgacaagaaggagaaggcggaccugcgccucuucuaccuggcccuggcccacaucaucaaguuccgggggcacuuccucaucgaggacgacagcuucgacgugcgcaacaccgacauccagcggcaguaccaggccuuccuggagaucuucgacaccacguucgagaacaaccaccuccucucccagaacaucgacguggagggcauccugaccgacaagaucagcaaguccgcgaagaaggaccgcauccuggcccaguaccccaaccagaaguccaccgggaucuucgccgaguuccucaagcugaucgucggcaaccaggccgacuucaagaagcacuucaaccuggaggacaagaccccgcuccaguucgccaaggacagcuacgacgaggaccuggagaaccugcucgggcagaucggcgacgaguucgcggaccuguucagcguggccaagaagcuguacgacuccgugcuccugagcggcauccugacggucaccgaccucuccaccaaggcgccccugagcgccuccaugauccagcgguacgacgagcaccgcgaggaccugaagcagcucaagcaguucgugaaggccagccugcccgagaaguaccaggagaucuucaccgacagcuccaaggacggguacgccggcuacaucgaggggaagacgaaccagggcgccuucuacaaguaccugagcaagcuccugaccaagcaggagggcuccgaguacuuccuggagaagaucaagaacgaggacuuccuccggaagcagcgcaccuucgacaacgggagcaucccccaccaggugcaccugaccgagcugaaggccaucauccgccggcaguccgaguacuacccguuccucaaggagaaccuggaccgcaucgagaagauccugacguuccggauccccuacuacgucggcccccucgcccgcgagaaguccgacuucgccuggaugacccggaagaccgacgacagcauccgccccuggaacuucgaggagcugguggacaaggaggcgagcgccgaggccuucauccaccggaugaccaacaacgaccuguaccugccggaggagaaggugcuccccaagcacucccugaucuacgagaaguucacggucuacaacgagcugaccaaggugcgcuacaagaacgagcagggggagaccuacuucuucgacagcaacaucaagcaggagaucuucgacggcguguucaaggagcaccggaaggucuccaagaagaagcuccuggacuuccuggccaaggaguacgaggaguuccgcaucguggacgugaucgggcucgacaaggagaacaaggccuucaacgcgagccugggcaccuaccacgaccugaagaagauccucgacaaggacuuccuggacaaccccgacaacgaguccauccuggaggacaucguccagacgcucacccuguucgaggaccgggagaugaucaagaagcgccuggagaacuacaaggaccucuucaccgagagccagcugaagaagcuguaccggcgccacuacaccggcugggggcggcucuccgccaagcugaucaacggcauccgcgacaaggagagccagaagacgauccuggacuaccucaucgacgacgggaaguccaaccggaacuucaugcagcugauccacgacgacggccugagcuucaaguccaucaucagcaaggcccaggccgggagccacuccgacaaccucaaggagguggugggcgagcuggcgggcagccccgccaucaagaaggggauccugcagucccucaagaucgucgacgagcuggugaaggucaugggcuacgagccggagcagaucgugguggagauggcccgcgagaaccagaccaccaaccaggggcggcgcaacagccgccagcgguacaagcugcucgacgacggcgucaagaaccuggccuccgaccugaacgggaacauccucaaggaguaccccaccgacaaccaggcccugcagaacgagcgccuguuccucuacuaccugcagaacggccgggacauguacacgggcaaggcgcuggacaucgacaaccucagccaguacgacaucgaccacaucaucccccaggccuucaucaaggacgacuccaucgacaaccgcgugcuggugagcuccgccaagaaccgggggaaguccgacgacguccccagccuggagaucgugaaggacugcaagguguucuggaagaagcuccuggacgccaagcugaugagccagcgcaaguacgacaaccucaccaaggccgagcggggcgggcugaccuccgacgacaaggcgcgcuucauccagcggcagcuggucgagacccgccagaucaccaagcacguggcccggauccucgacgagcgcuucaacaacgagcuggacagcaagggccggcgcauccggaaggugaagaucgucacgcugaaguccaaccucgugagcaacuuccgcaaggaguucggcuucuacaagauccgggaggugaacaacuaccaccacgcccacgacgccuaccugaacgccgucguggcgaaggccauccugaccaaguacccgcagcucgagcccgaguucguguacggggacuaccccaaguacaacuccuacaagacccgcaagagcgccaccgagaagcuguucuucuacagcaacaucaugaacuucuucaagacgaaggucacccuggccgacggcaccgugguggucaaggacgacaucgaggugaacaacgacaccggggagaucgugugggacaagaagaagcacuucgcgacgguccggaaggugcucuccuacccccaggugaacaucgucaagaagaccgagauccagaccggcggguucagcaaggaguccauccuggcccacggcaacagcgacaagcugaucccgcgcaagaccaaggacaucuaccucgaccccaagaaguacggcggguucgacucccccaucguggccuacagcgugcuggucguggccgacaucaagaagggcaaggcccagaagcugaagacggugaccgagcuccuggggaucaccaucauggagcggucccgcuucgagaagaaccccagcgcguuccuggaguccaagggcuaccucaacauccgcgacgacaagcugaugauccugccgaaguacagccucuucgagcuggagaacgggcggcgccggcugcucgccuccgccggcgagcugcagaagggcaacgagcuggcccuccccacccaguucaugaaguuccuguaccuggccagccgcuacaacgagcucaaggggaagcccgaggagaucgagcagaagcaggaguucgucgugcagcacguguccuacuucgacgacauccugcagaucaucaacgacuucagcaaccgggucauccuggcggacgccaaccucgagaagaucaacaagcuguaccaggacaacaaggagaacaucuccguggacgagcuggccaacaacaucaucaaccucuucacguucaccagccugggcgccccggccgcguucaaguucuucgacaagaucguggaccgcaagcgguacaccuccaccaaggagguccugaacagcacgcucauccaccaguccaucaccgggcuguacgagacccgcaucgaccugggcaagcucggggaggacuga

SEQ ID NO: 1982 - RNA, 4113 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaccgaccucuccaccaaggcgccccugagcgccuccaugauccagcacuacgacgagcaccgcgaggaccugaagcagcucaagcaguucgugaaggccagccugcccgagaaguaccaggagaucuucgccgacuccagcaaggacggcuacgccggguacaucgagggcaagaccaaccaggaggcguucuacaaguaccugagcaagcuccugacgaagcaggagggguccgaguaccugcucgagaagaucaagaacgaggacuuccugcggaagcagcgcaccuucgacaacggcagcaucccccaccaggugcaccugaccgagcuccgcgccaucauccggcgccaguccgaguacuacccguuccugaaggagaaccuggaccggaucgagaagauccucaccuuccgcauccccuacuacgucggcccccuggcccgggagaaguccgacuucgccuggaugacgcgcaagaccgacgacagcauccggcccuggaacuucgaggaccugguggacaaggagaaguccgccgaggcguucauccaccgcaugaccaacaacgaccuguaccucccggaggagaaggugcugcccaagcacagccugaucuacgagaaguucaccgucuacaacgagcucacgaaggugcgguuccuggccgagggguucaaggacuuccaguuccugaaccgcaagcagaaggagaccaucuucaacagccucuucaaggagaagcggaaggugaccgagaaggacaucaucuccuuccugaacaaggucgacggcuacgaggggaucgccaucaagggcaucgagaagcaguucaacgccagccuguccaccuaccacgaccucaagaagauccuggggaaggacuuccuggacaacacggacaacgagcucauccuggaggacaucgugcagacccugacccucuucgaggaccgcgagaugauccggaagcgccuggacaucuacaaggacuucuucaccgagagccagcugaagaagcucuaccggcgccacuacacgggcuggggccggcuguccgcgaagcugaucaacgggauccgcaacaaggagaaccagaagaccauccucgacuaccugaucgacgacggcagcgccaaccggaacuucaugcagcugaucaaggacgccgggcucuccuucaagcccaucaucgacaaggcccgcaccggcagccacuccgacaaccugaaggagguggucggggagcuggccggcagccccgcgaucaagaagggcauccuccagucccugaagaucguggacgagcuggugaaggucaugggguacgagccggagcagaucguggucgagauggcccgcgagaaccagaccacggccaagggccucagccggagccgccagcggcugaccacccugcgcgagucccucgccaaccucaagagcaacauccuggaggagaagaagcccaaguacgugaaggaccagguggagaaccaccaccucuccgacgaccggcuguuccuguacuaccuccagaacgggaaggacauguacaccgacgacgagcuggacaucgacaaccugagccaguacgacaucgaccacaucaucccccaggccuucaucaaggacgacuccaucgacaaccgcguccucgugagcuccgcgaagaaccggggcaagagcgacgacgugcccuccgucgagaucgugaaggacugcaagguguucuggaagaagcugcuggacgccaagcucaugagccagcgcaaguacgacaaccugaccaaggccgagcgcgggggccugacguccgacgacaaggcccgguucauccagcggcagcucgucgagacccgccagaucaccaagcacguggcccggauccuggacgagcgcuucaacaacgagcuggacagcaagggccggcgcauccggaaggugaagaucgucacccucaaguccaaccuggugagcaacuuccgcaaggaguucggguucuacaagauccgggaggugaacaacuaccaccacgcgcacgacgccuaccugaacgccgucguggccaaggcgauccucacgaaguacccgcagcuggagcccgaguucguguacggcgacuaccccaaguacaacuccuacaagacccgcaagagcgccaccgagaagcuguucuucuacuccaacaucaugaacuucuucaagaccaaggucacgcucgccgacgggaccgugguggucaaggacgacaucgaggugaacaacgacaccggcgagaucgugugggacaagaagaagcacuucgccaccguccggaaggugcugagcuacccccaggugaacaucgucaagaagacggagauccagaccggcggguucagcaaggaguccauccuggcccacggcaacagcgacaagcucaucccgcgcaagaccaaggacaucuaccuggaccccaagaaguacgggggcuucgacucccccaucguggcguacagcgugcuggucguggccgacaucaagaaggggaaggcccagaagcucaagaccgugacggagcugcugggcaucaccaucauggagcgcucccgguucgagaagaaccccagcgccuuccucgaguccaagggcuaccugaacauccgcgacgacaagcugaugauccucccgaaguacagccuguucgagcuggagaacgggcggcgccggcuccuggccuccgcgggcgagcugcagaaggggaacgagcucgcccugcccacccaguucaugaaguuccuguaccucgccagccgcuacaacgagcugaagggcaagcccgaggagaucgagcagaagcaggaguucgucgugcagcacguguccuacuucgacgacauccugcagaucaucaacgacuucagcaaccgggucauccucgccgacgccaaccuggagaagaucaacaagcuguaccaggacaacaaggagaacaucccgguggacgagcucgcgaacaacaucaucaaccuguucaccuucacgucccugggggcccccgccgccuucaaguucuucgacaagaucguggaccgcaagcgguacaccagcaccaaggagguccucaacuccacccugauccaccagagcaucacgggccuguacgagacccgcaucgaccucggcaagcugggggaggacuga

SEQ ID NO: 1983 - RNA, 4116 nt, Artificial Sequence
  Cas9 variant
augaaggugaacaacuaccacaucggccuggacaucgggaccagcuccaucggcugggucgccaucggggaggacggcaagccccuccgcaucaaggggaagaccgccaucggcgcgcggcuguuccaggagggcaacccggccgccgaccgccggauguuccgcacgacccggcgccggcugagccgccggaaguggcgccucaagcugcuggaggagaucuucgaccccuacaucacccccguggacuccaccuucuucgcccggcucaagcagagcaaccugucccccaaggacagccgcaaggaguucaagggguccaugcuguucccggaccucacggacaugcaguaccacaaggacuaccccaccaucuaccaccuccggcacgcccugaugacccaggacgagaaguucgacauccgcaugguguaccuggcgauccaccacaucgucaaguaccggggcaacuuccugaacagcacccccguggacuccuucaaggccagcaaggugaacuucgucgaccaguucaagaagcugaacgagcucuacacggccaucaaccccgaggaguccuuccagaucaaccuggccaacagcgaggacaucgggcaccaguuccuggacccguccauccgcaaguucgacaagaagaagcagauccccaagaucgugcccgugagcgucgacgacaaggcgaccgacaagaucaacggcaagaucgccuccgagaucaucaacgccauccucggguacaagagcaagcuggacguggugguccagugcacccccguggacuccaagagcugggcccugaaguucgacgaggaggacaucgacgccaagcuccagaagauccugccggagauggacgagaaccagcaguccaucaucgcgauccugcagaaccucuacagccaggugacccugaaccagaucguccccaacggcaugagccuguccgagagcaugaucgagaaguacaacgaccaccacgaccaccucaagcuguacaagaagaucaucgaccagcuggccgaccccaagaagaaggccgcccucaagaaggccuacucccaguacgugggcgacgacgggaaggugaucgagcaggcggacuucuggagcuccgucaagaagaaccuggacgacagcgaccuguccaagcagaucauggaccucaucgacgccgagaaguucaugcccaagcagcggacgagccagaacggcgugaucccgcaccagcugcaccagcgcgagcuggacgagaucaucgagcaccaguccaaguacuaccccuggcucgccgagaucaaccccaacaagcacgaccugcaccuggccaaguacaagaucgaggagcucguggccuuccggguccccuacuacguggggccgaugaucacccccgacgaccaggccaagagcgcggagaccguguucuccuggauggagcgcaagggcaaggaggccggccagaucacccccuggaacuucgacgagaaggucgaccggaacgccagcgccaaccgcuucaucaagcgcaugacgaccaaggacaccuaccugaucggggaggacgugcugcccgacgagucccuccuguacgagaaguucaagguccugaacgagcucaacauggugcgggugaacggcaagcugcugaaggucgcggacaagcaggccaucuuccaggaccucuucgagaacuacaagcacaucagcgugaagaagcugcagaacuacaucaaguccaagaccgggcugccgagcgaccccgagaucuccggccugagcgaccccgaguacuucaacaacucccucgggacguacaacgacuucaagaagcuguucggcaacaagguggacgagcccgaccugcaggacgacuucgagaagaucgucgaguggagcaccguguucgaggacaagcgcauccuccgggagaagcugaacgagaucaccuggcugagcgaccagcagaaggacgugcucgaguccagccgcuaccagggcugggggcggcuguccaagaagcugcucaccggcaucgucaacgaccagggggagcgcaucaucgacgagcuguggaacacgaacaagaacuucaugcagauccagagcgacaacgacuucgccaagcggauccacgaggccaacgcggaccagaugaaggccguggacguggaggacguccuggccgacgccuacaccuccccgcagaacaagaaggccauccgccagguggugaaggucguggacgacauccagaaggcgaugggcgggguggcccccaaguacaucagcaucgaguucacccgguccgaggaccgcaacccccggcgcaccaucagccggcagcgccagcucgagaacacgcugaaggacaccgccaagucccuggccaagagcaucaacccggagcuccuguccgagcuggacaacgccgccaagagcaagaagggccucaccgaccggcuguaccuguacuucacccagcucggcaaggacaucuacacggggaagcccaucaacaucgacgagaucuccaccuacgacaucgaccacauccugccccaggcguucgucaaggacgacagccugaacaaccgcgugcucguguccaaggccaucaacaacggcaagagcgacaacguccccgugcagcuguucggggccaagaugggccacuucuggaagcagcuggccgaggcggggcucaucuccaagcggaagcugaagaaccugcagaccgacccggacaccaucagcaaguacgccaugcacggcuucauccgccggcagcucguggagacgagccaggucaucaagcugguggccaacauccugggcgacaaguaccgcaacgacaacaccaagaucaucgagaucaccgcccgcaugaaccaccagaugcgggacgaguucggguucaucaagaaccgcgagaucaacgacuaccaccacgcguucgacgccuaccucaccgccuuccugggccgguaccuguaccaccgcuacaucaagcuccggcccuacuucguguacggggacuucaagaaguucaaggaggacaaggucaccaugcgcaacuucaacuuccugcacgaccugacggacgacacccaggagaagaucgccgacgccgagaccggcgaggugaucugggaccgggagaacuccauccagcagcucaaggacguguaccacuacaaguucaugcugaucagccacgaggucuacacccugcgcggcgcgauguucaaccagacgguguaccccgccuccgacgccgggaagcggaagcucauccccaucaaggccgaccgcccgaucaacguguacggcggguacagcggcuccgccgacgcguacauggccaucguccggauccacaacaagaagggggacaaguaccgcguggugggcguccccaugcgggcccgcgaccggcuggacgccgccaagaaggugagcgacgcggacugcgaccgcgcccugaaggacgugcucacgccccagcugaccaagaccaagaagucccggaagaccggcgagaucacccaggucguggaggacuucgagaucgugcuggggaaggucauguaccgccagcucaugaucgacggcgacaagaaguucaugcuggggagcuccaccuaccaguacaacgccaagcagcuggugcucagcgaccaguccgugaagacccuggccagcaagggccggcuggacccccuccaggaguccauggacuacaacaacgucuacacggagauccuggacaaggugaaccaguacuucagccuguacgacaugaacaaguuccgccacaagcucaaccugggguucuccaaguucaucagcuucccgaaccacaacguguucgacggcaacaccaaggcguccagcggcaagcgggagauccuggaggagguccucaacgggcugcacgccaaccccaccuucggcaaccugaaggacaucgggaucaccacgcccuucggccagcuccagcagcccaacgggauccugcuguccgacgaggccaagauccgcuaccagagcccgaccggccucuucgagcgcaccgugagccugaaggaccuguga

SEQ ID NO: 1984 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcauccgguaccugcaggagaucuucuccagcgagauguccaaggucgacgacagcuucuuccaccgccucgaggaguccuuccugguggaggaggacaagaagcacgagcggcacccgaucuucggcaacaucguggacgaggucgccuaccacgagaaguaccccaccaucuaccaccuccgcaagaagcucgccgacagcaccgacaaggcggaccugcggcugaucuaccucgcccuggcccacaugaucaaguuccgcggccacuuccugaucgagggggaccucaaccccgacaacuccgacauggacaagcuguucauccagcuggugcagaccuacaaccagcuguucgaggagaaccccaucaacgccagccggguggacgcgaaggccauccuguccgcccgccugagcaagucccggcgccucgagaaccugaucgcccagcugccgggcgagaagcggaacggccucuucgggaaccugaucgcccugagccucgggcugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgcgucaacagcgagaucaccaaggcgccccuguccgccagcaugaucaagcgguacgacgagcaccaccaggaccucacccugcugaaggcccucgugcgccagcagcugcccgagaaguacaaggagaucuucuucgaccaguccaagaacggcuacgcgggguacaucgacggcggggccagccaggaggaguucuacaaguucaucaagccgauccuggagaagauggacggcacggaggagcuccuggccaagcugaaccgcgaggaccugcuccggaagcagcgcaccuucgacaacggcuccaucccccaccagauccaccugggggagcugcacgccauccuccggcgccaggaggacuucuaccccuuccugaaggacaaccgggagaagaucgagaagauccugaccuuccgcauccccuacuacgugggcccgcucgcccgggggaacagccgcuucgcguggaugacccggaaguccgaggagacgaucacccccuggaacuucgaggaggucguggacaagggcgccagcgcccaguccuucaucgagcgcaugaccaacuucgacaagaaccugcccaacgagaaggugcugcccaagcacagccuccuguacgaguacuucaccgucuacaacgagcugacgaaggugaaguacgugaccgaggggaugcggaagccggaguuccucuccggcaagcagaaggaggccaucgucgaccugcuguucaagaccaaccgcaaggugaccgugaagcagcucaaggaggacuacuucaagaagaucgagugcuucgacagcgucgagaucuccggcguggaggaccgguucaacgcgagccuggggacguaccacgaccugcucaagaucaucaaggacaaggacuuccuggacaacgaggagaacgaggacauccuggaggacaucgugcucacccugacccuguucgaggacaaggagaugaucgaggagcgccucaagaaguacgccaaccuguucgacgacaaggucaugaagcagcugaagcggcgccacuacaccggcugggggcggcucucccgcaagcugaucaacggcauccgggacaagcagagcgggaagacgauccuggacuuccucaaguccgacggcuucgccaaccgcaacuucaugcagcugaucaacgacgacagccugaccuucaaggaggccauccagaaggcccagguguccggccaggggcacagccuccacgagcagaucgcgaaccuggccggcagccccgccaucaagaaggggauccugcaguccgucaaggugguggacgagcucgucaaggugaugggccacaagcccgagaacaucgugaucgagauggcccgcgagaaccagaccacccagaaggggcagaagaacagccgggagcgcaugaagcggaucgaggagggcaucaaggagcugggcucccagauccugaaggagcaccccgucgagaacacgcagcuccagaacgagaagcuguaccuguacuaccuccagaacgggcgcgacauguacguggaccaggagcuggacaucaaccggcugagcgacuacgacguggaccacaucgucccgcaguccuucaucaaggacgacagcaucgacaacaaggugcucacccgcuccgacaagaaccggggcaagagcgacaacgugcccuccgaggaggucgugaagaagaugaagaacuacuggcgccagcugcugaacgccaagcucaucacccagcggaaguucgacaaccugaccaaggcggagcgcgggggccugagcgagcucgacaaggccggcuucaucaagcggcagcugguggagacgcgccagaucaccaagcacgucgcccagauccuggacucccggaugaacaccaaguacgacgagaacgacaagcucauccgcgaggugaaggugaucacccucaagagcaagcuggucuccgacuuccggaaggacuuccaguucuacaaggugcgcgagaucaacaacuaccaccacgcccacgacgccuaccucaacgcgguggucgggaccgcccugaucaagaaguaccccaagcuggagagcgaguucguguacggcgacuacaagguguacgacguccggaagaugaucgccaaguccgagcaggagaucgggaaggccacggcgaagcgcuucuucuacagcaacaucaugaacuucuucaagaccgagaucacccucgccaacggcgagauccggaagcgcccccugaucgagaccaacgaggagacgggggagaucgugugggacaagggccgggacuucgccaccgugcgcaagguccuguccaugccccaggugaacaucgugaagaagaccgagguccagaccggcgcccucacgaacgagagcaucuacgcccgcgggagcuucgacaagcugaucucccggaagcaccgcuucgagagcuccaaguacggcggguucggcagcccgaccgugaccuacuccgugcuggucguggccaagagcaaggugcaggacgggaaggucaagaagaucaagaccggcaaggagcucaucggcaucacgcugcuggacaagcucguguucgagaagaacccccugaaguucaucgaggacaagggguacggcaacgugcagaucgacaagugcaucaagcugcccaaguacucccucuucgaguucgagaacgggacccggcgcaugcuggccagcgucauggccaacaacaacucccggggcgaccugcagaaggccaacgagauguuccucccggccaagcuggugacccugcucuaccacgcgcacaagaucgagagcuccaaggagcuggagcacgaggccuacauccuggaccacuacaacgaccucuaccagcugcugagcuacaucgagcgcuucgccucccucuacguggacgucgagaagaacaucagcaaggugaaggagcuguucuccaacaucgagagcuacuccaucagcgagaucugcuccagcgugaucaaccugcucacccugacggccagcggggcccccgcggacuucaaguuccugggcaccaccaucccccggaagcgcuacggcuccccgcagagcauccucuccagcacccugauccaccaguccaucacggggcuguacgagacccggaucgaccucagccagcugggcggggacuga

SEQ ID NO: 1985 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcauccgguaccugcaggagaucuucuccagcgagauguccaaggucgacgacagcuucuuccaccgccucgaggaguccuuccugguggaggaggacaagaagcacgagcggcacccgaucuucggcaacaucguggacgaggucgccuaccacgagaaguaccccaccaucuaccaccuccgcaagaagcucgccgacagcaccgacaaggcggaccugcggcugaucuaccucgcccuggcccacaugaucaaguuccgcggccacuuccugaucgagggggaccucaaccccgacaacuccgacauggacaagcuguucauccagcuggugcagaccuacaaccagcuguucgaggagaaccccaucaacgccagccggguggacgcgaaggccauccuguccgcccgccugagcaagucccggcgccucgagaaccugaucgcccagcugccgggcgagaagcggaacggccucuucgggaaccugaucgcccugagccucgggcugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgcgucaacagcgagaucaccaaggcgccccuguccgccagcaugaucaagcgguacgacgagcaccaccaggaccucacccugcugaaggcccucgugcgccagcagcugcccgagaaguacaaggagaucuucuucgaccaguccaagaacggcuacgcgggguacaucgacggcggggccagccaggaggaguucuacaaguucaucaagccgauccuggagaagauggacggcacggaggagcuccuggccaagcugaaccgcgaggaccugcuccggaagcagcgcaccuucgacaacggcuccaucccccaccagauccaccugggggagcugcacgccauccuccggcgccaggaggacuucuaccccuuccugaaggacaaccgggagaagaucgagaagauccugaccuuccgcauccccuacuacgugggcccgcucgcccgggggaacagccgcuucgcguggaugacccggaaguccgaggagacgaucacccccuggaacuucgaggaggucguggacaagggcgccagcgcccaguccuucaucgagcgcaugaccaacuucgacaagaaccugcccaacgagaaggugcugcccaagcacagccuccuguacgaguacuucaccgucuacaacgagcugacgaaggugaaguacgugaccgaggggaugcggaagccggaguuccucuccggcaagcagaaggaggccaucgucgaccugcuguucaagaccaaccgcaaggugaccgugaagcagcucaaggaggacuacuucaagaagaucgagugcuucgacagcgucgagaucuccggcguggaggaccgguucaacgcgagccuggggacguaccacgaccugcucaagaucaucaaggacaaggacuuccuggacaacgaggagaacgaggacauccuggaggacaucgugcucacccugacccuguucgaggacaaggagaugaucgaggagcgccucaagaccuacgcccaccuguucgacgacaaggucaugaagcagcugaagcggcgccacuacacgggcugggggcggcucucccgcaagcugaucaacggcauccgggacaagcagagcgggaagaccauccuggacuuccucaaguccgacggcuucgccaaccgcaacuucauccagcugauccacgacgacagccugaccuucaaggaggccauccagaaggcccagguguccggccaggggcacagccuccacgagcagaucgcgaaccuggccggcagccccgccaucaagaaggggauccugcaguccgucaaggugguggacgagcucgucaaggugaugggccacaagcccgagaacaucgugaucgagauggcccgcgagaaccagaccacgcagaaggggcagaagaacagccgggagcgcaugaagcggaucgaggagggcaucaaggagcugggcucccagauccugaaggagcaccccgucgagaacacccagcuccagaacgagaagcuguaccuguacuaccuccagaacgggcgcgacauguacguggaccaggagcuggacaucaaccggcugagcgacuacgacguggaccacaucgucccgcaguccuucaucaaggacgacagcaucgacaacaaggugcucacccgcuccgacaagaaccggggcaagagcgacgacgugcccuccgaggaggucgugaagaagaugaagaacuacuggcgccagcugcugaacgccaagcucaucacccagcggaaguucgacaaccugacgaaggcggagcgcgggggccugagcgagcucgacaaggccggcuucaucaagcggcagcugguggagacccgccagaucaccaagcacgucgcccagauccuggacucccggaugaacaccaaguacgacgagaacgacaagcucauccgcgaggugaaggugaucacccucaagagcaagcuggucuccgacuuccggaaggacuuccaguucuacaaggugcgcgagaucaacaacuaccaccacgcccacgacgccuaccucaacgcgguggucgggacggcccugaucaagaaguaccccaagcuggagagcgaguucguguacggcgacuacaagguguacgacguccggaagaugaucgccaaguccgagcaggagaucgggaaggccaccgcgaagcgcuucuucuacagcaacaucaugaacuucuucaagaccgagaucacccucgccaacggcgagauccggaagcgcccccugaucgagacgaacgaggagaccggggagaucguguggaacaagggccgggacuucgccaccgugcgcaagguccuguccaugccccaggugaacaucgugaagaagaccgagguccagacgggcgcccucaccaacgagagcaucuacgcccgcgggagcuucgacaagcugaucucccggaagcaccgcuucgagagcuccaaguacggcggguucggcagcccgaccgugaccuacuccgugcuggucguggccaagagcaaggugcaggacgggaaggucaagaagaucaagacgggcaaggagcucaucggcaucacccugcuggacaagcucguguucgagaagaacccccugaaguucaucgaggacaagggguacggcaacgugcagaucgacaagugcaucaagcugcccaaguacucccucuucgaguucgagaacgggacccggcgcaugcuggccagcgucauggccaacaacaacucccggggcgaccugcagaaggccaacgagauguuccucccggccaagcuggugacccugcucuaccacgcgcacaagaucgagagcuccaaggagcuggagcacgaggccuacauccuggaccacuacaacgaccucuaccagcugcugagcuacaucgagcgcuucgccucccucuacguggacgucgagaagaacaucagcaaggugaaggagcuguucuccaacaucgagagcuacuccaucagcgagaucugcuccagcgugaucaaccugcucacgcugaccgccagcggggcccccgcggacuucaaguuccugggcaccaccaucccccggaagcgcuacggcuccccgcagagcauccucuccagcacgcugauccaccaguccaucaccgggcuguacgagacccggaucgaccucagccagcugggcggggacuga

SEQ ID NO: 1986 - RNA, 4116 nt, Artificial Sequence
  Cas9 variant
augaacaacaacaacuacagcaucggccuggacaucgggaccaacuccgugggcugggccgucaucaccgacgacuacaaggugcccagcaagaagaugcgcgugcucgggaacacggacaagcgguucaucaagaagaaccugaucggcgcccugcuguucgacgaggggaccaccgcggaggaccgccggcugaagcgcaccgcccggcgccgguacacgcgccggaagaaccgccugcgguaccuccaggagaucuucgccgaggagauguccaaggucgacagcuccuucuuccaccgccuggacgacagcuuccuggugccggaggacaaguccggcagcaaguaccccaucuucgccacccucgccgaggagaaggaguaccacaagaaguuccccaccaucuaccaccuccggaagcaccuggcggacuccaaggagaaggccgaccuccgccugaucuaccuggcccucgcccacaucaccaaguaccggggccacuuccuguacgaggaggcguucgacaucaagaacaacgacauccagaagaucuucaacgaguucaucaacaucuacgacaacacguucgaggggagcucccugagcggccagaacgcccagguggaggccaucuucaccgggaagaucuccaagagcgucaagcgcgagcacgugcucaagcuguuccccgacgagaaguccaccggccuguucagcgaguuccucaagcugaucguggggaaccaggccgacuucaagaagcacuucgaccuggaggagaaggccucccuccaguucagcaaggacaccuacgacgaggaccuggagaaccugcucggccagaucggcgacgacuucgcggaccuguuccuggucgccaagaagcucuacgacgccauccugcuguccgggauccucacggugaccgacccgagcaccaaggcgccccugagcgccuccaugaucgagcgguacgagaaccaccaggaggaccuggccgcccucaagcaguucaucaagaacaaccugcccgagaaguacgccgagguguucagcgaccaguccaaggacggcuacgccggguacaucgacggcaagaccacgcaggaggccuucuacaaguacaucaagaaccugcucagcaaguucgagggcgcggacuacuuccuggacaagaucgagcgcgaggacuuccugcggaagcagcgcaccuucgacaacggguccaucccccaccagauccaccuccaggagaugaacgccauccugcggcgccagggcgagcacuacccgcugcucaaggagaacaaggagaagaucgagaagauccugaccuuccgcauccccuacuacgucgggccccuggcccggggcaaccgcgacuucgccuggcucacccggaacagcgaccaggccauccgccccuggaacuucgaggagaucguggacaaggcguccagcgccgaguccuucaucaacaagaugacgaacuacgaccuguaccugccggaggagaaggugcugcccaagcacagccuccuguacgagaccuucgccgucuacaacgagcugaccaaggugaaguucaucgccgaggggcuccgggacuaccaguucuucgacuccggccagaagaagcagaucgugaaccagcuguucaaggagaagcgcaaggucaccgagaaggacaucauccacuaccugcacaacguggacggcuacgacgggaucgagcucaagggcaucgagaagcaguucaacgcgagccuguccacguaccacgaccugcucaagaucaucaaggacaaggaguucauggacaaccacaagaaccaggagauccuggagaacaucgugcacacccugaccaucuucgaggaccgggagaugaucaagcagcgccucgcccaguacgacagcaucuucgacgagaaggucaucaaggcccugacccggcgccacuacacgggguggggcaagcuguccgccaagcucaucaacgggaucugcgacaagaagaccggcaagaccauccuggacuaccugaucgacgacggcuacaacaaccggaacuucaugcagcucaucaacgacgacgggcugagcuucaaggagaucauccagaaggcccagguggugggcaagaccgacgaccugacgcaggucgugcgcgagcucuccgggagccccgcgaucaagaagggcauccugcaguccaucaagaucgucgacgagcuggugaagaucaugggguacgcccccgagagcaucgugaucgagauggcccgggagaaccagaccaccgccaagggcaagaagaacagccagcagcgcuacaagcggaucgaggacgcccucaagaaccuggcgccgggccuggacuccaccaucagcaaggagaaccccacggacaacauccagcuccagaacgaccgccuguuccuguacuaccuccagaacgggaaggacauguacaccggcgaggcccuggacaucaaccagcuguccagcuacgacaucgaccacaucaucccccaggccuucaucaaggacgacucccucgacaaccggguccugaccagcuccaaggacaaccgcggcaagagcgacaacgugcccucccuggagguggucaagaagcggaaggccuucuggcagcagcuccuggacagcaagcugaucuccgagcgcaaguucaacaaccucaccaaggccgagcgcgggggccuggacgagcgggacaaggugggguucaucaagcgccagcugguggagacccggcagaucacgaagcacgucgcgcgcauccucgacgcccgguucaacaccgaggugagcgagaagaaccagaagauccgcuccgugaagaucaucacccucaagagcaaccuggucuccaacuuccggaaggaguucaagcuguacaaggugcgcgagaucaacgacuaccaccacgcccacgacgccuaccugaacgcgguggucgccaaggccauccugaagaaguacccgaagcucgagcccgaguucguguacggcgacuaccagaaguacgaccugaagcgguacaucagcaaguccaaggaccccaaggagguggagaaggccaccgagaaguacuucuucuacagcaaccugcucaacuucuucaaggaggagguccacuacgccgacgggacgaucgugaagcgcgagaacaucgaguacagcaaggacaccggcgagaucgcguggaacaaggagaaggacuucgugaccaucaagaagguccuguccuacccccaggugaacaucgugaagaagcgggagguccagaccgggggcuucagcaaggaguccauccugccgaagggcaacagcgacaagcucaucccccgcaagacgaaggacauccugugggacaccaccaaguacgggggcuucgacucccccgugaucgccuacagcauccugcucaucgccgacaucgagaaggggaaggccaagaagcugaagaccgugaagacgcuggucggcaucaccaucauggagaaggccgcguucgagaagaaccccaucaccuuccucgagaacaagggguaccacaacgugcggaaggagaacauccugugccugccgaaguacucccucuucgagcuggagaacggccgccggcgccugcucgccagcgccaaggagcugcagaagggcaacgagaucgugcugcccgucuaccucaccacgcugcuguaccacuccaagaacgugcacaagcucgacgagcccgagcaccuggaguacauccagaagcaccgguacgaguucaaggaccugcucaaccuggugagcgaguucucccagaaguacguccuggccgaggccaaccucgagaagaucaagagccuguacguggacaacgagcaggcggacaucgagauccuggccaacuccuucaucaaccuccugaccuucaccgcccugggggccccggcggccuucaaguucuucggcaaggacguggaccgcaagcgguacaccacggucagcgagauccucaacgccacccugauccaccaguccaucaccgggcuguacgagacccgcaucgaccucagcaagcugggcgaggacuga

SEQ ID NO: 1987 - RNA, 4116 nt, Artificial Sequence
  Cas9 variant
augaccgagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacaacggggagaccgccgaggccacccgccugaagcggacggcccgccggcgcuacacccggcgcaagaaccggcuccgcuaccugcaggagaucuucgccgaggagauggcgaaggucgacgagagcuucuucuaccggcuggacgaguccuuccucaccaccgacgacaaggacuucgagcgccacccgaucuucggcaacaaggccgacgagaucaaguaccaccaggaguuccccacgaucuaccaccuccggaagcaccuggccgacagccacgagaaggccgaccuccgccugaucuaccuggcgcucgcccacaugaucaaguuccggggccacuuccugaucgagggggagcugaacgccgagaacaccgacgugcagaagcuguucgaggccuucguggaggucuacgaccgcaccuucgacgacuccaaccugagcgagaucaccguggacgccuccagcauccugacggagaaguucuccaagagccggcgccucgagaaccugaucaagcacuaccccaccgagaagaagaacacccuguucggcaaccucguggcgcuggcccuggggcuccagcccaacuucaagaccuccuucaagcugagcgaggacgccaagcugcaguucuccaaggacacguacgaggaggaccucgaggagcugaucggcaagaucggggacgaguacgccgaccuguucaccagcgccaagaaccucuacgacgcgauccugcuguccggcauccucaccgucgccgacaacaccacgaaggccccgcugagcgccuccaugaucaagcgguacaacgagcaccagguggaccugaagaagcucaaggaguucaucaagaacaacgccagcgacaaguacgacgagaucuucaacgacaaggacaagaacggcuacgcgggguacaucgagaacggcgugaagcaggacgaguucuacaaguaccugaagaccacccuguccaagaucgacgggagcgacuacuuccucgacaagaucgagcgcgaggacuuccugcggaagcagcgcaccuucgacaacggcagcaucccccaccagauccaccuccaggagaugcacgccauccuccggcgccagggcgagcacuacgccuuccugaaggagaaccaggccaagaucgagaagauccugacguuccgcauccccuacuacgucgggccccucgcccggaagaacucccgcuucgcgugggccgaguaccacagcgacgagaagaucaccccguggaacuucgacgagaucaucgacaaggagaaguccgccgagaaguucaucacccggaugacccugaacgaccuguaccugcccgaggagaaggugcuccccaagcacagccugguguacgagacguacaccgucuacaacgagcugaccaaggugaaguacgugaacgagcagggcaaguccaacuucuucgacgccaacaugaagcaggagaucuucgagcacgucuucaaggagaaccgcaaggugaccaaggacaaguuccucaacuaccugaacaaggaguuccccgaguaccggauccaggaccugaucgggcucgacaaggagaacaagagcuucaacgcgucccugggcacguaccacgaccugaagaagauccucgacaagagcuuccuggacgacaagaccaacgagaccaucaucgaggacaucauccagacccugacgcuguucgaggaccgcgacaugauccggcagcgccugcagaaguacuccgacaucuucaccccgcagcagcugaagaagcucgagcggcgccacuacaccggguggggccggcugagcuacaagcugaucaacggcauccgcaacaaggagaacgggaaguccauccucgacuaccugaucgacgacggcuacgccaaccggaacuucaugcagcugaucagcgacgacacccuccccuucaagcagaucaucaaggacgcccagaucaucggggacaucgacgacgugaccuccgucgugcgcgagcugcccggcagccccgccaucaagaaggggauccugcaguccgugaagaucgucgacgagcucgugaaggucaugggccacaacccggacaacaucgugaucgagauggcccgggagaaccagacgaccaaccgcggccggaaccagagccagcagcgccugaagaagcugcaggacucccucaaggagcuggggagcaacauccugaacgaggagaagcccuccuacaucgagggcaagguggagaacaaccaccuccaggacgaccggcuguuccuguacuacauccagaacgggaaggacauguacaccggcgacgagcucgacaucgaccaccugagcgacuacgacaucgaccacaucaucccccaggcguucaucaaggacgacagcaucgacaaccgcguccugaccuccagcgccaagaaccgcgggaaguccgacgacgugcccagccucgacaucgugcacgaccggaaggccgacuggauccgccuguacaaguccggccugaucagcaagcggaaguucgacaaccucacgaaggccgagcgcggcgggcugaccgagaacgacaaggccggcuucaucaagcggcagcuggucgagacccgccagaucaccaagcacguggcgcagauccucgacucccgguucaacacggagcgcgacgagaacgacaaggugauccggaacgucaaggugaucacccucaagagcaaccuggugucccaguuccgcaaggacuucaaguucuacaagguccgggagaucaacgacuaccaccacgcccacgacgccuaccugaacgccgugguggggaccgcccugcugaagaaguacccgaagcucgcgcccgaguucgucuacggcgaguacaagaaguacgacauccgcaaguucaucaccagcuccggcgacaaggccacggccaaguacuucuucuacagcaaccugaugaacuucuucaagcgggugauccgcuacuccaacgggaagguggucgugcggcccgugaucgagugcagcaaggacaccggcgagaucgccuggaacaagcagaccgacuucgagaagguccgccgggugcuguccuacccccaggugaacaucgucaagaagguggagacccagaccgggggcuucagcaaggaguccauccucccgaaggggaacagcgacaagcugaucccccgcaagacgaagaaguuccggugggacacccccaaguacggcggcuucgacagccccaacaucgcguacuccguguucgucaucgccgacguggagaaggggaaggccaagaagcugaagaccgugaaggagcucgucggcaucagcaucauggagcgcuccagcuucgaggagaacccggugguguuccuggagaagaagggguaccagaacguccaggaggacaaccugaucaagcuccccaaguacucccuguucgaguucgagggcgggcggcgccgccugcucgccagcgccuccgagcugcagaagggcaacgagguggugcugagccggcaccucgucgagcugcuguaccacgcgcaccgcgugaacuccuucaacaacagcgagcaccucaaguacguguccgagcacaagaaggaguucggcgagguccugagcugcguggagaacuucgccaaguccuacguggacgucgagaagaaccuggggaagauccgggccguggccgacaagaucgacacguucagcaucgaggacaucuccaucagcuucgugaaccuccugacccugaccgcccucggcgcgcccgccgacuucaacuuccugggggagaagaucccgcgcaagcgguacaccuccacgaaggagugccugaacgccacccucauccaccagagcaucaccggccuguacgagacccgcaucgaccuguccaagcucggggaggaguga

SEQ ID NO: 1988 - RNA, 4116 nt, Artificial Sequence
  Cas9 variant
augaaccugcgcaacguggagagcuaccaggucggccucgacaucgggaccggcuccguggggugggccgugcuggacgacaacggcgaccugugccgguucaaggggaagcccaccuggggcagccgcgucuucccgacggccgagaccgcggccgaggcccgggugcaccgcggccagcggcgccgguacgaccgccggcgccagcggaucgaccuccugcagcgcuucuucgccgacgagguggccaaggucgaccccgaguucuucauccggcugaaccaggcgcgccuccaccccgagaaccgggaccccgcccacgccgacuaccgcuggccgcuguucaacggguccaacuucaccgagaaggacuacuaccggcaguuccccaccaucuaccaccuccgcgcccaccuccucaagagcgacgagcccgcggacauccggcugguguaccuggcccugcacaacaucgugaagcaccgcggcaacuuccugcaccaggacaaccccucccugagcgcccggaacgccaacgucggggacgccguggaggcgcugugccuggcccucgacgaguggugcggcgcccacgacguggagugcgccugcgacgaggccgcgcuggccgaggcccugggggacgccucccuccgcccgggcgagaagcgcgagcgggccgaggcggcccugggcgucgagaaggcccacaagaagcuggccaaggccgugagcuccgcgguggucggguacgccgccgaguucggccacguguucuucgccgagagcgagggguccaaguucgcgcucagcaacgacgagaagguggaggccuacgucugccccgacgagggccgcgaccuguucgacgccaugcgggccgugcacuccagcuacgugcugaugggcauccucuccgaggcccagggggagcugcugagcgucugcaaggugggcgaguacgagcgcuacaagcgggaccucgagacgcugaagucccuggugcgcgcguacgggcccgagcgguacgacgaguucuucugcggccccuucuacgaggggacccgcgacuacgacccgggcaaggcccagggcuacaccaaguacaaccucggggccagcaagcugucccacgaggacuuccugaaggagguccagaagcuccugaaggacaucggcgcccaggccgacgagcgguacgcggacaucgagcgcgccaucgaggccggggccuuccugcggcgccucaagaccagcgacaacggcacgauccccuaccagcugcaccuggaggagauggacgccaucaucgagcggcaggcggccuucuaccccuuccucgcccaggagaaggacaagcucaagagccugguguccuuccgcauccccuacuacgucgggccgcugacccagaagaacgccgcgcgggacggcaagggcgaggcccgcuucgccuggagcucccggaagcccgggauggaggacgcccgcguguaccccuggaacugggaggacgugaucgacaaggaccagagcgccgaggacuucauccggcgcaugaccgggaccugcacguaccugaagggggagcccguccuggcgcgcugcucccucgacuacgagcuguucugcgugcugaacgagcuggccggcgcccgguggacccaggacggggacaagagcuaccgcuucgacgccgccgaccggcucggcaucguggaggaccuguucaagaagcgcaagcgggucaccuacgaggcggccgagaaguggcuggcccgcacccacggcccggaguccggcaagagcgccggcggggccuaccacguguccggcggccagggggaggacgcguucgagagccagcucuccagccacuacgacuucugcaagauccugggcguggacgagcuguccgacgccgacgaggccauggccgaggacaucauccucuggaacacggucuucgaggaccggagcauccugaagcgcaagaucaagcuggcguacggggaccggcucggcgacgcccaggugcgcaagcugugccagaagcgguacaccggguggggccgccuguccggcgagcuccugcgggggcugcgcagcgccaccgacaacggccccaagaccaucauggacauccuccuggagggggaccccaaccacgcccggcgcaugggcgccgcgaugaaccugauggagauccuccacgacgaccugcuggaguuccaggccaagaucgacgagcacaaccgggagcgcgcccucgccgucgggggcauguccguggacgaggugacgggcagccccgcccugcggcgcgggaucaaccaggcgcugcggguggucgacgagaucgccggcaucgccgggaagccgcccgcccacaucuacguggaggugacccgcgacgagggcgcccgcaacaaggggcggcgcaccaccucccgguaccgcgcgcucgaggccgcccugagcagcaucaaggcccagugcgccgacgucuacgcggagcugaaggagcgggacccccgcgcccucgacgacgagcggcugacgcuguacuucaugcagugcggcaagugcauguacuccggcgacgcccucgacaucaacaagcugcagaccuaccagguggaccacauccugccccagagcuacgugaaggacgacuccuucgagaacaagguccucgugcgcccggacaccaaccagcggaagggggacacccugcugcucgacgagcgccugaucgcccggaugcgcggcuucuggcggacgcugcgcgacgcggagcucaucggggagaagaaguucaacaaccugacccggaccagcguguccgacgagcagaugaagaaguucgucagccgccagcugguggagaccggccagauggugaagcagguccagcagcuccugcaggcccgguaccccgaguccgaggugcagcccgugaaggccggggucagccaccagcugcgcgugggcugcgcccucgccaagucccgggagaucaacgacuuccaccacgcgcacgacgccuaccuggccugccaggugggccgcuucguccaguaccgccacagcgccguguacuccgagccggugaagauggccgcggucgugaagcaguucaucaagaagcaggccgaggacuaccggcgcacgcgggagcugcccgggagcgacggcuucaucguguccagcuucaugacccccggguucgacgucaagaccggcgagguguuccgcgacgccugggacgccggcgccgagaucgaccggauccgccggugcuucgacuacaaggacugcuucaucucccgcaugcccgaggagacccacggggcguucugggacgccacgaucuacagcccgcgggccgccggcaagacccucucccugccccugaagcgcgggcucgacccccggaaguacggcagcuacagccgcgagcaguucgcguacuucuucguguacgaggccgucaagcccaagaagaagcagcgggugcuggaguucgccccggugcccguccgcguggccuccgcccuggcgaacgaccccgacgcccucgaggacuacgcccgggagcuggccgaggccgaggggcugguguucgagcgcauccggcgccggaaggucuacaaguaccagcagaucaucgugggcgacagccgccucuacgugaccggccgggaggagguccgcaacgcgcgccagcuggccuucucccaggacgagaccaagcugaucugccggaucgagcagggggaggagugcgaggagggcgagcuccuggaccuguuccgcagcaugcagcggaaguaccucgccugcgcgccccgccuggcccggcugaugaagguggccgagauggaggagggguucaucgccgccaccgccuccggcaagcgcgagguccuccugagccugacguccaucgcggccgcccaccggaacagcaucgaccucaagccgaucgggcgcaagggcuccagcggccagaugaagaucaccuucuccaaggagcugagcaccaacgggauccuguucguggacuccagcgugaccggcauguucgagcggcgcugccggcucgggcuguga

SEQ ID NO: 1989 - RNA, 4116 nt, Artificial Sequence
  Cas9 variant
auggagaacaagaacuacagcaucggccuggacaucgggaccaacuccgugggcuggagcgucaucaccgacgacuacaaggugcccuccaagaagaugaaggugcucgggaacacggacaagcgcuucaucaagaagaaccugaucggcgcccugcuguucgacgaggggaccaccgccgaggcgcggcgccugaagcggaccgcccgccggcgcuacacgcggcgcaagaaccggcugcgcuaccuccaggagaucuucgccgaggagaugagcaaggucgacuccagcuucuuccaccggcuggacgacuccuuccugaucccggaggacaagcgcggcagcaaguaccccaucuucgccacccucgccgaggagaaggaguaccacaagcaguuccccaccaucuaccaccuccggaagcagcuggcggacuccaaggagaagaccgaccuccgccugaucuaccuggcccucgcccacaugaucaaguaccggggccacuuccuguacgaggacacguucgacaucaagaacaacgacauccagaagaucuucagcgaguucaucuccaucuacgacaacaccuucgaggggagcucccugagcggccagaacgcccagguggaggcgaucuucaccgacaagaucuccaagagcgccaagcgcgagcgggugcucaagcuguuccccgacgagaaguccaccgggcuguucagcgaguuccucaagcugaucgucggcaaccaggccgacuucaagaagcacuucgaccugggggagaaggccccgcuccaguucuccaaggacacguacgacgaggaccuggagaaccugcucggccagaucggcgacgacuucgccgaccuguuccugguggcgaagaagcucuacgacgccauccugcugagcgggauccucaccgugaccgaccccagcaccaaggcgccccuguccgccagcaugaucgagcgcuacgagaaccaccagaaggaccuggccguccucaagcaguucaucaagaacaaccugcccgagaaguacgacgagguguucuccgaccagagcaaggacggcuacgccggguacaucgacggcaagacgacccaggaggccuucuacaaguacaucaagaaccugcucuccaaguucgagggcaccgacuacuuccuggagaagaucgagcgggaggacuuccugcgcaagcagcggaccuucgacaacgggagcaucccgcaccagauccaccuccaggagaugaacgccauccugcgccgccagggcgagcacuaccccuuccugaaggacaacaaggagaagaucgagaagauccucacguuccggauccccuacuacguggggccccuggcccgcggcaaccgggacuucgccuggcugacccgcaacuccgacgaggcgauccggccguggaacuucgaggagaucgucgacaaggccagcuccgccgaggacuucaucaacaagaugaccaacuacgaccucuaccugcccgaggagaaggugcugcccaagcacagccugcucuacgagaccuucgccguguacaacgagcugacgaaggucaaguucaucgccgaggggcugcgcgacuaccaguuccucgacuccggccagaagaagcagaucgugacccagcuguucaaggagaagcggaaggugaccgagaaggacaucauccaguuccugcacaacgucgacggcuacgacgggaucgagcucaagggcaucgagaagcaguucaacgcgagccuguccaccuaccacgaccugcucaagaucaucaaggacaaggaguucauggacgacagcaagaacgaggagauccuggagaacaucgugcacacgcugaccaucuucgaggaccgcgagaugaucaagcagcggcucgcccaguacgacucccuguucgacgagaaggugaucaaggcccugauccgccggcacuacaccggguggggcaagcucagcgccaagcugaucgacgggaucugcgacaagcagaccggcaacacgauccuggacuaccucaucgacgacggcaagaacaaccgcaacuucaugcagcugaucaacgacgacgggcuguccuucaaggagaucacccagaaggcgcaggucgugggcaagaccgacgacgugaagcaggucgugcaggagcuccccgggagcccggccaucaagaagggcauccugcaguccaucaagaucgucgacgagcuggugaaggugauggggcacacccccgagagcaucgucaucgagauggcccgggagaaccagacgaccgcccgcggcaagaagaacagccagcagcgguacaagcgcaucgaggacgcccucaagaaccuggcguccggccuggacagcaacauccucaaggagcaccccaccaacaacauccagcugcagaacgaccggcuguuccucuacuaccugcagaacgggcgcgacauguacaccggcaagccccuggacaucaaccagcucuccagcuacgacaucgaccacaucgugccgcaggccuucaucaaggacgacucccuggacaaccgggugcugaccagccucaaggacaaccgcgggaaguccgacaacguccccagcaucgagguggugcagaagcgcaaggccuucuggcagcagcugcuggacuccaagcucaucagcgagcggaaguucaacaaccugacgaaggccgagcgcggcggccuggacgagcgggacaaggucggguucaucaagcgccagcucguggagacccggcagaucaccaagcacguggcccagauccuggacgcgcgcuucaacaaggaggucaacgagaaggacaagaagaaccggaccgugaagaucaucacgcugaaguccaaccucgugagcaacuuccgcaaggaguuccggcuguacaagguccgcgagaucaacgacuaccaccacgcccacgacgccuaccugaacgccgugguggccaaggcgauccucaagaaguaccccaagcuggagcccgaguucgucuacggcgacuaccagaaguacgaccugaagcgguacaucucccgcagccggaacccgaaggagguggagaaggccaccgagaaguacuucuucuacuccaaccuccugaacuucuucaaggaggaggugcacuacgccgacgggaccaucgucaagcgcgagaacaucgaguacagcaaggacaccggcgagaucgccuggaacaaggagaaggacuucgcgacgaucaagaaggugcuguccuacccccaggugaacaucgucaagaagcgggaggugcagaccgggggcuucagcaaggagagcauccuccccaagggcaacuccgacaagcugaucccccgcaagaccaaggacauccugugggagaccacgaaguacgggggcuucgacagcccggugaucgccuacuccauccuccugaucgccgacaucgagaaggggaaggccaagaagcugaagaccgucaagacccucgugggcaucaccaucauggagaaggccgcguucgaggagaaccccaucacguuccuggagaacaagggguaccacaacgugcggaaggagaacauccugugccuccccaaguacagccuguucgagcuggagaacggccgccggcgccuccuggccuccgccaaggagcugcagaagggcaacgagaucguccucccgguguaccugaccacccugcucuaccacagcaagaacgugcacaagcuggacgagcccgagcaccuggaguacauccagaagcaccggaacgaguucaaggaccuccugaaccuggucuccgaguucagccagaaguacgugcucgccgacgccaaccuggagaagauccagaaccuguacgcggacaacgagcaggccgacaucgagauccucgccaacuccuucaucaaccugcugaccuucacggcccucggggcccccgcggccuucaaguucuucggcaaggacaucgaccgcaagcgcuacaccaccgugagcgagauccugaacgccacccugauccaccaguccaucacggggcucuacgagacccggaucgaccugagcaagcugggcgaggacuga

SEQ ID NO: 1990 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccuccucuucgacagcggggagaccgcggaggccacccggcugaagcgcaccgcccggcgccgguacacgcgccggaagaaccgcauccgguaccugcaggagaucuucuccagcgagauguccaaggucgacgacagcuucuuccaccgccucgaggaguccuuccugguggaggaggacaagaagcacgagcggcacccgaucuucggcaacaucguggacgaggucgccuaccacgagaaguaccccaccaucuaccaccuccgcaagaagcucgccgacagcaccgacaaggcggaccugcggcugaucuaccucgcccuggcccacaugaucaaguuccgcggccacuuccugaucgagggggaccucaaccccgacaacuccgacauggacaagcuguucauccagcuggugcagaccuacaaccagcuguucgaggagaaccccaucaacgccagccggguggacgcgaaggccauccuguccgcccgccugagcaagucccggcgccucgagaaccugaucgcccagcugccgggcgagaagcggaacgggcuguucggcaaccugaucgcccugagccucgggcugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgcgucaacagcgagaucaccaaggcgccccuguccgccagcaugaucaagcgguacgacgagcaccaccaggaccucacccugcugaaggcccucgugcgccagcagcugcccgagaaguacaaggagaucuucuucgaccaguccaagaacggcuacgcgggguacaucgacggcggggccagccaggaggaguucuacaaguucaucaagccgauccuggagaagauggacggcacggaggagcuccuggccaagcugaaccgcgaggaccugcuccggaagcagcgcaccuucgacaacggcuccaucccccaccagauccaccugggggagcugcacgccauccuccggcgccaggaggacuucuaccccuuccugaaggacaaccgggagaagaucgagaagauccugaccuuccgcauccccuacuacgugggcccgcucgcccgggggaacagccgcuucgcguggaugacccggaaguccgaggagacgaucacccccuggaacuucgaggaggucguggacaagggcgccagcgcccaguccuucaucgagcgcaugaccaacuucgacaagaaccugcccaacgagaaggugcugcccaagcacagccuccuguacgaguacuucaccgucuacaacgagcugacgaaggugaaguacgugaccgaggggaugcggaagccggaguuccucuccggcaagcagaaggaggccaucgucgaccugcuguucaagaccaaccgcaaggugaccgugaagcagcucaaggaggacuacuucaagaagaucgagugcuucgacagcgucgagaucuccggcguggaggaccgguucaacgcgagccuggggacguaccacgaccugcucaagaucaucaaggacaaggacuuccuggacaacgaggagaacgaggacauccuggaggacaucgugcucacccugacccuguucgaggacaaggagaugaucgaggagcgccucaagaaguacgccaaccuguucgacgacaaggucaugaagcagcugaagcggcgccacuacaccggcugggggcggcucucccgcaagcugaucaacggcauccgggacaagcagagcgggaagacgauccuggacuuccucaaguccgacggcuucgccaaccgcaacuucaugcagcugaucaacgacgacagccugaccuucaaggaggccauccagaaggcccagguguccggccaggggcacagccuccacgagcagaucgcgaaccuggccggcagccccgccaucaagaaggggauccugcaguccgucaaggugguggacgagcucgucaaggugaugggccacaagcccgagaacaucgugaucgagauggcccgcgagaaccagaccacccagaaggggcagaagaacagccgggagcgcaugaagcggaucgaggagggcaucaaggagcugggcucccagauccugaaggagcaccccgucgagaacacgcagcuccagaacgagaagcuguaccuguacuaccuccagaacgggcgcgacauguacguggaccaggagcuggacaucaaccggcugagcgacuacgacguggaccacaucgucccgcaguccuucaucaaggacgacagcaucgacaacaagauccucacccgcuccgacaagaaccggggcaagagcgacaacgugcccuccgaggagguggucaagaagaugaagaacuacuggcgccagcugcugaacgccaagcucaucacccagcggaaguucgacaaccugaccaaggcggagcgcgggggccugagcgagcucgacaaggccggcuucaucaagcggcagcugguggagacgcgccagaucaccaagcacguggcccagauccuggacucccggaugaacaccaaguacgacgagaacgacaagcucauccgcgaggucaaggugaucacccugaaguccaagcugguguccgacuuccggaaggacuuccaguucuacaagguccgcgagaucaacaacuaccaccacgcccacgacgccuaccucaacgcggugguggggaccgcccugaucaagaaguacacgaagcuggagagcgaguucgucuacggcgacuacaagguguacgacgugcggaagaugaucgccaaguccgagcaggagaucgggaaggccaccgcgaagcgcuucuucuacagcaacaucaugaacuucuucaagaccgagaucacccucgccaacggcgagauccggaagcgcccccugaucgagacgaacgaggagaccggggagaucgucugggacaagggccgggacuucgccaccgugcgcaaggugcuguccaugccccaggucaacaucgugaagaagaccgaggugcagacgggcgcccucaccaacgagagcaucuacgcccgcgggagcuucgacaagcugaucucccggaagcaccgcuucgagagcuccaaguacggcggguucggcagcccgaccgucaccuacuccgugcugguggucgccaagagcaaggugcaggacgggaaggugaagaagaucaagacgggcaaggagcucaucggcaugacccugcuggacaagcucgucuucgagaagaacccccugaaguucaucgaggacaagggguacggcaacgugcagaucgacaagugcaucaagcugcccaaguacucccucuucgaguucgagaacgggacccggcgcaugcuggccagcgugauggccaacaacaacucccggggcgaccugcagaaggccaacgagauguuccuccccgccaagcuggucacccugcucuaccacgcgcacaagaucgagagcuccaaggagcuggagcacgaggccuacauccuggaccacuacaacgaccucuaccagcugcugagcuacaucgagcgcuucgccucccucuacguggacguggagaagaacaucagcaaggucaaggagcuguucuccaacaucgagagcuacuccaucagcgagaucugcuccagcgugaucaaccugcucacgcugaccgccagcggggccccggcggacuucaaguuccugggcaccaccaucccccggaagcgcuacggcagcccccagagcauccucuccagcacgcugauccaccaguccaucaccgggcuguacgagacccggaucgaccucagccagcugggcggggacuga

SEQ ID NO: 1991 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcauccgguaccugcaggagaucuucuccagcgagauguccaaggucgacgacagcuucuuccaccgccucgaggaguccuuccugguggaggaggacaagaagcacgagcggcacccgaucuucggcaacaucguggacgaggucgccuaccacgagaaguaccccaccaucuaccaccuccgcaagaagcucgccgacagcaccgacaaggcggaccugcggcugaucuaccucgcccuggcccacaugaucaaguuccgcggccacuuccugaucgagggggaccucaaccccgacaacuccgacguggacaagcuguucauccagcuggugcagaccuacaaccagcuguucgaggagaaccccaucaacgccagccgggucgacgcgaaggccauccuguccgcccgccugagcaagucccggcgccucgagaaccugaucgcccagcugccgggcgagaagcggaacggccucuucgggaaccugaucgcccugagccucgggcugacgcccaacuucaaguccaacuucgaccuggcggaggacgccaagcuccagcugagcaaggacaccuacgacgacgaccuggacaaccuccuggcccagaucggcgaccaguacgccgaccuguuccucgccgcgaagaaccuguccgacgccauccugcucagcgacauccugcgcgugaacagcgagaucaccaaggccccgcuguccgccagcaugaucaagcgguacgacgagcaccaccaggaccucacccugcugaaggcccucgugcgccagcagcugcccgagaaguacaaggagaucuucuucgaccaguccaagaacggcuacgcgggguacaucgacggcggggccagccaggaggaguucuacaaguucaucaagccgauccuggagaagauggacggcacggaggagcuccuggccaagcugaaccgcgaggaccugcuccggaagcagcgcaccuucgacaacggcuccaucccccaccagauccaccugggggagcugcacgccauccuccggcgccaggaggacuucuaccccuuccugaaggacaaccgggagaagaucgagaagauccugaccuuccgcauccccuacuacgucggcccgcucgcccgggggaacagccgcuucgcguggaugacccggaaguccgaggagacgaucacccccuggaacuucgaggaggugguggacaagggcgccagcgcccaguccuucaucgagcgcaugaccaacuucgacaagaaccugcccaacgagaagguccugcccaagcacagccuccuguacgaguacuucaccguguacaacgagcugacgaaggugaaguacgucaccgaggggaugcggaagccggccuuccucuccggcgagcagaagaaggcgaucguggaccugcuguucaagaccaaccgcaaggugaccgucaagcagcucaaggaggacuacuucaagaagaucgagugcuucgacagcguggagaucuccggcguggaggaccgguucaacgccagccuggggacguaccacgaccugcucaagaucaucaaggacaaggacuuccuggacaacgaggagaacgaggacauccuggaggacaucguccucacccugacccuguucgaggacaaggagaugaucgaggagcgccucaagaccuacgcccaccuguucgacgacaaggugaugaagcagcugaagcggcgccacuacacgggcugggggcggcucucccgcaagcugaucaacggcauccgggacaagcagagcgggaagaccauccuggacuuccucaaguccgacggcuucgccaaccgcaacuucauccagcugauccacgacgacagccugaccuucaaggaggccauccagaaggcgcaggucuccggccaggggcacagccuccacgagcagaucgccaaccuggccggcagccccgccaucaagaaggggauccugcaguccgugaagguggucgacgagcucgugaaggugaugggccacaagcccgagaacaucgucaucgagauggcccgcgagaaccagaccacgcagaaggggcagaagaacagccgggagcgcaugaagcggaucgaggagggcaucaaggagcugggcucccagauccugaaggagcaccccguggagaacacccagcuccagaacgagaagcuguaccuguacuaccuccagaacgggcgcgacauguacguggaccaggagcuggacaucaaccggcugagcgacuacgacgucgaccacaucgugccgcaguccuucaucaaggacgacagcaucgacaacaaggugcucacccgcuccgacaagaaccggggcaagagcgacaacguccccuccgaggagguggugaagaagaugaagaacuacuggcgccagcugcugaacgcgaagcucaucacccagcggaaguucgacaaccugacgaaggccgagcgcgggggccugagcgagcucgacaaggccggcuucaucaagcggcagcuggucgagacccgccagaucaccaagcacguggcccagauccuggacucccggaugaacaccaaguacgacgagaacgacaagcucauccgcgaggugaaggucaucacccucaagagcaagcugguguccgacuuccggaaggacuuccaguucuacaaggugcgcgagaucaacaacuaccaccacgcccacgacgcguaccucaacgccgucguggggacggcccugaucaagaaguaccccaagcuggagagcgaguucguguacggcgacuacaaggucuacgacgugcggaagaugaucgccaaguccgagcaggagaucgggaaggcgaccgccaagcgcuucuucuacagcaacaucaugaacuucuucaagaccgagaucacccucgccaacggcgagauccggaagcgcccccugaucgagacgaacgaggagaccggggagaucgugugggacaagggccgggacuucgccaccguccgcaaggugcuguccaugccccaggugaacaucgucaagaagaccgaggugcagacgggcgcccucaccaacgagagcaucuacgcgcgcgggagcuucgacaagcugaucucccggaagcaccgcuucgagagcuccaaguacggcggguucggcagccccaccgugaccuacuccguccuggugguggccaagagcaagguccaggacgggaaggugaagaagaucaagacgggcaaggagcucaucggcaucacccugcuggacaagcucguguucgagaagaacccccugaaguucaucgaggacaagggguacggcaacguccagaucgacaagugcaucaagcugcccaaguacucccucuucgaguucgagaacgggacccggcgcaugcuggccagcgugauggccaacaacaacucccggggcgaccugcagaaggccaacgagauguuccucccggcgaagcuggugacccugcucuaccacgcccacaagaucgagagcuccaaggagcuggagcacgaggccuacauccuggaccacuacaacgaccucuaccagcugcugagcuacaucgagcgcuucgccucccucuacgucgacguggagaagaacaucagcaaggugaaggagcuguucuccaacaucgagagcuacuccaucagcgagaucugcuccagcgucaucaaccugcucacgcugaccgccagcggggcgcccgccgacuucaaguuccugggcaccaccaucccccggaagcgcuacggcuccccgcagagcauccucuccagcacgcugauccaccaguccaucaccgggcuguacgagacccggaucgaccucagccagcugggcggggacuga

SEQ ID NO: 1992 - RNA, 4116 nt, Artificial Sequence
  Cas9 variant
auggagaacaagaacuacagcaucggccuggacaucgggaccaacuccgugggcuggagcgucaucaccgacgacuacaaggugcccuccaagaagaugaaggugcucgggaacacggacaagcacuucaucaagaagaaccugaucggcgcccugcuguucgacgaggggaccaccgccgaggcgcgccggcugaagcgcaccgcccggcgccgguacacgcgccggaagaaccgccugcgguaccuccaggagaucuucagcgaggagaucggcaaggucgacuccagcuucuuccaccgccuggacgacuccuuccugaucccggaggacaagcggggcagcaaguaccccaucuucgccacccucgccgaggagaagaaguaccacaagcaguuccccaccaucuaccaccuccgcaagcagcuggccgacuccaaggagaagaccgaccuccggcugaucuaccuggcgcucgcccacaugaucaaguaccgcgggcacuuccuguacgaggaggccuucgacaucaagaacaacgacauccagaagaucuucaacgaguucaucagcaucuacaacaacacguucgagggcaacucccugagcgggcagaacguccagguggaggccaucuucaccgacaagaucuccaagagcgcgaagcgggagcgcgugcucaagcuguuccccgacgagaaguccaccggccuguucagcgaguuccucaagcugaucguggggaaccaggccgacuucaagaagcacuucgaccuggaggagaaggccccgcuccaguucucccgggacaccuacgacgaggaccuggagaaccugcucggccagaucggcgacgacuucgccgaccuguuccugguggccaagaagcucuacgacgcgauccugcugagcgggauccucacggucaccaaccccuccaccaaggccccgcugagcgccagcaugaucgagcgcuacgagaaccaccagaaggaccuggccucccucaagcaguucaucaagaacaaccugcccgagaaguacgacgagguguucagcgaccaguccgaggacggcuacgccggguacaucgacggcaagaccacgcaggagaccuucuacaaguacaucaagaaccugcucagcaaguucgagggcgcggacuacuuccuggacaagaucgagcgggaggacuuccugcgcaagcagcggaccuucgacaacggguccaucccgcaccagauccaccuccaggagaugaacgccauccugcgccgccagggcgagcacuaccccuuccugaaggagaacaaggagaagaucgagaagauccucaccuuccggauccccuacuacguggggccccuggcccgcggcaaccgggacuucgccuggcugacgcgcaacagcgaccaggccauccggccguggaacuucgaggagaucgucgacaaggcguccagcgccgaggacuucaucaacaagaugaccaacuacgaccucuaccugcccgaggagaaggugcugcccaagcacucccugcucuacgagaccuucgccguguacaacgagcugaccaaggucaaguucaucgccgaggggcugcgcgacuaccaguuccucgacagcggccagaagaagcagaucgugacgcagcuguucaaggagaagcggaaggugaccgagaaggacaucauccaguuccugcacaacgucgacggcuacgacgggaucgagcucaagggcaucgagaagcaguucaacgccucccugagcaccuaccacgaccugcucaagaucaucaaggacaaggcguucauggacgacgccaagaacgaggccauccuggagaacaucgugcacacccugacgaucuucgaggaccgcgagaugaucaagcagcggcucgcccaguacgacucccuguucgacgagaaggugaucaaggcgcugacccgccggcacuacaccggguggggcaagcucagcgccaagcugaucaacgggaucuccgacaagcagaccggcaacacgauccuggacuaccucaucgacgacggcgagaucaaccgcaacuucaugcagcugaucaacgacgacgggcugagcuucaaggagaucauccagaaggcccaggucgugggcaagaccaacgacgugaagcaggucgugcaggagcuccccggguccccggccaucaagaagggcauccugcagagcaucaagaucgucgacgagcuggugaaggugauggggcacgcccccgaguccaucgucaucgagauggcgcgggagaaccagaccaccgcccgcggcaagaagaacagccagcagcgguacaagcgcaucgaggacagccucaagauccuggccuccggccugaacagcaagauccucaaggagcaccccacggacaacauccagcugcagaacgaccggcuguuccucuacuaccugcagaacgggaaggacauguacaccggcgaggcccuggacaucaaccagcucuccagcugcgacaucgaccacaucaucccccaggccuucaucaaggacgacucccuggacaaccgcgugcugaccagcuccaaggacaaccggggcaagagcgacaacgugccgucccucgaggucguggacaagaugaagguguucuggcagcagcugcuggacagcaagcucaucuccuaccgcaaguucaacaaccugaccaaggcggagcgcgggggccugaacgagcucgacaaggucggguucaucaagcggcagcugguggagacccgccagaucacgaagcacguggcccagauccuggacgcccgguucaacaaggaggucaccgagaaggacaagaagaaccgcaccgugaagaucaucacccucaagagcaaccugguguccaacuuccggaaggaguucgagcuguacaagguccgcgagaucaacgacuaccaccacgcccacgacgccuaccucaacgcggugguggccaaggccauccugaagaaguaccccaagcuggagcccgaguucgucuacggcgacuaccagaaguacgaccucaagcgguacaucagccgcuccaaggaccccaaggagaucgagaaggccacggagaaguacuucuucuacagcaaccugcugaacuucuucaaggaggaggugcacuacgcggacgggaccaucgugaagcgggagaacaucgaguacuccaaggacaccggcgagaucgccuggaacaaggagaaggacuucgccaccaucaagaagguccucagccugccccaggugaacaucgugaagaagcgcgagguccagaccgggggcuucagcaaggaguccauccugcccaagggcaacagcgacaagcucaucccccggaagacgaaggacauccugugggacaccaccaaguacgggggcuucgacucccccgugaucgccuacagcauccugcucaucgccgacaucgagaaggggaaggcgaagaagcugaagacggugaagacccuggucggcaucaccaucauggagaaggacgccuucgagaagaacccgaucgccuuccucgagaacaagggguaccacaacgugugcaaggagaacauccugugccugcccaaguacucccucuucgagcuggagaacggccgccggcgccugcucgccagcgccaaggagcugcagaagugcaacgagaucgugcugcccgucuaccucaccacgcugcuguaccacuccaagaacgugcacaagcucgacgagccgggccaccuggaguacauccagaagcaccggaacgaguucaaggaccugcucaaccuggugagcgaguucucccagaaguacguccuggcggacgccaaccucgagaagaucaagaaccuguacgccgacaacgagcaggccgacaucgagauccuggccaacagcuucaucaaccuccugaccuucaccgcgcugggggcccccgccgccuucaaguucuucggcaaggacguggaccgcaagcgguacaccacgguguccgagauccucaacgcgacccugauccaccagagcaucaccgggcuguacgagacccgcaucgaccucuccaagcugggcgaggacuga

SEQ ID NO: 1993 - RNA, 4116 nt, Artificial Sequence
  Cas9 variant
augaaggugaacaacuaccacaucggccuggacaucgggaccagcuccaucggcugggucgccaucggggaggacggcaagccccuccgcaucaaggggaagaccgccaucggcgcgcggcuguuccaggagggcaacccggccgccgaccgccggauguuccgcacgacccggcgccggcugagccgccggaaguggcgccucaagcugcuggaggagaucuucgaccccuacaucacccccguggacuccaccuucuucgcccggcucaagcagagcaaccugucccccaaggacagccgcaaggaguucaagggguccaugcuguucccggaccucacggacaugcaguaccacaaggacuaccccaccaucuaccaccuccggcacgcccugaugacccaggacgagaaguucgacauccgcaugguguaccuggcgauccaccacaucgucaaguaccggggcaacuuccugaacagcacccccguggacuccuucaaggccagcaaggugaacuucgucgaccaguucaagaagcugaacgagcucuacacggccaucaaccccgaggaguccuuccagaucaaccuggccaacagcgaggacaucgggcaccaguuccuggacccguccauccgcaaguucgacaagaagaagcagauccccaagaucgugcccgugagcgucgacgacaaggcgaccgacaagaucaacggcaagaucgccuccgagaucaucaacgccauccucggguacaagagcaagcuggacguggugguccagugcacccccguggacuccaagagcugggcccugaaguucgacgaggaggacaucgacgccaagcuccagaagauccugccggagauggacgagaaccagcaguccaucaucgcgauccugcagaaccucuacagccaggugacccugaaccagaucguccccaacggcaugagccuguccgagagcaugaucgagaaguacaacgaccaccacgaccaccucaagcuguacaagaagaucaucgaccagcuggccgaccccaagaagaaggccgcccucaagaaggccuacucccaguacgugggcgacgacgggaaggugaucgagcaggcggacuucuggagcuccgucaagaagaaccuggacgacagcgaccuguccaagcagaucauggaccucaucgacgccgagaaguucaugcccaagcagcggacgagccagaacggcgugaucccgcaccagcugcaccagcgcgagcuggacgagaucaucgagcaccaguccaaguacuaccccuggcucgccgagaucaaccccaacaagcacgaccugcaccuggccaaguacaagaucgaggagcucguggccuuccggguccccuacuacguggggccgaugaucacccccgacgaccaggccaagagcgcggagaccguguucuccuggauggagcgcaagggcaaggaggccggccagaucacccccuggaacuucgacgagaaggucgaccggaacgccagcgccaaccgcuucaucaagcgcaugacgaccaaggacaccuaccugaucggggaggacgugcugcccgacgagucccuccuguacgagaaguucaagguccugaacgagcucaacauggugcgggugaacggcaagcugcugaaggucgcggacaagcaggccaucuuccaggaccucuucgagaacuacaagcacaucagcgugaagaagcugcagaacuacaucaaguccaagaccgggcugccgagcgaccccgagaucuccggccugagcgaccccgaguacuucaacaacucccucgggacguacaacgacuucaagaagcuguucggcaacaagguggacgagcccgaccugcaggacgacuucgagaagaucgucgaguggagcaccguguucgaggacaagcgcauccuccgggagaagcugaacgagaucaccuggcugagcgaccagcagaaggacgugcucgaguccagccgcuaccagggcugggggcggcuguccaagaagcugcucaccggcaucgucaacgaccagggggagcgcaucaucgacgagcuguggaacacgaacaagaacuucaugcagauccagagcgacaacgacuucgccaagcggauccacgaggccaacgcggaccagaugaaggccguggacguggaggacguccuggccgacgccuacaccuccccgcagaacaagaaggccauccgccagguggugaaggucguggacgacauccagaaggcgaugggcgggguggcccccaaguacaucagcaucgaguucacccgguccgaggaccgcaacccccggcgcaccaucagccggcagcgccagcucgagaacacgcugaaggacaccgccaagucccuggccaagagcaucaacccggagcuccuguccgagcuggacaacgccgccaagagcaagaagggccucaucgaccggcuguaccuguacuucacccagcucggcaaggacaucuacaccgggaagcccaucaacaucgacgagaucuccacguacgacaucgaccacauccugccccaggcguucgucaaggacgacagccugaacaaccgcgugcucguguccaaggccaucaacaacggcaagagcgacaacguccccgugcagcuguucggggccaagaugggccacuucuggaagcagcuggccgaggcggggcucaucuccaagcggaagcugaagaaccugcagaccgacccggacaccaucagcaaguacgccaugcacggcuucauccgccggcagcucguggagaccagccaggucaucaagcugguggccaacauccugggcgacaaguaccgcaacgacgacacgaagaucaucgagaucaccgcccgcaugaaccaccagaugcgggacgaguucggguucaucaagaaccgcgagaucaacgacuaccaccacgcguucgacgccuaccucaccgccuuccugggccgguaccuguaccaccgcuacaucaagcuccggcccuacuucguguacggggacuucaagaaguucaaggaggacaaggucaccaugcgcaacuucaacuuccugcacgaccugaccgacgacacgcaggagaagaucgccgacgccgagaccggcgaggugaucugggaccgggagaacuccauccagcagcucaaggacguguaccacuacaaguucaugcugaucagccacgaggucuacacccugcgcggcgcgauguucaaccagaccguguaccccgccuccgacgccgggaagcggaagcucauccccaucaaggccgaccgcccgaucaacguguacggcggguacagcggcuccgccgacgcguacauggccaucguccggauccacaacaagaagggggacaaguaccgcguggugggcguccccaugcgggcccgcgaccggcuggacgccgccaagaaggugagcgacgcggacuacgaccgcgcccugaaggacgugcucacgccccagcugaccaagaccaagaagucccggaagaccggcgagaucacgcaggucguggaggacuucgagaucgugcuggggaaggucauguaccgccagcucaugaucgacggcgacaagaaguucaugcuggggagcuccaccuaccaguacaacgccaagcagcuggugcucagcgaccaguccgugaagacccuggccagcaagggccggcuggacccccuccaggaguccauggacuacaacaacgucuacaccgagauccuggacaaggugaaccaguacuucagccuguacgacaugaacaaguuccgccacaagcucaaccugggguucuccaaguucaucagcuucccgaaccacaacguguucgacggcaacacgaaggcguccagcggcaagcgggagauccuggaggagguccucaacgggcugcacgccaaccccaccuucggcaaccugaaggacaucgggaucaccacccccuucggccagcuccagcagcccaacgggauccugcuguccgacgaggccaagauccgcuaccagagcccgacgggccucuucgagcgcaccgugagccugaaggaccuguga

SEQ ID NO: 1994 - RNA, 4116 nt, Artificial Sequence
  Cas9 variant
augaaggugaacaacuaccacaucggccuggacaucgggaccagcuccaucggcugggucgccaucgggaaggacggcaagccccuccgcgugaaggggaagaccgccaucggcgcgcggcuguuccaggagggcaacccggccgccgaccgccggauguuccgcacgacccggcgccggcugagccgccggaaguggcgccucaagcugcuggaggagaucuucgaccccuacaucacccccguggacuccaccuucuucgcccggcucaagcagagcaaccugucccccaaggacagccgcaaggaguucaagggguccaugcuguucccggaccucacggacaugcaguaccacaagaacuaccccaccaucuaccaccuccggcacgcccugaugacccaggacaagaaguucgacauccgcauggucuaccuggcgauccaccacaucgugaaguaccggggcaacuuccugaacagcacccccguggacuccuucaaggccagcaaggucgacuucguggaccaguucaagaagcugaacgagcucuacgccgccaucaaccccgaggaguccuucaagaucaaccuggcgaacagcgaggacaucgggcaccaguuccuggacccguccauccgcaaguucgacaagaagaagcagauccccaagaucgugcccgucaugaugaacgacaaggugacggaccggcucaacggcaagaucgccagcgagaucauccacgccauccugggguacaaggccaagcuggacgugguccuccagugcacccccguggacuccaagccgugggcccugaaguucgacgacgaggacaucgacgcgaagcuggagaagauccuccccgagauggacgagaaccagcagagcaucguggccauccugcagaaccuguacucccaggucacccucaaccagaucgugcccaacggcaugagccuguccgagagcaugaucgagaaguacaacgaccaccacgaccaccugaagcucuacaagaagcugaucgaccagcuggccgaccccaagaagaaggccgugcucaagaaggccuacagccaguacgucggcgacgacgggaaggugaucgagcaggcggaguucugguccagcgugaagaagaaccuggacgacuccgagcugagcaagcagaucauggaccucaucgacgccgagaaguucaugccgaagcagcgcaccucccagaacggcgucaucccccaccagcugcaccagcgggagcuggacgagaucaucgagcaccagagcaaguacuaccccuggcucguggagaucaaccccaacaagcacgaccugcaccuggccaaguacaagaucgagcagcucguggccuuccgcgucccguacuacguggggcccaugaucacgcccaaggaccaggccgaguccgcggagaccgucuucagcuggauggagcggaagggcaccgagaccggccagaucacgcccuggaacuucgacgagaagguggaccgcaaggccuccgccaaccgcuucaucaagcggaugaccaccaaggacaccuaccugaucggggaggacgugcugccggacgagagccuccuguacgagaaguucaagguccugaacgagcucaacauggugcgcgugaacggcaagcugcugaaggucgccgacaagcaggccaucuuccaggaccuguucgagaacuacaagcacguguccgugaagaagcuccagaacuacaucaaggcgaagacggggcugcccagcgaccccgagaucuccggccugagcgaccccgagcacuucaacaacucccucgggaccuacaacgacuucaagaagcuguucggcagcaaggucgacgagccggaccugcaggacgacuucgagaagaucguggagugguccaccguguucgaggacaagaagauccuccgggagaagcugaacgagaucaccuggcugagcgaccagcagaaggacguccucgaguccagccgcuaccagggcugggggcggcugagcaagaagcugcucacgggcaucgugaacgaccagggggagcgcaucaucgacaagcuguggaacaccaacaagaacuucaugcagauccaguccgacgacgacuucgccaagcggauccacgaggccaacgccgaccagaugcaggcgguggacgucgaggacgugcuggccgacgccuacaccagcccccagaacaagaaggccauccgccagguggucaaggugguggacgacauccagaaggccaugggcggggucgcgcccaaguacaucuccaucgaguucacccggagcgaggaccgcaacccgcggcgcacgaucucccggcagcgccagcucgagaacacccugaaggacaccgccaagagccuggccaaguccaucaaccccgagcuccugagcgagcuggacaacgccgccaaguccaagaagggccucaccgaccggcuguaccuguacuucacgcagcucggcaaggacaucuacaccggggagcccaucaacaucgacgagcugaacaaguacgacaucgaccacauccugccccaggcguucaucaaggacaacagccucgacaaccgcgugcuggugcugaccgccgucaacaacggcaaguccgacaacgugccgcuccggauguucggggccaagaugggccacuucuggaagcagcuggccgaggccgggcugaucagcaagcgcaagcucaagaaccugcagaccgaccccgacacgaucuccaaguacgcgaugcacggcuucauccggcgccagcugguggagaccagccaggucaucaagcucguggccaacauccugggcgacaaguaccgcaacgacgacaccaagaucaucgagaucaccgcccggaugaaccaccagaugcgcgacgaguucggguucaucaagaaccgggagaucaacgacuaccaccacgccuucgacgcguaccugaccgccuuccucggccgcuaccuguaccaccgguacaucaagcugcgccccuacuucguguacggggacuucaagaaguuccgggaggacaaggucacgaugcgcaacuucaacuuccuccacgaccugaccgacgacacccaggagaagaucgccgacgccgagaccggcgaggugaucugggaccgggagaacuccauccagcagcugaaggacguguaccacuacaaguucaugcucaucagccacgaggucuacacgcugcgcggcgccauguucaaccagaccguguaccccgcguccgacgccgggaagcggaagcugaucccggugaaggccgaccgccccgucaacguguacggcggguacagcggcagcgccgacgccuacauggcgaucgugcggauccacaacaagaagggggacaaguaccgcgucgugggcgugcccaugcgggcccucgaccgccuggacgccgccaagaacgucuccgacgccgacuucgaccgggcgcugaaggacgugcucgcgccccagcugaccaagaccaagaagucccgcaagacgggcgagaucacccaggugaucgaggacuucgagaucguccuggggaaggugauguaccggcagcucaugaucgacggcgacaagaaguucaugcuggggagcagcaccuaccaguacaacgccaagcagcuggugcucuccgaccagagcgucaagacccuggccuccaagggccgccuggacccgcuccaggagagcauggacuacaacaacguguacacggagauccuggacaaggugaaccaguacuucucccuguacgacaugaacaaguuccggcacaagcucaaccugggguucagcaaguucaucuccuuccccaaccacaacguccuggacggcaacaccaaggugagcuccggcaagcgcgagauccuccaggagauccugaacgggcugcacgccaaccccaccuucggcaaccucaaggacgucgggaucaccacgcccuucggccagcugcagcagccgaacgggauccugcucagcgacgagaccaagauccgcuaccagucccccaccggccuguucgagcggaccgugagccugaaggaccucuga

SEQ ID NO: 1995 - RNA, 4116 nt, Artificial Sequence
  Cas9 variant
auggacaagaaguacagcaucggccuggacaucgggaccaacuccgugggcugggccgucaucaccgacgacuacaaggugcccagcaagaaguucaaggugcucgggaacacggaccgccacuccaucaagaagaaccugaucggcgcccugcuguucgacagcggggagaccgcggaggccacccggcugaagcgcaccgcccggcgccgguacacgcgccggaagaaccgcaucugcuaccugcaggagaucuucuccaacgagauggccaaggucgacgacagcuucuuccaccggcucgaggaguccuuccugguggaggaggacaagaagcacgagcgccacccgaucuucggcaacaucguggacgaggucgccuaccacgagaaguaccccaccaucuaccaccuccggaagaagcucgcggacagcaccgacaaggccgaccugcgccugaucuaccucgcccuggcccacaugaucaaguuccggggccacuuccugaucgagggggaccucaaccccgacaacuccgacguggacaagcuguucauccagcuggugcagaccuacaaccagcuguucgaggagaaccccaucaacgcgagccgcgucgacgccaaggccauccuguccgcccggcugagcaagucccgccggcucgagaaccugaucgcccagcugccgggcgagaagaagaacggccucuucgggaaccugaucgcgcugagccucgggcugacgcccaacuucaaguccaacuucgaccuggccgaggacgccaagcuccagcugagcaaggacaccuacgacgacgaccuggacaaccuccuggcccagaucggcgaccaguacgccgaccuguuccucgcggccaagaaccuguccgacgccacccugcucagcgacauccugcgcgugaacuccgagaucaccaaggccccgcugagcgccagcaugaucaagcgguacgacgagcaccaccaggaccucacgcugcugaaggcgcucgugcgccagcagcugcccgagaaguacaaggagaucuucuucgaccaguccaagaacggcuacgccggguacaucgacggcggggccagccaggaggaguucuacaaguucaucaagccgauccuggagaagauggacggcaccgaggagcuccuggccaagcugaaccgggaggaccugcuccgcaagcagcgcaccuucgacaacggcuccaucccccaccagauccaccugggggagcugcacgccauccuccggcgccaggaggacuucuaccccuuccugaaggacaaccgggagaagaucgagaagauccugaccuuccgcauccccuacuacgucggcccgcucgcgcgggggaacagccgcuucgccuggaugacgcggaaguccgaggagaccaucacccccuggaacuucgaggaggugguggacaagggcgccagcgcccaguccuucaucgagcgcaugaccaacuucgacaagaaccugcccaacgagaagguccugcccaagcacagccuccuguacgaguacuucacgguguacaacgagcugaccaaggugaaguacgucaccgaggggaugcggaagccggcguuccucuccggcgagcagaagaaggccaucguggaccugcuguucaagaccaaccgcaaggugacggucaagcagcucaaggaggacuacuucaagaagaucgagugcuucgacagcguggagaucuccggcguggaggaccgguucaacgccagccuggggaccuaccacgaccugcucaagaucaucaaggacaaggacuuccuggacaacgaggagaacgaggacauccuggaggacaucguccucacccugacccuguucgaggacaaggagaugaucgaggagcgccucaagacguacgcccaccuguucgacgacaaggugaugaagcagcugaagcggcgccacuacaccggcugggggcggcucucccgcaagcugaucaacggcauccgggacaagcagagcgggaagaccauccuggacuuccucaaguccgacggcuucgccaaccgcaacuucauccagcugauccacgacgacagccugaccuucaaggaggcgauccagaaggcccaggucuccggccaggggcacagccuccacgagcagaucgccaaccuggccggcucccccgccaucaagaaggggauccugcagagcgugaagguggucgacgagcucgugaaggugaugggccacaagcccgagaacaucgucaucgagauggcgcgggagaaccagacgacccagaaggggcagaagaacagccgcgagcgcaugaagcggaucgaggagggcaucaaggagcugggcucccagauccugaaggagcaccccguggagaacacccagcuccagaacgagaagcuguaccuguacuaccuccagaacgggcgcgacauguacguggaccaggagcuggacaucaaccggcugagcgacuacgacgucgaccacaucgugccgcaguccuucaucaaggacgacagcaucgacaacaaggugcucacccgcuccgacaagaaccggggcaagagcgacgacguccccuccgaggagguggugaagaagaugaagaacuacuggcgccagcugcugaacgccaagcucaucacgcagcggaaguucgacaaccugaccaaggccgagcgcgggggccugagcgagcucgacaaggccggcuucaucaagcggcagcuggucgagacccgccagaucaccaagcacguggcccagauccuggacucccggaugaacaccaaguacgacgagaacgacaagcucauccgcgaggugaaggucaucacgcucaagagcaagcugguguccgacuuccggaaggacuuccaguucuacaaggugcgcgagaucaacaacuaccaccacgcgcacgacgccuaccucaacgccgucguggggaccgcccugaucaagaaguaccccaagcuggagagcgaguucguguacggcgacuacaaggucuacgacgugcggaagaugaucgcgaaguccgagcaggagaucgggaaggccaccgccaagcgcuucuucuacagcaacaucaugaacuucuucaagaccgagaucacgcucgccaacggcgagauccggaagcgcccccugaucgagaccaacgaggagaccggggagaucgugugggacaagggccgggacuucgccaccguccgcaaggugcuguccaugccccaggugaacaucgucaagaagacggaggugcagaccggcgcgcucaccaacgagagcaucuacgcccggggguccuucgacaagcugaucagccgcaagcaccgcuucgagagcuccaaguacggcggguucggcagccccaccgugacguacuccguccuggugguggccaagagcaagguccaggacgggaaggugaagaagaucaagaccggcaaggagcucaucggcaucacccugcuggacaagcucguguucgagaagaacccccugaaguucaucgaggacaagggguacggcaacguccagaucgacaagugcaucaagcugcccaaguacucccucuucgaguucgagaacgggacccggcgcaugcuggccagcgugauggccaacaacaacucccggggcgaccugcagaaggcgaacgagauguuccucccggccaagcuggugacgcugcucuaccacgcccacaagaucgagagcuccaaggagcuggagcacgaggccuacauccuggaccacuacaacgaccucuaccagcugcugagcuacaucgagcgcuucgccucccucuacgucgacguggagaagaacaucagcaaggugaaggagcuguucuccaacaucgagagcuacuccaucagcgagaucugcuccagcgucaucaaccugcucacccugaccgcguccggggcccccgccgacuucaaguuccugggcaccacgaucccccggaagcgcuacggcagcccgcagagcauccucuccagcacccugauccaccaguccaucaccgggcuguacgagacccggaucgaccucagccagcugggcuccgacuga

SEQ ID NO: 1996 - RNA, 4119 nt, Artificial Sequence
  Cas9 variant
augaacaacgaguacuucgugggcuucgacaucgggaccaacagcgucggcgccgccgugaccgacgagaaguaccacgugcugaaguucaaggggaacgcgauguggacguccgccgucuucgagagcgcccagcaguccgccgaccgccggcucaaccgcaccgcccggcgccggcuggaccgcagccagcagcggcgcgaccugcuccaggagcugaucgcgcccgccaucaccccgguggacccccgguucuucgaccgcauccgggaguccgcccugugggccgaggacaagaccacgggcagccgcuucaccuacuucuccgacgagggguacaccgacaagcaguaccacaaggaguaccccaccauccaccaccucaucugcagccugaugaacgaccccgcgccgcacgacccccggcugguguacaucgccugcuccuacaugcucacgcaccgcggccacuuccugaacgaggccgacaaggagaagaucgacgacguccuggacauccggcgcguguucaacgagcucugcagcugguucaccuccuacggcaucgaggugcccuucagcugcuuccccgaggaguucgggaacguccugaccgccaaccggggcgugcaggaccgcacccgggccuucuacgaccuccucuucgcggggaagaagccgaagcccuccgaggacgaccagguggacaucgacguccugaucaagcugaucagcggcgggaagaucgagcucuccaagcuguuccugaacgaggaguacagcgagcucgagaacaacaagauccagcuguccgacgccggcuucgacgagaaggagcccgagcugcgcagcgagcucggcgacgacuucgggcugguggccgccgccaagaacaucuacgacuggucccugcucacgggcgugcugggggagugcaagagcaucagcgaggcgaaggucaagaccuacgagaagcacuccgaggaccuggccgcccuccggcgcguggugcgcaaguaccaccccgacaaguacaaggagaucuucaagaaguacgucgugggcaacuacaccagcuacuccggcaacgucaagagcgccgggaagaucuccgagaccaagcugaagcggugcaaccaggccgaguucugcgacuaccucaagagcaagcugaaggacgugaagccggcgcccggcgacgacgagugcgagcgcgugcugaaggagaucuccaagcacacguucugcccccgccaggugaccaccgacaaccgggucauccccuaccagcuguacuacaccgagcucaagaaggugcuggagaacgccaagcgguacaucccgcagcugaacgucacggacgaguacgggagcgccgccgacaagauccucucccugaugaccuuccgcauccccuacuacgugggcccccuggugaagaagaacgacagcuccaacgccuggaucguccggcgcggggagggccggauccuccccuggaacuucgacgagcugguggacaaggacaagugcgaggacgaguucauccgccggaugaccugcaagugcaccuacaucgcgggcaagaacgugcugccgaagaacagccuccuguacugcaaguucaugguccugaacgagaucaacaacaucaagaucaacggggagcgcaucuccgugggcgacaagcagaagaucuacacggagcuguucgagaagaagcggaaggugaccguccgcgacauccggaaccugcugaccagcgaggggcgccugaaggccggcgacaccuucgggggcaucgacaucacggugaaguccagccucaagccccagcacgaccugaagcggcugauggccgccggcgugaucaccgaggcggacgccgaggagaucaucgagcgcaucacgugcaccaccgacgucucccggcuccgcaccuggcuggggaaguucggccugagcgccgccgacgccaaguacguguccgggcucaaguacagcgacuucggccgccugagccgggaguuccugaccgaggugaacgacgucgaccccgcgaccggggaggugaucaaccccaacaucaucacgaugaugugggagaacaacaucaaccucauggagcugcugucccagaaguacagcuaccgcucccagaucgagagcaugaaccgggaguacuacgccgccaacccgcucacccuggacgagcgcauguccgagauguacauccccagcgccgugcggcgccccgucaagcggaccaucgagaugaugaaggaguacaugcacaucaugcgcaagcccccgaagcggaucuucaucgagauggcccgcgagcugaccgaccucgacaacaagggcaagcggaccuccagccgccggaacacgcugcuggaguucuucaagaagugcccccaggacaccaccgagcuccgcgcgcagcuggagaagaaguccgacgacgagcugcggagcgagaagcucuaccuguacuucgcccagcugggcaagugcauguacuccggggagagcaucgacaucgagcgccucggcuccaagcuguacgacguggaccacaucuucccccaggcccgggugaaggacgacagcaucgagaacaagguccuggugcucuccgaccugaacggggccaagagcgaccgcuacccgaucaacgccgacauccggaacaagaugcacuccuucugggacaagcugcacagcaucggccucaucggcgagaagaaguacgagcgccugacccggagcacgggguucaccgacgacgagcuggcgggcuucaucucccgccagcucguggagacccgccagagcaccaaggccgucgccgcccugcuggcggaggaguuccccgaguccgagaucguguacgugaaggccgggcucgccagccaguuccggcacgaguucggccugcugaagugccgcgagaucaacgaccuccaccacgccaaggacgccuaccugaacaucgucauggggaacaucuaccacgugaaguucacgaaggaccccaugaacuucgugaaggaguaccggcgcaaggagcaggucuucgaccugaagauccaguccaugcucacccacgacgcgauccggaacggcgagaccgccuggaucggcgacgggaccuggcuggagacggugaagaagcagauggagaagaacaacauccgcuacgugcgguacagcuuccgccggaagggcgcccuguucaaccucaugcccgagcgcaagaacccgucccugcugccccggaagaacgggaagaacaugguccuccccgccgagaaguacggcggguacaacaacaccgccgcgagcuucuucucccuggugaaguaccacagcgccaagggcuccggcguggucaucauccccguggagcugauccacgcccaccgcuacgagcacgacagcuccuucgccgaggaguacgcccuccgggugcuggcggacaucgucagccugaagaagggggacgugcuccaguccguggaguucccgcugggcagccgcauccugaaggucaacacccuccuggacaucgacggguuccgggccaacaucaccggcaaggacuccgggggcaaguaccugggcaucagcuccgccagcagccucaucaucucccagguggacacgaccuacaucaagcgcgugaucagcaucaacgagcggaucuccgccugcgagaagaacaagcagagcuacaccauccgccccgaguucgacgucaucaccuccgagcggaacaucgagaucuacaacaugcugugcgagaagaucagcucccgccccuucugcaucaaguucgcgaacacgagcgacaccuucguguccgggcgcgagaaguucaucgcccugagccucaacgagcaggucaagacccugaccaacaugcuguccguguucaagacgggccgggccagcgggugcgaccucaccaacaucggcggguccaagaacaccgccaucgugaagcugaacgccgugcugagcaaccucaaggacuucaaguccguccgcaucaucgaccagagccccaccggccuguacgagaagguguccccgaaccugcucagccuguga

SEQ ID NO: 1997 - RNA, 4119 nt, Artificial Sequence
  Cas9 variant
augaccaagaagaacuacagcaucggccuggacaucgggaccaacuccgugggcugggccgucaucacggacgacuacaagauccccgccaagaagaugaaggugcucgggaacaccgacaaggaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccgaggagaucgcgaaggccgacaacuccuucuuccagcggcuggacgagagcuuccucaccgacgacgacaaggacuucgacucccacccgaucuucggcaacaaggccgaggaggacgccuaccaccagaaguucagcaccaucuaccaccuccgcaaguaccuggcggacucccccgagaaguccgaccuccggcugguguaccuggcccucgcccacaugaucaaguaccgcggccacuuccugaucgagggggagcugaaggccgagaacacggacguccagaagcuguucaccgacuucguggagguguacgaccggaccuucgacgacagccaccugagcgaggucaccguggacgccuccagcauccugacggagaagaucuccaagagccgccggcucgagaaccugaucgaguccuaccccaaggagaagaagaacacccuguucggcaaccucaucgcgcugagccuggggcuccagcccaacuucaagaccaacuucaagcuguccgaggacgccaagcugcaguucagcaaggacaccuacgaggaggaccucgaggaggugcuggagaagaucggcgacgacuacgccgaccuguucacguccgccaagaaccucuacgacgccauccugcugagcgggauccucaccgucgacgacagcuccaccaaggcgccgcugagcgccuccaugaucaagcgcuacgccgagcaccacgaggaccuggagaagcucaaggccuucaucaagaccaacaagcccaaccuguaccacgacaucuucaaggacgagacgcagaacggcuacgccggcuacaucgagaacggggugaagcaggacgaguucuacaaguaccugaagaccauccucagcaagaccgacggcuccgaguacuuccuggacaagaucgagcgggaggacuuccugcgcaagcagcggaccuucgacaacgggagcaucccccaccagauccaccuccaggagaugcacgcgauccugcgccggcagggcgacuacuaccccuuccugaaggagaaccaggaccgcaucgagaagauccucacguuccgcaucccguacuacgugggcccccuggcccggaagaacucccgcuucgccugggccgaguaccacagcgacgagaagaucacccccuggaacuucaacaaggucaucgacaaggagaaguccgccgagaaguucaucacccggaugacccugaacgaccuguaccuccccgaggagaaggugcugccgaagcacagccacguguacgagacguucgcggucuacaacgagcugaccaagaucaaguacgugaacgagcaggggaaggaggccuucuucgacuccaacaugaagcaggagaucuucgaccacguguucaaggagaaccgcaaggucaccaaggagaagcuccugaacuaccuggacaaggaguuccccgaguaccggauccaggaccucaucggccuggacaaggagaacaagagcuucaacgccucccuggggaccuaccacgaccucaagaagauccuggacaagagcuuccuggacgacaaggugaacgaggaggugaucgaggacaucaucaagacgcucacccuguucgaggaccgcgagaugauccagcagcggcugcacaaguacuccgacaucuucagcacccagcagcucaagaagcuggagcgccggcacuacaccggcugggggcgccuguccuacaagcucaucaacggcauccggaacaaggagaacaacaagacgauccuggaguaccugaucgacgacggcuacgccaaccgcaacuucaugcagcucaucaacgacgacacccugcccuucaagcagaucaucaaggacgcgcagaucaucgggaacaucgacgacaucgccgccgucgugcacgagcugcccggcagcccggccaucaagaaggggauccuccaguccaucaagaucguggacgagcuggucaaggugaugggccacaaccccgacaacaucgucaucgagauggcccgggagaaccagaccaccaaccgcgggcggagccagagccagcagcgccugaagaagcuccaggacucccugaaggagcugggcagcaacauccucaacaagaagaagcccuccuacguggaggacaagguggagaacguccaccuccaggacgaccggcuguuccuguacuacauccagaacggcaaggacaucuacaccggggaggagcuggacaucgaccgccugagcgacuacgacaucgaccacaucaucccccaggcguucaucaaggacgacuccaucgacaaccgggugcucacgagcuccgccaagaaccgcggcaagagcgacgacgugccgaaccuggacaucguccgcgcccggaaggccgacugggugcgccuguacaaguccgggcucaucagcaagcggaaguucgacaaccugaccaaguccgagcgcggcgggcugaccgaggccgacaaggcgggcuucaucaagcggcagcucguggagacccgccagaucacgaagcacgucgcccagauccuggacgcccgguucaacaccgagcacgacgaggacgacaaggugauccgcaacgugaaggucaucacccucaagagcaaccugaucucccaguuccggaaggacuucaaguucuacaaggugcgcgagaucaacgacuaccaccacgcccacgacgccuaccugaacgcgguggucggcaccgcccugcuccggaaguaccccaagcuggcccccgaguucguguacggggaguacaagaaguacgacgugcgcaagcugaucacgagcuccagcgacaaggccaccgcgaaguacuucuucuacuccaaccucaugaacuucuucaagcgggucgugcgcuacagcaacggccgggugaucguccgccccgugaucgaguacagcaaggacaccggggagaucguguggaacaaggagaccgacuuccggacgaucugcaagguccuguccuacccccaggugaacaucgugaagaaggucgagagccagaccggcggcuucuccaaggagagcauccugccgaagggggacuccgacaagcucaucccccgcaagaccaagaagguguacugggacaccaagaaguacggcggguucgacagccccaucaucgccuacuccguguucgucguggccgacguggagaagggcaaggccaagaagcugaagaaggucaaggagcugguggggaucagcaucauggagcggccguccuucgagaagaaccccaucguguuccucgagaagaagggcuaccgcaacguccaggaggacacgcugaucaagcugcccaaguacagccucuucgaguucgagggcgggcggcgccgccugcuggccuccgcgagcgagcuccagaagggcaacgagguggugcuguccgaccggcuggucgagcuccuguaccacgcccaccgcgugaacagcuucaacuccaccgagcaccugaaguacgugagcgagcacaagaaggaguucggggagguccucuccugcguggagaacuucgccaacagcuacguggacgucgagaagaaccuggacaagauccgggccgugaucaacaagaucgacaccuucuccaucgaggagaucagcaccagcuucgugaaccugcucacgcugaccgcccugggcgcgccggccgacuucaacuuccucgggaagaagaucccccgcaagcgguacaccuccaccaaggagugccugaacgccacgcugauccaccagagcaucaccggccucuacgagacccgcaucgaccuguccaagcugggcgaggacaaguga

SEQ ID NO: 1998 - RNA, 4119 nt, Artificial Sequence
  Cas9 variant
augaccaagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccaacgagaucgcgaaggucgacgaguccuucuuccagcggcuggacgagagcuuccucaccgacgacgacaagaccuucgacucccacccgaucuucggcaacaaggccgaggaggacgccuaccaccagaaguuccccacgaucuaccaccuccgcaagcaccuggccgacagcuccgagaaggcggaccugcggcugguguaccuggcccucgcccacaugaucaaguuccgcggccacuuccugaucgagggggagcugaacgccgagaacaccgacgugcagaagaucuucgccgacuucgucggcguguacaaccggaccuucgacgacagccaccucuccgagaucaccguggacgucgcgagcauccugacggagaagaucuccaagagccgccggcuggagaaccucaucaaguacuaccccaccgagaagaagaacacccuguucgggaaccugaucgcccucgcccugggccugcagcccaacuucaagaccaacuucaagcucuccgaggacgccaagcugcaguucagcaaggacacguacgaggaggaccuggaggagcuccuggggaagaucggcgacgacuacgccgaccuguucaccuccgcgaagaaccucuacgacgccauccugcugagcggcauccucaccguggacgacaacuccaccaaggccccgcugagcgccuccaugaucaagcgcuacguggagcaccacgaggaccuggagaagcucaaggaguucaucaaggccaacaagagcgagcuguaccacgacaucuucaaggacaagaacaagaacggguacgcgggcuacaucgagaacggggucaagcaggacgaguucuacaaguaccugaagaacauccucagcaagaucaagaucgacggcuccgacuacuuccuggacaagaucgagcgggaggacuuccugcgcaagcagcggacguucgacaacggcagcaucccccaccagauccaccuccaggagaugcacgccauccugcgccggcagggggacuacuaccccuuccugaaggagaagcaggaccgcaucgagaagauccucaccuuccgcauccccuacuacgugggcccgcuggugcggaaggacucccgcuucgccugggccgaguaccggagcgacgagaagaucacccccuggaacuucgacaaggucaucgacaaggagaaguccgccgagaaguucaucacccgcaugacgcugaacgaccuguaccuccccgaggagaaggugcugcccaagcacagccacguguacgagaccuacgcggucuacaacgagcugaccaagaucaaguacgugaacgagcaggggaaggaguccuucuucgacagcaacaugaagcaggagaucuucgaccacguguucaaggagaaccggaaggucaccaaggagaagcuccugaacuaccugaacaaggaguucccggaguaccgcaucaaggaccucaucggccuggacaaggagaacaaguccuucaacgccagccuggggacguaccacgaccucaagaagauccuggacaaggccuuccuggacgacaaggugaacgaggaggugaucgaggacaucaucaagacccucacccuguucgaggacaaggacaugauccacgagcggcugcagaaguacuccgacaucuucaccgccaaccagcucaagaagcuggagcgccggcacuacacgggcuggggccgccugagcuacaagcucaucaacgggauccggaacaaggagaacaacaagaccauccuggacuaccugaucgacgacggcuccgcgaaccgcaacuucaugcagcucaucaacgacgacacccugcccuucaagcagaucauccagaagucccaggucgugggggacgucgacgacaucgaggccguggugcacgaccugcccggcagccccgccaucaagaaggggauccuccagagcgucaagaucguggacgagcuggugaaggucaugggcggcaacccggacaacaucgugaucgagauggcccgggagaaccagaccacgaaccgcgggcggucccagagccagcagcgccugaagaagcuccagaacucccugaaggagcugggcagcaacauccucaacgaggagaagcccagcuacaucgaggacaagguggagaacucccaccuccagaacgaccagcuguuccuguacuacauccagaacgggaaggacauguacaccggcgacgagcuggacaucgaccaccugagcgacuacgacaucgaccacaucaucccccaggccuucaucaaggacgacuccaucgacaaccggguccucaccagcuccgcgaagaaccgcggcaagagcgacgacgugcccucccuggacaucgugcgggcccgcaaggccgaguggguccgccuguacaagagcgggcucaucuccaagcggaaguucgacaaccugaccaaggccgagcgcggcgggcugaccgaggccgacaaggcgggcuucaucaagcggcagcucguggagacgcgccagaucaccaagcacguggcccagauccuggacgcccgguucaacaccgagcacgacgagaacgacaaggucauccgcgacgugaaggugaucacccucaagagcaaccuggucucccaguuccggaaggacuucgaguucuacaaggugcgcgagaucaacgacuaccaccacgcccacgacgccuaccugaacgcgguggucgggacggcccugcucaagaaguacccgaagcuggccagcgaguucguguacggcgaguacaagaaguacgacauccggaaguucaucaccaacuccagcgacaaggccaccgcgaaguacuucuucuacuccaaccugaugaacuucuucaagaccaaggugaaguacgccgacggcacggucuucgagcgccccaucaucgagaccaacgccgacggggagaucgccuggaacaagcagaucgacuucgagaaggugcggaaggugcucagcuacccccaggucaacaucgugaagaagguggagacccagaccggcggguucuccaaggagagcauccugcccaagggcgacagcgacaagcugaucccgcgcaagacgaagaaggucuacugggacaccaagaaguacgggggcuucgacucccccaccguggccuacagcguguucgucguggcggacguggagaagggcaaggccaagaagcucaagaccgucaaggagcugguggggaucuccaucauggagcggagcuucuucgaggagaaccccguggaguuccuggagaacaagggcuaccacaacauccgcgaggacaagcucaucaagcugcccaaguacucccuguucgaguucgagggcgggcggcgccggcuccuggccagcgccuccgagcugcagaaggggaacgagaugguccucccgggcuaccugguggagcugcucuaccacgcccaccgcgcggacaacuucaacagcacggaguaccugaacuacguguccgagcacaagaaggaguucgagaagguccugagcugcguggaggacuucgccaaccucuacguggacgucgagaagaaccuguccaagauccgggccguggccgacagcauggacaacuucuccaucgaggagaucagcaacuccuucaucaaccugcucacccugaccgcccugggcgcgcccgccgacuucaacuuccucggggagaagaucccccgcaagcgguacaccagcacgaaggagugccugaacgccacccugauccaccaguccaucaccggccucuacgagacccgcaucgaccugagcaagcugggggaggaguga

SEQ ID NO: 1999 - RNA, 4119 nt, Artificial Sequence
  Cas9 variant
augaacagcgacaagcgcgaggacuacuacgugggccuggacauggggaccggcucccucgggggcgccgucaccgacacgcaguaccaccuccugaaggugaaggggaaggacuucugguucgugcgggaguacgagaccgccaagagccagcuggaccgccggacccaccgcaucgcgaagcggcgccugcagcggcacaaggcccgcaucggccugauccgguccuacuucgccgaggacauccucaagcacgacccccuguucuacauccgccaggacaacagcaaguacuaccacgaggacaaggacguccggcugaccacgaaggacuccaucuucgccgacccgggcuacggggacaaggaguaccucgacgacaaggaguaccccaccaucuuccaccuccgccaggcccugcugcgggaccagaucaaggacgaggagcgcuacagccgguuccuguaccuggcgaucaucaacauguucgagcaccgcggccacuuccuccugaacaccgaguccagcgaccugaacgccgacaugaucaaggacgugggggagcucgugaugaacgccaucugcggcgucuccgaguacgggagcgugaccuacaaggagaucaucgagauccuggaggacaagaacaucucccggacggccaagaaggaccagaucgcgagcaagaucgacaucaagaaguccgagaaggcccagauggagcgcaucaagugccugugcggcauggaggccgacgcccgggugauguucgagaucgaggccgacgagaagaucaagaucgcguuccagcaggccgccuucgaggacgagaaggaggagaucgaggccgucaucggcgaggaccgcuaccucaucaucgagaacaugaagcagcuguacgacuacagccagcugcaguccgugcucaacggguucgacuaccugagcgacgcccgggugcagauguacgagaagcacaaggaggaccugcaccuccugaagaaggucuaccgcaagaaccuggaccgcgagaucuacgaccggauguuccgcuccggcgaggaggggagcuacugcgcguacuccaacagcaccaacagcguggacucccucgccgaggccaagaaguaccggcgcaacaugaagaagcggagccagaaggaccuguacgaccgcaucaagaaggaccugaaggaggugcacgacgccgacgccgacgcgauccggaaggagauggagcucgagcgcuuccugcccaagcagaucaccggcgccaacggcaucauccccaaccagguccaccggaaggagcugaagaagauccucgagaacgccgagcaccaccuggacuuccugaaggagaaggacgaguccggguacaccgugagcgagcgcauccucaugcuguucuccagcaacaucccguacuacgugggccccgucggguccggcagcaagacggggugggccaagauccaggaguccggccaggugcugcccuggaacauggagcagaagaucgacaucgagcagaccagcgagcgguucaucaccaaccucauccgcgagugcaccuaccuguccggcgagaaggugcugcccaagcagagccuccuguacgaguccuacugcguccugaacgagaucaacaaccuccggauccacgggaagcgcaucgugccggagcugaagcaggacaucuacaaggagguguuccagggcuuccggcuggggaagaaggucacgaagaagaacaucugcaccuaccugaucaaccgcggccucaucaccgaggagagcgagguguccgggaucgacaaggagaucaacgccuaccugcccagcuacggcaagauguacggcgucuucggggagcggcugcgcgaggaggcggugcaggagaucgccgagaagaucaucuacuacggcaccaucuacggggacgccaaguccauguuccggaagaagcucaaccaguacgugagcgacggcuggaugacggaguaccaggccaagcgcaucuccggguacaaguucaaggacugggcgcgccugagccggagcaugcugugccucuccggcugcgacaagagcaccggcgagaagaucucccugauccgcgccaugugggaguacaaccugaacuucauggagcucaucuaccgggaggacuucaccuuccagaaggagcuggaggagcgccggaaggcccuggggaagacccuccaggaguuccaguucgaggaccuggacgaguacuacuacagcgcccccgucaagcgcaugaucuggcaggccgugcaggcgcugaaggagaucacgcagaucaugggccacaaccccaagcggaucuucaucgagaugacccgcaccgaggaggagaagggggagcagggccggaagaacucccgcgagaagcggcuccugaagauguacgagagcauccgcgacgagcggaacugggccgccgagaucaagaacgccaacgccuccggcaagcugaacagcaagaagcucuaccuguacuaccugcagauggggcgcgacguguacaccggcgagccgaucgacaucgaggaccucuucgacgacucccgguacgacaucgaccacaucuacccccgcagccugacgaacgacaacaacaucgagaacaaccugguccucguguccaagaccaucaaccagaacgagaagaagaacgacuaccccgugcccgagaagauccggcgcaacaagaagguccggaaccuguggcacacccugcacaagaugggguucaugaacgacgagaaguacaaccgccucaccagcacggagcggcuguccgaggaccagcuggcgggcuucaucgcccgccagcucguggagaccgcccagggggccaagggcaucgccgagcugaugaaggcgaugcugccgggcaccgacaucguguacgccaaggcccgcaacgucagcgacuuccggaaggaguacaagaugcucaagucccgccuggugaacgacuaccaccacgcccaggacgcguaccugaacaucguggucgggaacguguacuucaugaaguucacccggaaccccaugaacuucgugaagacggaggcccgccgggacggccgcaacuacgacuacaaccucuacaagauguacagcaaggacaucauccggaacggggagaaggccuggaucgccaccuccgagcagggccccgggaccauccgccuggucaaggagaccaugggccggaacacccccaucaucacgcgccaggccuucgagcagcggggcgagcuguucaaccuccagccgguggggaaguacagcgcgaagaaggacaacuacgugccccugaagaucaacgacgagaagaugcaggacgucagcaaguacggcggguacaccucccugaaccccagcuacuucaucuucaucgagcacggccccgagaagaagcgcaagaagugcuucgaggugauccacuccuacuacgccgcccagaucaagaccgagaaggaccucaucgacuuccugcugcagaagggguacaagaacccgcgggugaucaacgcccgcaucaagaagaacgcccucaucaaguacaacggcuacuuccuguacaucaucggcauggacgcgcggaagaacaucgaguucagcaacgccaccgccaugugccugaagaacaaguacauccaguacgucugcaagcucgagaagaugaacaaggccauccugcuguccgagaagcagaagacgaaccuccacugggacgagaagaucacgugcgagagcaaccuggagcuguaccgcgagcucaccgagaagcaccuccacuccaucuaccagcggcacccccgcagcaucgggaagugccuggccgacggcgagggggcguucaagcugcuggacaucgaggagcaggucaagaucaucugcgacaucgugcaguacaccuccuuccagcggggcguguucagccugaaggugcucgggggccccaaggaggugggccgcauccgcaucuccgggaacaugaccgaggccaaggagugcaagcuggucaacuacagcaucaccggcauguacaagaccgagauggaccugcucaagaaguga

SEQ ID NO: 2000 - RNA, 4122 nt, Artificial Sequence
  Cas9 variant
auggagaagaccuacagcaucggccuggacaucgggaccaacuccgugggcuggagcgucaucacggacgacuacaaggugcccgccaagaagaugaaggugcucgggaacaccgacaagaaguacaucaagaagaaccugcugggcgcccuccuguucgacuccggggagaccgcggaggucacccgccugaagcggacggcccgccggcgcuacacccggcgcaagaaccggcuccgcuaccugcaggagaucuucgccaaggagauggccaagguggacgagagcuucuuccagcggcuggaggaguccuuccucaccgacgacgacaagaccuucgacagccacccgaucuucggcaacaaggccgaggaggacgcguaccaccaggaguuccccacgaucuaccaccuccgcaagcaccuggccgacuccagcgagaaggccgaccuccggcugguguaccuggcccucgcgcacaugaucaaguuccgcggccacuuccugaucgagggggagcugaacgccgagaacaccgacauccagaagcuguucaacgacuucgucgagaccuacgacaagaucgccgacgagucccaccugagcgagguggacgccuccagcauccugaccaacaagaucuccaagagccggcgccucgagaaccugaucaagcaguaccccacggagaagaagaacacccuguucggcaaccucguggcccugguccuggggcuccagcccaacuucaagaccaacuucaagcuguccgaggacgcgaagcugcaguucagcaaggacaccuacgacgaggaccucgaggagcugcugggcaagaucggggacgacuacgccgaccucuucacggccgccaagaaccuguacgacgccauccugcucuccggcauccugaccguggacgacaacagcaccaaggcgccgcuguccgccagcaugaucaagcgguacgaggagcaccacgaggaccucgagaagcugaagaaguucaucaaggugaacaacuucgacaaguaccacgagaucuucaaggacaagagcaagaacggcuacgccggguacaucgagaacggcgucaagcaggacaucuucuacaagcaccugaaguccaucaucagcgagaagaacgggggccaguacuuccucgacaagaucgagcgcgaggacuuccugcggaagcagcgcaccuucgacaacggcuccaucccccaccagauccaccuccaggagaugcgggccauccuccgccggcagggggaguacuaccccuuccugaaggagaaccaggccaagaucgagaagauccugacguuccgcauccccuacuacgugggcccgcucgcgcgcaaggacagccgguucgccugggccaacuaccacuccgacgagcccaucacccccuggaacuucgacgagguggucgacaaggagaaguccgccgagaaguucaucacccgcaugacccugaacgaccuguaccugcccgaggagaaggugcucccgaagcacagccacguguacgagacguucaccgucuacaacgagcugaccaagaucaaguacgugaacgagcagggggagagcuucuucuucgacgccaacaugaagcaggagaucuucgaccacguguucaaggagaaccggaaggucaccaaggcgaagcugcucuccuaccugaacaacgaguucgaggaguuccgcaucaacgaccugaucggccucgacaaggacagcaaguccuucaacgccagccuggggacguaccacgaccugaagaagauccucgacaaguccuuccuggacgacaagaccaacgagcagaucaucgaggacaucgugcugacccucacccuguucgaggaccgggacaugauccacgagcgccugcagaaguacagcgacuucuucacgucccagcagcucaagaagcuggagcggcgccacuacaccggcuggggccggcugagcuacaagcucaucaacgggauccgcaacaaggagaacaacaagaccauccuggacuuccugaucgacgacggccacgccaaccggaacuucaugcagcucaucaacgacgagucccugagcuucaagaccaucauccaggaggcccagguggucggggacguggacgacaucgaggcggucgugcacgaccugcccggcucccccgccaucaagaaggggauccuccagagcgugaagaucgucgacgagcuggugaaggugaugggcgacaaccccgacaacaucgucaucgagauggcccgcgagaaccagacgaccaaccgggagcgcagccagucccagcagcggcugaagaagcuccagaacagccugaaggagcugggcuccaacauccucaacgaggagaagccgagcuacaucgaggacaagguggagaacucccaccuccagaacgaccagcuguuccucuacuacauccagaacgggaaggacauguacaccggcgacgagcuggacaucgaccaccugagcgacuacgacaucgaccacaucaucccccaggccuucaucaaggacaacuccaucgacaaccgcgugcucaccagcuccgccaagaaccggggcaagagcgacgacguccccucccuggacaucgugcgcgcgcggaaggccgagugggugcgccuguacaagagcgggcucaucuccaagcgcaaguucgacaaccugaccaaggccgagcgcgggggccugacggaggccgacaaggccggcuucaucaagcggcagcucgucgagacccggcagaucaccaagcacguggcgcagauccuggacgcccgcuucaacaccaagcgggacgagaacgacaaggugauccgcgacgucaaggugaucacgcucaagagcaaccuggugucccaguuccggaaggaguucaaguucuacaagguccgcgagaucaacgacuaccaccacgcccacgacgccuaccugaacgccgugguggggaccgcgcugcucaagaaguaccccaagcugaccccggaguucgucuacggcgaguacaagaaguacgacgugcggaagcugaucgccaagagcuccgacgacuacagcgagauggggaaggccaccgccaaguacuucuucuacagcaaccucaugaacuucuucaagacggaggugaaguacgcggacggccgcgucuucgagcggcccgacaucgagaccaacgccgacggcgaggugguguggaacaagcagaaggacuucgacaucguccgcaaggugcuguccuacccccaggugaacaucgucaagaagguggaggagcagaccguggggcagaacggcgggcuguucgacaacaacauccucgccaagcccgagaaggacgacaagaagaagcuguucccgaucaagaagucccugagcaccacgagcuacggcggguacgcccgggccaccaucgcguacuccauccucaucgucagcgaguucggcaagaacaaggagcugaagcugcucggccugccccugcucgacaaggugaaguacgagaagaaccccaucgccuaccugaacuccaucgggaucaucaacgucaagagcaucuucaagcugcccaaguacugccucuucgaguuccaggagaagaacaccaacuaccgccgguacaugguguccaaccaggagcugaagcgcgccaaccagcuguuccugaccugcaaggagacggagcugguguacaaguacaucaagagcgacaacgacaacacccaccuggugggcaacgagaagaccauccucuccaucuggaacaagcuggucaucuucauggagcggaccaagcugaucgacaagaagcuguucgccagccugaagcagcugaaggacgagguggaccucaucaacauccuggacaugacggccaagucccuggacuucaccaagaucagcgcggggcagaagaagaucaccaucuccgacagccucucccugccgaucaagcgcuggcaguucagcuccgacgagaagaugcugaagcagcucaagaccgccacgcugauccaccagagcgugaccggccuguacgagacccggaucgaccucagcaagcugggggaggaguga

SEQ ID NO: 2001 - RNA, 4122 nt, Artificial Sequence
  Cas9 variant
auggagaagaccuacagcaucggccuggacaucgggaccaacuccgugggcuggagcgucaucacggacgacuacaaggugcccgccaagaagaugaaggugcucgggaacaccgacaagaaguacaucaagaagaaccugcugggcgcccuccuguucgacuccggggagaccgcggaggucacccgccugaagcggacggcccgccggcgcuacacccggcgcaagaaccggcuccgcuaccugcaggagaucuucgccaaggagauggccaagguggacgagagcuucuuccagcggcuggaggaguccuuccucaccgacgacgacaagaccuucgacagccacccgaucuucggcaacaaggccgaggaggacgcguaccaccaggaguuccccacgaucuaccaccuccgcaagcaccuggccgacuccagcgagaaggccgaccuccggcugguguaccuggcccucgcgcacaugaucaaguuccgcggccacuuccugaucgagggggagcugaacgccgagaacaccgacauccagaagcuguucaacgacuucgucgagaccuacgacaagaucgccgacgagucccaccugagcgagguggacgccuccagcauccugaccaacaagaucuccaagagccggcgccucgagaaccugaucaagcaguaccccacggagaagaagaacacccuguucggcaaccucguggcccugguccuggggcuccagcccaacuucaagaccaacuucaagcuguccgaggacgcgaagcugcaguucagcaaggacaccuacgacgaggaccucgaggagcugcugggcaagaucggggacgacuacgccgaccucuucacggccgccaagaaccuguacgacgccauccugcucuccggcauccugaccguggacgacaacagcaccaaggcgccgcuguccgccagcaugaucaagcgguacgaggagcaccacgaggaccucgagaagcugaagaaguucaucaaggugaacaacuucgacaaguaccacgagaucuucaaggacaagagcaagaacggcuacgccggguacaucgagaacggcgucaagcaggacaucuucuacaagcaccugaaguccaucaucagcgagaagaacgggggccaguacuuccucgacaagaucgagcgcgaggacuuccugcggaagcagcgcaccuucgacaacggcuccaucccccaccagauccaccuccaggagaugcgggccauccuccgccggcagggggaguacuaccccuuccugaaggagaaccagagcaagaucgagaagauccugacguuccgcauccccuacuacgugggcccgcucgcccgcaagaacucccgguucgcgugggccaaguaccacagcgacgagcccaucacccccuggaacuucgacgagguggucgacaaggagaaguccgccgagaaguucaucacccgcaugacccugaacgaccuguaccugcccgaggagaaggugcucccgaagcacagccacguguacgagacguacgccgucuacaacgagcugaccaagaucaaguacgugaacgagcaggggaaggaguccuucuucgacagcaacaugaagcaggagaucuucgaccacguguucaaggagaaccggaaggucaccaaggagaagcugcucaacuaccugaacaaggaguuccccgaguaccgcaucaaggaccugaucggccucgacaaggagaacaaguccuucaacgccagccuggggaccuaccacgaccugaagaagauccucgacaaguccuuccuggacgacaaggugaacgaggaggugaucgaggacaucaucaagacgcugacccucuucgaggacaaggacaugauccacgagcggcugcagaaguacagcgacaucuucaccgcgaaccagcugaagaagcucgagcgccggcacuacaccggcuggggccgccuguccuacaagcugaucaacgggauccggaacaaggagaacaacaagacgauccucgacuaccugaucgacgacggcagcgccaaccgcaacuucaugcagcugaucaacgacgacacccuccccuucaagcagaucauccagaagucccaggucgugggggacgucgacgacaucgaggccguggugcacgaccugcccggcagcccggccaucaagaaggggauccugcaguccgucaagaucguggacgagcucgugaaggucaugggcggcaaccccgacaacaucgugaucgagauggcgcgggagaaccagaccaccaaccgcgggcggagccagagccagcagcgccugaagaagcugcaguccagccucaaggagcugggcuccaacaucaucaacgaggagaagcccagcuacaucgaggacaagguggagaacucccaccuccagaacgaccagcuguuccuguacuacauccagaacgggaaggacauguacacgggcgacgagcuggacaucgaccaccucagcgacuacgacaucgaccacaucaucccccaggccuucaucaaggacgacuccaucgacaaccggguccugaccagcuccgccaagaaccgcggcaagagcgacgacgugccgucccuggacaucgugcgggcccgcaaggccgaguggguccggcucuacaagagcgggcugaucuccaagcgcaaguucgacaaccugaccaaggcggagcgcggcgggcucaccgaggccgacaaggccggcuucaucaagcggcagcugguggagacccgccagaucacgaagcacguggcccagauccuggacgcccgguucaacaccgagcacgacgagaacgacaaggucauccgcgacgugaaggugaucacccucaagagcaaccuggucucccaguuccggaaggacuucgaguucuacaaggugcgcgagaucaacgacuaccaccacgcgcacgacgccuaccugaacgccguggucgggaccgcccuccugaagaaguaccccaagcuggcccccgaguucguguacggcgaguacaagaaguacgacgugcggaagcucaucgccaagagcuccgacgaccacagcgagaugggcaaggcgacggccaaguacuucuucuacagcaaccugaugaacuucuucaagaccaaggucaaguacgccgacggguccguguacgagcgccccaucaucgagaccaacgcggacggcgagguggucuggaacaagcagaaggacuucgagaucauccggaaggugcugagcuacccccaggugaacaucgucaagaagguggaggagcagaccguggggcagaacggcggccucuucgacaacaacauccuggccaagccggagaaggacgacaagaagaagcuguuccccaucaagaagucccucagcacgaccuccuacgggggcuacgcccgcgccaccaucgccuacagcauccugaucgucuccgaguucgggaagaacaaggagcugaagcuccugggccugccccuccuggacaaggugaaguacgagaagaacccgaucgcguaccugaacagcaucgggaucaucaacgugaaguccaucuucaagcuccccaaguacugccuguucgaguuccaggagaagaacaccaacuaccggcgcuacauggucagcaaccaggagcugaagcgggccaaccagcuguuccugacgugcaaggagaccgagcugguguacaaguacaucaaguccgacaacgacaacacccaccucgugggcaacgagaagaccauccugagcaucuggaacaagcuggucaucuucauggagcgcacgaagcucaucgacaagaagcuguucgccucccugaagcagcucaaggacgaggugaaccugaucaacauccuggacaucgccagcaaguccaucgacuucaccaagaucagcgccgggcagaagaagaucgugcucaacgacucccugagccugcccaucaagcgguggcaguucaaguccgacgagaagaugcucaagcagcugaacgacgcgacccugauccaccagagcaucaccggccucuacgagacgcgcaucgaccugagcaagcugggcgaggaguga

SEQ ID NO: 2002 - RNA, 4122 nt, Artificial Sequence
  Cas9 variant
augaaccugcgccgggcccgcgacuacagcaucggccucgaccuggggaccggcuccguggggugggccgucaccgacgcggagggcaaccuguacagcuucaaggggcggcccgccaugggcucccgcacguucccgaacgccgagcccgccagcguggcccggaucccccgcggccagcggcgccgguacgagcgccggcgccagcggaucaagcuccugcagcaguucuucauguccgacauggagcgcguggaccccgacuucuucacccggcugaaccagagcacccuccuggcggaggacaaggacgagcgcaucgccuccugcgccuggccgaucuucaacagcuccgacuucaccgagaaggacuacuacaagaaguuccccacgaucuaccaccuccgggccuuccugugcgagagcgacgagaagggggaccugcgccuggucuaccucgcgcugcacaacaucgugaagcaccggggcaacuuccuguaccaggacaaccccgcccucuccgccagcgacgccuccguggacgaggccguccgccagcugguggacgcgcuggccgaguggugccagaacaaggagaucgagcucagcugcgacgccgggcggaucaucgagguguucggcgacgccucccugcgccgcaccgacaagcgggaccagcugaaggggcuccugggccugcccgccgaccucgcgaagaccaugggcaaggagcuggccagcgccguccugggguacgccgccaacuucuccaagaucuuccucaucagcgacgcggagcacaaguucucccugggcaacgacgagaagguggaggaguucgagaccaucugcccgaacgagugcacgagccuguucagcgcccuccgcaccgccuacuccgccuaccugcugagcgggauccuccgggacgccaacggcaagacccuguccuucugcaagaagaaggaguacgaccgcuaccacgacgaccuggcgcuccugaaggcccuggugcgggaguacgcccccgagagcuaccaguccuucuucggcggggagcgccucgucgugaacggccggaugaccaagcgcuacgaccccacgaaggccaagggguacaccaaguacgaccuggugcacagcgcgggcuccuacgacgagcuggccaaggacgucaagaagcuccuggggagccuggccgccgacgacucccgguaccagcgcaugaugcaggccuucgacgaggagcgguuccuccgccggcugaagaccagcgacaacggcuccauccccuaccagcugcaccucgaggagcugcgcgcgaucaucgcccggcagggcgaguucuacccguuccugaaggaggagagcaagaagaucgagucccuggugagcuuccgcauccccuacuacguggggccccucaccacgaagaacgccgccgucgacgugcacggcaacaagcgguucgccugguccgagcgcaagcccgggauggagagcgcgaaggugcggccguggaacugggacgacgucaucgaccgcggcaaguccgccgagaacuucaucgugcgcaugaccgggaccugcaccuaccugcagaacgagaaggugcugcccaagugcagccuccuguacgaggaguucugcguccugaacgagcucaacggcgcccacugguccgccgacggcgaccacgagugccccuucgacacgagcgaccggcgcgggaucgugcaggaccuguucugcggcaagcggcgcgucagcuacaagcaggucgaggacuggcugcggcagcacgggucccgccgggcccgcgugagcggcgggcagggcgcguccggcuucgagagcaagauguccagcuacaucuucuucuccaaggacgugcuccacguggaccggaucgaccccgccgacuucccgaugaucgaggagaucauccuguggaacacccuguucgaggaccgcgacauccucaaggagcggaucgaggaggccuacggggaccgccugaacgccgagcagaucaagaccaucugcaagaagcgguucaccggcugggggcgccugagccggcgccuccugacgggcaucaaggcgcagaccgaccagggcgaccuguccaucauggacauccuccgggagggggaccccaacaacgaccaccgcggcaaggccaugguguucauggggauccugcacagcgaggaccugggcuuccagaagaagaucgaccagaucaaccaggagaaggucuccgccgggaaggugagccucgaggaccugcccggcucccccgcccugcggcgcagcaucaaccaggccaugcggguggucgacgagaucguguccaucgcgaagugcccgcccagccacaucuaccucgaggugacccgcgacgaggacggcgcccgcaaggggcggcgcuccacccggcgcuacgacgccaucaaggccgcccuggagaaguucaaggaggagagccccacgugguucgaccaggacgucuucggcgaguuccggcgcagccgggcggaggaccuggacgagcgccucucccuguacuucaugcagggcggcaagagccuguacuccgccacgccccucaagcuggagcugcuccacaccaaccaguaccagguggaccacaucaucccgcagagcuacaucaaggacgacuccuucgagaacaaggcccuggugcuggccggggagaaccagcgcaagagcgacgcccuccugaucgacuccagcauccggaccgcgauggcccccuacuggcgggcccugcaccaggccgggcucaugggcgacaagaaguucaacucccugaugugcagcuccaucagcgacaagcgcguccggggguucaucgcgcgccagcugguggagaccucccagaucgugaagcucgccggcaugaugcugcagagcaacuaccccgaggccgacguccagccggugaaggccucccuggggcacgaccuccgggugcaggccggcuucaucaagugccgcgaggucaacgacuuccaccacgcgcacgacgcccugaucgccugcgagguggggcgguacaucaaccagugccaccccggcaucuacgacaaccccaucggcuacgcccgcgccgugcgggagcugguccgcaagcagaacgaggagaugcgcaaguacgggcggcuccccggcagcgcgggguucaucgugggcggguucaugcgcacccacguggacgucgacaccggcgagguggugugggacgccgaggaggagcugucccggauccgcgccuaccuggacuacagcaacgucuucgugacccggauguccgaggagacgagcggcgcccucuggaacgccaccaucuacagcccgcacuacgggaagaccgcgcccacccugcacaucaagcagggccuggacgugcagcgcuacgggggcuacuccagcgccaccuucgccuacuucacgcucuacgucgccgagaagggcaagaagcggaaggccgagcugcuggggauccccaucuccguggcgcgcaagaucgagggcgagcccagcaagcucgacgccuucguggcccaggacgccgaggcgaagaagcugaagcacccgcugaucauccgggcccgcauccucaaguacgcccgguucgagauggaggggaaccaguucuacuucgccgcccaggacgcggucuacuccgcccgccagcuggugcugaagggcgaccucuacagcguggccgccaaggccugcgacaagcaccugaacgacuccugcaucagcaacgaggaccugauccggcucuacgacgagcugguccacaagggggaccugcucugcaacaaguucggcaacgugaccgacgugcugcgcgcgggccgggagcgcuacgccgggcuguccaucagcgagaagcggcagcucgucugcaacgugcuggccuacuaccgcuccgccaccgcccggguggacaucagccuggucggcgggcccaagcacgcgggcaaccucgggaucgccuucgugcugaacaaccccgaggccaucguguucgucgaccaguccgugaccggcauguucgagaagcgcacgcggguggagcuguga

SEQ ID NO: 2003 - RNA, 4122 nt, Artificial Sequence
  Cas9 variant
augaagaagauccugggccucgaccuggggaccaacagcaucggcugggcccuggugaacgaggccgacaacgagcgcgagaaguccagcaucaucaagaucgggguccgggugaacccccucaccguggacgagcagcagaacuucgagaagggcaaguccaucacgaccaacgcggaccgcacccugaagcggagcaugcgccggaaccugcagcgcuucaagcuccggaaggagaaccugaucgagauccugaagaagcagaaguucaucaacgacgagaccauccucuccgagaacgggaacaagagcacguucgagaccuacaaccugcgcgccaaguccgccaccgaggagaucacccuggagcaguucgcccggguccuccugaugaucaacaagaagcgcggcuacaagagcucccggaaggccaagagccaggacgagggccagcugaucgacgggauggagaucgcgaagaagcucuacaacgacaaccugacgccgggccaguucguguuccagauccugaaggaggggaagaaguacauccccgacuucuaccgcuccgaccuccaggccgaguucgacaagaucuggagcuuccagaagcaguucaaccccgacauccugaccgaggaguucaacaagcagaucaucggcaaggggaaggugaacaccaccaagaucuuccuggccaaguacggcaucuacacgaucgacaacaagggcgccgacaagaagucccaggcguacaacuggcgggucgaggcccucaccaaccagcugaccaaggaggagcuggccuucgugaucagcgaccucaacgggaucaucuccaacagcuccggcuaccuggggagcaucuccgaccgcagcaaggagcuguacuucaacaagcagaccgugggccaguaccucaucgcccagcugaaggagaacccccacacgcagcugaagaaccaggucuucuaccggcaggacuaccucgacgaguucaacaccaucugggagacccaggccaaguuccacaaggagcugaccaacgagcugaaggaggagauccgcgacaucaucaucuucuaccagcggaagcucaagagccagaagggccugaucuccuucugcgaguucgagagcaagcagaucgagaucaacaucgacgggaagaagaagcugaagacggugggcuccaaggugugccccaagagcagcccccucuuccaggucuucaagaucuggcagauccugaacaacauccaggugaucgagaaguccaccgggaaguccaaguuccuggagcaggacgagaaggagauccucuucaaggagcugaacuucaaggacaagaucagcaagaccgacgcgcugaagauccucuacaagaacuacaaggagcuggacuucaacuucaaggagaacaucgagggcaaccgcacccaggccacguuccugaaggccuuccaguccaucaucgagcucagcgggcacgagguguccgacuucagcaagaucaagaccgacgagauccuggagaucgucacccccaucuucgagggcuucggcuucaacaccaaccugcuccaguucaacuccaaccugaaggggaaggacuucgagaagcaggccguguaccagcuguggcaccuccucuacagcuucgagggcgacaacuccaacacggggaacgagaagcugauccagaagaucagcgagcuguacggcuucgagcgggaguacgccaucaucaucgcgaacaucuccuuccagcccgacuacgggagccucuccaccaaggccauccgcaagauccugccgcaccugaaggagggcaucgaguucagccucgccugcgaguacgccggcuaccggcacagcaagaacucccugaccaaggaggagaagaacaagaagauccugaaggacaagaucgacauccuccccaagaacagccugcgcaaccccguggucgagaagauccugaaccagaugaucaacguggugaacgccaccaucgagacguacgggaagcccgacgagauccgcaucgagcucgcgcgggagcugaagaaguccgccaaggagcgcgaggaccugaccaacgccaucaacaagagcacccucgaccacgagaaguacaaggcccugcugcagaaggaguucggccucuccaacgucagccggaacgacaucauccgcuacaagcuguaccuggagcucgagcacaacggguuccacacccuguacuccaacacguacaucgagccgaacaagcuguucagcaaggaguucgacaucgagcacaucaucccccagucccggcuguucgacgacagcuucuccaacaagaccaucgagagccgcuccgccaacaucgagaagggcaacgagaccgcguucgacuacgugagcaacaagaacggggaggugggccugaaggacuaccugaagaacaucgaggaccucuucaacaacggcaagaucuccaagaccaaguacaacaagcugaagaugaagggggacgagauccccagcgacuucaucgcccgggaccugcgcgacacccaguacaucuccaagaaggccaagagcauccucgaggaccuggucaaggacguggucagcacgggcggguccaucaccgaccggcugcgcgaggacuggcagcucaucgacaucaugaaggagcugaacugggacaaguacgacaagcugggccucaccgaggugaucgagaacaacgacggccacaagaucaaccggaucaaggacuggaccaagcgcaacgaccaccggcaccacgccauggacgcgcugacgaucgccuucaccaagcgcagcuacauccaguaccugaacaaccucaacgcccgguccgacaagagcggguccaucuacggcaucgagcagaaggagcuguaccgcgacaagaacaacaagcugcgguucaagcccccgaucccccucgacgacuuccgcgccgaggccaagaagcagcuggagaacacccuggugagcaucaaggcgaagaacaaggucgccaccaucaacaucaacaacacgaagaagcagggcggggagaacaagaagaagcagcucaccccgcgggggcagcugcaccuggagaccaucuacggcuccauccagcaguacgugaccaaggaggagaaggugggcgccaacuucaacaaggagcucaucgagaaggucgccaacaagaagugccgcgaggcccugcugaagcgccucaucgaguucgacaacgaccccaagaaggcguucacgcggaagaacagccugaacaagaacccgcuguacaucgacaccaucaagaccuacaaggugcccgagaaggugaagaccgucacgaccgagaccaucuacaccauccgcaaggacaucaaccccgaccucaagaucgacaaggugguggacaagaagaucaagaacauccuggagcugcggcucaaggaguucaacggggacgccaagaaggccuucuccaaccuggacgagaagcccaucuggcugaacaaggagaagggcaucagcaucaagcgcgucacgaucaccgggaucuccaacgccaucgcccuccacgacaagaaggacaaggagggcaacuucauccuggacaaccaggggaagaagcaggcgguggacuucgugaacaccggcaacaaccaccacgucgccaucuacaaggacgagaagggcaaccugcaggagaacgugaucaccuucuacgaggccguggagcgggucaaccaggggaucccgaucaucgacaagacguacaagcagaacgagggcuggcaguuccucuucagcaugaagcagaacgaguacuucguguuccccaacgagaagaccggguucaacuccaacgagaucgaccugcugaaccccgagaacuaccaccucaucagccccaaccuguuccgcgugcagaagaucgccaccaaggacuacuucuuccggcaccaccuggagaccaacgucgagaacaucacgaccaccaaggaccucaccuggaagcgccugggcaucaacgggaucaucaacauccugaaggugcggaucaaccacaucggccagaucguguccgucggcgaguacuga

SEQ ID NO: 2004 - RNA, 4122 nt, Artificial Sequence
  Cas9 variant
augaccaagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccgaggagaugaccaaggucgacgaguccuucuuccagcggcuggacgagagcuuccuccgcugggacgacgacaacaagaagcugggccgguacccgaucuucggcaacaaggcggacguggugaaguaccaccaggaguuccccaccaucuaccaccuccgcaagcaccucgccgacuccagcgagaaggccgaccugcggcuggucuaccucgcccuggcgcacaugaucaaguuccgcgggcacuuccugaucgagggcgagcucaacgccgagaacacggacgugcagaagaucuucgccgacuucgugggggucuacgaccggaccuucgacgacucccaccugagcgagaucaccguggacgccgccuccauccugaccgagaagaucagcaagucccgccggcucgagaaccugaucaaguacuaccccacggagaagaagaacacccuguucggcaaccucaucgcgcuggcccuggggcuccagcccaacuucaagaugaacuucaagcugagcgaggacgccaagcugcaguucuccaaggacagcuacgaggaggaccucggcgagcugcugggcaagaucggggacgacuacgccgaccucuucaccuccgccaagaaccuguacgacgcgauccugcucagcggcauccugaucguggacgacaacuccaccaaggccccgcugagcgccuccaugaucaagcgcuacgucgagcaccaggaggaccucgagaagcugaaggaguucaucaaggccaacaagagcgagcuguaccacgacaucuucaaggacaagaacaagaacggguacgccggcuacaucgagaacggcgugaagcaggacgaguucuacaaguaccucaagaacacgcugagcaagaucgcgggguccgacuacuuccuggacaagaucgagcgggaggacuuccuccgcaagcagcggaccuucgacaacggcagcaucccccaccagauccaccuccaggagaugcacgccauccugcgccgccagggggacuacuaccccuuccugaaggagaaccaggaccggaucgagaagauccugaccuuccgcauccccuacuacgugggcccgcuggcccggaaggacucccgcuucagcugggccgaguaccacuccgacgagaagaucacccccuggaacuucgacaaggucaucgacaaggagaaguccgccgagaaguucaucacgcggaugacccugaacgaccucuaccugcccgaggagaaggugcugcccaagcacagccacguguacgagaccuacgcggucuacaacgagcucaccaagaucaaguacgugaacgagcaggggaaggacagcuucuucgacuccaacaugaagcaggagaucuucgaccacguguucaaggagaaccgcaaggucacgaaggagaagcugcugaacuaccucaacaaggaguucccggaguaccggaucaaggaccugaucggccuggacaaggagaacaagagcuucaacgccucccucggcaccuaccacgaccugaagaagauccuggacaaggccuuccucgacgacaaggugaacgaggaggugaucgaggacaucaucaagacccugacccuguucgaggacaaggacaugauccacgagcgccuccagaaguacagcgacaucuucacggccgaccagcugaagaagcuggagcggcgccacuacaccggguggggccggcucuccuacaagcugaucaacgggauccgcaacaaggagaacaacaagaccauccuggacuaccucaucgacgacggcagcgcgaaccggaacuucaugcagcugaucaacgacgacacccugcccuucaagcagaucauccagaagucccaggucgugggggacgucgacgacaucgaggccguggugcacgaccuccccggcagccccgccaucaagaagggcauccugcaguccgucaagaucguggacgagcuggugaaggucaugggggacaacccggacaacaucgugaucgagauggcccgcgagaaccagacgaccaaccggggccgcagccagucccagcagcggcucaagaagcugcagaacagccugaaggagcucgggagcaacauccugaacgaggagaagcccuccuacaucgaggacaagguggagaacagccaccuccagaacgaccagcuguuccuguacuacauccagaacggcaaggacauguacaccggggacgagcuggacaucgaccaccuguccgacuacgacaucgaccacaucaucccccaggccuucaucaaggacgacagcaucgacaaccgcguccugaccuccagcgcgaagaaccggggcaaguccgacgacgugcccagccuggacaucgugcgcgcccgcaaggccgaguggguccggcucuacaaguccggccugaucagcaagcgcaaguucgacaaccugacgaaggccgagcgcgggggccucaccgaggccgacaaggcgggguucaucaagcggcagcugguggagacccggcagaucaccaagcacguggcccagauccuggacgcccgcuucaacaccgaguccgacgagaacgacaaggucauccgggacgugaaggugaucacgcucaagagcaaccuggucucccaguuccgcaaggacuucgaguucuacaaggugcgggagaucaacgacuaccaccacgcccacgacgccuaccugaacgcgguggucggcaccgcccuccugaagaaguacccgaagcuggccagcgaguucguguacggcgaguacaagaaguacgacauccgcaaguucaucaccaacuccagcgacaaggccaccgcgaaguacuucuucuacuccaaccucaugaacuucuucaagcgggugauccgcuacagcaacgggaaggucaucgugcggcccguggucgaguacagcaaggacacggaggacaucgccugggacaagaaguccaacuuccgcaccaucugcaaggugcugagcuacccccaggugaacaucgucaagaagguggagacccagaccggcggguucuccaaggagagcauccugcccaagggcgacuccgacaagcucaucccgcggaagacgaagaaggccuacugggacaccaagaaguacgggggcuucgacagccccaccguggccuacuccgucuucgugguggccgacgucgagaagggcaaggcgaagaagcugaagaccgugaaggagcugguggggaucagcaucauggagcgcuccuucuucgaggagaaccccgucgaguuccucgagaacaagggcuaccacaacauccgggaggacaagcugaucaagcugcccaaguacagccucuucgaguucgagggcgggaagcgccggcugcuggccuccgccagcgagcuccagaaggggaacgagauggugaucccgggccaccuggugaagcugcucuaccacgcccagcgcaucaacuccuucaacagcacgaaguaccuggacuacgucuccgcccacaagaaggaguucgagaaggugcugagcugcguggaggacuucgcgaaccucuacgucgacguggagaagaaccuguccaagauccgggccguggccgacagcauggacaacuucuccaucgaggagaucagcaacagcuucaucaaccugcucacccugaccgcccugggcgcccccgcggacuucaacuuccucggggagaagaucccccgcaagcgcuacaccuccacgaaggagugccugaacgccacccugauccaccagagcaucaccggccucuacgagacccggaucgaccuguccaagaucggggaggaguga

SEQ ID NO: 2005 - RNA, 4122 nt, Artificial Sequence
  Cas9 variant
auggagaacaagaacuacagcaucggccuggacaucgggaccaacuccgugggcugggccgucaucaccgacgacuacaaggugcccagcaagaagaugaaggugcucgggaacacggacaagcgcuucaucaagaagaaccugaucggcgcccugcuguucgacgaggggaccaccgcggaggcccggcgccugaagcggaccgcccgccggcgcuacacgcggcgcaagaaccggcugcgcuaccuccaggagaucuucgccgaggagauguccaaggucgacagcuccuucuuccaccggcuggacgacagcuuccugaucccggaggacaagaagggcuccaaguaccccaucuucgccacccucaucgaggagaaggaguaccacaagcaguuccccaccaucuaccaccuccgcaagcagcuggcggacagcaaggagaagaccgaccuccggcugaucuaccuggcccucgcccacaugaucaaguaccgcggccacuuccuguacgaggacacguucgacaucaagaacaacgacauccagaagaucuucaacgaguucaucuccaucuacaacaacaccuucgaggggaacagccuguccggccagaacguccagguggaggccaucuucaccgacaagaucagcaaguccgcgaagcgggagcgcgugcucaagcuguuccccgacgagaaguccaccgggcuguucagcgaguuccucaagcugaucgugggcaaccaggccgacuucaagaagcacuucgaccuggaggagaaggccccgcuccaguucagccgggacacguacgacgaggaccuggagaaccugcucgggcagaucggcgacgacuucgccgaccuguucguggccgcgaagaagcuguacgacgccauccuccuguccggcauccugaccgucaccgaccccagcaccaaggcgccccucuccgccagcaugaucgagcgcuacgagaaccaccagaaggaccuggccacgcugaagcaguucaucaagaccaaccuccccgagaaguacgacgagguguucagcgaccaguccaaggacggguacgcgggcuacaucgacgggaagaccacccaggagagcuucuacaaguacaucaagaaccugcuguccaaguucgagggcgccgacuacuuccucgagaagaucgagcgggaggacuuccugcgcaagcagcggacguucgacaacggcagcaucccgcaccagauccaccuccaggagaugaacgccauccugcgccgccagggggagcacuaccccuuccugaaggagaacaaggagaagaucgagaagauccugaccuuccggauccccuacuacgugggcccccucgcccgcgggaaccgggacuucgccuggcugacccgcaacuccgaccaggcgauccggccguggaacuucgaggagaucgucgacaaggccagcuccgccgagagcuucaucaacaagaugaccaacuacgaccuguaccuccccgaggagaaggugcugcccaagcacucccugcuguacgagacguucgccguguacaacgagcucaccaaggucaaguucaucgccgagggccugcgcgacuaccaguuccuggacagccggcagaagaaggacaucuucuacacccucuucaaggcggaggacaagcgcaaggugaccgagaaggacaucauccaguaccugcacacgguggacggguacgacggcaucgagcugaagggcaucgagaagcaguucaacgccucccucagcaccuaccacgaccugcugaagaucaucaaggacaaggaguucauggacgaccccaacaacgaggagauccucgagaacaucguccacacccugaccaucuucgaggaccgggagaugaucaagcagcgccuggcccaguacgacucccucuucgacgagaaggugaucaaggcccugacgcggcgccacuacaccggguggggcaagcugagcuccaagcucaucaacgggauccgggacaagcagaccggcaagaccauccuggacuaccugauggacgacggguacaacaaccgcaacuucaugcagcucaucaacgacgacgagcugagcuucaaggagaucaucaagaaggcccagguggucggcaagacggacgacgugaagcaggucgugcaggagcugccgggcucccccgccaucaagaaggggauccuccagagcaucaagcugguggacgagcuggucaaggugaugggccacgagcccgaguccaucgugaucgagauggcccgggagaaccagaccaccgcccgcgggaagaagaacagccagcagcgguacaagcgcaucgaggacagccucaagauccuggccuccggccugaacgcgaagauccucaaggagcaccccaccgacaacauccagcugcagaacgaccggcuguuccucuacuaccugcagaacgggcgcgacauguacaccggcaagccgcuggacaucaaccagcucagcuccuacgacaucgaccacaucgucccccaggccuucaucaaggacgacagccuggacaaccgcgugcugacgucccucaaggacaaccggggcaagagcgacaacgugcccucccuggaggucguggagaagaugaagaccuucuggcagcagcugcucgacagcaagcugaucuccuaccgcaaguucaacaaccugaccaaggccgagcgcgggggccucgacgagcgggacaaggugggguucaucaagcggcagcuggucgagacccgccagaucacgaagcacguggcccagauccuggacgcccgguacaacaccgaggugaacgagaaggacaagaagaaccgcaccgucaagaucaucacccucaagagcaaccugguguccaacuuccggaaggaguuccgccuguacaagauccgggagaucaacgacuaccaccacgcgcacgacgccuaccucaacgccguggucgccaaggccauccugaagaaguaccccaagcuggagccggaguucguguacggcgacuaccagaaguacgaccucaagcgcuacaucagccgguccaaggaccccaaggagaucgagaaggcgacggagaaguacuucuucuacagcaaccugcugaacuucuucaaggaggaggugcacuacgccgacggcaccaucgucaagcgcgagaacaucgaguacuccaaggacaccggggagaucgccuggaacaaggagaaggacuucgccaccaucaagaaggugcucagccugccccaggugaacaucgucaagaagcgggaggugcagacgggcggguucuccaaggagagcauccugcccaagggcaacagcgacaagcucaucccgcgcaagaccaaggacauccugugggacaccaccaaguacgggggcuucgacucccccgugaucgcguacagcauccugcucaucgccgacaucgagaagggcaaggccaagcggcugaagacggucaagacccugguggggaucaccaucauggagaaggccaccuucgagaagucccccaucgccuuccucgagaacaagggcuaccacaacgugcgcaaggagaacauccugugccugccgaaguacagccucuucgagcugaagaacgggcggcgccggaugcuggcguccgccaaggagcuccagaagggcaacgagaucguccugcccgugcaccugacgacccuccuguaccacgccaagaacauccaccgccuggacgagcccgagcaccucgaguacauccagaagcaccgcaacgaguucaaggggcugcugaaccucgugagcgaguucucccagaaguacguccuggccgacgccaaccuggagaagaucaagaaccucuacgcggacaacgagcaggccgacaucgagauccuggccaacagcuucaucaaccugcucaccuucaccgcccugggcgcccccgcggccuucaaguucuucggcaaggacguggaccggaagcgcuacacgaccguguccgagauccugaacgccacccucauccaccagagcaucaccgggcuguacgagacgcggaucgaccuguccaagcucggcgaggacuga

SEQ ID NO: 2006 - RNA, 4125 nt, Artificial Sequence
  Cas9 variant
auggagaccaaguucaccuacuaccugggccucgacauggggacggacagccugggcugggccgugaccgacuccagcuaccacauccugcgcgccaaggggaaggaccucuggggcguccggcuguuccccuccgcggagaccagcguggagcgccggaccuaccgcgugaaccggcgccggcgccagcgggaggucgcccgcaucggggcccugaaggagcuguucgccgacgagaucgagaagguggacccgggcuucuucgugcggcuggacgaguccaaguuccacauggaggaccgcagcgagaacaacaagcagaaguacggccuguucgccgacaagcuguucuccgacgcgggguacuacaagaaguaccccacgaucuuccaccuccggaaggagcuccucgagagcgaggagccccacgacguccgccugguguaccuggcccuccugaacauguucaagcaccggggccacuuccugaacuccagccuccagaucgagggggagaacuccaacaucgccgagagcuaccagauguucguggacacccugaccgacgaggaccuggacuuccccgagcaggucuccggcgagcgccuccaggagaucuuccggagcuccgacagccgcaagaagaagguggagaaccugcuggccgagaugaaccucuccaagaagcagaagcgggagauccaguucgugaaccugaucugcgggcugaagggcaagcucagcgagcuguucccggacaaggaguacgacgaggagcagaagaagaucgcguucuccuuccaggacagcgacuacgaggacaaggagaacaccauccaggagcugcucgacgagagcgagaugaacaugaucuacgccgucaaggccgugcacgacuccggcgugcugagcgggaucaugaacggcgagcgcuaccuguccgucgcccggguggccagcuacgagaagcacaagaaggaccuccagauccugaaggacauccugaagaaguacgacacgaaggaguacuucgagauguuccgcaacgaguccgccaagagcgaguccuacagcgcguacgugggguccgucaaguaccacggcaccuuccgccggggccucagcgggggcaagcaggaggaccuguacaagcacaucaagaaggugcuggggaaguucccccaggacgacgagggcgugaccuacauccucgaggagaucgagaccgaguccuuccugcccaagcagcugacggccagcaacggggucauccccaaccaggugcacgcccgcgagaugcucgccauccugaagcacgcggagcuguaccucccguuccugcaggagaaggacgacaccggccuguccgugagcgagaagauccucaagcuguucauguuccagauccccuacuacgucggcccccuggggcaggaguacaaggacaagaagggcuacaacgugugggccgagcggaaggccuccgggaagaucuaccccuggaacuucgaggacaagaucgacgucaagaaguccgccgagaaguucaucggccgcauggugcggcgcugcaccuaccugagcggggagcaggcccucccgaagcagagccugcuguacgagaaguuccaggugcucaacgagcugaacaaccugcggauccgcggcgagaagauccccgucucccucaagcaggagaucuaccacgaccuguucggcgacgggaagaaggugagcaugacccggcugacgaacuaccuccugcagaacggcgugaucagcggggaggagaaggacuccugcaucagcggcaucgacgggggcuuccacaacucccugagcuccgucggcaaguucaaggggguguucggcgacaccgugcacaccgacgagcaccgcaagaugaucgaggacaucaucuucugggggaccgucuucggcgacggcaagaagcuccugaaggagaagguggaggagguguacgggaaccagcugacggaggcgcagaagaagcggaucuucggcuucaaguucagcuccugggggcgccucagcaaggccuuccugaccauggagggcgccuccaaggacgacggggagaucaagggccugauccaggccaugugggacaccaacugcaaccucauggagcugcugagcgaccgguucaccuacaaggacaagcucaacgagauggucacgaccgccgagaagccccugugcgaguggaagaucgaggaccuggacgagauguaccucuccgcgcccgugaagcgcaugguguggcagaccauccgggucguggacgaggugcagcagaucaucggcugcccgcccaagcgcaucuucgucgagaugacccggagcgacggggagaagggcaagcgcacggugucccggcagaagaagcugguggaccuguacaaggcccucgggaaggagggcaagaccuggagcgaggagcuguccgacacccccgagagccaguuccgcaucaagaagcuguaccucuacuaccugcagauggggaagugcauguacaccggcgaggccaucgagcuggagcagcucaugaacgacaaccuguacgacaucgaccacaucuacccccgccacuucaucaaggacgacaacaucuccaacaaccugguccucgugaagaaggagaagaacgcccacaagagcgacagcuucccgaucgagcccgagauccggaacaagaugaugcccuucuggaagucccugcgcaagaagggcuuccugacggaggagaaguacaaccggcucacccgcaugagcgcguucaccgacgaggagaaggccgccuucaucgggcggcagcugguggagaccucccagggcacgaaggccaucacccagaucuucgagcaggccuucgcgaacagcgagaucgucuucuccaaggccagcgugguguccgccuuccgccagaaguucgacugcuacaagguccggugcgugaacaacuaccaccacgcccacgacgccuaccugaacaucguggcggggaacaccuaccgcgucaaguucaccagcaacccccucaacuucaucaaggaggccaagaagaacccgaacucccgggagaaccgcuacaacauggacaagaucuucgagugggacgugacccggaacggcgagacggccuggguggcccagaccaaggagcaccccgggaccauccagcuggucaagaaguaccugaacaagaacagcccccucaucaccaagaugguguacgagaagcacggcggcaucacgcagaaggccaccaucugguccgcgaagaaggccgagagcgggaacaccgacgccuacauccccgugaagaugaacgacccgcgccuggccgacgucaccaaguacggcggggugacgaccaucgcgguggccggcuacacccugcucgaguacaaggccgggggcaagaccguccggucccuggaggcccugcccaucuaccucggcgggagcaagaagcugacggaggagcagaugguggaguacuucuccaacgugcugcagcaggagaacaaggagaaggucgugagcgacgugaucauccgcaagaagaugauccccuccggcagccucaucaaguacaacggguucuacuacuaccuggccggcaagaccggcgaccggaucauccugaucuccgcgguccagcucugccugccgauggacaccaugcuguacaucaagaagaucgagaaggccugcagcaccgggaacuucgaggagaaggacaagaacggcaagcagguccucagcaagcagcagaacgaguucguguacgagcugaucauccagaaguaccagcaguccaucuucaagaagaaggugggggccaucggcgacacgaucaucgagaagcgcgagaaguucgccgagaucagccuggaggagcagugcaaggugcucaugcagaucuuccugaacuuccaguccgggaucggcguggagcugaagaucaucgagggcgggaagaaguccggcgucaccuaccucaacaagaaggugaugaacguccaggagcugaagcugaucgaccagagcgugaccgggguguucagccgggagaucgaccuccugaccaucuga

SEQ ID NO: 2007 - RNA, 4125 nt, Artificial Sequence
  Cas9 variant
augaagaagcgcuacagcuacuccaucggccuggacaucgggaccaacagcgugggcugggccgucaucaacgaggacuacaaggugcccgccaagaagaugaccguguucgggaacacggaccggaagaccaucaagaagaaccuccugggcaccguccuguucgacuccggggagaccgcgcaggcccgccggcucaagcgcacgaaccggcgccgguacacccgccggcgcuaccggcugugccagcugcagaacaucuucgccaccgagauggugaagguggacgacaccuucuuccagcgccucagcgaguccuucuucuacuaccaggacaaggccuucgacaagcacccgaucuucggcaacagcaaggaggagcgggccuaccacaagacguaccccaccaucuaccaccuccgcaaggaccuggcggaccgggaccagaaggccgaccuccgccugaucuaccuggcccucucccacaucaucaaguuccggggccacuuccugaucgaggggaagcugaacagcgagaacaccgacguccagaagcuguucaucgcccuggugaccguguacaaccuccucuucgaggaggagcccaucgcgggcgagacgugcgacgccaaggcccugcugaccgccaagaccuccaagagcaagcgccucgagucccugaucagcgaguuccccgggcagaagaagaacggccuguucgggaaccuccuggcccuggcgcucggccugcggccgaacuucaaguccaacuucggccugagcgaggacgccaagcuccagaucaccaaggacacguacgaggaggagcuggacaaccugcucgccgagaucggggaccacuacgccgaccuguuccuggccgcgaagaaccucuccgacgccauccugcugagcgacauccucacccuguccgacgagaacacccgcgcgccccugagcgccuccaugaucaagcgguacgaggagcaccaggaggaccucgcccugcugaagaagcucgucaaggagcagaugcccgagaaguacugggagaucuucagcaacgccaagaagaacggcuacgccggguacaucgagggcaaggugagccaggaggacuucuaccgcuacaucaagcccauccugucccgccugaagggcggggacgaguuccucgccaagaucgaccgggacgacuuccugcgcaagcagcggaccuucgacaacggcagcaucccgcaccagauccaccugaaggagcugcacgccauccuccgccggcaggagaaguacuaccccuuccuggccgagcagaaggagaagaucgagcagcugcucugcuuccgcauccccuacuacguggggccccuggcgaagggcgggaacuccagcuucgccuggcugaagcggcgcuccgacgagccgaucacgcccuggaacuucaaggacgucguggacgaggaggccagcgcccaggcguucaucgagggcaugaccaacuacgacaccuaccuccccgaggagaaggugcugcccaagcacuccccgcuguacgagauguucaccgucuacaacgagcucacgaaggugaaguacaucgccgagaacaugaccaagccccuguaccugagcgccgagcagaaggaggccaucaucgaccaccucuucaagcagacccggaaggugaccgucaaggaccugaaggagaaguacuucucccagaucgagggccuggagaacguggacgugacgggggucgagggcgccuucaacgcgagccucgggaccuacaacgaccugcugaagaucaucaaggacaaggccuuccucgacgacgaggccaacgccgagauccuggaggagaucgugcugauccucacccuguuccaggacgagaagcugaucgagaagcgccucgccaaguacgcgaaccuguucgagaaguccgugcugaagaagcuccggaagcgccacuaccggggcugggggcgccugagccggcagcugaucgacggcaugaaggacaaggccuccggcaagaccauccucgacuuccugaaggccgacgacuucgccaaccgcaacuucauccagcugaucaacgacagcucccucgacuucgagaagcugaucgacgacgcccagaagaaggcgaucaagcgggagagccugacggaggccgucgccaaccucgccgggucccccgcgaucaagaagggcauccugcagagccugaagguggucgacgagaucgugaaggugauggggcacaaccccgacaacaucgucaucgagaugucccgcgagaaccagaccaccgcccagggccucaagaacgcccggcagcgccugaagaagaucaaggaggugcacaagaagaccgggagccgcauccuggaggacaacagcgagcggaucacgaaccucacccugcaggacaaccgccuguaccucuaccugcugcaggacggcaaggacauguacaccggccaggaccucgacaucaacaaccugucccaguacgacaucgaccacaucaucccgcagagcuucaucaaggacaacuccaucgacaaccuggugcucaccacccagaaggccaaccggggcaagagcgacaacguccccuccaucgagguggugcgcgacaugaaggaccgggucuggcgccggcagcuggccaacggggcgaucagccgccagaaguucgaccaccugacgaaggccgagcgcgggggccucgccgacuccgacaaggcccgguuccugcggcgccagcugguggagacccggcagaucaccaagcacguggcccagcuccuggacagccgcuucaacuccaagagcaaccagaacaagaagcuggcgcggaacgucaagaucaucacccucaaguccaagaucgugagcgacuuccgcaaggacuucggccuguacaagcugcgggaggugaacaacuaccaccacgcccacgacgccuaccucaacgccgucguggggacggcccugcugaagaaguaccccaagcucgaggcggaguucguguacggcgacuacaagcacuucgaccuggucaagcugaucuccaagagcgaccccucccucgggaaggccaccgccaagguguucuucuacagcaacaucaugaacuucuucaaggaggagcugucccuggccgacggcacccucaugaagcgcccggugaucgagaccaacacggagaccggggaggucgugugggacaaggugaaggacuucaagaccauccggaagguccugagcuacccccaggugaacaucgugaagaagaccgagauccagagcggcgcguucuccaaggagagcguccuguccaagggcaacagcgacaagcucaucgagcgcaagaaggggugggaccccaagaaguacggcggguucgacucccccaacacggccuacagcaucuucgugguggccaaggucgccaagcggaaggcccagaagcugaagaccgugaaggagaucgugggcaucaccaucauggagcaggcggaguacgagaaggacaacaucgccuuccuggagaagaagggguaccaggacauccaggagaagcuccugaucaagcugccgaaguacucccucuucgagcuggagaacggccgccgccggcugcucgccagcgccaacgaguuccagaagggcaacgagcuggcccuguccgggaaguacaugaaguuccucuaccuggcgagccgcuacgacaagcuguccagcaagaucgaguccgagcagcagaagaagcuguucgucgagcagcaccuccacuacuucgacgagauccuggacaucguggugaagcacgcgaccugcuacaucaaggccgagaacaaccugaagaagaucaucagccuguacaagaagaaggaggccuacuccaucaacgagcaggcccugaacaugcugaaccucuucaucuucacgagccugggcgcccccuccaccuucgucuucuucgacgagaccaucgaccggaagcgcuacaccacgagcuccgacgugcugaacgggauccucauccagcagagcaucaccggccuguacgagacccggaucgaccugagccgcuucgggggcgacuga

SEQ ID NO: 2008 - RNA, 4125 nt, Artificial Sequence
  Cas9 variant
augaagaagcagaaguucagcgacuacuaccugggcuucgacaucgggaccaacuccgugggcuggugcgucaccgaccucgacuacaacgugcugcgcuucaacaagaaggacaugugggggagccggcuguucgacgaggccaagacggccgcggagcgccgggugcagcgcaacucccggcgccggcucaagcgccggaaguggcgccugaaccugcucgaggagaucuucagcgacgagaucaugaagaucgacuccaacuucuuccggcgccugaaggagagcucccuguggcucgaggacaagaacagcaaggagaaguucacccuguucaacgacgacaacuacaaggacuacgacuucuacaagcaguaccccaccaucuuccaccuccgggacgagcucaucaagaacccggagaagaaggacauccgccugaucuaccuggcccuccacuccaucuucaagagccggggccacuuccuguucgaggggcagaaccugaaggagaucaagaacuucgagacccucuacaacaaccugaucuccuuccuggaggacaacggcaucaacaagagcaucgacaaggacaacaucgagaagcucgagaagaucaucugcgacuccggcaaggggcugaaggacaaggagaaggaguucaagggcaucuucaacagcgacaagcagcuggucgccaucuucaagcucuccguggggagcuccgugagccugaacgaccuguucgacacggacgaguacaagaaggaggaggucgagaaggagaagaucuccuuccgcgagcagaucuacgaggacgacaagcccaucuacuacagcauccucggcgagaagaucgagcugcuggacaucgccaagagcuucuacgacuucauggugcucaacaacauccuguccgacagcaacuacaucuccgaggccaaggugaagcuguacgaggagcacaagaaggaccucaagaaccugaaguacaucauccggaaguacaacaaggagaacuacgacaagcuguucaaggacaagaacgagaacaacuaccccgcguacaucgggcucaacaaggagaaggacaagaaggaggucguggagaagucccgccugaagaucgacgaccugaucaaggugaucaagggcuaccuccccaagccggagcggaucgaggagaaggacaagaccaucuucaacgagauccugaacaagaucgagcugaagaccauccuccccaagcagcgcaucagcgacaacggcacccugcccuaccagauccacgaggucgagcuggagaagauccucgagaaccagagcaaguacuacgacuuccugaacuacgaggagaacgggguguccacgaaggacaagcugcucaagaccuucaaguuccggauccccuacuacgugggcccgcugaacagcuaccacaaggacaagggcgggaacuccuggaucguccgcaaggaggagggcaagauccugcccuggaacuucgagcagaagguggacaucgagaaguccgccgaggaguucaucaagcgcaugaccaacaagugcaccuaccugaacggggaggacgugauccccaaggacagcuuccucuacagcgaguacaucauccugaacgagcugaacaagguccaggugaacgacgaguuccucaacgaggagaacaagcggaagaucaucgacgagcuguucaaggagaacaagaagguguccgagaagaaguucaaggaguaccugcucgucaaccagaucgccaaccgcacgguggagcugaagggcaucaaggacagcuucaacuccaacuacgugagcuacaucaaguucaaggacaucuucggggagaagcugaaccucgacaucuacaaggagaucuccgagaaguccauccuguggaagugccuguacggcgacgacaagaagaucuucgagaagaagaucaagaacgaguacggggacauccucaacaaggacgagaucaagaagaucaacagcuucaaguucaacaccuggggccggcugagcgagaagcugcucaccggcaucgaguucaucaaccuggagaccggggagugcuacagcuccgucauggaggcccugcgccggacgaacuacaaccucauggagcugcugagcuccaaguucacccuccaggagagcaucgacaacgagaacaaggagaugaacgagguguccuaccgcgaccugaucgaggagagcuacgucucccccagccugaagcgggcgauccuccagacccugaagaucuacgaggagaucaagaagaucaccggccgcgugccgaagaagguguucaucgagauggcccgcgggggcgacgaguccaugaagaacaagaagauccccgcccggcaggagcagcugaagaagcucuacgacagcugcgggaacgacaucgccaacuucuccaucgacaucaaggagaugaagaacagccuguccagcuacgacaacaacucccugcggcagaagaagcucuaccuguacuaccugcaguucggcaagugcauguacacgggccgcgagaucgaccucgaccggcugcugcagaacaacgacaccuacgacaucgaccacaucuacccccgcagcaaggucaucaaggacgacuccuucgacaaccucgugcuggugcugaagaacgagaacgccgagaaguccaacgaguaccccgucaagaaggagauccaggagaagaugaaguccuucuggcgguuccucaaggagaagaacuucaucagcgacgagaaguacaagcgccugaccgggaaggacgacuucgagcugcggggcuucauggcgcgccagcucgugaacgugcggcagaccacgaaggaggucgggaagauccugcagcagaucgagccggagaucaagaucguguacagcaaggccgagaucgccagcagcuuccgcgagauguucgacuucaucaaggugcgcgagcugaacgacacccaccacgccaaggacgccuaccucaacaucgucgcgggcaacguguacaacaccaaguucaccgagaagcccuaccgguaccugcaggagaucaaggagaacuacgacgugaagaagaucuacaacuacgacaucaagaacgccugggacaaggagaacucccuggagaucgucaagaagaacauggagaagaacacggugaacaucacccgcuucaucaaggaggagaagggggagcuguucaaccugaaccccaucaagaagggcgagaccagcaacgagaucaucuccaucaagcccaagcuguacgacggcaaggacaacaagcucaacgagaaguacggguacuacaccagccugaaggccgccuacuucaucuacguggagcacgagaagaagaacaagaaggucaagacguucgagcggaucacccgcaucgacuccacccugaucaagaacgagaagaaccucaucaaguaccuggugagccagaagaagcugcucaacccgaagaucaucaagaagaucuacaaggagcagacccugaucaucgacuccuaccccuacacguucaccggcguggacagcaacaagaaggucgagcugaagaacaagaagcagcucuaccuggagaagaaguacgagcagauccugaagaacgcccucaaguucguggaggacaaccagggggagaccgaggagaacuacaaguucaucuaccugaagaagcggaacaacaacgagaagaacgagaccaucgacgcggugaaggagcgcuacaacaucgaguucaacgagauguacgacaaguuccuggagaagcucuccagcaaggacuacaagaacuacaucaacaacaagcuguacaccaacuuccugaacuccaaggagaaguucaagaagcucaagcugugggagaagucccugauccuccgggaguuccugaagaucuucaacaagaacacguacggcaaguacgagaucaaggacagccagaccaaggagaagcuguucagcuuccccgaggacaccggccgcauccggcucgggcaguccagccugggcaacaacaaggagcugcucgaggagagcgucaccgggcuguucgugaagaagaucaagcuguga

SEQ ID NO: 2009 - RNA, 4128 nt, Artificial Sequence
  Cas9 variant
augagcaacaagcccuacuccaucggccuggacaucgggaccaacagcgugggcugggccgucaucaccgacgacuacaaggugccguccaagaagaugaaggugcucgggaacacggacaagcacuucaucaagaagaaccugaucggcgcccugcuguucgacgaggggaccaccgcggaggaccgccggcugaagcgcaccgcccggcgccgguacacgcgccggaagaaccgccugcgguaccuccaggagaucuucuucgaggagaugagcaagcuggacuccggcuucuuccaccgccuggacgacuucuuccucauccccgaggacaagcggggcagcaaguaccccaucuucgccacccuggccgaggagaaggaguaccacaagcaguuccccaccaucuaccaccuccgcaagcagcucgccgacuccaaggagaaggcggaccugcggcugaucuaccucacccuggcccacaugaucaaguaccgcgggcacuuccuguacgaggagagcuucgacaucaagaacaacgacauccagaagaucuucaacgaguucaucuccaucuacgacaacacguucgagggcagcucccucagcgggcagaacgcccagaucgaggccaucuucaccgacaagaucuccaagagcgcgaagcgggagcgcguccugaagcuguucccggacgagaaguccaccggccucuucagcgaguuccugaagcugaucguggggaaccaggccgacuucaagaagcacuucgagcucgaggagaaggcgccccugcaguuccccaaggacaccuacgacgaggaccuggagaacgugcucggccagaucggcgacgacuucgccgaccuguucgucgccgccaagaagcuguacgacgccauccuccuguccgggauccugacggugaccgaccccagcaccaaggccccgcucuccgccagcaugaucgagcgguacgagaaccaccagaaggaccuggccgcgcugaagcaguucaucaagaccaaccuccccgagaaguacguggaggucuucagcgaccaguccaaggacggcuacgccggguacaucgacggcaagacgacccaggaggccuucuacaaguacaucaagaaccugcugagcaaguucgagggcaccgacuacuuccucgacaagaucgagcgcgaggacuuccugcggaagcagcgcaccuucgacaacggguccaucccccaccagauccaccuccaggagaugaacgccauccuccggcgccagggcgagcacuaccccuuccugaaggagaacaaggagaagaucgagaagauccugacguuccgcaucccguacuacguggggccccucgcccggggcaaccgcgacuucgcguggcugacccggaacagcgaccaggccauccgccccuggaacuucgagaagaucguggacaaggccuccagcgccgaggacuucaucaacaagaugaccaacuacgaccuguaccuccccgaggagaagguccugccgaagcacucccugcuguacgagaccuucgccguguacaacgagcucacgaaggugaaguucaucgcggaggggcugcgggacuaccaguuccuggacagcggccagaagaagcagaucgucaaccagcuguucaaggagaagcgcaaggugaccaagaaggacaucauccacuaccugcacaccguggacggcuacgacgggaucgagcugaagggcaucgagaagcaguucaacgccucccucagcaccuaccacgaccugcugaagaucaucaaggacaagaaguucauggacgacuccaagaacgaggccauccucgagaacaucguccacacgcugaccaucuucgaggaccgggagaugaucaagcagcgccuggcccaguacgacagccucuucgacgagaaggugaucaaggcgcugacccggcgccacuacaccggguggggcaagcuguccgccaagcucaucaacgggaucugcgacaagcagacgggcaacaccauccuggacuaccugaucgacgacggcgagaucaaccggaacuucaugcagcucaucaacgacgacgggcugagcuucaagaagaucauccagaagucccagguggucggcgagaccgacgacgugaagcaggucgugcgcgagcugcccgggagccccgccaucaagaagggcauccuccaguccaucaagaucguggacgagcuggucaaggugauggaccacgcccccgagagcaucgugaucgagauggcccgggagaaccagaccacggcgcgcgggaagaagaacucccagcagcgguacaagcgcaucgaggacagccugaagaaccucgccagcggccuggacuccaacauccugaaggagaacccgaccgacaacauccagcucaagaacgaccggcuguuccuguacuaccuccagaacggcaaggacauguacaccggggaggcccuggacaucaaccagcugagcuccuacgacaucgaccacaucaucccccaggccuucaucaaggacgacagccucgacaaccgcguccugaccuccagcaaggacaaccggggcaaguccgacaacgugcccagccuggaggugguccagaagcgcaaggccuucuggcagcagcuccuggacuccaagcugaucagcgagcgcaaguucaacaaccucaccaaggcggagcgcgggggccugaacgagcgggacaaggugggcuucaucaagcggcagcugguggagacgcgccagaucaccaagcacgucgcccagauccucgacgcccgguacaacaccgaggugaacgagaaggacaagaagaaccgcaccgugaagaucaucacgcugaaguccaaccuggucagcaacuuccggaaggaguuccgccucuacaaggugcgggagaucaacgacuaccaccacgcccacgacgccuaccugaacgcgguggucgccaaggccauccugaagaaguaccccaagcucgagccggaguucguguacggggaguaccagaaguacgaccugaagcgcuacaucucccggagccgcaaccccaaggagguggagaaggccaccgagaaguacuucuucuacuccaaccugcucaacuucuucaaggaggagguccacuacgcggacggcaccaucgugaagcgggagaacaucgaguacagcaaggacaccggggagaucgccuggaacacggagaaggacuucgccaccaucaagaagauccuguccuacccccaggugaacaucgucaagaagaccgaggagcagaccgugggccagaacgggggccuguucgacaacaacaucgugagcaaggagaaggucguggacgccagcaagcucauccccaucaaguccggccugagcccgaagaaguacgggggcuacgcccgccccacgaucgcguacuccgugcuggucaccuacaagcagaacaacaagaucaagaacaccaugguggggauccccgugcucaccaagcuggaguucgagcgggacccgaaccuguaccuccgcaaccugggcaucaacaacgucagccacgugaucaagcuggugaaguacacgguccucgaguucaagcacaaguacgggaccuaccggcgcuucaucguguccaaccaggagcugaagcgggccaaccagaucuucgugaccaccaagcagaugaagcugaucagccaguacacgacccucgacaagaacgagcacgacucccugcugaagaacaaccagcagcucauccagagcaucuggaaccaguuccuggaguucaugcuggccaccgaccucgucaacaagaagcaguacgacgagcugauccugaccaacaaccagacgaucgaggagugccgcaacaucaugaaccgggugaucaccacccucuccuucaccaacaucaacgccggccagaagaagaucaucuucgacgacacgcugagccugcccaucaagcgcuggcaguucaccgacuccgacaagauggugaagaagaucaucgagagcacccucauccaccaguccaucaccggccuguacgagacgcgcaucgaccugagcaagcucggggaggacuga

SEQ ID NO: 2010 - RNA, 4128 nt, Artificial Sequence
  Cas9 variant
augaaggaguaccacaucggccuggacaucgggaccagcuccaucggcugggccgugaccgacagccaguucaagcucaugcgcaucaaggggaagacggccaucggcguccggcuguucgaggaggggaagaccgcggccgagcgccggaccuuccgcaccacgcggcgccggcugaagcgccggaaguggcgccuccacuaccuggacgagaucuucgccccccaccugcaggagguggacgagaacuuccuccggcgccugaagcaguccaacauccacccggaggaccccgccaagaaccaggccuucaucggcaagcugcucuuccccgaccugcugaagaagaacgagcggggcuaccccacccucaucaagaugcgcgacgagcugccgguggagcagcgggcgcacuaccccgucaccaacaucuacaagcugcgcgaggccaugaucaacgaggaccggcaguucgaccuccgcgagguguaccuggccgugcaccacaucgucaaguaccgggggcacuuccugaacaacgccagcguggacaaguucaaggugggccgcaucgacuucgacaaguccuucaacguccucaacgaggcguacgaggagcugcagaacggggagggcagcuucaccaucgagcccuccaagguggagaagaucgggcagcugcuccuggacacgaagaugcggaagcuggaccgccagaaggccguggccaagcuccuggaggucaagguggccgacaaggaggagaccaagcgcaacaagcagaucgccaccgcgaugagcaagcuggugcucggcuacaaggccgacuucgccaccgucgccauggugaacggcaacgaguggaagaucgaccuguccagcgagacguccgaggacgagaucgagaaguuccgggaggagcugagcgacgcccagaacgacauccucaccgagaucaccucccuguucagccagaucaugcugaacgagaucgugcccaacgggauguccaucagcgaguccaugauggaccgcuacuggacccacgagcggcagcucgcggaggucaaggaguaccuggccacgcagccggccagcgcccgcaaggaguucgaccagguguacaacaaguacaucggccaggcccccaaggagaagggguucgaccuggagaagggccucaagaagauccuguccaagaaggagaacuggaaggagaucgacgagcugcucaaggcgggcgacuuccugcccaagcagcggaucagcgccaacggggugaucccccaccagaugcaccagcaggagcuggaccgcaucaucgagaagcaggccaaguacuacccguggcucgccaccgagaaccccgccaccggcgagcgggaccgccaccaggcgaaguacgagcuggaccagcuggucagcuuccggauccccuacuacguggggccccucgugaccccggagguccagaaggccacguccggcgccaaguucgccugggcgaagcgcaaggaggacggggagaucacccccuggaaccugugggacaagaucgaccgggccgagagcgccgaggccuucaucaagcgcaugaccgugaaggacaccuaccugcucaacgaggacguccugcccgccaacucccugcuguaccagaaguacaacgugcucaacgagcugaacaacgugcgggucaacggccgccggcugagcgugggcaucaagcaggacaucuacacggagcucuucaagaagaagaagaccgugaaggcguccgacgucgccagccuggugauggccaagacccgcggggugaacaagcccuccgucgagggccugagcgacccgaagaaguucaacuccaaccucgccaccuaccuggaccugaagagcaucgugggggacaagguggacgacaaccgguaccagauggaccucgagaacaucaucgaguggcgcuccgucuucgaggacggcgagaucuucgccgacaagcugacggagguggaguggcugaccgacgagcagcggagcgcgcucgugaagaagcgcuacaagggguggggccgccuguccaagaagcugcucaccggcaucgucgacgagaacgggcagcggaucaucgaccugauguggaacaccgaccagaacuucaugcagaucgugaaccagcccguguucaaggagcagaucgaccagcugaaccagaaggccaucacgaacgacggcaugacccuccgcgagcgggucgagagcgugcuggacgacgccuacaccuccccccagaacaagaaggccaucuggcaggugguccgcgugguggaggacaucgucaaggccguggggaacgcgcccaagagcaucuccaucgaguucgcccggaacgagggcaacaagggggagaucacccgcagccggcgcacgcagcugcagaagcucuucgaggaccaggcccacgagcuggugaaggacaccucccugaccgaggagcucgagaaggucccggaccugagcgaccgguacuacuucuacuucacccagggcggcaaggacauguacaccggggaccccaucaacuucgacgagaucagcacgaaguacgacaucgaccacauccugccccaguccuucgugaaggacgacagccucgacaaccgcgugcugaccucccggaaggagaacaacaagaagagcgaccagguccccgccaagcuguacgcggccaagaugaagccguacuggaaccagcuccugaagcagggccugaucacccagcgcaaguucgagaaccucaccauggacguggaccagacgaucaaguaccggucccugggguucgugaagcgccagcuggucgagacccggcaggugaucaagcucaccgccaacauccugggcagcauguaccaggaggccggcaccgacaucaucgagacgcgcgccgggcugaccaagcagcuccgggaggaguucgaccugcccaaggugcgcgaggucaacgacuaccaccacgcgguggacgccuaccugaccaccuucgccggccaguaccucaaccggcgcuaccccaagcugcgguccuucuucguguacggggaguacaugaaguucaagcacggcagcgaccugaagcuccgcaacuucaacuucuuccacgagcugauggagggggacaagucccagggcaaggucguggaccagcagacgggcgagcugaucaccacccgcgacgagguggccgacuacuucgacuggguccaggaccucaagcugaugcuggugaccaaggagcucaagcggagcaacgggaagcuguucgacgccacgauccagaacgcgaacuacaccaagcugaacgagcgcaagaagguguucgucccgcucaagaaggagcuggacaagacccuguacggcuccuacagcgggauccaguccagcuacaugaccaucgugaagaaguucgacaagaagggcuccacguacgccgugcagcggauccccgucauguacagcaagcuccuggagcuggagaaggagcaguccaagcucaaccgccuggugcagagcaucgugaccagcgacccccaggcccccaacaacuucgagguccugaugccgugcgugcucuccgggcagcuggucaucgacaacggccggaaguucacccugaccagcuaccgcuaccagugcuccacggcccagcucuuccugcccaagaaggaccugaaguacauccagaacaacuucaaggagcucaagaagacccccgacaagcaggacaagaucuucgagaccaucuacgacgacauccugaagcagguggacaaguacuucagccuguacgacaucaacaaguuccgguccaagcuccacgacggcaaggacaaguuccuggcccuggagaacuucggggagaaggagagcaaggacaaggugaucaccaagauccuccgcggccugcacgcgaacgccgagcggacgucccugaaggagaucgggcucagcaccccccugggccaguuccaguccggggagggcggcaucacccugagcgacaacaccaagaucaucuaccaguccccgacggggcucuucgagcgccacgucuaccugaaggaccuguga

SEQ ID NO: 2011 - RNA, 4128 nt, Artificial Sequence
  Cas9 variant
augcgcaagaaccaggagcccuacaacaucggccuggacaucgggaccagcuccaucggcuggagcaucaugaacgacaacuucgaccucaugcgggugaaggggaagaagggcaucgggguccgccuguacaacgagggccaguccgccgccgagcggcgcaugcaccggaccgcgcgccggcgcuacggccggcgcaaguggcggcugcgccuccuggaggacuucuucgacgagcacauggccgagguggacgacacguucuucgcccggcugaaggacagcaacaucuccccgaaggacgacaagaaguaccgcaagagccuccuguuccccaaguccaagggggugaccuaccaggacgacggcgaguucuacaagaaguaccccaccauguaccaccuccgguacgcccucaugaccgagcaccgcaaguucgaccugcgggagaucuaccuggccuuccaccacauggucaaguaccgcgggaacuuccucuacgacacgagcguggacuccuucgaggcgaagaaccuggacaucaagggcaaguucgacgagaucaacgaccugcucagcuccuacaccgacuucuacguggacaacagcaacgccgcccuggucgaguccauccugcucgagaagaacaccacccggaaggacaagagcaagaagaucgccaagcugcugcacguggaggacaaggagaaggggaagaacaagaaggcgaaggaccucgccacgcagaucuccaacgccgugcugggccugaagugcaacuuccaccucaucuucgagcugcagcagaaguacagcuucgaccugugcuccgagaagaccgaggagaacaucgccaagcucagcgagguccuggacgagaaccagaagaugcugcucaugauccugaaggaggugcaggaccaggugaugcugaacgccuucguccccuccggcaugagccucagcgaggcgaugaugcagaaguacgacgacuacggggagcagcugaagaucuaccacgagcuggagcacuccgugagcgacgacuccgccgccaagcuccgcggcgccuaccgggacuacaacgacaacaucaucaagcgcaucgacggggacaacaagaaggacaccuucuacaagcgcgugaagaacauccugaccaagaucagcaaggaguacgucgaccaggacgugcuggaguccugcggcaagcucaagaagcugaucgacgagaacaagcuguucauccggcagcgcacggccgcgaacggcgugcucccgcaccagcugcaccagaucgagaugcggaagaucaucgacaaccagaaggaguacuaccccuggcuggccgagcccaaccccaacgagaagcgccgggucuacagcaaguacaagguggaggagcucaucgccuuccgcaucccguacuacguggggccccuggucgaccccaacaacgccgacaagaacaaggaggcccgguucuccuggauggugcgcaagaaggacggcgagaucacccccuggaacuucuacgacaagguggacugggcggagagcgccaacaacuucaucgagcggaugaaguccaaggacaccuaccugcucggggaggacgucgugccgaaggagagcaugcuguaccagaaguacgagguccugaacgagcugaacaaccuccgcaucaacgacuccggccugagcgacuccuucgaggacgugaagcugaagcaggccaucuacaacgaccucuucaagaagcagaagaucgugaagaucaccgaccugcagaacuaccugguccagaaccacaaguaccucgugaagcccaagaucagcgggcuggccgacgagaaccgguuccuguccagccucuccacguacagcgaccugaagaccaucuucggcgacaagguggacgaccgcaccuacuucaacgacuucgagaagauggucgaguacuccaccguguucgaggacggccacgacuacaaccagaagcuggacgaguacacguggcucaccaaggaggagaaguacaagaucgggaagaagcgguaccgcggcugggggaagcugagcaagaagcugcucaccggccugcgggacaagaacaaccacaccaucauggacaaccugugggagacgaaccgcaacuucaugcagauccagaccgccgacgaguucagcaagcagaucgcggaggagaacgagcggcaccucaagggguccgugagcgacgccaucaacgacauguacaccucccccgccaacaagaaggccauccgccagguccugcgggugguggacgacauccagaaggcgaugggcuacgcccccagcuccaucagccuggaguucgcccgcgaggacggcccguccguccgcaccgugagccgggccaaccgcaugaaguccaucuacgagaaguacgccagcgagguguccgaggaggucaugaaggaccucgacggggugaucaaggacaagaagggccugaacgaccggcuguaccucuacuucgagcagcaggggaaggacauguacagcggccacccccuggacuucgacaaggugaucuccgggcaggaguacgacaucgaccacauccugccccaggcggucaucaaggacgacagccucgacaaccgcgugcugacgaccaaggcccugaacaacgacgugaaguccaagggcguccccugccggauguucaacggcaugcacagcuucuggaagaaccucuacgacaagggguucaucucccgccggaaguucaacaaccugaccaccaacccggagaacaucgacaaguacaagaugaagggcuucgugaaccgccagcugguggagacgcggcagaucaucaagcucgucgccaacgugcugaacgacaaguaccagaacgacgacguggacaucaucgagguccgcgccgagcugacccacgacgugcggaagcacuucaaguucuacaagaaccgcaacgugaacgacuaccaccacgccuucgacgcguaccucaccagcuucaucgggcacuaccuguucaagaaguaccccaaccugcggccccucuucgacuacaacgacuucaugaaggucagcgacaacguguucaagcagcugcgcggcaacaacuuccugggcgaguuccucaacaagaccggggacaucaucuccacggacggcaacuucgugcugaacaaggaggagaugaucaacaagcugaacaaggccuacgccuucaagaagauccucgucaccaaggagguggggcagcggaccggcgccauguucaacgagacccgcuaccccgccccgaacagccggaaggcggcccugaaguaccgccggaugcccaagcccgacucccugaucagcgugaaggacuacaagaacaccgacaucuacgggggcuacuccggcaagaacgacgccuacauggucaucguggacauggggaagcaguacaugguggucggcgugcccgugcgcuacacggagaagcucgacaagcugcggaucaagcacagcgagcuguaccgcgacgagcuccgcaagguccugucccgggacaagacccugcucgacagcaaggggaacgugaagcgcuucgacaucgugcuggaccggguccuguacggccagcucaucgaggacgggaacgagcuguucacccugggcuccagcaaguacaagcgcaacuuccggcagcuguuccuggacaagcagugcaucgagauccuggacuccagcgccaccccgcagcccacggacgaggagcucaucuggguguacgaccagauccuggacaagguggacaaguacuucgagcuguacgacaucaaccgccagcgggagacccuccgcaagggccgggcggccuucugcucccugcccaacaucagcaugaagaaggacgacgucaccaagaagaagauccugaacgagauccucguggcccugcacgccaacgaguccgagagcaacugcgagaagaucgggaagaagguguucggccgccugcagguccccgggggcaucaagcucuccaaggaggccaagcugaucuaccagagcccgaccgggcuguucgagcggguggucuaccucaaggaccuguga

SEQ ID NO: 2012 - RNA, 4128 nt, Artificial Sequence
  Cas9 variant
auggagaacaagaaguacagcaucggccuggacaucgggaccuccagcaucggcuucgccguggucgacgagaacaaccgcgugaugcgggugaaggggaagaacgccaucggcguccgccucuucuccgaggggcagcccgcggccgaccggcgcagcuuccggaccacgcgccggcgccugucccggcgccgguggcgccugcggcuccugcgcgagaucuucgagccguacaucaaccccguggacgaggccuucuucaugcggcugaaggagagcaaccucucccccaaggacgccaacaagcacuacagcggcgacauccuguucaacaaccagaccgaccaggacuucuacgagaaguaccccaccaucuaccaccuccgccacgcccugaugaccgagcaccggaaguucgacgugcgcgagaucuaccuggcgauccaccacaucgucaaguuccggggccacuuccugaacgccgccuccgccagcaacuucacgguggggaagcucaaccuggagggcaaguucgacgcgcugaacgagaucuaccagcgcgugcucaccgacgacccguucgcccugcggaccgacaaccuggaccacaucaaggagauccucaucgacaacaagcgcucccaggccgaccgccagcggacccugacgggggacgucuaccagagcuccgaggagaaggagaucgagaagcgcaacaaggccaucgccaccgagauccugaaggcggccgugggcaacaaggccaagcucaacgugaucaccaacgucgagguggacaaggaggccgccaaggacuggagccugaccuucgacuccgagacgaucgacgacgagcuggcgaagguggacgggcagaugaccgacgacggccgggagaucaucgagauccuccgcagccuguacuccggcaucacccuggccgccaucguccccgagaaccacacccucagccaguccaugguggagaaguacaacagccacaaggcccaccugaagcugcucaaggaccugaucaacaacaugacggacaccaagaaggccaagaaccugcgggcggccuacgacggguacaucgacggcgugaaggggaagguccucacccgcgacgacuucuacaagcagauccagggcaaccuggacgacagcgccgaggcccagaagauccaggacgugauggaccaggacgaguucaugcccaagcagcggaccaaggccaacggcuccaucccccaccagcugcagcagcaggagcucgaccagaucguggagaaccagaaggaguacuacccguggcuggcggaggagaaccccaacgagacgcgccgcggggucgccaaguacaagcuggacgagcucgugaccuuccgggugcccuacuacgucggccccaugaucaccgccgaggaccaggagaagcagagcggggccuccuucgcguggaugaagcggaaggagccgggcaacaucacccccuggaacuucgaccagaagguggaccgcauggccagcgccaaccaguucaucaagcggaugacgaccaccgacaccuaccugcugggggaggacguccuccccgcccagucccugcuguaccagcgcuucgaggugcucaacgagcugaacaagauccggaucgaccgcaagcccaucagcaucgagcugaagcagcagaucuucaacgaccucuucaagaaguucaagaacgugacgaucaagcaccuccaggaguaccuggucgccaccggcggcuacgacaagcggccgcgcaucgacgggcuggcggacgagaagcgguucaacuccggccugagcgccuaccacgaccugcacgggauccugggcgccgaggugguggacgccaacgacaagcaggacgaccucgagaagaucaucgagugguccaccaucuucgaggacaagaagaucuaccgcgccaagcuggacgagcugaccuggcucacggacagccagaaggagaagcuggcgaccaagcgcuaccagggguggggccggcuguccaagaagcuccugagcggccugcgcaacuccgaccaccggagcauccucgacauccuguggaucaccaacgagaacuucaugcagauccaggccgaccccgacuucgccgagcuggucaagaacgccaaccaggggaugcucggcaagaacaacucccaggacgugaucaacgaccuguacaccagcccccagaacaagaaggccauccgccagauccugcucgugguccacgacauccagaacgcgaugcacgggcaggcccccgccaagauccacguggaguucgcccggggcgaggagcgcaacccgcggcgcuccauccagcggcagcaccagaucgaggcggccuacgacaaggugacgagcgaccugcuggucgacgccggggugcgccaggagcucaaggacgccaucaacgacaagcgggacuucaaggaccgccuguuccuguacuucaugcagggcggccgggacaucuacaacggggagcccaucaacaucgaccgccucuccagcuacgacaucgaccacauccugccccaggccuucgugaaggacgacagccugaacaaccggguccucaccgacgcggagggcaaccgccggaaguccgacgccgugcccagcgagcuguucggggccaagaugcgcuccaccugggagcugaugcgggagcagggccucaucagcaaggccaaguaccgcaaccugaccaugaacccggagaacaucaacgcccacaccgagaacggcuucaucaaccggcagcugguggagacgcgccaggucaucaagcucgcggugaacauccuggccgacgaguacaccgaggacacccagaucguguccgucaaggccgaccugagccaccagaugcgcgaggacuucgagcuccugaagaaccgggacgugaacgacuaccaccacgccuucgacgccuaccuggcggccuucaucgggaacuaccuccuggagcgcuaccccaagcugcaguccuacuucguguacggcgacuucaagaaguucagccagaaggacaccaagaugcggcgcuucaacuucaucuacgaccucaagcacuccgaccagaucgccgacaagaacgggaagaagaucuggcacaagacgaacgaccuggacuacauccggcaccuguucgccuacaagaagauccucaucagccacgaggucuccgagcgccggggcgcgcuguacaaccagaccguguacaaggccagcgacgacaaggccuccgggcagggcagcaagaagcugauccccaucaaggccaacaagcccaccgagaucuacggcggguacaccggcaagacgcucgccuacauggcgaucgugaaggucaucaaggggaagaagaucgccuacaagguggugggcgucccgaccuccgcccuggugcagcuggccgggaucgagcacggcagccaggaggagcucaaccgccuguacgacgugcugaagccccaguucacccagcucaagaagaacaacaagaccggcgagaucuccgagacggucagcaaguucgagaucgugaucccccgggugaaguaccagcagcuggucgaggacgacgacaagcuguucaugaucgggagcgacaccuacccguacaacgcccagcagcucgugcuguccgagggcgcgcugaaggugaucaacaacgucuaccgcaagggggagaacagcgacaagcaggaguccuacaagcucgacgacguguacgacgagaucaucaucgccaugaagaaguacuucccccuguacgacaaccggggcuuccgcgagaagguggccgagggcaagagcaccuucgagaaccugcccaucuccaacgaguucaagaacgggaagcucaccaagaucggcaagaaggaggucaucaaccggaugcugcaggggcugcacgccaacgccacgaugaccgaccucaagauccugggcaucaagagccccuucggguucaugcagcagccgaccggcaucgcgcuguccgagaacgcccagcucaucuaccagagccccaccgaccuguucgagcgccgggugcagcugaacaagaucaaguga

SEQ ID NO: 2013 - RNA, 4128 nt, Artificial Sequence
  Cas9 variant
augaagaagauccugggccucgaccuggggaccaccagcaucggcugggcccugguguacgaguccgagaacacggacgagaaguccagcaucguccgccucggggugcgggugaacccccugagcgucgacgagaagggcaacuucgagaaggggaaggccaucaccaccaacgcggaccgccagcagacccacggcgcccggaucaaccugcagcgcuacaagcuccggcgcgagaaccugaaggacugccugcagaagcagggcuggaucgggacggaggcccucugcgaggagggcaagaccuccaccuucgagaccuacaugcugcgggccaaggccgcggaggaggagaucagccugcacgagcucugccgcgugcuguucaugaugaacaagaagcggggguacaaguccaaccgcaaggccaacaacaaggaggacggcaagcuguucgacgggaugacgguggccaagaagcucuacgaggagcaccugaccccggccgaguacagcuuccagcugcucuccagcggcaagaaguucaagcaggaguacuaccgguccgaccugaaggaggaguucgaccgcaucuggaacgagcagcagaaguacuaccccgagauccugaccgacgacuucaagcagcagcuccagggcaagagcaaggggaacaccuccaagaucuuccugggcaaguacgggaucuacagcgcggaccugaagggccucgaccggaagcugcagccccugaaguggcgcgucgaggcccucaagcagcaggucgacaaggaggugcuggccuucgugaucuccgaccugaacggccagaucgccagcacguccgggcuccugggcgccaucagcgaccgguccaaggagcuguacuucaacaagcagaccguggggcaguaccucuggaccagccugaaggagaccccgcacgugagcaucaagaacaagccguucuaccgccaggacuaccuggacgaguucgagaagaucugggagacgcaggcgaccuaccacaaggagcucacccccgagcugaagcaggagauccgggacaucaucaucuucuaccagcgcccccugaaguccaagaagggccucaucagcgucugcgagcuggagcagcggaaggugaaggugaccaucgacgggaaggagaaggagaucuccaucggccccaaggucgcccccaagagcucccccauguuccaggaguuccgcaucuggcagaaccugaacaacauccuccugaucgacaagggcaacaacagcauccacccccuguacgaggaggagaagaaccuccuguacgaggagcuguccgugaaggagaagcucagcaaggccgaggcccugaaggugcugaacaagaacuccaagcagugggaccugaacuacaaggagaucgaggggaaccggacgcaggccguccucuacgacugcuacaaccgcaucaucgugaugaccggccacgaggaguacaacuucaagaagcugaaggcgagcgagauccgcuccuacgugaagaccaccuucacggggcugggcuucaacaccgacauccucgaguucgacagcucccugaccgggcacgagcuggagaagcagcccauguaccagcucuggcaccuccuguacagcuacgaguccgacaacagccggaccggcaacgacgcccugcugcgcaagcuggagacggccuucggcuucccgaaggaguacgccgccguccucuccgacgugguguucgaggacagcuacgggaaccuguccgucaaggcgaugcggaagauccugccccaccuccaggccggccugaacuacagccaggccugcgaggaggccggguacaagcacagccgccggucccugaccaagaacgagcucgaccagaaggaguacaaggagaagcuggagcugcuccccaagaacagccugcacaaccccguggucgagaagauccugaaccagaugaucaacgugaucaacgccgugaucgacgaguacggcaagccggacgagauccgcaucgagcucgcgcgggagcugaagaucggggccgccgagcgcgagaacaugacccgguccaucaaccagggcaacgccgagaacaagcgcauccgggagauccuggagaaggaguucgcgcucagcuacaucucccgcaacgacaucaucaaguacaagcuguacgaggagcucaagagcaacggcuucaagacccuguacuccgacacguacaucagcaaggacaagcuguucuccaaggacuucgacaucgagcacaucauccccaaggcccggcuguucgacgacagccucuccaacaagaccaucgaggcccgcgacgucaacaucgccaagagcaacaagaccgccuucgacuucaucuccgagaaguacgaccagcaggggaucgaggcguacaagaagaagcuggacauccugcuccaggacggcagcaucuccaaggccaaguacaaccggcugcugaugaaggaggccgacauccccagcggguucaucgaccgcgaccuccgggacacccaguacaucgccaagaaggccuacgagauccuguccgaccuggugcgcaacgugacgcccaccaccggcgcggucaccagccggcuccgcgaggacuggcagcugguggacgugaugaaggagcugaacuucgagaaguaccagaagcucggccuggucgaggugaucgaggaccgcgacgggcggaagaucaagcgcaucaaggacuggaccaagcggaacgaccaccgccaccacgccauggacgcccugacgaucgccuucaccaagccgagcuacauccaguaccucaacaaccugaacgcccgguccgacaagaacagcuccaucuacggcaucgagaacaaggagcugcaccgcgaggacaacaagcuccgguucaacgcgccccugcccaucaacgaguuccgcgccgaggcccggcgccaccucaagagcauccugguguccgucaaggccaagaacaaggugaugacccagaacgugaacgucaucaagaccaagcacggggugaucaagaaggugcagcugacgccccggggcgagcugcacaacgcgaccuucuacgggaccaagaagcgcccgaucaucaagauggucaaggugggcgccgcccucgacgaggugaccaucaagaaggucagcuccagcuucauccgggaggcccugcuggaccgccuccacgaguacaacggcgacgccaagaaggcguucacggggcggaacuccaucgacaagaaccccaucuacaucgacgaggagcacaagaagaccgugcccgcccuggugaagaccaucgagugggagauguaccaccccacccgcaagcugaucagcccggaccucaagaucgacaaggucaucgacaagggcauccgggagauccugaagacgcgccuggccaaguucaacggggacgcccagaaggccuucuccaaccucgacgagaaccccaucuacaaggacgaggcgaagaagaucacccugaagcgggugagccuggagggcguguccagcgucaucccccuccacacccugaaggaccgcgaggggaagcugguggugggcaaggacggcaagccgguccucggggacuacgugcagaccuccaacaaccaccacaucgccuucuacauggacgagaacggcaaccugcaggacaacguggucagcuucuucgaggccgccgagcggaagucccagggggugcccgugaucgacaagaacuacaaccacgacaagggcuggaacuuccuguucacgaugaagcagaacgaguacuucgucuuccccaacgaggugaccggguucaaccccagcgagguggaccucauggacgaggccaacuacuccaucaucagcccgaaccuguaccgcguccagaagaugagcaaggcguccggccgcgacuacugguuccggcaccaccuggaggccaugcucaacgacgaccccaagcugcgcaacagcauguucaagcggaucaccucccugaaggcccucgagggcaucgugaaggugcgcaucaacugcaucgggaagaucgucgccgugggcgaguacgacuga

SEQ ID NO: 2014 - RNA, 4128 nt, Artificial Sequence
  Cas9 variant
augagcaacaaguccuacagcaucggccuggacaucgggaccaacuccgugggcugggccgucaucaccgacgacuacaaggugcccagcaagaagaugaaggugcucgggaacacggacaagcacuucaucaagaagaaccugaucggcgcccugcuguucgacgaggggaccaccgcggaggaccgccggcugaagcgcaccgcccggcgccgguacacgcgccggaagaaccgccugcgguaccuccaggagaucuucucccaggagaucagcaaggucgacuccagcuucuuccaccgccuggacgacuucuuccuggugccggaggacaagcggggcuccaaguaccccaucuucgccacccucguggaggagaaggaguaccacaagaaguuccccaccaucuaccaccuccgcaagcaccuggccgacagcaaggagaagaccgaccuccggcugaucuaccuggcccucgcgcacaugaucaaguaccgcggccacuuccuguacgaggaguccuucgacaucaagaacaacgacauccagaagaucuucagcgaguucaucuccaucuacgacaacacguucgagggcaagagccuguccgggcagaacgcccaggucgaggccaucuucaccgacaagaucagcaaguccaccaagcgggagcgcgugcucaagcuguuccccgacgagaaguccaccgggcuguucagcgaguuccucaagcugaucgugggcaaccaggccgacuucaagaagcacuucgaccuggaggagaaggcgccgcuccaguucagcaaggacacguacgacgaggaccuggagaaccugcucgggcagaucggcgacgacuucgccgaccuguuccuggucgccaagaagcucuacgacgccauccugcugagcggcauccucaccgugaaggaccuguccaccaaggcgccccugagcgccuccaugaucgagcgguacgagaaccaccagaaggaccucgccgcccugaagcaguucauccagaacaaccugcaggagaaguacgacgagguguucagcgaccaguccaaggacggguacgccggcuacaucgacgggaagaccacgcaggaggccuucuacaaguacaucaagaaccuccugagcaaguucgagggcgcggacuacuuccuggacaagaucgagcgcgaggacuuccucaagaagcagcggaccuucgacaacggcuccaucccccaccagauccaccuccaggagaugaacgccaucauccgccggcagggggagcacuaccccuuccugcaggagaacaaggagaagaucgagaagauccugaccuuccgcaucccguacuacgucggcccccuggcccgcgggaacggcgacuucgccuggcugacccggaacagcgaccaggccauccgccccuggaacuucgaggagaucguggaccaggcguccagcgccgaggacuucaucaacaagaugacgaacuacgaccucuaccugcccgaggagaaggugcugccgaagcacucccugcucuacgagaccuucgccgucuacaacgagcugaccaaggugaaguucaucgccgaggggcugacccgguaccaguuccucgacaagaagcagaagaaggacaucuucgacacguucuucaaggccgagaacaagcgcaaggugaccgagaaggacaucauccacuaccugcacaacgucgacggcuacgacggcaucgagcugaaggggaucgagaagcaguucaacgcgagccucuccaccuaccacgaccugcugaagaucaucaaggacaaggccuucauggacgacagcaagaacgaggagauccucgagaacaucauccacacccugacgaucuucgaggaccgggagaugaucaagcagcgccuggcccaguacgacucccucuucgacgagaaggugaucaaggcccugacccggcgccacuacaccggcugggggaagcugagcgcgaagcucaucaacggcauccgggacaagaaguccgggaagaccauccuggacuaccugaucgacgacggcgagaucaaccgcaacuucaugcagcucauccacgacgacggccugagcuucaaggagaucauccagaaggcccagguguucgggaagacgaacgacgucaagcaggucgugcaggagcugcccggcucccccgccaucaagaaggggauccuccagagcaucaagaucguggacgagcuggugaaggucaugggccacgcccccgagagcaucgugaucgagauggcccgggagaaccagaccaccgcgcgcgggaagaagaacucccagcagcgguacaagcgcaucgaggacagccugaagaaccucgccuccggccuggacagcaacauccugaaggagaacccgaccgacaacauccagcuccagaacgaccggcuguuccuguacuaccuccagaacggccgcgacauguacacggggaagccccuggagaucaaccagcuguccaacuacgacaucgaccacaucaucccccaggccuucaucaaggacgacagccucgacaaccgggugcugaccuccagcaaggacaaccgcggcaaguccgacaacguccccagccuggaggugguggagaagaugaaggccuucuggcagcagcuccuggacuccaagcugaucagcgagcggaaguucaacaaccucaccaaggccgagcgcgagcgcgggggccugaacgagcuggacaaggucggcuucaucaagcggcagcucguggagacccgccagaucaccaagcacguggcgcaguuccuggacgcccgguucaacaaggaggucacggagaaggacaagaagaaccgcaacgugaagaucaucacccugaaguccaaccucgugagcaacuuccggaaggaguucgggcuguacaagguccgcgagaucaacgacuaccaccacgcccacgacgccuaccugaacgccgugcucgcgaaggccauccugaagaaguacccgaagcuggagcccgaguucguguacggcgacuaccagaaguacgaccuccagcgguacaucuccaagagccgcgagcccaaggaggucgagaaggccacccagaaguacuucuucuacuccaaccugcugaacuucuucaaggaggaggugcacuacgccgacgggaccaucgugaagcgggagaacaucgaguacagcaaggacacgggcgagaucgcguggaacaaggagaaggacuucgccaccgucaagaaggugcucagccugccccaggugaacaucgucaagaagaccgaggugcagaccgggggcuucuccaaggagagcauccugccgaagggcaacuccgacaagcucaucccccgcaagacgaaggagauccugugggacaccaccaaguacgggggcuucgacagccccgugaucgccuacuccauccugcucaucgccgacaucgagaaggggaaggccaagaagcugaagaccgucaagacgcuggugggcaucaccaucauggagaaggcgaccuucgagaagaaccccaucaccuuccucgagaacaagggguaccacaacgugcggaaggagaacauccugugccugccgaaguacagccucuucgagcuggaguccggccgccggcgcaugcuggccagcgccaaggagcuccagaagggcaacgagaucguccugcccguguaccugacgacccuccuguaccacuccaagaacgugcacaagcuggacgagcccgagcaccucgaguacauccagaagcaccgguacgaguucaaggaccugcugaaccucgucagcgaguucucccagaaguacgugcuggccgacgccaaccuggagaagaucaagaaccucuacgcggacaacgagcaggccgacaucgagauccuggccaacagcuucaucaaccugcucaccuucaccgcccugggggccccggcggccuucaaguuccugggcaaggacguggaccgcaagcgguacacgaccgucuccgagauccucaacgccacccugauccaccagagcaucaccgggcuguacgagacgcgcaucgaccucuccaagcugggcgaggacuga

SEQ ID NO: 2015 - RNA, 4128 nt, Artificial Sequence
  Cas9 variant
auggagaagaaguacagcaucggccuggacaucgggaccaacuccgugggcugggccgucaucaccgacgacuacaaggugcccagcaagaaguucaaggugcucgggaacacgaaccgcaaguccaucaagaagaaccugaugggcgcccugcuguucgacagcggggagaccgcggaggccacccggcugaagcgcaccgcccggcgccgguacacgcgccggaagaaccgcauccgguaccugcaggagaucuucgccaacgagauggccaagcucgacgacuccuucuuccagcgccuggaggagagcuuccuggucgaggaggacaagaagaacgagcggcacccgaucuucggcaaccucgcggacgagguggccuaccaccgcaacuaccccaccaucuaccaccuccggaagaagcuggccgacucccccgagaaggccgaccuccgccugaucuaccuggcgcucgcccacaucaucaaguuccggggccacuuccugaucgaggggaagcugaacgccgagaacagcgacguggccaagcuguucuaccagcugauccagaccuacaaccagcuguucgaggagagcccccucgacgagaucgaggucgacgccaagggcauccuguccgcgcgccuguccaagagcaagcggcucgagaagcugaucgccguguucccgaacgagaagaagaacgggcuguucggcaacaucaucgcccucgcccuggggcugacccccaacuucaaguccaacuucgaccucacggaggacgccaagcugcagcugagcaaggacaccuacgacgacgaccucgacgagcugcugggccagaucggcgaccaguacgcggaccucuucuccgccgccaagaaccugagcgacgccauccugcucuccgacauccugcgcagcaacuccgaggugaccaaggcgccccugagcgccagcauggucaagcgguacgacgagcaccaccaggaccucgcccugcugaagacccucgugcgccagcaguuccccgagaaguacgccgagaucuucaaggacgacacgaagaacggguacgccggcuacguggggaucggcaucaagcaccggaagcgcaccaccaagcuggccacccaggaggaguucuacaaguucaucaagccgauccuggagaagauggacggcgcggaggagcuccuggccaagcugaaccgcgacgaccugcuccggaagcagcgcacguucgacaacggguccaucccccaccagauccaccugaaggagcugcacgccauccuccggcgccaggaggaguucuaccccuuccugaaggagaaccgggagaagaucgagaagauccugaccuuccgcauccccuacuacgucggcccgcucgcccgggggaacagccgcuucgcguggcugacccggaaguccgaggaggccaucacccccuggaacuucgaggaggugguggacaagggcgccagcgcccaguccuucaucgagcgcaugacgaacuucgacgagcagcugcccaacaagaagguccuccccaagcacagccugcuguacgaguacuucaccguguacaacgagcucaccaaggugaaguacgucaccgagcggaugcgcaagccggaguuccuguccggggagcagaagaaggccaucguggaccuccucuucaagacgaaccggaaggugaccgucaagcagcugaaggaggacuacuucaagaagaucgagugcuucgacagcguggagaucaucggcguggaggaccgcuucaacgcgucccugggcaccuaccacgaccuccugaagaucaucaaggacaaggacuuccuggacaacgaggagaacgaggacauccucgaggacaucguccugacccugacgcuguucgaggaccgggagaugaucgaggagcgccugaagaccuacgcccaccuguucgacgacaaggugaugaagcagcucaagcggcgccacuacaccggguggggccggcugagccgcaagaugaucaacgggauccgcgacaagcaguccggcaagaccauccuggacuuccucaagagcgacggguucuccaaccggaacuucaugcagcugauccacgacgacagccugacguucaaggaggagaucgagaaggcccaggucuccggccagggcgacagccuccacgagcagaucgccgaccuggccgggucccccgcgaucaagaagggcauccugcagaccgugaagaucguggacgagcucgucaaggugauggggcacaagcccgagaacaucgugaucgagauggcccgcgagaaccagaccaccacgaagggccugcagcagagccgggagcgcaagaagcggaucgaggaggggaucaaggagcuggagucccagauccucaaggagaaccccgucgagaacacccagcugcagaacgagaagcuguaccucuacuaccugcagaacggccgcgacauguacguggaccaggagcuggacaucaaccggcucagcgacuacgacguggaccacaucgucccgcagagcuucaucaaggacgacuccaucgacaacaaggugcugacccgcagcguggagaaccggggcaaguccgacaacguccccagcgaggagguggugaagaagaugaagaacuacuggcgccagcugcucaacgccaagcugaucacccagcggaaguucgacaaccugaccaaggccgagcgcgggggccucuccgaggccgacaaggcgggguucaucaagcggcagcuggucgagacgcgccagaucaccaagcacguggcccggauccuggacagccgcaugaacaccaagcgggacaagaacgacaagcccauccgcgaggugaaggucaucacccucaaguccaagcuggugagcgacuuccggaaggacuuccagcuguacaaggugcgcgacaucaacaacuaccaccacgcccacgacgccuaccucaacgcggucgugggcacggcccugaucaagaaguaccccaagcuggaguccgaguucguguacggcgacuacaaggucuacgacgugcggaagaugaucgccaagagcgagcaggagaucgggaaggccaccgccaagcgcuucuucuacuccaacaucaugaacuucuucaagaccgaggugaagcucgcgaacggcgagauccgcaagcggccgcugaucgagaccaacggggagacgggcgaggucguguggaacaaggagaaggacuucgccaccgugcgcaagguccuggccaugccccaggugaacaucgugaagaagaccgagguccagaccgggggcuucagcaaggaguccauccucagcaagcgggaguccgccaagcugaucccccgcaagaagggcugggacacgcggaaguacgggggcuucgggagccccaccguggccuacuccauccugguggucgcgaagguggagaagggcaaggccaagaagcucaagagcgugaagguccugguggggaucaccaucauggagaagggcagcuacgagaaggacccgaucggcuuccuggaggccaagggguacaaggacaucaagaaggagcucaucuucaagcugcccaaguacucccuguucgagcucgagaacggccgccggcgcaugcuggccagcgccaccgagcugcagaaggcgaacgagcucgugcugccccagcaccugguccggcuccuguacuacacgcagaacaucuccgccaccaccgggagcaacaaccugggcuacaucgagcagcaccgcgaggaguucaaggagaucuucgagaagaucaucgacuucuccgagaaguacauccucaagaacaaggugaacagcaaccugaaguccagcuucgacgagcaguucgccguguccgacagcauccugcucuccaacagcuucgucucccugcugaaguacaccagcuucggggccuccggcggcuucacguuccucgaccuggacgugaagcaggggcggcugcgcuaccagaccgugaccgagguccucgacgcgacccugaucuaccagagcaucacgggccuguacgagacccggaccgaccucucccagcucgggggcgacuga

SEQ ID NO: 2016 - RNA, 4128 nt, Artificial Sequence
  Cas9 variant
augaagaagauccugggccucgaccuggggaccaccagcaucggcugggcccuggugaacgaguccgagaacaaggacgagcagagcuccaucguccgccucggggugcgggugaucccccugacggucgacgagaagggcaacuucgagaaggggaaggccaucaccaccaacgcggaccgccagcagguccacgccgcccggaucaaccugcagcgcuacaagcuccggcgcgagaaccugcgggacugccugcagaagcagggcuggaucggcagcgagccgaugugcgaggacgggaaguccagcaccuucgagacguacaagcuccgcgccaaggccgcgguggaggaggugucccugcacgaguucgcccgggugcuguucaugcucaacaagaagcgcggcuacaagagcaaccggaaggccaacgacaaggaggaggggaagcuguucgacggcaugaccaucgccaagaagcuguacgaggagcaccucacccccgcggaguacucccugcagcugcucaacaccgggcgcaaguucacgcccgaguacuaccggagcgaccugaucgaggaguucgagaagaucuggaacgagcagcagaaguacuaccccgagauccugaccgacgaguucaagcagcagcucgagggcaaggccaaguccaacaccagcaagcuguuccugggcaaguacgggaucuacuccgccgacaccaagggccucgaccgccggcugcagccgcugaaguggcgcguggaggccaugaagcagcaggucgacaaggacgugcucgccuucgugaucagcgaccugaaggggcagaucgcgaacacguccggccugcucggcgccaucagcgaccgguccaaggagcuguacuucagcaagcagaccaucgggcaguaccugugggccucccuccaggagaacccccacaucagcaucaagaaccagcccuucuaccgccaggacuaccuggacgaguucgagaagaucugggagacccaggccaccuaccacaaggagcugacgagcgagcucaagcaggagauccgggacaucaucaucuucuaccagcgcccccugaaguccaagaagaaccugaucgccgucugcgagcucgagcagcggaaggugaaggugaccgucgacggcaaggagaaggagaucaccaucgggccgaagaucgcgcccaagagcucccccauguuccaggaguuccgcaucuggcagaaccugaacaacauccugcuccuggaccacgagaccaacagcaagcgcccccuguacgaggaggagcggaaccuccuguacgaggagcuguccgugaaggagaagcucagcaagacggaggcccugaaggugcugggcaagaaguccaagcagugggaccugaacuacaaggagcucgaggggaaccgcacccaggccguccuguacgacugcuacaaccggaucaucgugaugagcggccacgaggagugcaacuucaagaagcugaaggccuccgacauccgccacuacgugaagaugaucuucaagaaccucgccuucaacaccgacauccugugcuucgacagcucccugaagggccacgagcucgagcggcagccgaugugccagcuguggcaccuccuguacagcuacgagggggacaacucccgcaccggcaacgacgcgcugcugcggaagcucgagacgagcuucggguuccccaaggaguacgccgccguccuggccgacgugaucuucgaggacuccuacggcaaccugagcgugaaggccaugcgcaacauccucccccaccuccaggcggggaaggacuacucccaggccugcgaggaggccggcuacaagcacagccggcgcucccugaccaaggaggagcugaaccagaaggucuacaaggagaagcuggagcugcuccccaagaacagccugcacaacccgguggucgagaagauccugaaccagauggugaacgugaucaacgccgucaucgaggaguacggcaagcccgacgagauccggaucgagcucgcgcgcgaccugaagaucggggccgccgagcgggagaacaugacccgcagcaucaaccagggcaacgccgagaacaagcggauccgcgagauccuggagaaggaguucgcccucuccuaccugagccggaacgacaucaucaaguacaagcuguacgaggagcucaaguccaacggguucaagacccuguacagcgacacguacaucuccaaggacaagcuguucagcaaggacuucgacaucgagcacaucauccccaaggcgcgccucuucgacgacucccugagcaacaagaccaucgaggcccgggacgugaacaucgccaaguccaacaagaccgccuucgacuucauccuggagcgcuacggcgagcagggggugaagaccuacaagacgaagcuccugcgccugcucgaggacggcgccaucagcaacaagaaguacaacaaccugcugaagaccgaggcggacauccccuccggcuucaucgaccgggaccuccgcaacacccaguacaucgccaagaaggccuacgagauccugagcgagcuggucaagaucgugaccccgacgaccggguccgugaccaaccggcuccgcgaggacuggcagcuggucgacgugaugaaggagcugaacuucgagaaguaccagaagcucggccuggccgacgugaucgaggaccgggacgggcgcaaggucaagcggaucaaggacuggaccaagcgcaacgaccaccggcaccacgccauggacgcgcugaccaucgccuucacgaagcccagcuacauccaguaccucaacaaccugaacgcccgcuccgacaagagcuccagcaucuacggcaucgaggugaaggagcugcaccgggaggagggcaaguuccgcuucaacgcgccccuccccaucaacgaguuccgggccgaggccaagcgccaccucaagagcgugcuggucuccaucaaggccaagaagaaggugaugacccagaacgugaacaagaucaagaccaagcacgggaucaucaagaagguccagcugaccccgcggggcgagcugcacaacgccacguacuacgggaccaagaagcgcccccuggugcggauggugaaggucggcgccgcgcucgacgaggccaccaucaagcgcgugugcagccccgccauccgggccgcccugcugaagcgccucaacgcguacaacggggacgccaaggaggccuucaccggccggaacuccaucgacaagaaccccaucuaccuggacaucgagcagacgaagcuggugccgguccucgugaagaccaucgaguggggcauguaccaccccauccgcaagcgcaucacccccgaccugaagaucgacaaggugaucgacaaggggauccgggagaagcugaaggcccgccucgccgaguucaacggcgacgcgcagaaggccuucagcaaccuggacgagaacccgaucuacauggacgaggccaagcggaucacccugaagcgcgucuccaucgagggggugcucagcgccaucccccugcacacgcugaaggacaaggcgggcaagcccgugaucggguccgacggcaagcccgucuucggcgacuacgugcagaccagcaacaaccaccacaucgccuucuacaucgacgacaaggggaaccuccaggacaacccgguguccuucuucgaggccgccgagcgcaagagccagggcguccccgugaucgaccggcgguacaacugcgacaagggguggcacuucguguucaccaugaagcagaacgaguacuucgucuuccccaacgaggccaccggcuucauccccuccgagguggaccugcuggacgaggcgaacuacugcaucaucagcccgaaccucuaccgcgugcagaagcuguccaaggccagcgggcgggacuacugguuccgccaccaccuggagacgaugcucaacgacgaccugcggcugaagaacuccaccuucaagcgcauccagagccucaagggccuggaggacaucgucaaggugcggaucaacuccaucggcaagaucguggccgucgggaaguacgacuga

SEQ ID NO: 2017 - RNA, 4128 nt, Artificial Sequence
  Cas9 variant
auggagaccaaguucaccuacuaccugggccucgacauggggacggacagccugggcugggccgugaccgacuccagcuaccacauccugcgcgccaaggggaaggaccucuggggcguccggcuguuccccgcggccgagaccuccguggaccgccggaccuaccgcgugaaccggcgccggcgccagcgggaggucgcccgcaucggggcccugaaggagcuguucgccgacgagaucgagaagguggacccgggcuucuucgugcggcuggacgagagcaaguuccacauggaggaccgcuccgagaacaacaagcagaaguacggccuguucgcggacaagcuguucagcgacgccgaguacuacaagaaguaccccacgaucuuccaccuccggaaggagcuccucgaguccgaggagccccacgacguccgccugguguaccuggcccuccugaacauguucaagcaccgggggcacuuccugaacagcucccuccagaucgagggcgagaacagcaacaucgccgaguccuaccagauguucguggacacccugaaggacgaggagcuggacuuccccgagcaggucagcggggagcgccuccaggagaucuuccgguccagcgacucccgcaagaagaagguggagaaccugcuggcggagaugaaccucagcaagaagcagaagcgggagauccaguucgugaaccugaucugcggccugaaggggaagcucuccgagcuguucccggacaaggaguacgacgaggagcagaagaagaucgccuucagcuuccaggacuccgacuacgaggacaaggagaacaccauccaggagcugcucgacgagagcgagaugaacaugaucuacgccgucaaggccgugcacgacagcggcgugcuguccggcaucaugaacggggagcgcuaccugagcgucgcccggguggcguccuacgagaagcacaagaaggaccuccagauccugaaggacauccugaagaaguacgacaccaaggaguacuucgagauguuccgcaacgagagcgagaaguccgagaacuacagcgccuacgugggcuccgucaaguaccacgggacguuccgccggggccucagcggcgggaagcaggaggaccuguacaagcacaucaagaaggugcugggcaaguucccccaggacgacgagggggugaccuacguccucgaggagaucgagaccgaguccuuccugcccaagcagcugaccgccagcaacggcgugauccccaaccaggugcacgcccgcgagaugcucgccauccugaagcacgcggagcuguaccucccguuccugcaggagaaggacgacacggggcuguccgucagcgagaagauccucaagcuguucauguuccagauccccuacuacgugggcccccugggccaggaguacaaggacaagaagggguacaacgucugggccgagcggaaggagcccggcaagaucuacccguggaacuucgaggagaagaucgacgugaagaaguccgccgagaaguucaucgggcgcauggugcggcgcugcaccuaccugagcggcgagcaggcccuccccaagcagucccugcuguacgagaaguuccagguccucaacgagcugaacaaccugcggauccgcggggagaagauccccgugagccucaagcaggagaucuaccacgaccuguucggcgacggcaagaagguguccaugacccggcugaccaacuaccuccugcagaacggggucaucagcuccgaggagaaggacagcugcaucagcggcaucgacgggggcuuccacaacucccugagcuccguggggaaguucaagggcguguucggcgacacgguccacaccgacgagcaccgcaagaugaucgaggacaucaucuucugggggaccguguucggcgacgggaagaagcuccugaaggagaagguggaggaggucuacggcaaccagcugaccgaggcccagaagaagcggaucuucggcuucaaguucagcggguggggccgccucuccaaggcguuccugacgauggagggggccagcaaggacaacggcgagaucaaggggcugauccaggccaugugggacaccaacugcaaccucauggagcugcuguccgagcgguucaccuacaaggacaagcucaacgagauggugaccacggccgagaagccccugugcgaguggaagaucgaggaccuggacgagauguaccucagcgccccggugaagcgcauggucuggcagaccauccgggugguggacgagguccagcagaucaugggcugcccgcccaagcgcaucuucguggagaugacccgguccgacggcgagaaggggaagcgcaccgugagccggcagaagaagcuggucgaccuguacaaggcgcucggcaaggaggggaagaucugguccgaggagcugaacaacacgcccgagggccaguuccgcaucaagaagcuguaccucuacuaccugcagauggggaagugcauguacaccggcgagagcaucgagcuggagccccucaugaacgacaaccaccuguacgacaucgaccacaucuacccccgccacuucaucaaggacgacaacaucuccaacaaccuggugcucgugaagaaggagcggaacgcccacaagagcgacuccuuccccaucgagcccgagauccgcaacaagaugaugccguucuggaagucccugcggaagaagggcuuccugaccgaggagaaguacaaccgccucacccggaugagcgccuucacggacgaggagaaggccgcguucaucagccgccagcuggucgagaccagccaggggaccaaggccaucacccagaucuucaagcaggccuucgccgacuccgagaucguguucagcaaggccuccguggucagcgcguuccggcagaaguucgacugcuacaaggugcgcugcgugaacgacuaccaccacgcccacgacgccuaccugaacaucgucgccggcaacacguaccgggugaaguucaccuccaacccccucaacuucaucaaggaggccaagaagaaccccaacagccgcgagaaccgguacaacauggacaagaccuucgagugggacgugacccgcaacggggagaccgcgugggucgcccaguccaacgagaaccccggcacgauccagcuggugaagaaguaccugaacaagaacagcccgcucaucaccaagaugguguacgagaagcacgggggcaucacccagaaggccaccaucugguccgccaagaaggccgagagcggcaacacggacgcguacauccccgucaagaugaacgacccccggcuggccgacgugaccaaguacgggggcgugaccaccaucgccgucgccggguacacgcugcucgaguacaaggcgggcgggaagaccgugcgcucccuggaggcccugccgaucuaccucggcggcagcaagaaccugaccgaggagcagaugguggaguacuucuccaacauccugcagcaggagaacaaggagaaggucgugagcgacgugaucauccggaagaagaugauccccuccgggagccucaucaaguacaacggcuucuacuacuaccuggccgggaagaccggcaaccgcaucguccugaucuccgccgugcagcucugccugcccauggacacgaugcuguacaucaagaagaucgagaaggccugcagcaccggcaacuucgaggagaaggacaagaacgggaagcagguccucuccaagcagcagaacgaguucguguacgagcugaucaucgagaaguaccagcagagcaucuucaagaagaaggugggcgcgaucggggacaccaucaucgagaagcgggagaaguucgccgagaucagccuggaggagcagugcaaggugcucaugcagaucuuccugaacuuccaguccggcaucggggucgaccugaccagcguggacggcuccaacaagagcggcgucacguaccucaacaagaagaucaugaacgcccaggagcugaagcugaucgaccaguccgugaccgggguguucagccgcgagaucgaccuccugaccaucuga

SEQ ID NO: 2018 - RNA, 4128 nt, Artificial Sequence
  Cas9 variant
augagcaacaaguccuacagcaucggccuggacaucgggaccaacuccgugggcugggccgucaucaccgacgacuacaaggugcccagcaagaagaugaaggugcucgggaacacggacaagcacuucaucaagaagaaccugaucggcgcccugcuguucgacgaggggaccaccgcggaggaccgccggcugaagcgcaccgcccggcgccgguacacgcgccggaagaaccgccugcgguaccuccaggagaucuucuccgaggagaugagcaaggucgacuccagcuucuuccaccgccuggacgacuccuuccuggugccggaggacaagcggggcagcaaguaccccaucuucgccacccucgccgaggagaaggaguaccacaagaaguuccccaccaucuaccaccuccgcaagcaccuggccgacuccaaggagaagaccgaccuccggcugaucuaccuggcgcucgcccacaugaucaaguaccgcggccacuuccuguacgaggagagcuucgacaucaagaacaacgacauccagaagaucuucuccgaguucaucagcaucuacgacaacacguucgaggaguccagccugaucgggcagaacgcccagguggaggccaucuucaccgacaagaucuccaagagcgcgaagcgggagcgcguccucaagcuguuccccgaccagaaguccaccggccuguucagcgaguuccucaagcugauccuggggaaccaggccgacuucaagaagcacuucgaccucgaggagaaggccccgcugcaguucagcaaggacaccuacgacgaggaccuggagaaccuccugggccagauccgggacgacuucgccgaccuguuccucguggccaagaagcuguacgacgcgauccugcucuccgggauccugacggugaaggaccugagcaccaaggcgccccucuccgccagcaugaucgagcacuacgagaaccaccagaaggaccuggccgcccugaagcaguucauccagaacaaccuccaggagaaguacgacgaggucuucuccgaccagagcaaggacggcuacgccggcuacaucaacgggaagaccacccaggaggccuucuacaaguacaucaagaaccugcuguccaaguucgagggcgccgacuacuuccucgacaagaucgagcgcgaggacuuccugcggaagcagcgcacguucgacaacgggagcaucccccaccagauccaccuccaggagaugaacgccauccugcaccggcagggcgagcacuaccccuuccugaaggagaacaaggagaagaucgagaagauccugaucuuccgcaucccguacuacgugggcccccucgcccgcgggaaccgggacuucgcguggcugacccgcaacuccgacgaggccauccggcccuggaacuucgaggagaucguggacaaggccagcuccgccgaggacuucaucaacaagaugaccaacuacgaccuguaccugcccgaggagaagguccucccgaagcacagccugcuguacgagaccuucgccguguacaacgagcucacgaaggugaaguucaucgcggagggccugacccgcuaccaguuccuggacaagaagcagaagaaggacaucuucuacaccuucuucaaggccgaggacaagcggaaggucaccgagaaggacaucauccacuaccuccacacgguggacggguacgacggcaucgagcuggaggggaucgagaagcaguucaacgccucccugagcaccuaccacgaccuccugaagaucaucaaggacaaggaguucauggacgacgacaagaacgaggccauccuggagaacaucgugcacacccucaccaucuucgaggaccgcgagaugaucaagcagcggcuggcgcaguacaacucccuguucgacgagaaggucaucaaggcccucacgcgccggcacuacaccggcuggggcaagcugagcgccaagcugaucaacgggauccgcgacaagaaguccggcaagaccauccucgacuaccugaucgacgacggggagaucaaccggaacuucaugcagcugauccacgacgacggccucagcuucaaggagaucauccagaaggcccagguguucgggaagaccaacgacgugaagcaggucgugcacgagcugcccggcucccccgccaucaagaagggcauccugcagagcaucaagaucguggacgagcucgucaaggugauggggcacgcgcccgagagcaucgucaucgagauggcccgcgagaaccagacgaccgcccggggcaagaagaacucccagcagcgcuacaagcggaucgaggacagccugaagaaccuggccuccgggcucgacagcaacauccugaaggagaacccgaccgacaacgugcagcugcagaacgaccgccucuuccuguacuaccugcagaacggccgggacauguacaccgggaagccccucgagaucaaccagcuguccaacuacgacaucgaccacaucaucccccaggccuucaucaaggacgacagccuggacaaccgcgugcucacguccagcaaggacaaccggggcaaguccgacaacguccccagccuggaggugguggagaagaugaaggcguucuggcagcagcugcucgacuccaagcugaucagcgagcgcaaguucaacaaccugaccaaggccgagcgcgagcggggcgggcucaacgagcuggacaaggucggcuucaucaagcgccagcugguggagacccggcagaucaccaagcacguggcccagauccucgacacccgcuucaacaaggaggucacggagaaggacaagaagaaccggaacgugaagaucaucacccugaaguccaaccuggugagcaacuuccgcaaggaguucgggcucuacaagguccgggagaucaacgacuaccaccacgcccacgacgccuaccugaacgcggugguggccaaggccauccugaagaaguacccgaagcucgagcccgaguucgucuacggcgaguaccagaaguacgaccugaagcgcuacaucucccggagcaaggaccccaaggacaucgagaaggccaccgagaaguacuucuucuacuccaaccugcucaacuucuucaaggaggaggugcaguacgcggacggcaccaucgccaagcgcgagaacaucgaguacagcaaggacacgggggagaucgccuggaacaaggagaaggacuucgccaccgugaagaagguccugagccugccccaggugaacaucgugaagaagcgggagguccagaccggcggguucuccaaggagagcauccucccgaagggcaacuccgacaagcugaucccccgcaagaccaaggacauccugugggagacgaccaaguacgggggcuucgacagccccgugaucgccuacuccauccuccugaucgcggacaucgagaagggcaagagcaaggagcugaagaccgugaagacccucgucgggaucacgaucauggagaaggccaccuucgaggagaaccccaucaccuuccuggagaacaagggcuaccacaacgugcggaaggagaacauccugugccucccgaaguacucccuguucgagcuggagaacgggcgccggcgccuccuggccagcgccaaggagcugcagaagggcaacgagaucgugcuccccgucuaccugaccacgcugcucuaccacuccaagaaccugcacaagcuggacgagcccgggcaccucgaguacauccagaagcaccggaacgaguucaaggaccugcugaaccucgugagcgaguucucccagaaguacauccuggccgacgcgaaccuggagaagauccagaaccucuacgccgacaacgagcaggccgacaucgagauccuggccaacagcuucaucaaccugcucaccuucaccacccugggcgccccggcggccuucaaguucuucggcaaggacaucgaccgcaagcgguacacgaccguguccgagauccugaacgccacccucauccaccagagcaucaccgggcuguacgagacgcgcaucgaccuguccaagcucggcgaggacuga

SEQ ID NO: 2019 - RNA, 4128 nt, Artificial Sequence
  Cas9 variant
auggagaaguccuacagcaucggccuggacaucgggaccaacagcgugggcugggccgucaucaccgacgacuacaaggugcccgccaagaagaugaaggugcucgggaacacggacaagaaguacaucaagaagaaccugcugggcgcgcuccuguucgacuccggggagaccgccgaggucacccgccugaagcggaccgcccgccggcgcuacacgcggcgcaagaaccggcuccgcuaccugcaggagaucuucgccaaggagaugaccaagguggacgagagcuucuuccagcggcuggaggaguccuuccucaccgacgacgacaagaccuucgacagccacccgaucuucggcaacaaggccgaggaggacgcguaccaccagaaguuccccacgaucuaccaccuccgcaaguaccuggccgacucccaggagaaggccgaccuccggcugguguaccuggcccucgcgcacaugaucaaguaccgcggccacuuccugaucgagggggagcugaacgccgagaacaccgacguccagaagcuguucaacguguucguggagaccuacgacaagaucgucgacgagagccaccuguccgagaucgagguggacgccagcuccauccugaccgagaaggugagcaagucccggcgccucgagaaccugaucaagcaguaccccacggagaagaagaacacccuguucggcaaccucaucgcccuggcccuggggcuccagcccaacuucaagaccaacuucaagcugagcgaggacgcgaagcugcaguucuccaaggacaccuacgaggaggaccucgaggagcugcugggcaaggucggggacgacuacgccgaccucuucaucagcgccaagaaccuguacgacgccauccugcucuccggcauccugacgguggacgacaacagcaccaaggccccgcuguccgcgagcaugaucaagcgguacguggagcaccacgaggaccucgagaagcugaaggaguucaucaagaucaacaagcugaagcucuaccacgacaucuucaaggacaagaccaagaacggcuacgccggguacaucgacaacggcgucaagcaggacgaguucuacaaguaccugaagaccauccugacgaagaucgacgacagcgacuacuuccucgacaagaucgagcgcgacgacuuccugcggaagcagcgcaccuucgacaacggguccaucccccaccagauccaccuccaggagaugcacagcauccugcggcgccagggcgacuacuaccccuuccugaaggagaaccaggccaagaucgagaagauccugaccuuccggauccccuacuacgugggcccgcuggcccgcaaggacucccgcuucgccugggcgaacuaccacagcgacgagcccaucacccccuggaacuucgacgagguggucgacaaggagaaguccgccgagaaguucaucacgcggaugacccucaacgaccuguaccugcccgaggagaaggugcucccgaagcacagccacguguacgagaccuucaccgucuacaacgagcugacgaagaucaaguacgugaacgagcagggggaguccuucuucuucgacgccaacaugaagcaggagaucuucgaccacguguucaaggagaaccgcaaggucaccaaggccaagcugcucagcuaccugaacaacgaguucgaggaguuccggaucaacgaccugaucggccucgacaaggacuccaagagcuucaacgccucccuggggaccuaccacgaccugaagaagauccucgacaagagcuuccuggacgacaagaccaacggccagaucaucgaggacaucgugcugacgcucacccuguucgaggaccgcgacaugauccacgagcggcugcagaaguacuccgacuucuucaccagccagcagcucaagaagcuggagcgccggcacuacaccggguggggccgccuguccuacaagcucaucaacggcauccggaacaaggagaacaacaagacgauccuggacuuccugaucgacgacgggcacgcgaaccgcaacuucaugcagcucaucaacgacgagagccuguccuucaagaccaucauccaggaggcccaggucgugggcgacguggacgacaucgaggccgucgugcacgaccugcccgggagccccgccaucaagaagggcauccuccaguccgugaagaucgucgacgagcuggugaaggugaugggggacaaccccgacaacaucgucaucgagauggcgcgggagaaccagaccaccggcuacggccgcaacaagagcaaccagcggcugaagcgccuccaggacagccugaaggaguucggguccgacauccugagcaagaagaagccguccuacguggacagcaagguggagaacucccaccuccagaacgaccggcuguuccuguacuacauccagaacggcaaggacauguacaccggggaggagcucgacaucgaccgccugagcgacuacgacaucgaccacaucaucccccaggccuucaucaaggacaacuccaucgacaacaagguccugacgagcuccgccaagaaccggggcaagagcgacgacgugcccuccaucgagaucgugcgcaaccggcgcagcuacugguacaagcucuacaaguccgggcugaucagcaagcgcaaguucgacaaccugaccaaggccgagcggggcggccucaccgaggccgacaaggcgggguucaucaagcgccagcuggucgagacccggcagaucacgaagcacguggcccagauccuggacgcccgcuucaacaccaagcgggacgagaacgacaaggugauccgcgacgucaaggugaucacccucaaguccaaccuggugagccaguuccggaaggaguucaaguucuacaagguccgcgagaucaacgacuaccaccacgcccacgacgccuaccugaacgcgguggugggcaccgcccuccugaagaaguaccccaagcugacgccggaguucgucuacggggaguacaagaaguacgacgugcggaagcucaucgccaaguccagcgacgacuacagcgagaugggcaaggccaccgccaaguacuucuucuacuccaaccugaugaacuucuucaagaccgaggugaaguacgcggacggccgcgucuucgagcggcccgacaucgagaccaacgccgacggggaggugguguggaacaagcagaaggacuucgacaucguccgcaaggugcugagcuacccccaggugaacaucgucaagaagguggaggcccagacgggcggguucuccaaggagagcauccucuccaagggcgacagcgacaagcugaucccccggaagaccaagaagguguacuggaacaccaagaaguacgggggcuucgacuccccgaccgucgccuacagcgugcugguggucgcggacaucgagaagggcaaggccaagaagcucaagacggugaaggagcugguggggaucuccaucauggagcgcagcuucuucgaggagaaccccgucuccuuccuggagaagaagggcuaccacaacgugcaggaggacaagcucaucaagcugcccaaguacagccuguucgaguucgagggcgggcggcgccggcuccuggccuccgccaccgagcugcagaaggggaacgaggugaugcuccccgcccaccuggucgagcugcucuaccacgcgcaccgcaucgacagcuucaacuccaccgagcaccugaaguacgugagcgagcacaagaaggaguucgagaaggugcuguccugcgucgagaacuucagcaaccucuacguggacguggagaagaaccuguccaagguccgggccgccgccgagagcaugaccaacuucagccuggaggagaucuccgccagcuucaucaaccuccugacgcugaccgcgcucggcgccccggccgacuucaacuuccugggcgagaagaucccccgcaagcgguacaccuccaccaaggagugccugagcgccacgcucauccaccaguccgugaccgggcuguacgagacccgcaucgaccugagcaagcucggcgaggaguga

SEQ ID NO: 2020 - RNA, 4128 nt, Artificial Sequence
  Cas9 variant
augaccaagaucaaggacgacuacaucgugggccuggacaucgggaccgacagcugcggcugggucgccaugaacuccaacaacgacauccucaagcugcaggggaagacggccaucggcagccgccuguucgagggcgggaaguccgcggccgagcggcgccucuuccggaccacccaccgccggaucaagcgccggcgcuggcggcugaagcugcucgaggaguucuucgaccccuacauggccgagguggacccguacuucuucgcccgccugaaggagagcggccugagcccccucgacaagcggaagaccgugagcuccaucgucuuccccacgagcgccgaggacaagaaguucuacgacgacuaccccaccaucuaccaccuccgcuacaagcugaugaccgaggacgagaaguucgaccuccgggagguguaccuggcgauccaccacaucaucaaguaccgcgggaacuuccuguacaacaccuccgugaaggacuucaaggccagcaagaucgacgucaaguccagcaucgagaagcucaacgagcuguacgagaaccugggccucgaccugaacguggaguucaacaucuccaacacggccgagaucgagaaggugcugaaggacaagcagaucuucaagcgggacaaggucaagaagaucgccgagcuguucgcgaucaagaccgacaacaaggagcagagcaagcgcaucaaggacaucuccaagcaggucgccaacgccgugcugggguacaagacccgguucgacaccaucgcccugaaggagaucagcaaggacgagcucuccgacuggaacuucaagcugagcgacaucgacgccgacuccaaguucgaggcgcugaugggcaaccucgacgagaacgagcaggccauccugcugacgaucaaggagcuguucaacgaggugacccucaacgggaucguggaggacggcaacacccugagcgagagcaugaucaacaaguacaacgaccaccgcgacgaccucaagcugcugaaggaggugaucgagaaccacaucgaccggaagaaggccaaggagcucgcccuggccuacgaccuguacgucaacaaccgccacggccagcuccugcaggcgaagaagaagcuggggaagaucaagccgcgguccaaggaggacuucuacaagguggugaacaagaaccucgacgacagccgcgccuccaaggagaucaagaagaagaucgagcuggacagcuucaugcccaagcagcgcaccaacgccaacggcgucauccccuaccagcugcagcagcucgagcuggacaagaucaucgagaaccaguccaaguacuaccccuuccugaaggagaucaacccggugagcucccaccucaaggaggcccccuacaagcuggacgagcugauccgguuccgcgugcccuacuacgucgggccccugaucagcccgaacgaguccacgaaggacauccagaccaagaagaaccagaacuucgccuggaugauccggaaggaggagggccgcaucacccccuggaacuucgaccagaagguggaccggaucgagagcgcgaacaaguucaucaagcgcaugaccacgaaggacaccuaccucuucggcgaggacgugcugcccgccaacucccugcucuaccagaaguucaccguccugaacgagcugaacaacauccggaucaacgggaagcgcaucagcguggaccucaagcaggagaucuacgagaaccuguucaagaagcacaccacggucaccgugaagaagcuggagaacuaccucaaggagaaccacaaccuggugaaggucgagaucaagggccuggccgacgagaagaaguucaacuccgggcucaccaccuacaaccgguucaagaaccugaacaucuucgacaaccagaucgacgaccugaaguaccgcaacgacuucgagaagaucaucgaguggagcacgaucuucgaggacaaguccaucuacaaggagaagcuccggagcaucgacuggcugaacgagaagcagaucaacgcccuguccaacauccgccuccagggcugggggcggcugagcaagaagcugcucgcccagcugcacgaccacaacggccagaccaucaucgagcagcugugggacucccagaacaacuucaugcagaucgugacccaggcggacuucaaggacgccaucgccaaggccaaccagaaccuccugguggcgaccagcgucgaggacauccugaacaacgccuacacgagccccgccaacaagaaggccauccgccaggugaucaagguggucgacgacaucgugaaggccgcguccggcaaggugccgaagcagaucgccaucgaguucacccgggacgccgacgagaaccccaagcgcagccagacccggggguccaagcuccagaaggucuacaaggaccugagcaccgagcuggccuccaagacgaucgccgaggagcucaacgaggcgaucaaggacaagaagcuggugcaggacaaguacuaccuguacuucaugcagcucggccgcgacgccuacaccggggagcccaucaacaucgacgagauccagaaguacgacaucgaccacauccugccccagagcuucaucaaggacgacgcccuggacaaccgggugcucgucucccgcgccgugaacaacggcaagagcgacaacgugccggucaagcuguucgggaacgagauggccgcgaaccugggcaugaccauccgcaagaugugggaggaguggaagaacaucggccucaucuccaagaccaaguacaacaaccugcugaccgaccccgaccacaucaacaaguacaagagcgccggguucauccggcgccagcucguggagacgucccagaucaucaagcuggugagcaccauccugcagucccgguaccccaacaccgagaucaucaccgucaaggccaaguacaaccacuaccuccgcgagaaguucgaccuguacaagagccgggaggugaacgacuaccaccacgccaucgacgcguaccuguccgccaucugcggcaaccuccuguaccagaacuaccccaaccugcgcccguucuucguguacgggcaguacaagaaguucagcuccgaccccgacaaggagaaggccaucuucaacaagacgcggaaguucagcuucaucagccagcuccugaagaacaaguccgagaacagcaaggagaucgccaagaagcugaagcgcgccuaccaguucaaguacaugcucgucucccgggagaccgagacccgcgaccaggagauguucaagaugaccguguacccccgguucagccacgacacggugaaggcgccccgcaaccugaucccgaagaagaugggcaugucccccgacaucuacgggggcuacaccaacaacagcgacgccuacauggucaucgugcggaucgacaagaagaagggcaccgaguacaagauccuggggauccccacccgcgagcucgugaaccugaagaaggccgagaaggaggaccacuacaaguccuaccugaaggagauccucacgccgcggauccuguacaacaagaacggcaagcgcgacaagaagaucaccagcuucgagaucgucaaguccaagauccccuacaagcaggucauccaggacggggacaagaaguucaugcugggcagcuccaccuacguguacaacgccaagcagcucacccugagcacggaguccaugaaggccaucaccaacaacuucgacaaggacagcgacgagaacgacgcgcugaucaaggccuacgacgagauccucgacaagguggacaaguaccugccccuguucgacaucaacaaguuccgggagaagcuccacuccggccgcgagaaguucaucaagcugagccuggaggacaagaaggacaccauccucaaggugcuggaggggcugcacgacaacgccgugaugaccaagauccccacgaucggccucuccaccccgcugggguucaugcaguuccccaacggcgucauccugagcgagaacgccaagcucaucuaccagucccccaccgggcuguucaagaaguccgugaagaucagcgaccuguga

SEQ ID NO: 2021 - RNA, 4131 nt, Artificial Sequence
  Cas9 variant
augagcaacuucgacaaccacaaggacuccaucugcaagcacaagggccugaagaaggggaacuacuacaucggccucgacaucgggaccaacagcgugggcugggccgccaccaacgagcaguacgagcugcugaaguucaagucccacaagaugugggggagccgccucuucgcggaggcccagacggccgucgacacccggaugaagcgcuccgcccggcgccggcugcagcgccggaaguuccgccugauccuccuggagagccuguucuccaaggagaucaacgccguggacgagaccuucuucaugcggcuccacgagagcaacuaccacguggaggacaagaccaaccuggucaaguacacgcuguucaucgacaagaacuacaccgacguggacuacuacaaggaguuccccaccaucuaccaccuccgccaccaccugaugaccgagggcacgaaggacauccggcugcuguuccuggcgauccaccacauccugaaguaccgcggcaacuuccucuacgggaagaaggaguucuccguggacggcgagauguacagcguccugcgguccacccuggaggagcucggguucggcagcuacguggaggacgagaacgugcugcaguccaucgccaaccugguccucgaccgcgggaucgcccggagcgagaaggugaagcagaucgagccgcugaucgcccagggcaagaagcuguccagcguggagaagaaccgccucaaggcgugggccuaccugaucaugggccugaaggccaaccucgucaaccuguucaccgacgaggacguggaggugguccugcccgaggagaaggaguucaaguccaucaaccuccacgaggggaucuacgaggacgugcgggacgccuacgaggacgccuggggcgaccgcuucgcgaucguggaccagugcaagguccugcacgacaucaucgugaucagcuccaucaucaagcccgggcagagccugagcgaggccaagaucgaguccuacaaccagcacaaggaggaccucgugcugcucaagagcguccucaaggaggacaagaagcuguacgacgacauguucgugguggacaucgacaagggcaccaacuacgucaaguacaucaagcagggcgugaacgggaacacguccaccacccaggaggccuucuacaaguacguccggaagguggugagcguccugcccgagaccgagaacacgcgcugcaucgugcagaagcucgaggagggcaccuuccugccgcugcagcggaucuccaagaacggggugguccccuaccagcuccacaaggaggagcuggugcgcauccuggagaaggccaagcucaacuuccccuuccugaacgagguggaggacggccugaccgucgccgacaagaucaucagcauccuggaguucaagauccccuacuacguggggccgcucaaccccacccacuccaucgagaacggcggcuucgcgugggugguccgcaaggaggccggccaggugcugcccuggaacuucgagcagaagguggacguccaggccagcgccgugaaguucaucgagaaccugacgaacaagugcaccuaccucaucgaccaggacgugcugcccaaguacucccugcucuacgccgaguucagccugcugaacgagcucaacaacauccgggucaacgacaagccgcugcccgcggacgugaagcaggccuucauccgcgaccacuucaucucccugcaggacagcaagaccgccaccaagaagguggucgccaaguaccucguggacaacaacuacgugucccagccgcccaucaucacggggauggaccagcagaucgccaccaagcugaccagccaccgggacaugacccgcauccugggggagcacuucgacuacgcgauggccgaggacaucauccgguacaucacgaucuucggcgaguccaaggacaugcuccgccagguccugaagaacuacuacggggaccggcugaccaccgagcagaucaagaagcucggcaagcugaccuacacgggcugggggcgccugagcaagaaguuccucuccgacaucuggggcaugaagaagaacgacgacgacgccgaggccgggaccaucaucgagcacaugcgggagggccaggagaaccugaugcagcugcucagcuccagcuacagcuucaucgacguggugcaggaguacgucaccaacgugcugggggcgaaggagaagaccgccuucgagaugcuggaggaccucucccugagccccauggugaagcgcuccgucuggcagacgcugcggauccucgacgagaucgugagcauccgcaaggagcugcccaagaagaucuucguggaggucgcccggaccaacaaggccgacaagaagcgcacccagucccggaaggcccugcucgaggagcuguacgagcagaucaaggacgaggacgugcacgugcugcagcaggagcucgagagcaaggaggacuccgcgcugaacagcaagaagcuguaccucuacuucacccagaugggccgcugcauguacuccggccggcgcaucgacauccacgagcuguucaccgacacguacgacaucgaccacaucuacccccggagccugaccaaggacgacuccuggcacaacaucguccucguggagaagcagcugaacgccgagaagaccgaccgcuuccccauccugagcgccauccaguccaagcagaagggguucuggaagcuccugugggaccgcggcuucaucagcgagaagaaguacgaccggcuggugcgcaccacggaccucaccgacgaggagcugaaccaguucaucaaccggcagaucgucuccaccaaccagagcgugaaggccgugaccacgcugcuccaccagcuguacccggagaccgaggucguguucuccaaggccgagaacaucagcgacuuccgccgggacuacggguucgugaagguccgcagcaucaaccaccaccaccacgcgaaggacgccuaccugaacaucguggugggcaacgucuaccacgagaaguucaccaagaacuuccucuccuucgccaagcagaagggcacccaccggacguacaaccugaccaagauguucgaguacgagaucaagcugaccgaggagagcaagaaggugaucugggaccccaacauccacauggacaucgugaagaagaugaugaaguccaacgacguccgcgugacccagcgggccgucccccagaagggcgggcucagcgacgagacgaucuacaagaaggggaucgccaagcgcggcguguaccugccccugaaguccagcgacgagcgggugcgcgacgucgagaaguacgggggccggaccuccaucaccaucagcgaguacaucauccucaacauccgcgacaccuccgaccaggaccggaucgagaucuucagccugccgcuguacaucgcgggcaagaaggacauccacaaggccaucgaggaggccuaccucuccacgugcaagaagcccgccagcgugguggacauccagauccuguaccgcgggcuguacaucggcuccaaggucaacaucaacggguucaccuacuacaugggcgggaagaccggcagcaacguguccguggacagcgcggucgacguggugauggacaucaccuccagcgucuacaucaagcuccuggagaagguggccaucaagaagaucgagaacuccaagacguuccggaucgagaacaucaagaccagcuacaaccacaaggaggugaccgucagcaaggagcagaacaucgcccuguaccaggagcuccugaagaagcuggacacgccccucuucuccaagaugaagggcaacaagcuggaggaguuccgcaccgugggguucgacaccuucaucgcccugagccucgaggaccaggccuccgugcugcuggagguccucaacgugcugaccaacuucaagaccaagcgggacaucacgaagaucggcaugaccagcucccgcagcacccuggggaucaacaucuccaacaccgagcaguucagcgugaucacgaccuccaucaccggccucuacgagcaggagaucaagaucaaguga

SEQ ID NO: 2022 - RNA, 4131 nt, Artificial Sequence
  Cas9 variant
augaccaccaagaaccgcgagaagaacaacaaguuccacaaggccagcccccuguacacgcucggccuggacaucgggaccaccuccgugggcuucaccgccaucgacgaggcgcagcggccgaugcgcgccaaggggaagacggucaucggcgugcggcuguuccaggaggggcagagcgccgugggccgcaagaacuuccggaccacccgccggcgccucaagcggcgccggcgccggcugaaccugcucaagcaguucuucuccgcgccccugcgcaagaucgaccccaccuucuucaagcggcugaaggccagcucccucagccccgccgacaagcgccgguaccuggccccgggccuguuccccaacgggggcgacaucaaguucuaccagaaguaccccacgaucuaccaccuccgccuggcccugaugaccgagaagcggcccuucgaccuccgcgaggucuaccuggccauccaccacaucgugaaguaccgggggaacuuccugaacccgcuccccguguccgcguuccgcggccgcaaccagcgguucgaggaccaguucagcgagcugaaccagcuguacaagucccucgagggggagagccccuuccaguucgacgagaagaucuucuccgagcuggacaagcagcugcucgucaacgacggccgcaagaucgaccggcagaagcagcuggccaagcgcguguucaucaagaccaacgagaagcggaucgacagccaccaccagaagaucgccuccgccuucagcaaggccguguucggcuacaaguuccgccccgacguccugcucaacuccgacccgaacgagagcaucgacgaguucaucaaguucggggacgaggacuucgacgacaagcuggugauccugcgggagucccucaacgcgacccagaaggagauccuggccgugacgcagcgcaucuacagccagaucauccugaacgagaucguccccucccgggagacccucagcgaggccauggugagccgcuaccagaagcaccacuccgaccugcagcugcucaccgaggccugcaagaagaugaccaaggccaaggcggcccggauccaggccgccuacacggacuacaucggcaagggggacggccacaagcuggugcacgaccaguucgucgcccugaucaagaagaaccucgaccccagcgaggagggccgcgaccuggcggagcggcuggcccaggacgacuucaugccccuccagcgcaccccgcugaaccgggugaucccccaccagcugcagcaggaggagcucgaccgcaucaucgagaaccagggggaguacuaccccuuccugaagacccugaaccccaaccggucccgcgccggcguggccaacuaccagcucgacgagcuggucagcuuccggaucccguacuacguggggccccugaucaccgccacggaccagcugcacaccuccggcgcgaaguucgccuggaugacccgccgcgccgccggggagaucacccccuggaacuucgaccagaagguggaccggcucgcgagcgccaaccaguucauccgccagaacaugcccaaggacaaccaccuccuggaggccgacguccugccggccaacucccugacguaccagcgguaccuggugcucgacgagcugaacgccgugaaggucaaccacaagagccugaccgugucccagaagcagcgcaucuucaacgaccucuucaagcggcagcgcaccgucaccgugcugaaccugcagaacuaccucaagagcaucgagaagcugcccacgcugcccgugaucaccggcgucuccgacagcgagcgguucaagaccacccucuccacguaccuggacuucaagaacaucuucggcgggaagguggacgacagcucccagaaggagaaguucgagaagaucauccuguacgcgaccaucuucgaggaccacgccguguacaaggccaagcucgaccagaucgacuggcugggccagcagcagaagaccgaccugcucagcaagaacuaccagggguggggccagcuguccgagaagcugcuccuggggcugaagaaccaggccggccagagcauccucgacgagcuguggcagaccaacaagcgcuuccgggagaucaugaacgaggcccacuucgcgaagcagaucauggccuccaacgccgcccugcuccgcaagaagggccuggacgacguccugagcacggccuuccucagcccccagaacaagaaggcgauccggcagaccguggagguggucgacgacaucgugaaggccaucgggugcccgccccagaagaucucccugcacuucagcaaggcccccgccgacgcgauccgccacgagcgggacaacgccaacaucauccugcgcaccuaccggaaccucccggccaagaugguggacgaccagcugaaggccgagcugcaggccaccgcggagaagcaccagguccucuccgacaagcuguaccuguacuucacccagcucggccgcgaccuguacacgggggagaugcugaagaugagcgagcucgagaacgacaugaucgaccacaucaugccccagaccuucgccuacgacgacuccgugaacaaccgggugcuggucagccagaaccacuccagccagcugggcaagaccuccggggagaaguccgacgccaagaugauccgcuucuggcagguccuccgggacaacaagcugaucagcgagcagaaguaccagaaccugacccucgacagcgaccaccuguccaagagcacgcgcgagcagcugcucaaccgguaccugguggagaagaaccccaucacccaguggguggccuccgugcugaccgagaaguacggcgacaacggcacccgcgugcucacgaucaacccccgcauggucuaccagaugcggcgccaguucaaccuggugaaccugccggaggugaacgacuacgaccacgggcucgacgccuaccuggcggccuucaucggcaacuacgucgaccggcgcuacccccggcugcgcagcuacuucguguacggggacuucuccagcagcaaggagaucguguuccggcucaaccgcuucaacuuccuguucgaccugggccaggccgagcccaacgagcucaccgacugggagaccggcgagaugaucugggacaaggccgccgcgaacuccguccugcgggacguguaccaguacaaguucaugcugaucagccaggccguguacucccgccagggggccauguucaaccagaccaucuaccccgccagccaggcggccggccggcagcucaucccggucaagaagaaccgcgccacgaagcuguacgggggcuacuccgggaacguggacgccuaccuggccaucgugcggcucggcggccccaagagcgaccaguaccgcgucguggggauccccacccggauggugggccgccugcaguccgcgaugaagcagggggccgacaccuacgccaacacccugcacaagauccuccagccccaguucacgaagcggaagaagaaccgccagaccggcuacuacgaggagaccaccgagccguucgccgucauccuggacaagguguacuaccggcagcugaucaucgacgggcagcagaaguucaugcucggcagcuccacguaccaguucaacgccaagcagcuggugcugagcucccgcgcgcgccagauccucagcggcgaggagcggcugaccgacgagaacgggucccaggaccugaucgacgucuacgacgagauccucaccaagaucgaccgcuacuucgagcuguacgaccagcggcacuuccgccagagccugcacgacggccggaagcaguucaucucccuccccauccacaacguguaccgcgccaaccggcugaucgagcacgggaaguacgagacccugagccagauccucaacggccugcacgccaacacgaugaugaccaaccugcgcuaccucgggaucuccagccccuucggcaaguuccagucccccaacggcaucaagcugagcaaggacgccgugcuggucuaccagagcccguccgggcuguucgagcggcgcgugcggcuccgcgaccuguga

SEQ ID NO: 2023 - RNA, 4131 nt, Artificial Sequence
  Cas9 variant
augaacaacaagcccuacagcaucggccuggacaucgggaccaacuccgugggcugggccgucaucaccgacgacuacaaggugccgagcaagaagaugaaggugcucgggaacacggacaagcacuucaucaagaagaaccugcugggcgcccuccuguucgacgaggggaccaccgcggaggaccgccggcugaagcgcaccgcccggcgccgguacacgcgccggaagaaccgccuccgguaccugcaggagaucuucaccgaggagauguccaaggucgacaucagcuucuuccaccgccuggacgacuccuuccucgugcccgaggacaagcggggcagcaaguaccccaucuucgccacccuggaggaggagaaggaguaccacaagaacuuccccaccaucuaccaccuccgcaagcaccuggccgacuccaaggagaaggccgacuuccggcugaucuaccuggcgcucgcccacaucaucaaguaccgcggccacuuccuguacgaggagagcuucgacaucaagaacaacgacauccagaagaucuucaacgaguucaucuccaucuacgacaacacguucgaggggagcucccugaacggccagaacgcccagguggaggccaucuucaccgacaagaucagcaaguccgcgaagcgggagcgcguccucaagcuguucccggacgagaaguccaccgggcuguucagcgaguuccucaagcugaucgugggcaaccaggccgacuucaagaagcacuucgaccuggaggagaaggcgccccuccaguucagcaaggacaccuacgacgaggaccuggagaaccugcucgugcagaucggggacgacuucgccgaccuguuccuggucgccaagaagcucuacgacgccauccugcuguccggcauccucacggugaccgaccccagcaccaaggcgccccuguccgccagcaugaucgaccgguacgagaaccaccagaaggaccuggccgcccucaagcaguucaucaagaccaaccugccggagaaguacgacgagguguucagcgaccaguccaaggacggcuacgccggguacaucgacggcaagacgacccaggaggccuucuacaaguacaucaagaaccugcucagcaagcuggagggggccgacuacuuccuggacaagaucgagcgcgaggacuuccuccggaagcagcgcaccuucgacaacggcuccaucccccaccagauccaccuccaggagaugaacgccaucauccggcgccagggcgagcacuaccccuuccugcaggagaacaaggagaagaucgagaagauccugaccuuccgcauccccuacuacgucgggccgcuggcccggggcaaccgcgacuucgcguggcugacgcggaacagcgaccaggccauccgccccuggaacuucgaggagaucguggacaaggcccgguccgccgaggacuucaucaacaagaugaccaacuacgaccucuaccugcccgaggagaaggugcugcccaagcacagccugcucuacgagaccuucgccgucuacaacgagcugaccaaggugaaguucaucgcggaggggcugcgcgacuaccaguuccucgacuccggccagaagcagcagaucgugacgcagcuguucaaggagaagcggaaggucaccgagaaggacaucauccaguaccugcacaacguggacagcuacgacgggaucgagcucaagggcaucgagaagcaguucaacgccucccugagcaccuaccacgaccugcucaagaucaucaaggacaaggaguucauggacgacuccaagaacgaggccauccuggagaacaucgugcacacccugacgaucuucgaggaccgcgagaugaucaagcagcggcucgcccacuacgcgagcaucuucgacgagaaggucaucaaggcccugacccgccggcacuacaccggcugggggaagcuguccgccaagcucaucaacggcaucuacgacaagcagagcaagaagaccauccuggacuaccugaucgacgacggggagaucaaccgcaacuucaugcagcucaucaacgacgacggccuguccuucaaggagaucauccagaaggcccaggugguggggaagacgaacgacgucaagcaggucgugcaggagcugccgggcagccccgccaucaagaagggcauccuccaguccaucaagcugguggacgagcuggugaaggucauggggcacgcgcccgagagcaucgugaucgagauggcccgggagaaccagaccaccgcccgcggcaagaagaacucccagcagcgguacaagcgcaucgaggacgcccucaagaaccuggcccacgggcuggacagcaacauccucaaggagcaccccaccgacaacauccagcugcagaacgaccggcuguuccucuacuaccugcagaacggcaaggacauguacacggggaagucccuggacaucaaccagcucagcagcugcgacaucgaccacaucaucccgcaggcguucaucaaggacgacucccuggacaaccgcgugcugaccagcuccaaggacaaccggggcaagagcgacaacguccccucccucgagaucgugcagaagcgcaaggccuucuggcagcagcugcuggacagcaagcucaucuccgagcgcaaguucaacaaccugaccaaggccgagcggggcgggcuggacgagcgcgacaaggugggcuucaucaagcggcagcucgucgagacccgccagaucaccaagcacguggcccagauccuggacgcccgguucaacacggaggugaccgagaaggacaagaaggaccgcagcgucaagaucaucacccugaaguccaaccucgugagcaacuuccggaaggaguuccgccuguacaaggugcgggagaucaacgacuaccaccacgcgcacgaccccuaccugaacgccgucguggccaaggccauccucaagaaguaccccaagcuggagccggaguucguguacggggacuaccagaaguacgaccugaagcgcuacaucucccggaccaaggaccccaaggaggucgagaaggcgacggagaaguacuucuucuacagcaaccuccugaacuucuucaaggaggaggugcacuacgccgacggcaccaucgugaagcgcgagaacaucgaguacuccaaggacaccggcgagaucgccuggaacaaggagaaggacuucgccaccaucaagaagguccugagccucccccaggugaacaucgugaagaagacggaggagcagaccgucgggcagaacggcgggcuguucgacaacaacaucguguccaagaagaagguggucgacgccagcaagcugacccccaucaagagcggccucuccccggagaaguacgggggcuacgcgcggcccaccaucgccuacagcgugcuggugaucgccgacaucgagaagggcaaggccaagaagcugaagcgcaucaaggagauggucgggaucacggugcaggacaagaagaaguucgaggccaaccccaucgcguaccucgaggagugcggcuacaagaacaucaacccgaaccugaucaucaagcugcccaaguacucccucuucgaguucaacaacgggcagcggcgccugcuggccagcuccaucgagcuccagaagggcaacgagcugaucgugcccuaccacuucaccgcccugcucuaccacgcccagcggaucaacaagaucagcgagcccauccacaagcaguacgucgagacccaccaguccgaguucaaggagcugcugaccgccaucaucagccucuccaagaaguacauccagaagccgaacguggagagccugcugcagcaggcguucgaccaguccgacaaggacaucuaccagcucagcgaguccuucaucagccugcugaagcucaucuccuucggggcccccggcacguucaaguuccugggcguggagaucagccaguccaacguccgcuaccagagcguguccagcugcuucaacgccacccugauccaccagagcaucaccgggcucuacgagacccggaucgaccuguccaagcugggcgaggacuga

SEQ ID NO: 2024 - RNA, 4131 nt, Artificial Sequence
  Cas9 variant
auggacaagaaguacggcaucgggcuggacaucggcaccagcuccaucggguggaccguggucgacaaguacggccacaucauccgcgugaaggggcagacgggcaucggcgugcggcuguuccgcgaggggcagaccgccgccgagcggcgcaccuuccggaccacgcgccggcgccugagccggcgccgguggcgccugcggcuccugcgcgagaucuucgacgagcccaucuccgcgaucgacgagaacuucuucgcccggcagaaggccagcucccuggccccgggcgacgcccgcuaccagcaggcguuccagcuguucaacgaccggaccgaccaggccuucuacugcaaguaccccaccaucuaccaccuccgccaggcccugaugaccgagagccggcaguucgacauccgcgagaucuaccucgcccugcaccagaucaucaaguaccgggggcacuuccugcucggcggggcggccaaggacuuccaguccgacaagcuggaccuggaggccuacuucacgaccaucaacgcccagcucgccggcaucuacagcgacggcuccguccagcugcccacccuggacuggaaccaggcgugccaggagcucaccgacacgagccgcacccaguccgaccgcaagaacuggcuggugaaggagcucaagagcuacggggacucccagcucaagcccaucuacacccagaucgccaacgccauccugggcuucaagaccgaccuggccaagaucauggggaucaacgacccggagaaggcccucagcuucaaccuggacgcgcuggacgaccaccgggacgacguggccgagcuccugacggacgagcagaucccccuggucaaccuccuggccaagcugcacaccgcccucgagcuggccgcgauccugcccgacggccagacccucuccggcaagaugguggagaucuacgagacccaccgcaagcagcugaagacguacaaggccuucauccggcagcugcccgaccgccagcagcggcucgcccugaagcaggccuacgaccacuacaucgaccaggggcugaaccgcgaggccuucuacagcgaggugaaggcgauccucgagaagcagaagccgcugaccgccaccggccaggccaugaagaaggccauggaccagaacgcguuccugcucaagcagcggaccaagacgaacaucgccauccccuaccagguccagcagcaggagauggaccagaucaucgccaaccaguccaaguacuaccccuggcuggccacccccaacccggugaagucccgccgggugaucgcccccuacaagcuggacgagcucgucugcuuccgcgugaacuacuacguggggccccugguccaguccaagcccggcgaggcgaccaaggaggccaaguucgccuggaugacccggaaggacccgcagagcacgguggccaucacccccuggaacuucgaccagcaggucgaccgccaggccagcgcgaacgccuucauccagcggaugaagaccaccgacacguaccugcugggggaggacgugauccccaagaacucccuccuguaccagaaguacgaggugcugaacgagcucaacaacgugcgcgucaacggcgacuggcuggacccccagcggaagcaguaccuguucaagaagcuguucauggaccagccgcagagcguggugaccgucaaggcccugcagaagacccugguggucaucggcgccugccccacccuccccacgguggaggggcuggccaaccccaagcgcuuccugucccagcucaccaccuaccacgacuucugcaagcugcugccggacgacauccagcgggcggaccgccaggccgacaucgagaagaucaucaacuggagcaccaucuucgaggacaccgccaucuucaaggagaagcuccgggacaucaaguggcuguccgccgaccagauccgccgccugagcucccggccccgcuaccggggcugggggcgcuucagcgcgaagcuccugugcggccugcacgaccggcaggggaacacggugauggacgagcucuggcagaccucccgcaacuucaugcagaucauccggcagagcgacuuccagaccgccaucgccgccgucaaccagcaggaccugggccgccaggaccugcagcgggugaucgacgaccucuacaccagcccccagaacaagaaggccauccgccaggugcuggcggucgugacggacauccagaaggccaugcacggcaaggcccccagcuggcuguucguggaggucgccaagggggcccagaagaacccgcagcggacccagucccgccagagcaagcucgcggaggccuaccgggaguccgcccgcgagcugguggacgaggccgugaaggagcagcugcucacccugcccgacgaccggcagaccuucagcgaccgccugguccucuacuuccagcagaacggccgggacaucuacacgggggagccccuggacuucgagcgccuguccaacuaccacaucgaccacaucaucccgcaggccguggugaaggacgacagccucgacaaccggguccugaccuccaaccaggcgaaccuggagaagggcgcccacgugcccaccaucuuccgcgacaagcaggagcccguguggcaggagcucuaccgggucgggcugaucagccaccgcaagcugcgcaaccuccugaccacgcccgacgaccuggacgaccggggccgcgccaccggcuucaucgcccggcagcucguggagacccgccaggugaucaagcuggucauggaggugcugagccaguacuacgacaccacggagaccgagcucaucuccaucaaggcggggcugagccaccaguuccggcaggagcugaaccucccgaagcugcgcgcccugaacgacuaccaccacgcccaggacgccuaccucgccgcgcggaucggcaccuaccugcugcagcgcuaccccaaccucaagcgguucuucguguacggggacuucaagaagacccacuucgaccugcagcgccgguucaacuucaucggcggcaugaucucccgcgagaagcagcccuacaaccugaucaagaaccccgucacgcaccaggugaucugggacgaggagauggagaucggggacugccagaagaagaacccggagcagcccaagcacgacgccaccgugaagaugaugaaccucaccaagaucaugaaccugaagcacauccuggucacccacgagguguacgagaaccacggcgcccucuucaaccagacgaucuaccccgccagccaggcccacaagaagaagcugaucccccagaagaccgagaagccgaucgagcuguacgggggccacuccagcgagcaggcgggguacauggccaucauccggcuccugggcaagcgccccggcuacaaggugaugcggguccccgugcgcuacgugucccagcugcagcaccaggacgucgccgagcagaagaagcuccuguacaagaucuucgugagcgagcugaccucccggaacaaggugaagcccuucgaggucguggugccgcacgucugccucaaccagcccguggaggacaugaucaaggggcaguggcaccgcuucgcccugcggaccaacggcuacuaccagaaccagcagcagcugauccucagccugguggcccagcgcacgcuggcgggguacaagcccaaggacgacgagcucauggccgucuaccacgagaucugcaagcaggucaaguacuacuucccccuguacaagaugaacaaguuccagucccgccuguucgccgccgaggagcuccugcagaagcggagcaccgugaacuccuucagcaucaccaucggcaagaacgggaaggagaacaagacccugaaccucggcaagcgcgagcugcugcuccggcugcugggcgggcuccacgccaacgcgacgcgcguggaccugaaggacaucggcugcaccgggcaguucggccagcuccaggugaagaacgggaucaagcucaccgagcaggccgugcugauccacgaguccccgaccggccuguuccaccggcgcguccggcugaacgaccucuga

SEQ ID NO: 2025 - RNA, 4134 nt, Artificial Sequence
  Cas9 variant
augaccaagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccgaggagaugaccaaggucgacgaguccuucuucuaccggcuggacgagagcuuccucaccacggacgagaaggacuucgagcgccacccgaucuucggcaacaaggcggacgagaucaaguaccaccaggaguuccccaccaucuaccaccuccggaagcaccuggccgacuccagcgagaaggccgaccugcgccugguguaccuggcccucgcgcacaugaucaaguuccggggccacuuccugaucgagggggagcugaacgccgagaacaccgacgugcagaagaucuucgccgacuucgucggcguguacgaccgcaccuucgacgacucccaccucagcgagaucacgguggacgccgccuccauccugaccgagaagaucagcaagucccggcgccuggagaaccucaucaaguacuaccccaccgagaagaagaacacccuguucgggaaccugaucgcgcucgcccugggccugcagcccaacuucaagaugaacuucaagcucagcgaggacgccaagcugcaguucuccaaggacagcuacaacgaggaccuggaggagcuccuggggaagaucggcgacgacuacgccgaccuguucacguccgccaagaaccucuacgacgcgauccugcugagcggcauccucaccgucgacgacaacuccaccaaggccccgcugagcgccuccaugaucaagcgguacgccgagcaccacgaggaccuggagaagcucaaggaguucaucaaggccaacaagagcgagcuguaccacgacaucuucaaggacgagaccaagaacggguacgcgggcuacaucgagaacggggugaagcaggacgaguucuacaaguaccugaagaacacgcucagcaagaucgccggcuccgacuacuuccuggacaagaucgagcgcgaggacuuccugcggaagcagcgcaccuucgacaacggcagcaucccccaccagauccaccuccaggagaugcacgccauccugcggcgccagggggacuacuaccccuuccugaaggagaaccaggaccgcaucgagaagauccucaccuuccggauccccuacuacgugggcccgcuggcccgcaaggacucccgguucagcugggccgaguaccacuccgacgagaagaucacccccuggaacuucgacaaggucaucgacaaggagaaguccgcggagaaguucaucacgcgcaugacccugaacgaccuguaccuccccgaggagaaggugcugcccaagcacagccacguguacgagaccuacgccgucuacaacgagcugaccaagaucaaguacgugaacgagcaggggaaggacagcuucuucgacuccaacaugaagcaggagaucuucgaccacguguucaaggagaaccggaaggucacgaaggagaagcuccugaacuaccugaacaaggaguucccggaguaccgcaucaaggaccucaucggccuggacaaggagaacaagagcuucaacgccucccuggggaccuaccacgaccucaagaagauccuggacaaggccuuccuggacgacaaggugaacgaggaggugaucgaggacaucaucaagacccucacccuguucgaggacaaggacaugauccacgagcggcugcagaaguacagcgacaucuucacggcggaccagcucaagaagcuggagcgccggcacuacaccggcuggggccgccuguccuacaagcucaucaacgggauccggaacaaggagaacaacaagaccauccuggacuaccugaucgacgacggcagcgccaaccgcaacuucaugcagcucaucaacgacgacacccugcccuucaagcagaucauccagaagucccaggucgugggggacguggacgacaucgaggccgucgugcacgaccugcccggcagccccgccaucaagaaggggauccuccaguccgucaagaucguggacgagcuggugaaggucaugggcgacaacccggacaacaucgugaucgagauggcccgggagaaccagacgaccaaccgcggccggagccagucccagcagcgccugaagaagcuccagaacagccugaaggagcuggggagcaacauccucaacgaggagaagcccuccuacaucgaggacaagguggagaacagccaccuccagaacgaccagcuguuccuguacuacauccagaacggcaaggacauguacaccggggacgagcuggacaucgaccaccuguccgacuacgacaucgaccacaucaucccccaggcguucaucaaggacgacagcaucgacaaccggguccucaccuccagcgccaagaaccgcggcaaguccgacgacgugcccagccuggacaucgugcgggcccgcaaggccgaguggguccgccuguacaaguccgggcucaucagcaagcggaaguucgacaaccugaccaaggccgagcgcggcggccugacggaggcggacaaggccggguucaucaagcggcagcucguggagacccgccagaucaccaagcacguggcccagauccuggacgcccgguucaacaccgaguccgacgagaacgacaaggucauccgcgacgugaaggugaucacgcucaagagcaaccuggucucccaguuccggaaggacuucgaguucuacaaggugcgcgagaucaacgacuaccaccacgcccacgacgcguaccugaacgccguggucggcaccgcccugcucaagaaguacccgaagcuggccagcgaguucguguacggggaguacaagaaguacgacgugcacaagcugaucgcgaaguccagcgacgaccacuccgagaugggcaaggccaccgccaaguacuucuucuacagcaaccucaugaacuucuucaagcgggucauccgcuacagcaacggcaaggugaucgugcggcccgucguggaguacuccaaggacaccgaggacaucgccugggacaagaaguccaacuuccgcacgaucugcaaggugcugagcuacccccaggucaacaucgugaagaagguggagacccagaccgggggcuucagcaaggaguccauccugcccaagggggacagcgacaagcucaucccgcggaagaccaagaaggccuacugggacacgaagaaguacggcggguucgacucccccaccgucgcguacagcguguucguggucgccgacguggagaagggcaaggccaagaagcugaagaccgugaaggagcuggucggcaucuccaucauggagcgcagcuucuucgaggagaaccccguggaguuccucgagaacaagggguaccacaacauccgggaggacaagcugaucaagcugcccaaguacucccucuucgaguucgagggcgggaagcgccggcugcuggccagcgccuccgagcuccagaagggcaacgagauggugaucccggggcaccuggucaagcugcucuaccacgcgcagcgcaucaacagcuucaacuccaccaaguaccuggacuacgugagcgcccacaagaaggaguucgagaaggugcuguccugcgucgaggacuucgccaaccucuacguggacguggagaagaaccugagcaagauccgggccgucgccgacuccauggacaacuucagcaucgaggagaucagcaacuccuucaucaaccugcucacgcugaccgcgcugggcgcccccgccgacuucaacuuccucggcgagaagaucccccgcaagcgguacaccagcaccaaggagugccugaacgccacgcugauccaccaguccaucaccgggcucuacgagacccgcaucgaccugagcaagaucggcgaggaguga

SEQ ID NO: 2026 - RNA, 4134 nt, Artificial Sequence
  Cas9 variant
augaagaagcccuacagcaucggccuggacaucgggaccaacuccgugggcugggccgucaucaccgacgacuacaaggugccgagcaagaagaugaaggugcucgggaacacggacaagcacuucaucaagaagaaccugaucggcgcccugcuguucgacgaggggaccaccgcggaggaccgccggcugaagcgcaccucccggcgccgguacacgcgccggaagaaccgccugcgguaccuccaggagaucuucagcgaggagaucuccaagcuggacagcuccuucuuccaccgccuggacgacagcuuccucguccccgaggacaagcggggcuccaaguaccccaucuucgccacccuggaggaggagaaggaguaccacaagaaguuccccaccaucuaccaccuccgcaagcaccucgccgacagcaaggagaagaccgaccugcggcugaucuaccucgcccuggcccacaugaucaaguaccgcggccacuuccuguacgaggaguccuucgacaucaagaacaacgacauccagaagaucuucaacgaguucaucagcaucuacgacaacacguucgagggguccagccucuccggccagaacgcccagguggaggccaucuucaccgacaagaucagcaaguccaccaagcgggagcgcgugcugaagcuguucagcgacgagaaguccaccgggcuguucagcgaguuccugaagcugaucgucggcaaccaggccgacuucaagaagcacuucgaccucgaggagaaggccccgcugcaguucagcaaggacacguacgacgaggaccuggagaaccuccuggggcagaucggcgacggcuucgcggaccuguuccucguggccaagaagcuguacgacgccauccugcucuccgggauccugaccgugaccgaccccagcaccaaggcgccccuguccgccagcaugaucgagcgguacgagaaccaccaggaggaccucgcggcccugaagcaguucaucaagaacaaccuguccgagaaguacgccgaggucuucagcgaccaguccaaggacggcuacgccggguucaucgacggcaagacgacccaggaggccuucuacaaguacaucaagaaccuccugagcaagcuggagggcgcggacuacuuccucaacaagaucgagcgcgaggacuuccugcggaagcagcgcaccuucgacaacggguccaucccccaccagauccaccuccaggagaugaacgccauccuccggcgccagggcgagcacuaccuguuccugaaggagaaccgcgagaagaucgagaagauccucgccuuccggaucccguacuacguggggccccuggcccgcggcaaccgggacuucgccuggcugacccgcaacagcgaccaggcgauccggcccuggaacuucgaggagguggucgacaaggccuccagcgccgaggacuucaucaacaagaugacgaacuacgaccuguaccuccccgaggagaaggugcugccgaagcacucccugcucuacgagaccuucgccguguacaacgagcugaccaaggucaaguucaucgccgaggggcugcgcgacuaccaguuccucgacagcggccagaagaagcagaucgugaaccagcuguucaaggacaagcggaaggugaccgagaaggacaucauccacuaccugcacaacgucgacggcuacgacgggaucgagcucaagggcaucgagaagcaguucaacgcgucccugagcacguaccacgaccugcucaagaucaucaaggacaaggaguucauggacaaccccaagaacggggagauccuggagaacaucauccacacccugaccaucuucgaggaccgcgagaugaucaagcagcggcucgcccaguacgacacccuguucgacgagaaggugaucaaggcccugacgcgccggcacuacaccggcugggggaagcucuccgccaagcugaucaacggcauccgcgacaagcagaccggcaagaccauccuggaguaccucaucgacgacggggacugcaaccggaacuucaugcagcugaucaacgacgacggccugagcuucaaggagaucauccagaaggcccagguggucgggaagacggacgacgugaagcaggucgugcaggagauccccggcucccccgcgaucaagaaggggauccuccagagcaucaagaucguggacgagcuggucaaggugaugggccacaacccggagagcaucgugaucgagauggcccgcgagaaccagaccaccgccaagggcaagaagaacucccagcagcgguacaagcgcaucgaggacgcccugaagaaccucgcgcccgggcuggacagcaacauccugaaggagaaccccaccgacaacauccagcuccagaacgaccggcuguuccuguacuaccuccagaacggcaaggacauguacacggggaaggccaucgacaucaaccagcuguccaacuacgacaucgaccacaucaucccccaggccuucaucaaggacgacagccuggacaaccgcguccucaccuccagcaaggacaaccggggcaaguccgacaacgugccgagcaucgaggugguccagaagcgcaaggccuucuggcagcagcugcuggacuccaagcucaucagcgagcgcaaguucaacaaccugaccaaggccaagcggggcgggcuggacgagcgcgacaaggugggcuucaucaagcggcagcucguggagacccgccagaucaccaagcacgucgcgcagcugcuggacacgcgguucaacaccgaggugaacgaggagaaccagaagauccgcaccgugaagaucaucacccucaaguccaaccuggucagcaacuuccggaaggaguucgggcuguacaaggugcgcgagaucaacgacuaccaccacgcccacgacgccuaccucaacgccguggucgccaaggcgauccugaagaaguaccccaagcuggagcccgaguucguguacggcgacuaccagaaguacgaccucaagcgguacauccugaaguccaaggccagcaacacgaucgacaaggccaccgagaaguacuucuucuacuccaaccugcucaacuucuucaaggagaaggugcgcuacgccgacgggaccaucaagaagcgggagaacaucgaguacagcaacgacaccggcgagaucgcguggaacaaggagaaggacuucgccacgaucaagaagguccugucccugccccaggugaacaucgugaagaagaccgaggagcagaccgucggccagaacgggggccucuucgacaacaacaucgugagcaagaagaagguggucgacgccagcaagcugaucccgaucaaguccagccugucccccgagaaguacgggggcuacgcccgccccaccaucgccuacagcgugcucgugaucgcggacaucgagaaggggaagggcaaggccaagaagcugaagcggaucaaggagaucgucggcaucacgauccaggacaagaagaaguucgaguccaaccccgugaccuaccuggaggagugcggguacaagaacaucaacagcaaccucaucaucaagcugccgaaguacucccuguucgaguucaacgacggccagcgccggcuccuggccagcuccaucgagcugcagaaggggaacgagcucauccugcccuaccaccugaccgcccuccuguaccacgcccagcgcaucaacaagaucagcgagcccauccacaagcaguacguggaggcgcaccagaacgaguucaaggagcugcucaccacgaucaucucccugagcaagaaguacauccagaagccgaacgucgagcugcuccugcagcaggccuucgaccaggccgacaaggacaucuaccagcuguccgagagcuucaucucccuccugaagcugaccagcuucggcgcccccggggccuucaaguuccucggcguggagaucucccagagcuccgugcgguacaagcccaacagccaguuccuggacaccacccugauccaccagagcaucacgggccucuacgagacccgcaucgaccuguccaagcugggggaggacuga

SEQ ID NO: 2027 - RNA, 4134 nt, Artificial Sequence
  Cas9 variant
augaacaacaagcccuacagcaucggccuggacaucgggaccaacuccgugggcuggagcgucaucaccgacgacuacaaggugccguccaagaagaugaaggugcucgggaacacggacaagcgcuucaucaagaagaaccugaucggcgcccugcuguucgacgaggggaccaccgccgaggcgcggcgccugaagcggaccgcccgccggcgcuacacgcggcgcaagaaccggcugcgcuaccuccaggagaucuucgccgaggagaugagcaaggucgacuccagcuucuuccaccggcuggacgacuccuuccugauccccgaggacaagcgcggcagcaaguaccccaucuucgccacccucguggaggagaaggaguaccacaagcaguuccccaccaucuaccaccuccggaagcagcuggccgacuccaaggagaaggcggaccuccgccugaucuaccuggugcucgcccacaugaucaaguaccggggccacuuccuguacgaggaggccuucgacaucaagaacaacgacauccagaagaucuucaacgaguucaucagcaucuacgacaacaccuucgagggguccagccuguccggccagaacgcccaggucgagacgaucuucaccgacaagaucagcaaguccgcgaagcgcgagcgggugcucaagcuguucccggacgagaaguccaccgggcuguucagcgaguuccucaagcugaucgugggcaaccaggccgacuucaagaagcacuucgaccuggaggagaaggcgccccuccaguucagcaaggacaccuacgacgaggaccuggagaaccugcucgagcagaucggggacgacuucgccgaccuguucgucgccgcgaagaagcuguacgacgccauccuccuguccggcauccugacggugaccgaccccagcaccaaggcgccccucagcgccuccaugaucgagcgcuacgagaaccaccagaaggaccuggccgugcugaagcaguucaucaagaccaaccucccggagaaguacgucgagguguucagcgaccaguccaaggacggcuacgccggguacaucgacggcaagacgacccaggaggccuucuacaaguacaucaagaaccugcugagcaaguucgacggggccgacuacuuccucgacaagaucgagcgggagguguuccugcgcaagcagcggaccuucgacaacggcuccaucccccaccagauccaccuccaggagaugaacaccauccugcgccgccagggcgagcacuaccccuuccugaaggagaacaaggagaagaucgagaagauccugacguuccggauccccuaccacgucgggccgcucgcccgcggcaaccgggacuucgccuggcugacccgcaacagcgaccaggcgauccggcccuggaacuucgaggagaucguggacaaggccuccagcgccgaggacuucaucaacaagaugaccaacuacgaccuguaccuccccgaggagaaggugcugcccaagcacucccugcuguacgagaccuucgccgucuacaacgagcucacgaaggugaaguucaucgccgaggggaugcgcgacuaccaguuccuggacagcggccagaagaagaagaucaucaaccagcuguucaagaagaagcggaaggugaccgaggacgacaucaucgacugccuccagaagaucgacaacuacgacgggaucgagcugaagggcaucgagaagcaguucaacgcgucccugagcaccuaccacgacauccucaagaucauccgcgacaaggaguucauggacgacccgaagaacggcgacauccuggagaacgucauccacacccugacgaucuucgaggaccgggagaugaucaagcagcgccucgcccaguacaacuccaucuucgacgagaaggugaucaaggcccugagccggaagcacuacaccggguggggcaagcuguccgccaagcucaucgacgggauccgcgacaagcagaccggcaagaccauccuggacuaccugauggacgacggcaagagcaaccggaacuucaugcagcucaucaaggacgacgagcuguccuucacggagaucauccagaaggcccagguggucggggacaccgacaaccugcgccaggugguccagaaccuccccggcagccccgccaucaagaaggggauccugcaguccaucaagaucguggacgagcuggugaaggucaugggccacgcccccgagagcaucgugaucgagauggcccgggagaaccagaccaccgcccgcgggaagaagaacagccagcagcgguacaagcgcaucgaggacucccucaagaaccuggcgagcggccuggacuccaacauccucaaggagaacccgacggacaacauccagcugcagaacgaccggcuguuccucuacuaccugcagaacgggaaggacauguacaccggcgaggcccugaacaucaaccagcucagcuccuacgacaucgaccacaucaucccccaggccuucaucaaggacgacagccuggacaaccgcgugcugaccuccagcaaggacaaccgcggcaaguccgacaacguccccagccucgaggugguggagaagaugaaggccuucuggcagcagcugcuggacuccaagcucaucagcgagcggaaguacaacaaccugaccaaggccgagcgcgagcgcgggggccugaacgagcucgacaaggucggguucaucaagcggcagcugguggagacccggcagaucacgaagcacguggcgcagauccuggacgcccgcuucaacaaggaggucaccgagaagaacaagaagaaccggaacgugaagaucaucacccucaaguccaacauggugagcaacuuccgcaaggaguucggccuguacaagguccgggagaucaacgacuaccaccacgcccacgacgccuaccugaacgccgugguggcgaaggccauccucaagaaguaccccaagcuggagccggaguucgucuacggcgacuaccagaaguacgaccugaagcgcuacaucucccggagcaaggaccccaaggagguggagaaggccaccgagaaguacuucuucuacuccaaccuccugaacuucuucaaggaggaggugcacuacgccgacgggacgaucgucaagcgcgagaacaucgaguacagcaaggacaccggcgagaucgcguggaacaaggagaaggacuucgccaccaucaagaaggugcugagccucccccaggugaacaucgucaagaagaccgaggagcagacgguggggcagaacggcgggcuguucgacaacaacaucguguccaagaagaaggucguggacgccagcaagcugauccccaucaaguccggccucagcccggagaaguacggcggguacgcccggcccaccaucgccuacuccgugcuggucaccuacaagcagaacaacaagaucaagaacaccauggugggcauccccgugcugacgaagcucgaguucgagcgcgacccgaaccuguaccugcggaaccucgggaucaacaacgucagccacgugaucaagcuggugaaguacaccguccuggaguucaagcacaaguacggcaccuaccgccgguucaucguguccaaccaggagcucaagcgcgcgaaccagaucuucgugaccacgaagcagaugaagcugaucagccaguacaccacccuggacaagaacgagcacgacucccuccugaagaacaaccagcagcugauccagagcaucuggaaccaguuccucgaguucaugcuggccaccgaccuggucaacaagaagcaguacgacgagcucauccugacgaacaaccagaccaucgaggagugccggaacaucaugaaccgcgugaucaccacccuguccuucacgaacaucaacgccgggcagaagaagaucaucuucgacgacacccucagccugcccaucaagcgguggcaguucaccgacuccgacaagauggugaagaagaucaucgagagcacccugauccaccaguccaucacgggccucuacgagacccgcaucgaccugagcaagcugggcgaggacuga

SEQ ID NO: 2028 - RNA, 4134 nt, Artificial Sequence
  Cas9 variant
auggagagcaaccacgacggcgagcaggucaaguacacccuggggcucgacaucggcaccuccagcaucggguacgccgccaucgacaagcaccagaagcccauccgcgcgaagggcaagcacgugaucggggugcggcuguuccaggagggccagacggccgccgaccgccgggccuuccgcaccacccggcgccggcugaagcgccggaaguggcgccucaaccugcugaaccgccucuucgacccguaccuguccgagguggaccccaacuuccugccccggcuccggcagagcaaccugucccccaaggacgacaacaagcacuucaacggcagcacccuguucccggacaagacggacgccgcguucuaccgccaguaccccaccauguaccaccuccgguacgcccugaugaccgagaagcgcaaguucgacauccgggagguguaccuggccauccaccacaucgugaaguaccgcgggaacuuccucaacuccgccaccguggacagcuucaagacguccaacaucgacuucaccagccaguucgaccggcugaacgagcuguaccgccaggucauccucgacgagcccuuccagaucaacauggaccagguggacgagaugaccaacaagcugcuggacaacgacgcgcucaagcuggacacccagaagcaggucgccaagcugcuccccgugaucuacaacgacaagccgaucgacaagcaguacacgcggaucgccaccgaguucuccaaggccauccugggcuacaagaccaagcuggacgugauccucaaccuggacacccagaacgccaaggacugggugauccgccuggacgacgaggacaucgacgacaagcuccccgcgcuggucgagaaccuggacgagagccgccaggagaucgugacgaucauccgggaccucuacgcccagaucacccugaacgccaucgugcccaaggggaagucccugagcgaguccauggucgacaaguacaacgaccacaaggaccaccucgaccugcugaugggccucauccacgagcugggggacgacagcgccaagggcaucaagcugcgcgaggccuacacccaguacgugggcaaguccgacgacaagacccucaaccaggacgacuucuacgcggccaucaagaagaaccuggacgaggacagcaagcggucccccaagauccagcgccugaucgagcaggccagcuucaugccgaagcagcggacgagcgccaacggggugaucccccaccagcuccaccagcuggagcuggaccgcaucaucgagaaccagggccgguacuaccccuuccucaagaagcccaacccgaacacccacaagcccaacgggggcaaguacaagcuggacgagcuggucgccuuccgcauccccuacuacgugggcccccugaucaccaagcgggaccaggagaagaccuccggggcggacuucgccuggaugauccgcaagccgggccaggagggggagaucacgcccuggaacuucgaccagaagguggaccggauggccagcgccaaccgcuucauccggcgcaugaccaccaaggacuccuaccucgucgccgaggacgugcugcccgacgcgagccugaucuacgagaaguucaaggcccucaacgagcugaacaugcugaaggugaacgacucccggcucagccccucccagaagcaggaccuguucaacaaccuguucaagaagcagaagaccauccgcacgaagaagcuccagaccuacauccggaccaacugggagcugccgagcgucaugaucuccggccuggccgaccccgacaaguucaacagcucccucagcaccuacaucgacuuccgcgacaucuucggggagaagguggacgaccccaaccggcaggccgacuacgaggagaucaucgagugguccacggucuucgaggaccgcaagaucuaccaggcgaagcugaaccagcuggacuggcucaccgagccccagcgcaaggcccugcugaccaagcgguacaccggcuggggccgccucagcaagaagcugcugacggggcucaaggaccagaacggcgacuccauccuggaccagcuguggaagaccaacgacaacuucaugcagauccagagccgggacgaguucgccaagcagauccacgacgagaacgccaagcaguuccacgaggccaacaacguggacgacauccucgacgacgcguucaccuccccgcagaacaagaaggccauccgccagguggacaaggucgugcaggacguggucaaggccgugggguacgcccccgacaagaucgccaucgaguucacccggagccuggagaacaacccccagcgcaccgugucccggcagcgccagcugcaggcggccuacaagaacaucccgcgggagaucaugaaguccggccucauggccgagcuggggagcgucgccgacagcaagaaggugcugagcgacaagcucuaccuguacuucacgcagaugggcaaggacauguacgaggacaagaccaucaacaucgacaaccugcccaacuacgacaucgaccacauccucccccaggccuucaucaaggacgacuccaucgacaaccgcgugcugaucagcaaggaggagaacgcgcggaaguccaaccgcgucccccugaaguucuucggcgccaagcggaugggguucuggaaggaccuccugaacaacggccugaucagcaaccgcaaguuccagaaccucaccaccgacccggagaagaucuccaaguacagcgccaagggguucauccaccggcagcugguggagacgucccaggugauccgccuggucgccaacauccucggcaacgaguacagccaggcggggaccaccaucaucgagguguccgccaagaugaaccggcagcugcgcgaggacuuccaccugaucaagaaccggaacgugaacgacuaccaccacgccauggacgccuaccucaccgccuacgucggcgacuaccuguaccugcgcuaccccaagcuccggcccuacuucguguacggcgacuucaagaaggcggaggaccaggaccugaacauccgcaacuucaacuuccugcacgaccucaaggacaacgagagccuggacaagaucguggacuccgagacgggggagaucgucugggagaagcacggcagcgugaagcagcugaagaagguguaccacuacaaguucaugcucgucucccaggagguguacacccgccaggacgcccuguucaaccagaccaucuaccccgccagcgacgccgacaagcggaagcugaucccgaucaagaacuccaagcccguggacgucuacgggggcuacagcggcaacaucgacgccuacauggcgaucgugcgcgugcacgggaagaaggaggacaacuacaaggucgugggcauccccaugcgggccgugaccaagcucaagaaggccgagaaggaggggcacgacagcuaccugaacgccguccacgaggugcugaagccccaguucacgaagaagaagaagaaccgcaagaccggcgagaucaccgagaccguggacgaguucgacguccuccuggggaagguguacuaccggcagcugaucguggacggcaacaagaaguucaugcucggcuccagcuccuaccaguacaacgccaagcagcugguccugagcgacaaggcgaugcagguccucuccaagaacgggaaggucaagagccaggacgagaaccagaaccugaucgacguguacgacgagauccuggagaagguggaccaguacuucgagcucuacgaccagcgccacuaccgggagucccugcacaagggccgcgggaucuucgugaaccugccgcucagcaaccaguacgacggcuccaagcugacgagcuacgggaaguacgagaccaucgacgccauccugaacggccuccacgccaacgccaccauguccaaccugcgguaccugggcaucagcucccccuucgggaagaugcaggcgagcaacggccucaccaucgaccccgacuccaucaucugcuaccagagccccacggggcuguucgagcgccagaucaagcuguccgaccucuga

SEQ ID NO: 2029 - RNA, 4134 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucguguaccuggcccuggcccacaucaucaaguuccgggggcacuuccucaucgaggacgaccgcuucgacgugcggaacaccgacauccagaagcaguaccaggcguuccuggagaucuucgacaccacguucgagaacaaccaccuccucucccagaacgucgacguggaggccauccugaccgacaagaucagcaaguccgccaagaaggaccgcauccuggcccaguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgucgccaagaagcuguacgacuccgugcuccugagcggcauccugacggugaccgaccucuccaccaaggcgccccugagcgccuccaugauccagcgguacgacgagcaccacgaggaccugaagcaccucaagcaguucgucaaggccagccugcccgagaacuaccgcgagguguucgccgacuccagcaaggacggcuacgccggguacaucgagggcaagaccaaccaggaggccuucuacaaguaccugcucaagcugcugacgaagcaggaggggagcgaguacuuccucgagaagaucaagaacgaggacuuccugcggaagcagcgcaccuucgacaacggcuccaucccccaccaggugcaccugaccgagcuccgcgcgaucauccggcgccagagcgaguacuacccguuccugaaggagaaccaggaccggaucgagaagauccugaccuuccgcauccccuacuacgucggcccccucgcccgggagaaguccgacuucgccuggaugacgcgcaagaccgacgacagcauccggcccuggaacuucgaggaccugguggacaaggagaaguccgccgaggccuucauccaccgcaugaccaacaacgaccuguaccugccggaggagaaggugcuccccaagcacagccugaucuacgagaaguucaccgucuacaacgagcugacgaaggugcgguuccucgcggagggguucaaggacuuccaguuccugaaccgcaagcagaaggagaccaucuucaacucccuguucaaggagaagcggaaggugaccgagaaggacaucaucagcuuccucaacaaggucgacggcuacgaggggaucgccaucaagggcaucgagaagcaguucaacgccucccugagcaccuaccacgaccugaagaagauccucgggaaggacuuccuggacaacacggacaacgagcugauccucgaggacaucgugcagacccugacccuguucgaggaccgcgagaugaucaagaagugccucgacaucuacaaggacuucuucaccgagucccagcugaagaagcuguaccggcgccacuacacgggcuggggccggcucagcgccaagcugaucaacgggauccgcaacaaggagaaccagaagaccauccuggacuaccucaucgacgacggcuccgcgaaccggaacuucaugcagcugaucaacgacgacgaccugagcuucaagcccaucaucgacaaggcccgcaccgggucccacagcgacaaccucaaggagguggucggcgagcuggccgggucccccgccaucaagaagggcauccugcagagccucaagaucguggacgagcuggucaaggugaugggcuacgagccggagcagaucguggucgagauggcccgggagaaccagaccacggcgaaggggcugucccgcagccgccagcggcucaccacccugcgcgagagccuggccaaccucaaguccaacauccuggaggagaagaagcccaaguacgugaaggaccagguggagaaccaccaccugagcgacgaccgccucuuccuguacuaccugcagaacggccgggacauguacaccaagaaggcccucgacaucgacaaccugucccaguacgacaucgaccacaucaucccccaggccuucaucaaggacgacagcaucgacaaccggguccugguguccagcgccaagaaccgcgggaaguccgacgacgugcccagcaucgagaucgucaaggcgcggaagauguucuggaagaaccuccuggacgccaagcugaugucccagcgcaaguacgacaaccucaccaaggccgagcggggcgggcugacgagcgacgacaaggcccgcuucauccagcggcagcugguggagacccgccagaucaccaagcacguggcccggauccucgacgagcgcuucaacaacgaggucgacaacggcaagaagaucugcaaggugaagaucgugacccugaaguccaaccuggucagcaacuuccggaaggaguucggcuucuacaagauccgcgaggugaacgacuaccaccacgcgcacgacgccuaccucaacgccguggucgccaaggcgauccugacgaaguacccgcagcuggagcccgaguucguguacgggauguaccggcagaagaagcucuccaagaucgugcacgaggacaaggaggagaaguacagcgaggccacccgcaagauguucuucuacuccaaccugaugaacauguucaagcgggucgugcgccuggccgacggcagcaucgugguccggcccgugaucgagaccgggcgcuacaugcgcaagaccgccugggacaagaagaagcacuucgccacggugcggaagguccucuccuacccccagaacaacaucgugaagaagaccgagauccagaccggcggcuucagcaaggagagcauccuggcgcacgggaacuccgacaagcugaucccgcgcaagaccaaggacaucuaccucgaccccaagaaguacggcggguucgacagccccaucguggccuacuccguccuggugguggccgacaucaagaagggcaaggcccagaagcugaagacggucaccgagcuccuggggaucaccaucauggagcggagccgcuucgagaagaaccccuccgccuuccuggagagcaagggcuaccucaacauccgggacgacaagcugaugauccugccgaaguacucccucuucgagcuggagaacggccgccggcgccugcucgcgagcgccggggagcugcagaagggcaacgagcuggcccuccccacccaguucaugaaguuccuguaccuggccucccgguacaacgagagcaaggggaagcccgaggagaucgagaagaagcaggaguucgugaaccagcacguguccuacuucgacgacauccuccagcugaucaacgacuucagcaagcgcgucauccuggccgacgcgaaccucgagaagaucaacaagcuguaccaggacaacaaggagaacaucccgguggacgagcuggccaacaacaucaucaaccucuucacguucaccucccugggcgcccccgccgcguucaaguucuucgacaagaucguggaccggaagcgcuacaccagcaccaaggagguccugaacuccacgcucauccaccagagcaucaccgggcuguacgagacccggaucgaccugggcaagcucggcgaggacuga

SEQ ID NO: 2030 - RNA, 4134 nt, Artificial Sequence
  Cas9 variant
auggagaagaccuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcgggccgcccgccggcgcuacacgcggcgcaagaaccggcuccgcuaccugcaggagaucuucgcgaaggagauggccaaggucgacgaguccuucuuccagcggcuggaggagagcuuccucaccgacgacgacaagaccuucgacucccacccgaucuucggcaacaaggccgaggaggacaccuaccaccaggaguuccccacgaucuaccaccuccgcaagcaccuggccgacagccccgagaagguggaccugcggcugguguaccuggcgcucgcccacaugaucaaguuccgcggccacuuccugaucgaggggcagcugaacgccgagaacaccgacguccagaagaucuucgccgacuucgugggcguguacgaccggaccuucgacgacucccaccucagcgagaucaccgucgacgccgcguccauccugacggagaagaucagcaagucccgccggcuggagaaccucaucaagcaguaccccaccgagaagaagaacacccuguucgggaaccugguggcccucgcccugggccugcagccgaacuucaagaccaacuucaagcucagcgaggacgccaagcugcaguucuccaaggacacguacgacgaggaccuggaggagcuccuggggaagaucggcgacgacuacgccgaccuguucaccgcggccaagaaccucuacgacgccauccugcugagcggcauccucaccguggacgacaacuccaccaaggcgccccugagcgccuccaugaucaagcgcuacgaggagcaccacgaggaccuggagaagcucaagacguucaucaaggucaacaacuucgacaaguaccacgagaucuucaaggacaagagcaagaacggguacgccggcuacaucgagaacggggugaagcaggacaucuucuacaagcaccugaaguccaucaucagcgagaagaacggcggccaguacuuccuggacaagaucgagcgggaggacuuccuccgcaagcagcggaccuucgacaacgggagcauccccuaccagauccaccuccaggagaugcgcaccauccugcggcgccagggcgaguacuaccccuuccugaaggagaaccaggccaagaucgagaagauccugaccuuccgcaucccguacuacguggggccccuggcccggaagaacucccgcuucgccugggccaaguaccacagcgacgagcccaucacgcccuggaacuucgacgaggucguggacaaggagaaguccgcggagaaguucaucacccggaugacccucaacgaccuguaccugccggaggagaaggugcugcccaagcacagcuacgucuacgagaccuucgccguguacaacgagcucacgaagaucaaguacgugaacgagcagggcaaguccuucuucuucgacgccaacaugaagcaggagaucuucgaccacgucuucaaggagaaccgcaaggugaccaaggccaagcugcugagcuaccucaacaacgaguucgaggaguuccggaucaacgaccugaucgggcuggacaaggacuccaagagcuucaacgcgucccucggcaccuaccacgaccugaagaagauccuggacaagagcuuccucgacgacaagaccaacgagcagaucaucgaggacaucgugcugacgcugacccucuucgaggaccgcgacaugauccacgagcggcugcagaaguacuccgacaucuucaccagccagcagcugaagaagcucgagcgccggcacuacaccggcugggggcgccuguccuacaagcugaucaacggcauccggaacaaggagaacaacaagacgauccucgacuuccugaucgacgacggggacgccaaccgcaacuucaugcagcugaucaacgacgacagccucuccuucaagaccaccauccaggaggcccaggucgugggcgacgucgacgacaucgaggccguggugcacgaccugcccgggagccccgccaucaagaagggcauccugcaguccgucaagaucguggacgagcucgugaaggucaugggccacaacccgcagaacaucgugaucgagauggcgcgggagaaccagaucaccggguacggccgcaaccggagcaaccagcgccugaagcggcugcaggacucccucaaggaguucgggagcgacauccugagcaagaagaagcccuccuacguggacagcaaggucgagaacucccaccuccagaacgaccgccuguuccuguacuacauccagaacggcaaggacauguacaccggggaggagcuggacaucgaccaccucagcgacuacgacaucgaccacaucaucccccaggccuucaucaaggacaacuccaucgacaaccgggugcugacgagcuccgccaagaaccgcggcaagagcgacgacgugcccuccaucgagaucguccgcaaccgcaagagcuacugguacaagcuguacaaguccggccucaucagcaagcggaaguucgacaaccugaccaaggccgagcgcgggggccugaccgagaccgacaaggccggguucaucaagcggcagcucguggagacgcggcagaucaccaagcacguggcgcagauccuggacgcccgcuucaacaccaagugcgacgagaacgacaaggucauccgggacgugaaggugaucacccugaaguccagccucgucucccaguuccgcaaggaguucaaguucuacaaggugcgggagaucaacgacuaccaccacgcccacgacgccuaccugaacgccguggucggcacggcgcugcucaagaaguacccgaagcuggcccccgaguucguguacggcgaguacaagaaguacgacgugcgcaagcuggucgccaagagcuccgacaaccacagcgagcucgggaaggccaccgcgaaguacuucuucuacagcaaccugaugaacuucuucaagaccgaggugaaguacgccgacggccggguguucgagcgccccgacaucgagaccaacgccgacggggaggucguguggaacaagcagcgggacuucaacaucgugcgcaagguccuguccuacccccaggugaacaucgugaagaaggucgaggugcagacgggcggguucagcaaggaguccauccucccgaagggcgacagcgacaagcugaucccccggaagaccaagaagcugcagugggagacccagaaguacggcggguucgacucccccaccguggccuacagcguccucgugguggccgacgucgagaagggcaagacgcgcaagcugaagaccgugaaggagcugguggggaucuccaucauggagcggagcuccuucgaggagaaccccgucagcuuccucgagaagaagggcuaccacaacgugcaggaggacaagcugaucaagcugccgaaguacucccucuucgaguucgagggcgggcgccggcgccugcuggcgagcgccaccgagcuccagaagggcaacgaggugguccugccccaguacauggugaaccugcucuaccacucccagcacgugaacaacagccacaagcccgagcaccugaacuacgucaagcagcacaaggacgaguucaaggacaucuucaaccugaucaucuccaucgcccggaucaacauccucaagccgaaggugguggacaaccugaucaacgaguucaccgaguacgggcaggaggacaucagcucccugagcgaguccuucaucaaccuccugaaguucaucagcuucggcgcccccggggccuucaaguuccugaagcucgacgucaagcagagcaaccugcgcuacaaguccacgaccgaggcgcugagcgccacccucauccaccaguccgugaccggccuguacgagacgcgcaucgaccugagcaagcucggggaggaguga

SEQ ID NO: 2031 - RNA, 4137 nt, Artificial Sequence
  Cas9 variant
augaagaccuucgccgaggaguacgugauggacaagagcaagcccuacggcaucgggcuggacaucggcaccaacuccgucggguucguggccacggacgcggagggccaccucauccgccugaaggggaagaccgugaucggcgccuaccuguucaacgccggcaucagcgccgccgagcggcgcggguuccggaccacccgccggcgccucucccgggucaaguggcgccugggccugcuccgggagaucuucgagacgcacuuccaggagagcaugggggagaacgaggacaacgacuucuuccugcgcuucaaguacuccaacaucagccccaaggacccccaguucuccaccgcgaagggccuguucaacgaccggaccgacaaggaguucuacgaccaguaccccaccaucuaccaccuccgccgggcccugaugacggaggaccaccaguucgacauccgcgagaucuacaucgccaugcaccacaucgugaaguaccgggggcacuuccugaaggagggccgcgccaaggacuucaaggugggcgaccuccggcugcuggacaacuucaagaugaugaacgagcagaucgaggagaucaacccccucuggcagcugaagcugccgaccgacgacgcgagcaucaaguccaucaccgccauccuccuggacaacacccagagccagaacgaccgccagaaggccgucacgaaggugauccuggccacccucgugaaggccuccgacaaggacaucaacgcggcccggaagcgcuucgucggggagcugagcaaggccauggugggccugaagaccaagcucugggugcuggccgacgucucccagaacggggacugggagaucaaguacgagaacuacgccgacuucgcggagaccaucggcagcggcgaguccgacacgauccagagccuguucaacgagaucaacgaccucuacggggugaucacccuggccggcaucauccccaaggaggccgaguccuucagcgacgggauggugcggaaguacgagcaccaccgcaagaaccuggagcuccugaaggucuacugcgccgagcaguccgacggcaagcgcgggcggcagauccgccagaccuacgacaaguacaucgacggcguggacagcaagcaguucacccaggaggacuucuacaaggcccugagcaaguucacggcgaaggacgaggccaccuccgagaacgccaagcucaucgcccaggagaucgccgugggcaccuucaugcccaagcugcggaccaaggcgaacgggacgaucccccaccagcugcaccagaaggagcucgacgccaucaucgagaaccagaagaaguacuacccguggcugggcgaggucaaccccguggagagccaccgccgggcccugcccuacaagcucgacgagcugguguccuuccgcauccccuacuacgucgggccgauggugacccccaccaagggcgaccccgagaaguccaaguucgccuggauggugcggaaggagcccgggaccaucacgccguggaacuucgaccagaaggucgaccgcagcgcgagcggcgaggccuucauccagcggaugaagaccaccgacaccuuccugaucggcgaggacgugcucccccagcagucccugcuguaccagaaguucgagguccucaacgagcugaacaagaucaugaucaacgggaagcccaucugccgcgagcagaagcagcggcuguucaagcagcuguucaugcaguacaagacggugaccgugaagaagguccagcagaaccucaucgccaacggcgaggagagcgagaacgugcccaucaccgggcuguccgacccgcugcgcuucaacagcuccuucagcaccuacaucgacuacaaggacauccucggcacggccgccgugaacgacaacgcgaagcaguccgacaucgagcagaucaucgccuggagcaccaucuucgaggacgccgccaucuuccgggagaagcugaacgacaucaccuggcugaacgacgaccagcgcaacaagcucucccacaagcgguaccgcggguggggccggcacagccgcaagcugcuggccggccuccgggacggggagggccagaccaucaucgagcgccuguggaacaccaacgacaacuucaugcagauccagaacgacuccgagaucgcgcgccagaucacggaggccaacagcuccaagauggccaccgccgaggggaccgacgagaucaucgacggcuucuacaccagccccgagaacaagaaggcccugcgggaggucaugaagguggugaaggacauccagcgcgcgcaccacggccaggcccccgccugggucuacaucgagagcccccgggagacgccgcgccccgggcagcggaccgugucccgcgagcagcagcucaccgaccuguacgagggcgccgcgaaggagaucguggacgacgccguccugaacgagcucaaggacaaggucaagagcaaggagaacuucaccgacaagcuggugcuguacuuccuccagaacgggcacgacaucuacgccaacgacuccaucaacaucgacaaccugaacgccuacgacaucgaccacgugcugccccagagccucaucaaggacgacucccuggacaaccgggugcugacgacccacgagcgcaaccucaagaaguccaaccgguucgccaccgagcuguucgcggaccagcgcaagaagugggagaaguggcaccggcugggccucaucagcagccgcaagcugaagcaccugaccaugcagcccaacuccguggagaaguucgcccacggguucaucgcccggcagcucacggagacccgccagaucauccaccugaccgccaacguccugagcaaccucuaccaggagaacgacaccaagaucgugaugaucaaggccggccugaacuccgaguuccggcgcacguucgacuucccgaagaaccggagcgugaacgacuaccaccacgcguucgacgccuuccugaccgccaagaucggccgcuaccuccuggcccgguaccccaagcuggagcccuucuucgucuacgggaacuucgugaagaacccgaaggccaugaagcgccucuccagcuucgacuucaucgcgcagcuggccgccaagaccgacgacaccucccacaucgaccagcggagccugaagcagguccccguggugaacgaggagacgggcgagaucgugugggacaaggacaucgagcucgccgagcuggacaagaccuacaacuacaagaccaugcuggucaagcgcgcgcagaccgagaacaacgcccagauguucaagcagacgguguucaaggcccgcgacaaccagaacaagacccucauccccgugaagaacgggcuguccaccgacgucuacggcgggcacagccagcaggccaucagcuaccugugcaucgugugggugggccagaagaagaaguaccggguccucggcaucuccaccgcccacgcggggauccugaacaacuucgagaagaacuacggccgcuucgaggccaagaagaagcugcaggagaucgugagcaacacgcucgacaacgccgaccggaacgacuucaagaucguggcccccaagguccuguucgagcaggucguggaggacgacaacaugaaguucgggcugggcuccgccagcgacuaccgcaacgugcagcagcuguuccucucccggaagaaccagcugcuccuggcgaacaugaugaccgaccagauccacgaccaggaccuggugcaccucuucgacgagaucguggggcagaugaacgcccacuucccgaucuucgaccgcggcggcuaccggagcucccugacccagagccgcgacaaguuccugaagcuccccuucaagaagaacgaggaccugaucaccaagcaggaggucauccggcgcauccuggacgggcuccacgccaacgccaaccggaaggaccugaagaucaucggcuccaagggggacuucggccgccuggggacgaagaagaucuaccucagcaaggacgccaagcugaucuacaccuccccgaccugccuguucacccggacggugccccucagcucccuguga

SEQ ID NO: 2032 - RNA, 4137 nt, Artificial Sequence
  Cas9 variant
augaccaacgagaaguacagcaucggccuggacaucgggaccuccagcaucggcuucgccguggucaacgacaacaaccgcgugauccgggugaaggggaagaacgccaucggcguccgccucuucgacgaggggaaggcggccgccgaccggcgcuccuuccggacgacccgccggcgccugagccggcgccgguggcgccugaagcuccugcgggagaucuucgacgccuacaucacccccguggacgaggccuucuucauccgccugaaggaguccaaccucagcccgaaggacuccaagaagcaguacagcggcgacauccuguucaacgaccgguccgacaaggacuucuacgagaaguaccccaccaucuaccaccuccgcaacgcgcugaugacggagcaccggaaguucgacgugcgcgagaucuaccuggccauccaccacaucaugaaguuccggggccacuuccugaacgccacccccgccaacaacuucaaggucgggcgccucaaccuggaggagaaguucgaggagcugaacgacaucuaccagcggguguuccccgacgagagcaucgaguuccgcaccgacaaccucgagcagaucaaggaggugcugcuggacaacaagcgcucccgggcggaccgccagcggacccucgucagcgacaucuaccaguccagcgaggacaaggacaucgagaagcgcaacaaggccguggccacggagauccugaaggccucccugggcaacaaggccaagcucaacgugaucaccaacgucgagguggacaaggaggcggccaaggaguggagcaucaccuucgacuccgagagcaucgacgacgaccuggccaagaucgaggggcagaugaccgacgacggccacgagaucaucgaggugcugcggucccucuacagcgggaucacgcugagcgccaucgucccggagaaccacacccugucccagagcaugguggccaaguacgaccuccacaaggaccaccugaagcuguucaagaagcucaucaacggcaugaccgacaccaagaaggcgaagaaccugcgcgccgccuacgacggcuacaucgacggggugaagggcaagguccugccccaggaggacuucuacaagcagguccaggugaaccucgacgacuccgccgaggccaacgagauccagacguacaucgaccaggacaucuucaugcccaagcagcggaccaaggcgaacgggagcaucccccaccagcugcagcagcaggagcuggaccagaucaucgagaaccagaaggccuacuacccguggcucgccgagcugaaccccaaccccgacaagaagcgccagcagcuggccaaguacaagcucgacgagcuggugaccuuccgggugcccuacuacgugggcccgaugaucaccgccaaggaccagaagaaccaguccggcgcggaguucgccuggaugauccgcaaggagcccgggaacaucacgcccuggaacuucgaccagaaggucgaccggauggccaccgccaaccaguucaucaagcgcaugaccaccacggacaccuaccugcucggcgaggacgugcugcccgcgcagagccugcucuaccagaaguucgagguccugaacgagcugaacaagauccggaucgaccacaagccgaucuccaucgagcagaagcagcagaucuucaacgaccucuucaagcaguucaagaacgugaccaucaagcaccuccaggacuaccuggugagccaggggcaguacuccaagcgcccccugaucgagggccuggccgacgagaagcgguucaacagcucccugagcaccuacuccgaccugugcgggaucuucggcgccaagcucgucgaggagaacgaccgccaggaggaccuggagaagaucaucgaguggagcacgaucuucgaggacaagaagaucuaccgggccaagcugaacgaccucaccuggcugaccgacgaccagaaggagaagcuggccaccaagcgcuaccagggcugggggcggcucucccgcaagcugcuggugggccucaagaacagcgagcaccgcaacaucauggacauccuguggaucacgaacgagaacuucaugcagauccaggcggagcccgacuucgccaagcuggugaccgacgccaacaaggggaugcucgagaagaccgacucccaggacgucaucaacgaccuguacaccagcccccagaacaagaaggccauccggcagauccugcucguggugcacgacauccagaacgccaugcacggccaggcgccggccaagauccacgucgaguucgcccgcggggaggagcggaacccccgccgguccgugcagcgccagcgccagguggaggccgccuacgagaaggucagcaacgagcuggugagcgcgaaggugcggcaggaguucaaggaggccaucaacaacaagcgggacuucaaggaccgccugcuccuguacuucaugcagggcggcaucgacaucuacacggggaagcagcugaacaucgaccagcucuccagcuaccagaucgaccacauccugccccaggccuucgucaaggacgacucccugaccaaccgggugcucaccaacgagaaccaggugaaggccgacagcguccccaucgacaucuucggcaagaagaugcuguccgugugggggcgcaugaaggaccagggccugaucagcaaggggaaguaccggaaccucaccaugaacccggagaacaucuccgcgcacaccgagaacggcuucaucaaccgccagcugguggagacgcggcaggucaucaagcuggccgugaacauccucgccgacgaguacggcgacagcacccagaucaucuccgugaaggccgaccugagccaccagaugcgcgaggacuucgagcugcucaagaaccgggacgucaacgacuaccaccacgccuucgacgcguaccuggccgccuucaucgggaacuaccugcucaagcgcuaccccaagcuggaguccuacuucguguacggcgacuucaagaaguucacccagaaggagaccaagaugcggcgcuucaacuucaucuacgaccugaagcacugcgaccagguggucaacaaggagacgggggagauccucuggaccaaggacgaggacaucaaguacauccggcaccuguucgccuacaagaagauccuggugagccacgaggugcgcgagaagcgcggcgcccucuacaaccagaccaucuacaaggcgaaggacgacaagggcuccgggcagggcagcaagaagcugauccggaucaaggacgacaaggagaccaagaucuacgggggcuacuccggcaagagccuggccuacaugacgaucguccagaucaccaagaagaacaagguguccuaccgcgugaucgggauccccacccucgcccuggcccggcugaacaagcucgagaacgacagcaccgagaacaacggcgagcuguacaagaucaucaagccccaguucacgcacuacaaggucgacaagaagaacggggagaucaucgagaccaccgacgacuucaagaucguggugagcaagguccgcuuccagcagcugaucgacgacgccggccaguucuucaugcucgcguccgacaccuacaagaacaacgcccagcagcuggugaucagcaacaacgcccugaaggccaucaacaacacgaacaucaccgacugcccgcgggacgaccucgagcgccuggacaaccugcggcucgacuccgcguucgacgagaucgugaagaagauggacaaguacuucagcgccuacgacgccaacaacuuccgcgagaagauccggaacuccaaccugaucuucuaccagcugcccgucgaggaccagugggagaacaacaagaucaccgagcucgggaagcgcaccgugcugacgcggauccugcagggccuccacgccaacgccaccaccaccgacaugagcaucuucaagaucaagacgcccuucgggcagcugcgccagcgguccggcaucagccuguccgagaacgcgcagcucaucuaccagagcccgaccggccuguucgagcgccgggugcagcugaacaagaucaaguga

SEQ ID NO: 2033 - RNA, 4137 nt, Artificial Sequence
  Cas9 variant
augaagaacaaggacuacagcaucgggcuggacaucgggaccuccagcaucggcuucgccguggucgacgagaacaaccacgugaugcgcgugaaggggaagaacgccaucggcguccggcuguucgacgaggggaagcccgcggccgaccgccgggccuuccgcaccacgcggcgccggcugucccgccggcgcuggcggcugaagcuccugcgcgagaucuucgacagcuacaucaccccgguggacgaggccuucuucauccggcugaaggaguccaaccucagccccaaggacuccaagaagcaguacagcggcgacauccuguucaacgaccgcuccgacaaggacuucuacaccaaguaccccaccaucuaccaccuccggaacgcccucaugacggagcaccagcgcuucgacauccgggagaucuaccuggcgauccaccacaucgugaaguuccgcggccacuuccugaacgccacccccgccaacaacuuccaggucgggaagcucgaccuggaccagaaguucgaggaccugaacgacaucuaccagcggguguucccggacgacagcaucgaguuccgcaucgacaaccucgagcagaucaaggccgugcugcuggacuccaagcggagccgcuccgaccgccagcggagccucgucgacgacguguaccagaccuccgaggacaaggagguggagaagcagaacaaggcggucgccaccgaggugcugaaggccauccugggcaacaaggccaagcucaacaucaucgccaacguggaggucgacaaggaggcggccaaggaguggacgaucaccuucgacagcgaguccaucgacgacgaccuggccaagaucgacgggcagaugaccgacgacggccgcgccaucguggagauccugcggagccucuacuccgggaucacccugagcgccaucgugcccgagaaccacacgcugagccaggcgauggucgccaaguacgaccuccacaagaagcaccugacccugcucaagaagcugaucaacuccaugaccgacaccaagaaggccaagaaccugcgcgccgccuacgacggcuacguggacggcgugaaggggaagguccucacgcaggacgaguucuacaagcagauccagagcaaccuggacgaguccguggaggcgagcgagauccagaccuacaucgaccaggacaucuucaugcccaagcagcggaccaaggccaacggcuccaucccccaccagcugcagcagcaggagcucgaccagaucaucgagaaccagaaggaguacuacccguggcuggccgagcugaaccccaaccccgacaagaagcgccagcagcucgccaaguacaagcuggacgagcuggugaccuuccggguccccuacuacguggggccgaugaucacggccgaggcgcagaagaagcagagcggcgccgaguucgccuggaugauccgcaaggaguccggcaacaucacccccuggaacuucgaccagaaggucgaccggauggccaccgcgaaccaguucaucaagcgcaugaccacgaccgacaccuaccuccugggggaggacgugcugcccagccagucccuccuguaccagcgguucgaggugcugaacgagcucaacaagauccgcaucgaccggaagcccaucagcgucgagcugaagcagcagaucuucaacgaccuguucaagaaguucaagaacgugaccaucaagcaccuccaggacuaccucguggcccagggccaguacuccaagcgcccgcugaucgaggggcuggccgacgagaagcgguucaacagcggccucuccacguacaacgacuucugcgggaucuucggcgccaagcuggucgacgagaacgaccgccaggccgaccuggagaagaucaucgaguggagcaccaucuucgaggacaagaagaucuaccgggcgaagcucaacgaccuggccuggcugaccgacgagcagaaggacaagcucgccaccaagcgcuaccagggcugggggcggcuguccagcaagcugcucaucggccugcagaacuccgagcaccgcaacaucauggaccugcucuggaucgggaacgagaacuucaugcagauccaggccgacagcgacuucgccaagcugaucaaggacgcgaaccagaacgcccugcagaacaacgacucccaggacgugaucaacgaccucuacacgagcccccagaacaagaaggccauccgccagauccugcuggugguccacgacauccagaacgccaugcacggccaggcccccaccaagauccacguggaguucgcgaagggggaggagcggaacccccgccggagcgugcagcgccagcggcaggucgaggccgccuacgagaaggccuccaacgagcucgugggcgcgaacgugcgcgaggagcugaaggacgccaucaccaacaagcgggacuucaaggaccgccuguuccucuacuucaugcagggcggggucgacauguacagcggcgagccgaucaacaucgacaaccugucccgguacgacaucgaccacauccugccccaggccuucgugaaggacgacagccucaacaaccgcgugcugaccgacgccgagaagaaccggcgcaaguccgacgccguccccaacgagcuguucggggcgaagaugcgggugacgugggagcgcaugaaggagcagggccucaucagcaaggggaaguaccggaaccugaccaugaaccccgagaacaucaacaaguacaccgagaacggcuucaucaaccgccagcugguggagacccggcaggucaucaagcucgccgugaacauccuggccgacgaguacaaggagaacacccagaucaucuccgugaaggccgaccugagccaccagaugcgcgaggacuucgagcuccugaagaaccgggacgucaacgacuaccaccacgccuucgacgcguaccuggccgccuucaugggcaacuaccuccugaagcgcuacccgaagcugcgguccuacuucguguacggggacuucaagaaguucacgcagaaggagaucaagcuccgccgcuucaacuucaucuacgaccugaagcacgaggaccaggugaucgacaaggagaccggcgagauccuguggaacaagaacgaggacaucgccuacauccggcaccucuucgccuacaagaagauccugaucagccacgaggucuccgagcgccgcggggcgcuguacaaccagaccguguacaaggccagcgacgacaaggccuccggccagggcagcaagaagcucauccccaucaaguccgacaagcccaccgagaucuacgggggcuacacggggcggacccuggccuacaugaccaucgugaaggucaccaagggcaagaagaucagcuacaaggugguggggguccccacggcggugcuggccaagauggccggcgugcggcagggcucccaggaggagcaggacaagcucuacgggguccugaagccgcaguucacccaccagaaggagaacaagaagaccggcgagaucaccgagacgguggacaaguucgacaucaucgugcccaaggucaaguaccagcagcuggugaacgacaacgggcagcuguucaugaucggcagcgacacccugcccuacaacgccgagcagcuggugcucagcaaggaguccguccagaccaucaacaacccggggaucaaggacgagggcagcgacgaggaguccgagaacaagaagcuggacaacguguacgacgagaucgugcugugcaugaacaaguacuucccccucuacgacaaccgcggcuuccggaacagcaucaccaacgggaagaacaaguuccugaagcugcccaucaagaacaucuacaagaacggcaagcucaucaacgucgggaagcgcgaggugaucaaccggauccugcagggccugcacgccaacgcguccgugacggaccucagcaaccuggggaucaagucccccuucggcuuccugcagaagggcgccgggcucagccuguccggcgaggcccagcugauccaccagagcgccaccggccucuucgagcaccgcguccagcugaacaagaucaaguga

SEQ ID NO: 2034 - RNA, 4137 nt, Artificial Sequence
  Cas9 variant
augagcaacaagcccuacuccaucggccuggacaucgggaccaacagcgugggcugggccgucaucaccgacgacuacaaggugccguccaagaagaugaaggugcucgggaacacggacaagcacuucaucaagaagaaccugaucggcgcccugcuguucgacgaggggaccaccgcggagggccgccggcugaagcgcaccgcccggcgccgguacacgcgccggaagaaccgccugcgguaccuccaggagaucuucagcgaggagaucuccaaggucgacagcuccuucuuccaccgccuggacgacagcuuccuggugcccgaggacaagcggggcuccaaguaccccaucuucgccacccucgccgaggagaaggaguaccacaagaacuuccccaccaucuaccaccuccgcaagcagcuggccgacagcaaggagaaggcggaccuccggcugaucuaccuggcccucgcccacaugaugaaguaccgcgggcacuuccuguacgaggaguccuucgacaucaagaacaacgacauccagaagaucuucaacgaguucaucagcaucuacgacaacaccuucgagggcuccagccuguccgagcagaacgugcaggucgaggccaucuucacggacaagaucagcaaguccgcgaagcgggagcgcgugcucaagcuguucccggacgagaaguccaccgggcuguucagcgaguuccucaagcugaucgugggcaaccaggccgaguucaagaagcacuucgaccuggaggagaaggcgccccuccaguucagcaaggacaccuacgacgaggaccuggagaaccugcucgggcagaucggcgacggcuucgccgaccuguuccuggucgccaagaagcucuacgacgccauccugcugagcgggauccucaccgugacggaccccuccaccaaggcgccccugagcgccuccaugaucgagcgguacgagaaccaccagaaggaccuggccagccucaagcaguucaucaagaacaaccugccggccgagaagugcguggaggucuucuccgaccagagcaaggacggcuacgccggguacaucgacggcaagaccacccaggaggccuucuacaaguacaucaagaaccugcucuccaagcuggagggcgccuacuacuuccuggacaagaucgagcgcgaggacuuccuccggaagcagcgcacguucgacaacgggagcaucccccaccagauccaccuccaggagaugaacgccauccugcggcgccagggcgagcacuaccccuuccugaaggagaaccgcgagaagaucgagaagauccugaccuuccggauccccuaccacguggggccgcuggcccgcggcaaccgggacuucgcguggcucacccgcaacuccgacgaggccauccggcccuggaacuucgaggagaucguggaccaggccagcuccgccgaggacuucaucaacaagaugaccaacuacgaccuguaccugcccgaggagaagguccugcccaagcacagccuccuguacgagacguucgccguguacaacgagcugaccaaggugaaguucaucgcggaggggcucacccgcuaccaguuccuggacaagaagcagaagaaggacaucuucuacaccuucuucaaggccgaggacaagcggaaggucacggagaaggacaucauccacuaccugcacaacguggacggcuacgacggcaucgagcucaaggggaucgagaagcaguucaacgccucccugagcaccuaccacgaccugcucaagaucaucaaggacaaggaguucauggacgacccgaagaacgaggagauccuggagaacaucgugcacacccugaccaucuucgaggaccgcgagaugaucaagcagcggcucgcccaguacgacucccuguucgacgagaaggucaucaaggcgcugacgcgccggcacuacaccggcugggggaagcucagcgccaagcugaucaacggcaucugcgacaagcagaccgggaagaccauccuggacuaccucaucgacgacggcaagaucaaccgcaacuucaugcagcugaucaacgacgacggccuguccuucaaggagaucauccagaaggcccaggugguggggaagacguacgacgucaagcaggucgugcaggagcuccccggcagccccgccaucaagaaggggauccugcaguccgugaagcugguggacgagcucgucaaggugaugggccacgcccccgagagcaucgugaucgagauggcgcgggagaaccagaccaccgccaaggggaagaagaacagccagcagcgcuacaagcggaucgaggacgccaucaagaaccuggccccgggccuggacuccaccauccucaaggagcaccccacggacaacauccagcugcagaacgaccgccuguuccucuacuaccugcagaacggccgggacauguacaccgggaagccccuggagaucaaccagcucagcaacuacgacaucgaccacaucaucccccaggccuucaucaaggacgacucccuggacaaccgcguccugaccagcuccaaggagaaccggggcaagagcgacaacgugccgucccucgagguggucgagaagaugaaggcguucuggcagcagcugcuggacagcaagcucaucuccgagcgcaaguucaacaaccugaccaaggccgagcgcgggggccuggacgagcucgacaaggugggcuucaucaagcggcagcugguggagacccgccagaucacgaagcacgucgcccagauccuggacgcccgguucaacaaggaggugaccgagaagaacaagaagaaccgcaacgugaagaucaucacccucaagagcaacauggucuccaacuuccggaaggaguucgggcuguacaaggugcgcgagaucaacgacuaccaccacgcccacgacgcguaccugaacgccguggucgccaaggccauccucaagaaguaccccaagcuggagcccgaguucguguacggcgacuaccagaaguacgaccugaagcgguacaucagcaaguccaaggaccccaaggagguggagaaggcgaccgagaaguacuucuucuacagcaaccuccugaacuucuucaaggaggagguccacuacgccgacgggacgaucgugaagcgcgagaacaucgaguacuccaaggacaccggcgagaucgccuggaacaaggagaaggacuucgccaccaucaagaaggugcugagcuucccgcaggucaacaucgugaagaagaccgaggagcagacgguggggcagaacggcggccucuucgacaacaacaucgucuccaaggagaaggugguggacgccagcaagcugauccccaucaagagcgggcugucccccgagaaguacggcggguacgcgcggccgaccaucgccuacagcguccucgugaccuacaagcagaacaacaagaucaagaacaccauggugggcauccccguccugacgaagcuggaguucgagcgcgaccccaaccucuaccugcggaaccuggggaucaacaacgugucccacgugaucaagcucgucaagcacaccgugcuggaguucaagcacaaguacggcaccuaccgccgguucaucgugagcaaccaggagcugaagcgcgccaaccagaucuucgucaccacgaagcagaugaagcucaucucccaguacaccacccuggacaagaacgagcacgacagccugcucaagaacaaccagcagcugauccaguccaucuggaaccaguuccuggaguucaugcucgccaccgaccuggugaacaagaagcaguacgacgagcugauccucacgaacaaccagaccaucgaggagugccggaacaucaugaaccgcgugaucaccacccugagcuucacgaacaucaacgccggccagaagaagaucaucuucgacgacacccugucccuccccaucaagcgguggcaguucaccgacagcgacaagauggucaagaagaucaucgaguccacccugauccaccagagcaucacggggcuguacgagacccgcaucgaccucaacaagcugggcgaggacuga

SEQ ID NO: 2035 - RNA, 4137 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccugcuguucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgaugcaggaggagaaguacuaccacgagaaguuccccaccaucuaccaccuccggaaggagcuggcggacaagaaggagaaggccgaccugcgccucaucuaccuggcccuggcccacaucaucaaguuccgggggcacuuccucaucgaggacgaccgcuucgacgugcggaacaccgacauccagaagcaguaccaggcguuccuggagaucuucgacaccacguucgagaacaacgaccugcucucccagaacguggacgucgaggccauccugaccgacaagaucagcaaguccgccaagaaggaccgcauccuggcccgguaccccaaccagaaguccaccggcaucuucgccgaguuccucaagcugaucguggggaaccaggcggacuucaagaagcacuucaaccuggaggacaagaccccgcuccaguucgccaaggacagcuacgacgaggaccuggagaaccugcucggccagaucggggacgaguucgccgaccuguucagcgccgccaagaagcuguacgacuccgugcuccugagcggcauccugacggucaucgaccucuccaccaaggcgccccugagcgccuccaugauccagcgcuacgacgagcaccacgaggaccugaagcaccucaagcaguucgugaaggccagccugcccgagaacuaccgggagguguucgccgacuccagcaaggacggcuacgccggguacaucgagggcaagaccagccaggaggcguucuacaaguaccugcucaagcugcugaccaagcaggagggguccgaguaccuccuggagaagaucaagaacgaggacuuccugcgcaagcagcgcacguucgacaacggcagcaucccccaccagguccaccucaccgagcugcgggccaucauccgccggcaguccgaguacuacccguuccugaaggagaaccucgaccgcaucgagaagauccugaccuuccggauccccuacuacgugggcccccuggcccgcgagaaguccgacuucgccuggaugacccggaagacggacgacagcauccgccccuggaacuucgaggaccugguggacaaggagaaguccgccgaggcguucauccaccggaugaccaacaacgaccucuaccugccggaggagaagguccugcccaagcacagccucaucuacgagaaguucaccguguacaacgagcugaccaaggugcgcuuccuggccgagggguucaaggacuuccaguuccucaaccggaagcagaaggagacgaucuucaacagccuguucaaggagaagcgcaaggucaccgagaaggacaucaucuccuuccugaacaagguggacggcuacgaggggaucgccaucaagggcaucgagaagcaguucaacgccagccucuccaccuaccacgaccugaagaagauccuggggaaggacuuccucgacaacaccgacaacgagcugauccuggaggacaucauccagacgcucacccuguucgaggaccgggagaugaucaagaagcgccuggacaucuacaaggacuucuucaccgagagccagcucaagaagcuguaccggcgccacuacaccggcuggggccggcuguccgcgaagcucaucaacgggauccgcaacaaggagaaccagaagacgauccuggacuaccugaucgacgacggcagcgccaaccggaacuucaugcagcucaucaaggacgccgggcuguccuucaagcccaucaucgacaaggcccgcaccggcagccacuccgacaaccugaaggagguggucggggagcucgccggcagccccgcgaucaagaagggcauccugcagucccugaagaucguggacgagcucgugaaggucaugggguacgagccggagcagaucguggucgagauggcccgcgagaaccagaccaccgccaagggccugagccggagccgccagcggcugacgacccuccgcgagucccuggggaaccucaagagcaacauccucgaggagaagaagcccaaguacgugaaggaccagguggagaaccaccaccuguccgacgaccggcuguuccucuacuaccugcagaacggcaaggacauguacaccgacgacgagcuggacaucgacaaccucagccaguacgacaucgaccacaucaucccccaggccuucaucaaggacgacuccaucgacaaccgcguccuggugagcuccgccaagaaccggggcaagagcgacgacgugcccuccaucgagaucgucaaggcgcgcaagauguucuggaagaaccugcucgacgccaagcugaugagccagcggaaguacgacaaccugaccaaggccgagcgcgggggccucaccuccgacgacaaggcccgguucauccagcgccagcugguggagacgcggcagaucaccaagcacguggcccgcauccuggacgagcgguucaacaacgagcucgacagcaaggggcgccggauccgcaaggucaagaucgugacccugaaguccaaccuggugagcaacuuccggaaggaguucggcuucuacaagauccgcgaggucaacaacuaccaccacgcgcacgacgccuaccucaacgccgugguggccaaggcgauccugaccaaguacccgcagcuggagcccgaguucgucuacgggcucuaccggcgcaagaagcuguccaagaucgugcgcgaggacaaggaggagaaguacagcgaggccacgcggaagauguucuucuacuccaaccugaugaacauguucaagcgcgugguccggcucgccgacggcagcaucguggugcgccccgucaucgagaccggccgguacauggggaagaccgccugggacaagaagaagcacuucgccaccgugcgcaaggugcugagcuacccccagaacaacaucgucaagaagacggagauccagaccggcggguucuccaaggagagcauccuggcgcacggcaacuccgacaagcucaucccgcggaagaccaaggacaucuaccuggaccccaagaaguacgggggcuucgacagccccaucguggccuacuccgugcuggucguggccgacaucaagaagggcaaggcccagaagcucaagaccgugacggagcugcuggggaucaccaucauggagcgcagccgguucgagaagaacaccuccgccuuccucgagagcaagggcuaccugaacauccgcgacgacaagcugaugauccuccccaaguacucccuguucgagcuggagaacgggcggcgccggcuccuggcgagcgccggcgagcugcagaaggggaacgagcucgcccugccgacccaguucaugaaguuccuguaccucgccucccgcuacaacgagagcaagggcaagcccgaggagaucgagaagaagcaggaguucgucaaccagcacguguccuacuucgacgacauccugcagcugaucaacgacuucagcaaccgggugauccucgccgacgcgaaccuggagaagaucaacaagcuguaccaggacaacaaggagaacauccccgucgacgagcucgccaacaacaucaucaaccuguucacguucaccucccugggcgccccggccgcguucaaguucuucgacaagaucguggaccgcaagcgguacaccagcaccaaggaggugcucaacuccacgcugauccaccagagcaucaccgggcuguacgagacccgcaucgaccucggcaagcugggggagggcuga

SEQ ID NO: 2036 - RNA, 4137 nt, Artificial Sequence
  Cas9 variant
augaccaacgagaaguacagcaucggccuggacaucgggaccuccagcaucggcuucgccguggucaacgacaacaaccgcgugauccgggugaaggggaagaacgccaucggcguccgccucuucgacgaggggaaggcggccgccgaccggcgcuccuuccggacgacccgccggcgccugagccggcgccgguggcgccugaagcuccugcgggagaucuucgacgccuacaucacccccguggacgaggccuucuucauccgccugaaggaguccaaccucagcccgaaggacuccaagaagcaguacagcggcgacauccuguucaacgaccgguccgacaaggacuucuacgagaaguaccccaccaucuaccaccuccgcaacgcgcugaugacggagcaccggaaguucgacgugcgcgagaucuaccuggccauccaccacaucaugaaguuccggggccacuuccugaacgccacccccgccaacaacuucaaggucgggcgccucaaccuggaggagaaguucgaggagcugaacgacaucuaccagcggguguuccccgacgagagcaucgaguuccgcaccgacaaccucgagcagaucaaggaggugcugcuggacaacaagcgcucccgggcggaccgccagcggacccucgucagcgacaucuaccaguccagcgaggacaaggacaucgagaagcgcaacaaggccguggccacggagauccugaaggccucccugggcaacaaggccaagcucaacgugaucaccaacgucgagguggacaaggaggcggccaaggaguggagcaucaccuucgacuccgagagcaucgacgacgaccuggccaagaucgaggggcagaugaccgacgacggccacgagaucaucgaggugcugcggucccucuacagcgggaucacgcugagcgccaucgucccggagaaccacacccugucccagagcaugguggccaaguacgaccuccacaaggaccaccugaagcuguucaagaagcucaucaacggcaugaccgacaccaagaaggcgaagaaccugcgcgccgccuacgacggcuacaucgacggggugaagggcaagguccugccccaggaggacuucuacaagcagguccaggugaaccucgacgacuccgccgaggccaacgagauccagacguacaucgaccaggacaucuucaugcccaagcagcggaccaaggcgaacgggagcaucccccaccagcugcagcagcaggagcuggaccagaucaucgagaaccagaaggccuacuacccguggcucgccgagcugaaccccaaccccgacaagaagcgccagcagcuggccaaguacaagcucgacgagcuggugaccuuccgggugcccuacuacgugggcccgaugaucaccgccaaggaccagaagaaccaguccggcgcggaguucgccuggaugauccgcaaggagcccgggaacaucacgcccuggaacuucgaccagaaggucgaccggauggccaccgccaaccaguucaucaagcgcaugaccaccacggacaccuaccugcucggcgaggacgugcugcccgcgcagagccugcucuaccagaaguucgagguccugaacgagcugaacaagauccggaucgaccacaagccgaucuccaucgagcagaagcagcagaucuucaacgaccucuucaagcaguucaagaacgugaccaucaagcaccuccaggacuaccuggugagccaggggcaguacuccaagcgcccccugaucgagggccuggccgacgagaagcgguucaacagcucccugagcaccuacuccgaccugugcgggaucuucggcgccaagcucgucgaggagaacgaccgccaggaggaccuggagaagaucaucgaguggagcacgaucuucgaggacaagaagaucuaccgggccaagcugaacgaccucaccuggcugaccgacgaccagaaggagaagcuggccaccaagcgcuaccagggcugggggcggcucucccgcaagcugcuggugggccucaagaacagcgagcaccgcaacaucauggacauccuguggaucacgaacgagaacuucaugcagauccaggcggagcccgacuucgccaagcuggugaccgacgccaacaaggggaugcucgagaagaccgacucccaggacgucaucaacgaccuguacaccagcccccagaacaagaaggccauccggcagauccugcucguggugcacgacauccagaacgccaugcacggccaggcgccggccaagauccacgucgaguucgcccgcggggaggagcggaacccccgccgguccgugcagcgccagcgccagguggaggccgccuacgagaaggucagcaacgagcuggugagcgcgaaggugcggcaggaguucaaggaggccaucaacaacaagcgggacuucaaggaccgccuguuccucuacuucaugcagggcggcaucgacaucuacacggggaagcagcugaacaucgaccagcuguccagcuaccagaucgaccacauccucccccaggccuucgucaaggacgacucccugaccaaccgggugcugaccaacgagaaccaggugaaggccgacagcguccccaucgacaucuucggcaagaagaugcucuccgugugggggcgcaugaaggaccagggccugaucagcaaggggaaguaccggaaccugaccaugaacccggagaacaucuccgcgcacaccgagaacggcuucaucaaccgccagcucguggagacgcggcaggucaucaagcuggccgugaacauccuggccgacgaguacggcgacagcacccagaucaucuccgugaaggccgaccucagccaccagaugcgcgaggacuucgagcugcugaagaaccgggacgucaacgacuaccaccacgccuucgacgcguaccucgccgccuucaucgggaacuaccugcugaagcgcuaccccaagcucgaguccuacuucguguacggcgacuucaagaaguucacccagaaggagaccaagaugcggcgcuucaacuucaucuacgaccugaagcacugcgaccagguggucaacaaggagacgggggagauccuguggaccaaggacgaggacaucaaguacauccggcacagcuucgccuacaagaagauccucgugucccacgaggugcgcgagaagcgcggcgcccuguacaaccagaccaucuacaaggcgaaggacgacaagggcagcgggcagggcuccaagaagcugauccggaucaaggacgacaaggagaccaagaucuacgggggcuacagcgggaagucccucgccuacaugacgaucguccagaucaccaagaagaacaaggugagcuaccgcgugaucggcauccccacccuggcccuggcccggcucaacaagcuggagaacgacagcaccgagaacaacggcgagcuguacaagaucaucaagccccaguucacgcacuacaaggucgacaagaagaacggggagaucaucgagaccaccgacgacuucaagaucgugguguccaagguccgcuuccagcagcucaucgacgacgccggccaguucuucaugcuggcgagcgacaccuacaagaacaacgcccagcagcuggugaucuccaacaacgcccucaaggccaucaacaacacgaacaucaccgacugcccgcgggacgaccuggagcgccuggacaaccuccggcuggacagcgcguucgacgagaucgugaagaagauggacaaguacuucuccgccuacgacgccaacaacuuccgcgagaagauccggaacagcaaccugaucuucuaccagcuccccgucgaggaccagugggagaacaacaagaucaccgagcuggggaagcgcaccgugcugacgcggauccuccagggccugcacgccaacgccaccaccaccgacauguccaucuucaagaucaagacgcccuucgggcagcugcgccagcggagcggcaucucccucagcgagaacgcgcagcugaucuaccaguccccgaccggccuguucgagcgccgggugcagcucaacaagaucaaguga

SEQ ID NO: 2037 - RNA, 4137 nt, Artificial Sequence
  Cas9 variant
augaccaacgagaaguacagcaucggccuggacaucgggaccuccagcaucggcuucgccguggucaacgacaacaaccgcgugauccgggugaaggggaagaacgccaucggcguccgccucuucgacgaggggaaggcggccgccgaccggcgcuccuuccggacgacccgccggcgccugagccggcgccgguggcgccugaagcuccugcgggagaucuucgacgccuacaucacccccguggacgaggccuucuucauccgccugaaggaguccaaccucagcccgaaggacuccaagaagcaguacagcggcgacauccuguucaacgaccgguccgacaaggacuucuacgagaaguaccccaccaucuaccaccuccgcaacgcgcugaugacggagcaccggaaguucgacgugcgcgagaucuaccuggccauccaccacaucaugaaguuccggggccacuuccugaacgccacccccgccaacaacuucaaggucgggcgccucaaccuggaggagaaguucgaggagcugaacgacaucuaccagcggguguuccccgacgagagcaucgaguuccgcaccgacaaccucgagcagaucaaggaggugcugcuggacaacaagcgcucccgggcggaccgccagcggacccucgucagcgacaucuaccaguccagcgaggacaaggacaucgagaagcgcaacaaggccguggccacggagauccugaaggccucccugggcaacaaggccaagcucaacgugaucaccaacgucgagguggacaaggaggcggccaaggaguggagcaucaccuucgacuccgagagcaucgacgacgaccuggccaagaucgaggggcagaugaccgacgacggccacgagaucaucgaggugcugcggucccucuacagcgggaucacgcugagcgccaucgucccggagaaccacacccugucccagagcaugguggccaaguacgaccuccacaaggaccaccugaagcuguucaagaagcucaucaacggcaugaccgacaccaagaaggcgaagaaccugcgcgccgccuacgacggcuacaucgacggggugaagggcaagguccugccccaggaggacuucuacaagcagguccaggugaaccucgacgacuccgccgaggccaacgagauccagacguacaucgaccaggacaucuucaugcccaagcagcggaccaaggcgaacgggagcaucccccaccagcugcagcagcaggagcuggaccagaucaucgagaaccagaaggccuacuacccguggcucgccgagcugaaccccaaccccgacaagaagcgccagcagcuggccaaguacaagcucgacgagcuggugaccuuccgggugcccuacuacgugggcccgaugaucaccgccaaggaccagaagaaccaguccggcgcggaguucgccuggaugauccgcaaggagcccgggaacaucacgcccuggaacuucgaccagaaggucgaccggauggccaccgccaaccaguucaucaagcgcaugaccaccacggacaccuaccugcucggcgaggacgugcugcccgcgcagagccugcucuaccagaaguucgagguccugaacgagcugaacaagauccggaucgaccacaagccgaucuccaucgagcagaagcagcagaucuucaacgaccucuucaagcaguucaagaacgugaccaucaagcaccuccaggacuaccuggugagccaggggcaguacuccaagcgcccccugaucgagggccuggccgacgagaagcgguucaacagcucccugagcaccuacuccgaccugugcgggaucuucggcgccaagcucgucgaggagaacgaccgccaggaggaccuggagaagaucaucgaguggagcacgaucuucgaggacaagaagaucuaccgggccaagcugaacgaccucaccuggcugaccgacgaccagaaggagaagcuggccaccaagcgcuaccagggcugggggcggcucucccgcaagcugcuggugggccucaagaacagcgagcaccgcaacaucauggacauccuguggaucacgaacgagaacuucaugcagauccaggcggagcccgacuucgccaagcuggugaccgacgccaacaaggggaugcucgagaagaccgacucccaggacgucaucaacgaccuguacaccagcccccagaacaagaaggccauccggcagauccugcucguggugcacgacauccagaacgccaugcacggccaggcgccggccaagauccacgucgaguucgcccgcggggaggagcggaacccccgccgguccgugcagcgccagcgccagguggaggccgccuacgagaaggucagcaacgagcuggugagcgcgaaggugcggcaggaguucaaggaggccaucaacaacaagcgggacuucaaggaccgccuguuccucuacuucaugcagggcggcaucgacaucuacacggggaagcagcugaacaucgaccagcuguccagcuaccagaucgaccacauccucccccaggccuucgucaaggacgacucccugaccaaccgggugcugaccaacgagaaccaggugaaggccgacagcguccccaucgacaucuucggcaagaagaugcucuccgugugggggcgcaugaaggaccagggccugaucagcaaggggaaguaccggaaccugaccaugaacccggagaacaucuccgcgcacaccgagaacggcuucaucaaccgccagcucguggagacgcggcaggucaucaagcuggccgugaacauccuggccgacgaguacggcgacagcacccagaucaucuccgugaaggccgaccucagccaccagaugcgcgaggacuucgagcugcugaagaaccgggacgucaacgacuaccaccacgccuucgacgcguaccucgccgccuucaucgggaacuaccugcugaagcgcuaccccaagcucgaguccuacuucguguacggcgacuucaagaaguucacccagaaggagaccaagaugcggcgcuucaacuucaucuacgaccugaagcacugcgaccagguggucaacaaggagacgggggagauccuguggaccaaggacgaggacaucaaguacauccggcaccucuucgccuacaagaagauccuggugagccacgaggugcgcgagaagcgcggcgcccuguacaaccagaccaucuacaaggcgaaggacgacaagggcuccgggcagggcagcaagaagcucauccggaucaaggacgacaaggagaccaagaucuacgggggcuacuccggcaagagccuggccuacaugacgaucguccagaucaccaagaagaacaagguguccuaccgcgugaucgggauccccacccuggcccucgcccggcugaacaagcuggagaacgacagcaccgagaacaacggcgagcucuacaagaucaucaagccccaguucacgcacuacaaggucgacaagaagaacggggagaucaucgagaccaccgacgacuucaagaucguggugagcaagguccgcuuccagcagcugaucgacgacgccggccaguucuucaugcuggcguccgacaccuacaagaacaacgcccagcagcucgugaucagcaacaacgcccugaaggccaucaacaacacgaacaucaccgacugcccgcgggacgaccuggagcgccucgacaaccugcggcuggacuccgcguucgacgagaucgugaagaagauggacaaguacuucagcgccuacgacgccaacaacuuccgcgagaagauccggaacuccaaccucaucuucuaccagcugcccgucgaggaccagugggagaacaacaagaucaccgagcuggggaagcgcaccgugcucacgcggauccugcagggccugcacgccaacgccaccaccaccgacaugagcaucuucaagaucaagacgcccuucgggcagcuccgccagcgguccggcaucagccuguccgagaacgcgcagcugaucuaccagagcccgaccggccucuucgagcgccgggugcagcugaacaagaucaaguga

SEQ ID NO: 2038 - RNA, 4140 nt, Artificial Sequence
  Cas9 variant
augaagcagauccugggccucgaccuggggaccaccagcaucggcugggcccuggugcgcgaggccgagaacaaggacgagcaguccagcaucguccggaucggggugcgcgugaacccccucacguccgacgagcagaagaacuucgagcagggcaagagcaucaccaccaacgcggaccggacccugaagcgcuccaugcggcgcaaccugcagcgguacaagcuccgccgggaccaccugaaggacugccugcagaagaacgggaucaucacggacaaggccguccucagcgagaacggcaacuacaccaccuuccagaccuacuaccugcgcgccaaggccgugaacgagaagaucucccuggaggaguucgcccgggugcuccugaugcugaacaagaagcgcggcuacaagagcucccggaagaugaaguccgcggacgaggggcagcucaucgacggcaugagcgucgccaagcgccuguacaacgacaacaucacgccggggcaguacgugcugagccuccuggaggagggccggaaguacauccccgacuucuaccgcuccgaccugcucgacgagcuggacaagaucuggaccuuccagcagugcuucuaccccgagauccugacccccgagugccggaagcucaucgccgggaagggcaagcaggccaccgcgaagaucuuccugggcaaguacaagaucuacacggccgacaacaagagcaaggacaagcgccugcaggccuaccaguggcggguggaggcccucuccgggcagcugccgaucgaggucguggccuucguggucugcgagaucaacggcgcgauccaggccagcuccggguaccugggcgccaucagcgaccgcuccaaggagcucuacuucgagggccugaccguggggcaguaccuggugaagcagcucgagaagaaccccgacaccagccugaagaacaaggucuucuaccggcaggacuaccugaacgaguucgagaagaucugggagaagcaggccgaguaccacaccgagcucacgccccagcugaagaaggaggugcgcgacaucaucaucuucuaccagcgcacccucaagagccagaagggccuggugggguucugcgaguucgagucccggcagaucgaggucaugaucgacggcaagcugaagaagaagaccguggggugccgcgugugccccaagagcuccccgcuguuccaggaguacaagaucuggcacaaccucaacaaccugaagaucgucgagaaggagcugggcaagagccgguuccucaaccaggacgagaaggagucccuguuccaggagcugaacaucaaggagaagcucagcaagaccgacauccugaagcugcugugccucaaggccaaggaguucgaccugaacuucgagaagguggagggcaaccgcacgcaggcggagcuguuccgggccuaccaggccaucaucgagauguccgggaacggcgacuacgacuucagcaagaugaccuccagcgagauccaggacaccgugaccggggucuuccgcggccucggguacaacacggacauccuguccuucgacgccgagaaggaggagaagaccuucgacaagcagcccauguaccugcucuggcaccuccuguacagcuacgagggcgacuccagcgacaccggcaacaaggcccugaucaccaagaucaagaagcugugcggguucgaguccgaggaguacgcgcggauccugacggacgugaccuuccagagcgaguacggcaaccucuccaccaaggccauccgccggauccugcccuucaugaagaaggggagcgaguacuccgaggccugccgccacgccggcuaccggcacagcgagcgcagccugaccaaggaggagcucgacaagaaggucuacaaggaccaccuggagcugcucccccggaacucccugcgcaacccggugguggagaagauccugaaccagaugauccacgucgugaacacgguggucgacaccuacgggaagcccgacgagauccggaucgagcucgcccgcgagcugaagaaguccgcgaaggagcgggacgagaugaccgccagcaucaacaagaccgccgccgagcacaagaaguacugcgaggugcugcagaaggaguucggcuucacgcacgugagccgcaacgacaucauccgguacaagcucuaccuggagcuggagaacaacggcuacaagacccucuacuccgacaccuacaucccccgcgagaagcuguucagcaaggaguucgacaucgagcacaucaucccccaguccaagcuguucgacgacagcuucuccaacaagacccucgagugccgcagcgucaacaucgagaaguccaacgacaccgcguacgacuacgugcugaacaaguacggggagcagggcauccuggacuacaagaaccggaucgagaaccucuacaaggacagcaagaucucccgcacgaaguaccagaagcugaugaugaagaacagcgacaucuccgggaacuucaucgagcgggagcugcgcgacagccaguacaucgccaagaaggcccgggagauccucgaggagcuggugaaguucgucgugccgaccaccggcuccgugaccgcccgccugcgggaggacuggcagcucgucgacgugaugcaggagcugaacuggaagaaguacgacaagcugggccucacggacgugcgcuacgacaaggacgggcgggagauccgcuacaucaaggacuggagcaagcggaacgaccaccgccaccacgccauggacgcgcugaccaucgccuucaccaagcggagcaucauccaguaccugaacaaccucaacgccaaguccgacaagagcggcuccaucuacgccaucgagcagaaggagcuguuccgcgacaagcgggggaagcugaaguucaucccgcccaugcccugcaacaucuuccgcgccgaggcgaagcggcaccucgagaacguccuggugagcgugaaggccaagaacaaggucgugacccccaacaucaaccgcuccaagggcaagaacgggaucaacaagaagauccagcugacgccccggggccagcuccacaacgagaccaucuacggcagcaugaagcgcuacgagaccaagugggagaagaucggguccggcuucgacgagcggcagaucgccaagguggccaacaagaaguuccgcgaggcccugcugagccgccucgcggaguucgggaacgacccccagaaggccuucaccggcaagaacucccuggagaagaacccccuguacgucgacgagcuccacacgcagaaggugccggagaaggugaagaucgucacccuggagaaccuguacaccauccggaaggagaucacccccgaccucaagaucgacaaggugguggacgccgggguccgccgggugcugcaggagcgccuggacgaguucgacgacgacagcaagaaggccuucuccaaccucgacgagaaccccaucuggcugaacggcaagaagaugaagcgggugacgaucaugggcgucagcaacgcggugccccugcacgacaagaaggacuacaaggggaaccucguguucgacuccaagggccgcaagcagccggucgacuucgugaacaccgggagcaaccaccacguggccaucuaccgggacgaguccggcgagcugcaggacaucgucgugagcuucuacgaggccaccacccgcuccacgcuggggauccccgugaucgacaaggaguacaagaaggccgagggcuggaacuuccucuucagcaugaagcagaacgaguacuucgucuuccccaacgaggagaccggcuucaacccgaaggagaucgaccugaugaaccccgacaacuacaccaccaucucccccaaccuguaccgggugcagaaguucagcaagugcauguacgggaacagcuccgugcgcgaguacgucuuccggcaccaccucgagacgagcgugaacgacuccaagggccugaagaacaucgccuacaagaacgucaagagccugguguaccucgaggggaucgugaaggugcgcaucaaccacaucggccagaucgucuccgugggggaguacuga

SEQ ID NO: 2039 - RNA, 4140 nt, Artificial Sequence
  Cas9 variant
augcgcaucgacaacggccuggaggagcucaaggugaacaaccggaucuacaacaucgggcuggacaucggcaccagcuccgucggguucgccgugaccgacgcccaggacaagcuggugcgcgucaagggcaagacggcgaucggggugcggcuguucgaggagggccacaccgccgccgagcgccggggcuuccgcaccacccggcgccggcugagccgccggaaguggcgcaucaaccugcucaaccagaucuucgagcccuacaucuccgagaucgacccgacguucuucgcccggcugaagaacagcucccuggccgggaaggacaagaaguucgagggcagccuccuguuccccgaccgcaccgacuaccaguucuacaaggacaaccccaccauguaccaccuccggaagcaccucauggagaaggaccgccaguucgaccugcgggagaucuaccuggcgaugcaccacaucaucaaguaccgcgggaacuuccucaacaccacgcccaugaaccacuucaagaacgaggagaucgacuucuccgcccuguucagccggcugaacgagcucuaccaggagaucgacgacgagaacaucuucgagcugaacaucgagaacguggacgagaucaagaagauccugcucaaccacgaccuguucaagauggagaagcagaagcaggucgccaagcugcucaacguggacaccgacgacaagcagcugaagaaggagaacaccgcccuggcguccaacuucagcaaggccauccucggcuacaaguucaaccuggcccuggugaccaagaucccggaccaggacaagaaggaguggacgaucucccucggggacgaggacuucgacgaccgccuggacaacguccccguggcccugaccgagagccagcucgagguggucgaggugcugcacuccaucuucaacagcaucucccugaacgagaucguggagaacggcgagacccucagcuccgccaugguccggaaguacaacgaccacaagcacgaccugaagcugcucaagaacgugaugaccacgcuggaggaccgcaagaaggcgaagaagauccagggcaucuacaacguguucgucgggaaggacaccgaccugaucagcgacaaggacaagaacaaguacaaggacaaggacgaguucuacaaggagauccagaagaaccucgacaacuccagcgacgccgaggagaucaucaagcgcaucaagcaggaccaguuccugcccaagcagcggaccagcaagaacggcgugaucccccaccagcugcaccagcgcgagcucgaccugaucaucgagaaccaggccaaguacuacccguuccugaaggaggccaaccccaacaagaagcggcucaagcaggccaaguacaagcuggacgagcugaucgcguucaagauccccuacuacaucgggcccaccuccggcgccgagaacagcgacuucuccuggcugaagcgcaagaaggacggccagaucacgccguggaacuucgacgagaagguggaccggaucgagagcgccaaccgcuucauccggcgcaugaccaccaaggacaccuaccuccuggccgaggacguccugccccucgagucccugaucuacgagaaguacagcgugcugaacgagcucaacaacgugcggaucaaccgccagaagcuguccgucaacgacaagcaggacaucuacaacgagcuguucaagaacagcaagacggugacccucaagcagcugcagaaguacuucgaggucaccaagaagcugaagaccgugguggucgaggggcucgccgaccccaagaaguuccuguccaaccugggcacguaccacgacuucaagcucaucuucggggacaucguggacgaccccgaguaccagaccgaccuggagaacaucaucgaguggagcaccaucuucgaggaccggggcaucuucaacuccaagcugaacgagaucaccuggcucacggacgagcagcgcaagaaggugcugagcaagcgguaccagggguggggccgcuucuccaagaagcugcucgucggccugaagaacagccaggggaacuccauccuggacgagcucuggaacaccaaccugaacuucaugcagcugcagagccaggacgacuucgcggagcucauccacgccgagaacgccaagcaguucaaggccaacgacccggacaaccccuggaacggcaucgacgccauccugaacgacgcguacaccagcccccagaacaagaaggccauccgccagguggugaaggucgugcaggacaucgagaaggccauggggaacaagccccagaagaucgccaucgaguucacccggagcgcggacaagaacccgcggcgcacggacucccggaucaagcgccugagcgacaucuacaaggaggccgccgagaagguggucggcgagagccucaagcuggagcugaacgaguaccucaccuccaagaagaagaugaccgacaagauguaccuguacuucacccagcuggggaccgacaucuacacgggcaagaagaucgacaucgaccagcucaacaacuacgacaucgaccacgugcugccccagagcuuccugaaggacgacucccucgacaaccgcgugcugaccaaccggagcgacaacuccgagaaguccgacaccgucccccugcacaaguucggcgccaagauggggaacuucuggcgccagcucgccgacgagggccugaucaccaagcggaaguacaagaaccugacgaccgaccccgcgaccaucgacaaguacaccauccagggguucauccgccggcagcucguggagacgucccaggugaucaagcugaccgccaacauccugggcgggcucuacccggaggagaccgagauccuggagauccccgccaagcugaaccaccaguuccgcgacauguucgaccucgucaaggugcgggaggugaacgacuaccaccacgccuucgacgccuacaucaccgucuucgugggcaacuuccuguaccgccgguaccccaagcugcgcagcuacuucguguacggcgacuucaagaagcucaacaagacggacgacgacauccggaaguucaacuuccugaaccuguucaacaaggacaaggucgaggacaacgagaccgacgagauccucugguccaaggcggagagcauccgcgacaucaagaacaucuacaacuacaaguucaugcuggugucccgggagguguacacccgccacggggccauguucaaccagaccaucuaccccgccagcaagaacgacuccaagaagcugaucccgaucaagaagggcaaggacacggccaucuacgggggcuacagcggcaacaccgacgccuacauggcgaucgucgccguggaggacaagaagggggagaaguucaagguggucggcgugcccacccgggccgugucccgccucgagcagcuggccgcggacgaccacgaccaguaccugaccgcccuccacgacguccugaagcccaacuucacgaagaucaagaccaaccggaagaccaaggccaaggaggaggugaccacgccguuccgcauccugguggggaaggucggcuaccggcagcucauccaggacggccaggugaagaugaugcuggggagcuccgccuacaaguacaacgccaagcagcuggugcucagcgagaagucccugaaggucaucaagaacaacaagaaguacaaccccgacgacgagaaccaggaccugaucgacguguacgacgagauccucggcguggucaaccgcgcguucaaccuguacgacaccaacggguuccggaagaagcugaacgacaaccgcgugaaguucguggagcuccccaucaacaacaucuucgacggcaccaagcugguccagauggggaagcgcgccgugcugacccagauccucaacggccugcacgccaacgccgcccugggggaccucaaggcgcugggcaucagcacgcccuucggcaagaugcagagcaaguccgggaucccgcugagcauggacgccucccucguguaccagagccccaccggccuguucgagcggaagcugaaccucuccgaccuguga

SEQ ID NO: 2040 - RNA, 4140 nt, Artificial Sequence
  Cas9 variant
augaccaagaagaacuacagcaucggccuggacaucgggaccaacuccgugggcugggccgucaucacggacgacuacaaggugcccgccaagaagaugaaggugcucgggaacaccgacaagaaguacaucaagaagaaccugcugggcgcgcuccuguucgacagcggggagaccgccgaggccacccgccugaagcggacggcccgccggcgcuacacccggcgcaagaaccggcuccgcuaccugcaggagaucuucgccgacgagauggcgaaggucgacgaguccuucuuccagcggcuggacgagagcuuccuccgcugggacgacgacaacaagaagcugggccgguacccgaucuucggcaacaaggccgacguggugaaguaccaccaggaguuccccaccaucuaccaccuccgcaagcaccucgccgacuccagcgagaaggccgaccugcggcuggucuaccucgcgcuggcccacaugaucaaguuccgcgggcacuuccugaucgagggcgagcucaacgccgagaacaccgacgugcagaagaucuucuccgacuucgugcgggucuacgaccgcacguucgacgacagccaccuguccgagaucaccguggacgccgccagcauccugaccgagaagaucuccaagagccggcgccucgagaaccugaucaaguacuaccccaccgagaagaagaacacgcuguucgggaaccucaucgcgcuggcccugggccuccagcccaacuucaagaugaacuucaagcuguccgaggacgccaagcugcaguucagcaaggacuccuacaacgaggaccucgaggagcugcuggggaagaucggcgacgacuacgccgaccucuucaccagcgccaagaaccuguacgacgcgauccugcucuccggcauccugaccguggacgacaacagcaccaaggccccgcuguccgccagcaugaucaagcgguacgccgagcaccacgaggaccucgagaagcugaaggaguucaucaaggccaacaagagcgagcuguaccacgacaucuucaaggacgagacgaagaacggguacgcgggcuacaucgagaacggggucaagcaggacgaguucuacaaguaccucaagaacacccuguccaagaucgccggcagcgacuacuuccuggacaagaucgagcgcgaggacuuccuccggaagcagcgcaccuucgacaacggcuccaucccccaccagauccaccuccaggagaugcacgccauccugcgccggcagggggacuacuaccccuuccugaaggagaaccaggaccgcaucgagaagauccugaccuuccggauccccuacuacgugggcccgcuggcccgcaaggacagccgguucuccugggccgaguaccacagcgacgagaagaucacgcccuggaacuucgacaaggugaucgacaaggagaaguccgcggagaaguucaucacccgcaugacccugaacgaccucuaccugcccgaggagaagguccugcccaagcacagccacguguacgagaccuacgccguguacaacgagcucacgaagaucaaguacgucaacgagcaggggaaggacuccuucuucgacagcaacaugaagcaggagaucuucgaccacguguucaaggagaaccggaaggugaccaaggagaagcugcugaacuaccucaacaaggaguucccggaguaccgcaucaaggaccugaucggccuggacaaggagaacaaguccuucaacgccagccucgggaccuaccacgaccugaagaagauccuggacaaggccuuccucgacgacaaggucaacgaggaggugaucgaggacaucaucaagacccugacgcuguucgaggacaaggacaugauccacgagcggcuccagaaguacuccgacaucuucaccgcggaccagcugaagaagcuggagcgccggcacuacaccggcuggggccgccucagcuacaagcugaucaacgggauccggaacaaggagaacaacaagaccauccuggacuaccucaucgacgacggcuccgccaaccgcaacuucaugcagcugaucaacgacgacacgcugcccuucaagcagaucauccagaagucccagguggucggggacguggacgacaucgaggccgucgugcacgaccuccccggcagccccgccaucaagaaggggauccugcagagcgugaagaucgucgacgagcuggugaaggugaugggcgacaacccggacaacaucgucaucgagauggcccgggagaaccagaccaccaaccgcggccggucccagagccagcagcgccucaagaagcugcagaacagccugaaggagcucggguccaacauccugaacgaggagaagcccagcuacaucgaggacaagguggagaacucccaccuccagaacgaccagcuguuccuguacuacauccagaacggcaaggacauguacaccggggacgagcuggacaucgaccaccugagcgacuacgacaucgaccacaucaucccccaggcguucaucaaggacgacuccaucgacaaccgggugcugacgagcuccgccaagaaccgcggcaagagcgacgacguccccucccuggacaucgugcgcgcccggaaggccgagugggugcgccucuacaagagcgggcugaucuccaagcggaaguucgacaaccugaccaaggccgagcgcggcggccucaccgaggcggacaaggccggguucaucaagcggcagcuggucgagacccgccagaucaccaagcacguggcccagauccuggacgcccgguucaacacggagagcgacgagaacgacaaggugauccgcgacgucaaggugaucacccucaaguccaaccuggugagccaguuccggaaggacuucgaguucuacaagguccgcgagaucaacgacuaccaccacgcccacgacgcguaccugaacgccguggugggcaccgcccuccugaagaaguacccgaagcuggccuccgaguucgucuacggggaguacaagaaguacgacgugcacaagcucaucgccaagagcuccgacgaccacagcgagaugggcaaggcgaccgccaaguacuucuucuacagcaaccugaugaacuucuucaagcgggugauccgcuacuccaacggcaaggucaucgugcggcccguggucgaguacagcaaggacacggaggacaucgccugggacaagaaguccaacuuccgcaccaucugcaaggugcugagcuacccccaggugaacaucgucaagaagguggagacccagaccgggggcuucuccaaggagagcauccuccccaagggggacuccgacaagcugaucccgcggaagacgaagaaggccuacugggacaccaagaaguacggcggguucgacagccccaccguggcguacuccgucuucgugguggccgacgucgagaagggcaaggccaagaagcugaagaccgugaaggagcucgugggcaucagcaucauggagcgcuccuucuucgaggagaaccccgucgaguuccuggagaacaagggguaccacaacauccgggaggacaagcugaucaagcuccccaaguacagccuguucgaguucgagggcgggaagcgccggcugcucgccuccgccagcgagcugcagaagggcaacgagauggugaucccggggcaccuggugaagcuccuguaccacgcgcagcgcaucaacuccuucaacagcacgaaguaccuggacuacgucuccgcccacaagaaggaguucgagaaggugcucagcugcguggaggacuucgccaaccuguacgucgacguggagaagaaccuguccaagauccgggccguggccgacagcauggacaacuucagcaucgaggagaucuccaacagcuucaucaaccuccugacccugaccgcgcucggcgcccccgccgacuucaacuuccugggcgagaagaucccccgcaagcgcuacaccuccacgaaggagugccugaacgccacccucauccaccagagcaucaccgggcuguacgagacccggaucgaccuguccaagaucggcgaggaguga

SEQ ID NO: 2041 - RNA, 4143 nt, Artificial Sequence
  Cas9 variant
augggcaaguacaaccuggggcucgacaucggcaccaacagcguggggugggccgucguggacgagaacaaccagaucgugaagaagggcgggaaggcccuguggggcguccgcauguucgacgaggcgcaguccgccaaggagacccggaucuaccgcaacagccggcgccggaucgugcgccggaaccagcgccugcuccugcugcagaaggaguucuacgacgagaucaucaagguggaccagacguucuuccagcggcucaaggacuccuucuucaagaaggaggacaagcugaacaagaacaacuacaccuucuucgacgacgacaucaccgaccgcgaguacuucaagaaguuccccaccaucuaccaccuccggagccaccuccuguacaacgacgagaagaucgacauccgcaugcuguaccuggcccugcaccacaucgucaaguaccggggccacuuccuggacuccggggaggugaacgagagcaacuucuccaagaucaaggacgugcucgacacguucaacaacaagaugagcgagaugucccuggaguucgaggacaacgaggacuacuucugcaagaucgaguucgacgagaacuucgagaacaagcugaaggacaucaugcucagccagcuguccaagaaggagaagcgccaggagcugaucgaccucuucaaggucgacaagaagucccuggugaacgagcugcucaucgagcugcuggugaacaagaaggucaagcucaacagccugagcaucaccaacggcaagaaguacgaggugugcgagaucgacuucgagaaggaggagcuguucgagaagcucgaggacgccaagaagaucaucaccgagcuguucgacauccuggacgagaucgugaacaucaagaagaucgucgacuacuacuacgugcucaagaucaucggggacaacgaguaccuguccgaggccauggugaagaaguacgacaagcacgacaaggaccugcgggagcucaagagcuucaucaagaccuacugcccgaacaaguacuacgagugcuuccgcaagacguccaaccccaaccugugcaacuaccccaaguacgucggcaucaacagcgugaacaagaagaucgagcgguucgcgcacugcaagaaggaggaguucuacaaguaccugaagucccucuucaacaccaucaaggacgagaacgccaagcugaagaucgaccuguuccagaaggacauggagaacgacgacuuccucaaccgccagaacagcaaccacaacagcuccauccccaugcagcugaacuucugcgagcugaagaagauccucgagaaccagagcaaguacuacccguuccugaugcugaagaacuccgacggguacagcaccuccgaccggaucaucgccaucuucaaguacaagauccccuacuacgugggcccccucaacaagaacagcaaguacuccuggcuggucaagaaguccaacgagaacaucacccccuggaacuacgagaaggugaucgaccuggacgccagcgcgaaggaguucauccagcgcaugcagaacaagugcacguaccugaagggcgagaacgacuacugccucccgaagaaguccauccuguucagcgaguacaacugccugcaguaccucaaccggcugaucaucaacggggcccugaucgagaacaagcucaagaacgagaucuacgagaacaucuuccugugcuacaagaagcccaccaagaaguccaucguggaguaccugaagaccaacuacaacuacgacgagaccacgcucaagagcaacauccuggaggucaacugcgacaugagcuccuacauccaguucaaggagaucuacggcgaggacuucgagcagaaccugaacaucguggaggacaucaucaaggacaucaccaucuucgaggacaagaagauccucgagaagcgccugcgcgagaucuaccaccugagcgaggacaagguccagaagaucaaggggcucaacuacaagggcuacgccacccuguccaagcacuuccugaacaacuucuacagcgugaacgaggagaccggcgagaucuacgggcccaucauccagaucaugcgggacacgaacuacaaccuccagcaggucaucuacaacgaccgcuacaacuucaugaaggccaucgacaaguacaacaagaagaaccuggacaccgagaagaagcugaacguguccgacuucaucgacgaguacaucuacgugagccccaucaugaagcggagccucauccaguccuacaacaucauccaggagcuggagaagauccugggcgagagcaucuccaaguacuacaucgagugcgcccgcgugcggagcaacuccaaggacgucaucaacagccgcuaccggcagcucuccgagcuguacaaggacugcgagcaccaggugagcgacaucuccaagaacuacaucaacaucaacaagcugaagaagcagcucgaggacaacaagaacgagcugcgcgcggacaagcuguaccucuacuucacccaguucgggaagugcauguacacccugaaggacaucgaccuggacgacguguuccucggcaaguacgacaucgaccacaucuacccgcagagccugaucaaggacgacucccugaacaaccggguccucgccagcaaggagaagaacgggaagaaggacaaccaguucaucuucaacauccccgaguuccugcccaagaacgccgagcuguucuacaagaagcuccuggagugcaagcugaucacgaaggagaaguaccgccggcucaccaugaagaagaucgacgacgacgagcuggacaucuucgugaaccgccagcugguggccaccaaccaguccgucaagggccucguggacgugcugaagaucuacaagggcgucaagcccaccaacaucguguacagcaaggccgugaacaucuccgacuuccggaacaacuacaaccuguacaagagccgcacggcgaacaacuaccaccacgcccacgacgccuaccucaacgucgugaucgggaaggcccuggacguguacuaccagugcaacuacuuccagaacuacaaggacgucaucaagcugaaggaccggaacaucaccaucaacccggagaucauccucuccaagaaccgcuacgugaaccggaacggcgagaagaaggugaucugggaccuggacaacacccugaagcucaucaagaacaaccuguacaaccgcuucgacaucaccgagacgaucaugacccgcaagagcaacaagauguucagcaaguccagcaucucccccgccaagaacagcaagaaccugauccccaucaagaccuccgacccccggugcaacguccucaaguacgggggcaucaagagcaacuccuacaacuucuacugcaucguggagcuguacgacaagaaggggaagaaguccuacauccuggaggcgaucccgaagacccacagcgacaagcucgaggaguacaucaagaacagcaucgacgagaagaacguguccaacuucaagaucaucaacaagaacaucaagagcaacaucaucaucgaguacaagaagcugcgcuacgucaucacgggcaaguccggcaaguacuaccugaucaagaacuucaaggaccggaacuucagcuacaacgccaucaagaccaucaaguacaucgagaaguacaacuaccagaagaaguacgagauccccuucgaggagaccaaggagaagaucauccucgcccccaagaagaaggacaccaaggagaucucccugacccuggacaacugccaggcccuccuggacgagaucaucagccuguucaagaaggacaucuacaacuacgacaucaucuacaagaucacguccaagcucgaggagaacaagcagaaccugacccugaccaaccucaucaaggugcugaccgagauccugauccuccugaagacgaacgagcgcgggaccgccgaccugacccucaucgacaugagcaaggacaccggcacgcugugcaucuccaagacccugaagcccgggaugaaguucaucagcgagagcccgaccggcuacuaccggaagaucaucuucgaggugcccaacgggaucuga

SEQ ID NO: 2042 - RNA, 4143 nt, Artificial Sequence
  Cas9 variant
augaagcgcauccugggccucgaccuggggaccaccagcaucggcugggcccuggugaacgaggccgagaacaacaacgaggcguccagcaucguccggcucggggugcgcgugaacccccugacggucgacgagaaguccaacuucgagaagggcaaggccaucaccaccaacgccgaccggcagcugcgccacggggcccggaucaaccuccagcgcuacaagcugcggcgccagaaccugcacgacugccuccagaagcagggcuggcugggcaccgaggccauguacgaggaggggaaggcgagcacguucgagaccuacaagcugcgggccaaggccgccgaggaggagaucucccuccacgaguucgcgcgcgugcuguucaugcugaacaagaagcggggcuacaagagcaaccgcaaggccaacaacaaggaggacgggcagcuguucgacggcaugaccaucgccaagaagcuguacgaggagcaccugaccccggccgaguacucccuccagcugcugaacaaggggaagaaguucacgcagggcuacuaccggagcgaccucaacgccgagcuggagcgcaucugggacgagcagaagaaguacuaccccgagauccugaccgacgaguucaagcagcagcucgagggcaagaccaagaccaacacguccaagaucuuccuggcgaaguacgggaucuacagcgccgaccugaagggccucgaccggaaguuccagccccugaaguggcgcguggaggcccugcagcagcaggucgacaaggaggugcucgccuucgugaucuccgaccugaaggggcagaucgccaacaccagcggccugcucggcgcgaucuccgaccggagcaaggagcuguacuucaacaagcagaccgucgggcaguaccugugggccucccucgaggagaacccccacaucagcaucaagaacaagccguucuaccgccaggacuaccuggacgaguucgagaagaucugggagacccaggccgccuuccacaagcagcugacgcccgagcucaagcaggagauccgggacaucaucaucuucuaccagcgcccccugaaguccaagaagucccugaucagcgugugcgagcucgagcagcggaaggugaaggccaccaucgacggcaaggagaaggagaucaccaucgggcccaaggucgcgcccaagagcagcccgguguuccaggaguuccgcaucuggcagaaccugaacaacgugcugcucaucgacaacgacaccaacgagaagcgcccccuggacgaggucgagcggaaccugcucuacaaggagcuguccaucaaggccaagcugagcaagacggaggcccugaagauccucaacaagaagggcaagcagugggaccugaacuaccgcgagcuggaggggaaccggacccaggccauccucuucgacugcuacaaccgcaucaucacccugaccggccacgaggagugcgacuucaagaagaucaaggccuccgagauccggcacuacgugagcacgaucuucaagaaccugggcuucuccaccgagauccucgacuucgaccccagccugaagaagcacgagcuggagaagcagccgauguaccagcucuggcaccuccuguacuccuacgagagcgacaacucccgcaccgggaacgagagccuccugcggaagcuggagaccacguucggcuuccccgaggaguacgcgaccgugcucugcgacgucguguucgaggaggacuacgggaaccuguccgugaaggccaugcgcgagauccugcccuaccuccaggccggcaacgacuacagccaggccugcgcguacgccggguacaaccacucccggcacagccugaccaaggaggagcuggaccagaaggucuacaaggagcgccucgagcugcugcccaagaacucccuccggaacccggugguggagaagauccugaaccagaugaucaacgucaucaacgccaucaucgacgaguacggcaagcccgacgagauccgcaucgagauggcccgggagcucaagagcuccgccgcggaccgcaagaagaccacgcacgccaucagccagggcaacgccgagaaccagcggauccgcgagauccuggagaaggaguucucccugagcuacaucagccggaacgacaucaucaaguacaagcuguacgaggagcucgagcccaacuacuacaagacccuguacuccgacaccuacaucaccaaggacaagcuguucagcaaggacuucgacaucgagcacaucauccccaaggcccgccucuucgacgacuccuucagcaacaagacgcuggaggcccggaacaucaaccuggagaaguccaacaagaccgcguucgacuucaucaaggagaaguacggggaggacggcgccgaggccuacaagaagaagcucgacaugcugcuggagaacgacgccaucagccgcccgaaguacaacaaccuccugcgcgccgaggcggacauccccuccgacuucaucaaccgggaccugcgcaacacccaguacaucgccaagaaggccugcgagauccucggggagcuggugaagaccgucacccccacgaccggcaagaucaccaaccggcugcgcgaggacuggcagcucguggacgugaugaaggagcugaacuucgagaaguacgagaagcuggggcucaccgagaucgucgaggaccgggacggccgcaagaucaagcggaucaaggacuggacgaagcgcaacgaccaccggcaccacgccauggacgcgcuggccaucgccuucaccaagcccagcuucauccaguaccugaacaaccucaacgcccgcuccaacaagggcgacagcaucuacgccaucgagaacaaggagcugcacuacgaggaggggaagcugcgguucaacgcgccgauccccgugaacgaguuccgcgccgaggccaagcggcaccucuccgccauccuggugagcaucaaggccaagaacaaggucaugacccagaacgugaacaagaucaagaccaagcacggcaucaucaagaagauccagcugacgccccgcgggccccuccacaacgagaccaucuacggcaccaagaugcggccgaucaucaagauggugaaggucggcgcggcccuggacgaggccaccaucaacaagguguccagccccgccauccgcgaggcccugcucaagcggcugaacgaguacuccgggaacgcgaagaaggccuucacgggcaagaacacccuggagaagaaccccaucuaccucaacgccgggcgcaccaagaccgugccgagccuggucaagacgguggagugggaguccuuccaccccacccggaagcugaucgacaaggaccucaacguggacaaggucguggacaagggcauccgcgagauccugaaggcccggcuggaggaguucaacggggacgcgaagaaggccuucagcaaccucgaggagaaccccaucuaccuggacgaggccaagaagaucgcccugaagcgcgugagcaucgagggcguccucuccgccaucccccugcacacccugaagaaccaggcgggcaagccgaucaccgggaaggacggcaagcccgugcucgggaacuacgugcagacgagcaacaaccaccacaucgccuucuacuacgacgaggacggcaaccugcaggacaacgccgucuccuucuucgaggccgccgagcgcaagagccaggggauccccgugaucgacaaggacuacaaccgggacaagggcuggcgcuuccuguucaccaugaagcagaacgaguacuucguguuccccaacgaggcgaccggcuucaucccguccgaggucgaccucaccgacgaggccaacuacgggaucaucagccccaaccuguaccgggugcagaaggugucccgcaucgacaagggcacgagcgccucccgggacuacugguuccgccaccaccuggagaccauccucaacgacgacgccaagcugaagaaccuggccuucaagcggauccgcgggcuccuggagcugaaggacaucaucaagguccggaucaacagcaccggcaagaucguggcggugggggaguacgacuga

SEQ ID NO: 2043 - RNA, 4143 nt, Artificial Sequence
  Cas9 variant
augaagaagauccugggccucgaccuggggaccaccagcaucggcugggcccuggugaacgaggccgagacggaguccgagaaguccagcaucauccgccucgggguccgggugaacccccugaccaucgacgagaagggcaacuucgagaaggggaaggcgaucaccaccaacagcgaccgccagcagcggcacuccgcccgcaucaaccugcagcgguacaagcuccgccggcagaaccugugcgacugccugcagaucggcggccuccuggggagcgaguccauguacgaggagggcaaggagagcacguucgagaccuacaagcugcgcgccaaggccgccaccgagaagguggcgcuccacgaguucgcccggauccuguucaugcugaacaagaagcgcggguacaaguccaaccggaaggccaacagcaaggaggacggccaggccuucgacgggaugaccaucgcgaagaagcucuacgaggagaaccugacgccggccgaguacucccugcagcuccugaacaagggcaagaaguucagccccuccuacuaccgcagcgaccuggaguccgagcucaaccggaucugggaggagcagaagaaguacuaccccgagauccugaccgacgacuucuaccagcagcuggagggcaagaccaaggucaacaccacgaagaucuuccucgccaaguacgggaucuacaccgccgaccugaagggccuggacaagaagaugcagccccucaaguggcgcaucgaggcccugaacaagcaggucgacaaggaggugcugaccuucguggugagcgaccucaaggggcagaucgagaagaccuccggccugcugggcgagaucagcgaccgguccaaggagcucuacuucaacaagcagacgguggggcaguacgucugggcgagccugaaggagaacccgcacgugagcaucaagaacaagcccuucuaccgccaggacuaccuggacgaguucgagaagaucugggagacccaggccgccuuccacaaggagcucacccccgagcugaagaaggagauccgggacaucaucaucuucuaccagcgcccccugaaguccaagaagggccucaucagcaucugcgagcuggagcagaagaaggagaaggugaucaucgaggggaaggagaaggagauccugaucggcuccaaggucgcccccaagagcucccccauguaccaggaguuccggaucuggcagaaccucaacaacgugcugcugaucgacaccgagaucaacgagagccgcccccucgacgaggaggagaaggcccugcuguacaacgagcucuccgugcgggcgaagcugagcgagacggaggcccugaagaccaucaacaagaaggggaagcacugggaccugaacuucaaggagcucgagggcaaccgcacccaggccguccuguucgagugcuacaaccgcaucaucacccagacgggccacgaggagugcaacuucaagaagaucuccgccgaggacauccggcacuacguggccaccaucuucaagaaccugggguucaacaccgacauccucgacuucaaccccagccuggagaagcacgagcuggagaagcagccgauguaccagcucuggcaccuccuguacuccuacgagagcgacaagucccgcaccggcaacgagagccugcugaacaagcuggaggcgaacuucggguucccccaggaguacgccuccgugcucgccgacgccacguucgaggacgacuacggcaacaucagcgucaaggccauccggaagauccugccccaccuccacgacggguacgacuacuccgaggcgugcgagcgcgccggcuacaaccacagcgugcggucccugaccaaggaggagcuggcccagaagguguacaaggaccgccuggaccuccugcccaagaacagccugcggaacccggucguggagaagauccucaaccagaugaucaacgugaucaacgccaucaucgucgaguacggcaagcccgacgagauccgcaucgagauggcgcgggagcucaagagcuccgccgccaagcgcgaggagcggaccaagagcaucaaccagaacgccgccgagaacaagcgcaucaccgagauccugcagacggaguucgggcuguccuacaucagccggaacgacaucgugaaguacaagcuguaccaggagcuggaggcgaacggcuucaagacccucuacuccaacaccuacauccccaaggagaagcuguucagcaaggacuucgacaucgagcacaucguccccaaggcccgccuguucgacgacuccuucgggaacaagaccaucgaggcccgggacgugaaccucgccaagagcaacaagacggccuucgacuucgugaaggagaaguacggcgagcaggggaucgaggaguacaagaagaagcuggacacccugcucaaggagaacgcgaucuccagcggcaaguacaagaagcugaugauguccgaggccgacaucccgagcgacuucaucaaccgcgaccugcggaacacccaguacaucgcccgcaaggccuacgagauccucggcgagcuggucaagaccaucacccccacgaccgggaagaucaccgaccggcugcgcgaggacuggcagcucaucgacgugaugaaggagcugaacuucgagaaguacgaccgccugggccucaccgaggugaucgaggaccgggacgggcgcaagaucaagcggaucaaggacuggacgaagcgcaacgaccaccggcaccacgccauggacgcgcugaccaucgccuucaccaagcccuccuacauccaguaccugaacaaccucaacgcccgcagcgacaaguccggcagcaucuacgccaucgagaccaaggagcugcaccgggagaacaacacgcugcgcuucaacgcgcccaugccgcucaacgaguuccggaaggaggccaagcgccaccuguccgccauccuggucagcaucaaggccaagaacaaggugaugacccagaacgugaacaagaucaagaccaagaacggcaucaucaagaagguccagcucaccccgcgcggggcccugcacaacgagacgaucuacggcaccaagaugcggcccaucaucaagauggugaagaucggggcggcccuggacgaggccaccaucaacaaggugagcucccccaccauccgggaggcccuccugaagcgccugaacgaguacagcggcgacgccaagaaggcguucgccgggaagaacgccaucacgaagaacccgaucuaccucaacgccgagcacaccaagaccgcccccgcgauggucaagaucguggagugggagauguacuaccccauccggaagcugaucaccccggaccugaagaucgagaaggugaucgacaacggcaucaaggagauccucaagaagcgccugaaggaguucggcggggacgccaagaaggccuucuccaaccuggacgagugccccaucuaccucgacgaggagaagaacaucacgcugaagcgggucagcaucgagggcgugcuguccgccauccccgugcacacccucaagaaccacgcggggaaggagaucaaggacgaggacggcaaggccguccugggggacuacgugcagaccagcaacaaccaccacguggccaucuaccaggacgccaagggcaaccugcaggacaacgucaucuccuucuucgaggccgcggagcgcaagagccagaacgugcccaucguggacaagaaccucaaccgggacaagggcuggcacuuccuguacaccaugaagcagaacgaguacuucgucuucccgaacgaggagacgggguucgugcccuccgagaucgaccugauggacgagaacaacuacgagaugaucagccccaaccucuuccgcgugcagaccaugucccgggucgacuacggcaagaccaucauccgcgaguacguguuccgcaaccaccuggagaccauccugaacgacaaccucaagcugaaggggcugguguucaagaagaucaagagccucaaggcccuggagggcaucgucaaggugcgggugaacgccaucgggaagaucgucgccgugggcgaguacgacuga

SEQ ID NO: 2044 - RNA, 4143 nt, Artificial Sequence
  Cas9 variant
augaagaagaaguacgccaucggcaucgacaucgggaccaacagcgugggcugguccgucgugaccgacgacuacaaggugcccagcaagaagaugaaggucuucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacgugcagcaccuguucaacgacuucgucgagauguucgacaagaccguggagggguccuaccugagcgagaaccuccccaacguggccgacguccugguggagaagguguccaagagccggcaccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacgaacagcaccaccaaggcgccccucuccagcuccauggucaaccgcuacgaggagcaccagaaggaccuggcccugcucaagaacuucauccaccagaaccugagcgacagcuacaaggagguguucaacgacaagcugaaggacggcuacgccggcuacaucgaggggaagaccacgcaggagaacuucuaccgguucaucaagaaggccaucgagaagaucgacggcuccaacuacuucaucgagaagaucgagcgcgaggacuuccuccggaagcagcgcaccuucgacaacgggagcaucccccaccagauccaccuccgggagaugcaggccaucauccgccgccaggcgaaguucuaccccuuccuggaggagaaccaggacaagaucgagaagauccucaccuuccggaucccguacuacgugggcccccuggcccgcgggaaguccgaguucgccuggcugaaccgcaagagcgacgagaagauccggcccuggaacuucgacgagauggucgacaaggagaccuccgccgagaacuucaucacgcggaugaccaacuacgaccaguaccuccccgaccagaaggugcugccgaagcacagccugcuguacgagaaguucgccguguacaacgagcucaccaagguccgcuacgugaccgagcagggcaaguccuucuucuucgacgcgaacaugaagcaggagaucuucgaccggacguucaagguguaccgcaaggucaccaaggagaagcugauggacuuccugagcaaggaguucgacgaguuccggaucguggaccuccugggccuggacaaggacaacaaguccuucaacgccagccucgggaccuaccacgaccugaagaagaucguguccgaggacuuccuggacaacagcgagaacgaggacauccucgagaacgucgugcugacccugacgcuguucgaggaccgcgagaugauccggaagcgccuggagaaguacaaggacguccugaccgaggagcagcggaagaagcucgagcgccggcacuacaccggcugggggcgccuguccgccaagcugaucaacggcauccgggacaaggugacccgcaagacgauccucgacuaccugaucgacgacgggaccagcaaccggaacuucaugcagcugaucaacgacgacacccucuccuucguggacgagauccgccuggcccagggcagcggcaaggccgaggacuaccgcgcggagguccagaaccuggccgggucccccgccaucaagaagggcauccuccagagccugaagaucguggacgagcugaucgaggugaugggguacgaccccgagcacaucgucguggagauggcccgggagaaccaguucaccaaccagggccgccggaacucccagcagcgcuacaagaagaucgagaacgcgaucaagaaccucgacagcaaccugaacagcaagauccugaaggaguaccccacgaacaaccaggcccuccagaacgaccggcuguuccuguacuaccuccagaacgggaaggacauguacaccgacgaggagcuggacaucgaccagcugucccaguacgacaucgaccacaucaucccgcaggccuucaucaaggacgacagccucgacaacaaggugcugaccaaguccgccaagaaccgcggcaagagcgacgacguccccucccuggagaucguguacaagaagaagaacuucuggaagcagcuccuggacagccagcugaucucccagcggaaguucgacaaccucaccaaggccgagcgcggcgggcugaccaacgaggacaaggcgcgguucauccagcgccagcugguggagacgcggcagaucaccaagcacgucgcccgcauccucgacacccgguucaacaccaagcuggacgaggccggcaaccgcauccgggaccccaaggugaacaucaugacgcucaagagcucccucgugagccaguuccgcaaggacuaccagcuguacaagguccgggagaucaacaacuaccaccacgcccacgacgccuaccugaacgcggugguggccaccgcccuccugaagaaguacccccagcuggccccggaguucgucuacggggacuaccccaaguacaacuccuacaagagccgcaaguccgccaccgagaaggugcuguucuacagcaacaucaugaacuucuucaagcgggugcuggucuacuccaagaccggcgaggugcgcauccggcccgugaucgaggucaacaaggagacgggcgagaucgugugggacaagaaguccgacuuccgcaccgugcgcaagguccugagcuacccccaggugaacguggucaagaagaccgaggugcagaaccacgggcucgaccggggcaagccgaagggguucuacaacgcgaaccugagcccccgccccaaggagggcagcguggagaaccugguccccgccaagcaguccuucgacaccaagcgguacgggggcuacgccggcaucagcaacuccuacgccgugcucgugaacgggaucaucgagaagggcaagaagaaguccaaggcggaggucacggaguuccaggggaucagcauccuggcccgcaaggacuucgacaagaacccgaagcaguaccugcucaaccugggcuacaaggacaucaagagcaucaucaagcugcccaaguacucccucuucgagcuggagaacgggagccggcgcaugcuggccuccauccucagcaccaacaacaagcggggcgagauccacaagggcaacgagauguaccugcccgacaaguucgugacccugcucuaccacgccaugcgcgugaaccggacccuggagccggggcacaagaaguacgucgaggcccaccgccacguguucgacgagcugcucacguacauccuggaguacaacgagaagaucgugggcgcgaaggccaacgggaagcggaucgucgaggccuacuccgcccgcaaggacaccgacaaccuggaggagcucugcaacagcuucaucaaccugcugaaccucaccgcccugggcuccgcgguggacuucgaguuccuggggaccaagaucccccgguaccgcgacuacacgcccagcucccuccugaaggccacccugauccaccagagcgugaccggccucuacgagacccggaucgaccuguccaagcugggcggggacuga

SEQ ID NO: 2045 - RNA, 4143 nt, Artificial Sequence
  Cas9 variant
augaagaagauccugggccucgaccuggggaccaccagcaucggcugggcccugguguacgaguccgagaacgccgacgagaaguccuccaucguccgccucggggugcgggugaacccccugagcgucgacgagaagggcaacuucgagaaggggaaguccaucacgaccaacgcggaccgccagcagacccacggcgcccggaucaaccugcagcgcuacaagcuccggcgcgagaaccugaaggacugccugcagaagcagggcuggaucgggaccgaggcccucuacgaggagggcaagacgagcaccuucgagaccuacaugcugcgggccaaggccgcggaggaggagaucucccugcacgagcucugccgcgugcuguucaugcugaacaagaagcggggguacaagagcaaccgcaaggccaacaacaaggaggacggcaagcuguucgacgggaugaccguggccaagaagcuguacgaggagcaccugacgccggccgaguacucccucaagcugcugagcuccggcaagaaguucaagcaggaguacuaccggagcgaccucaaggaggaguucgaccgcaucuggaacgagcagcagaaguacuaccccgagauccugaccgacgacuucaagcagcagcugcagggcaaguccaaggggaacaccagcaagaucuuccucggcaaguacgggaucuacuccgcggaccugaagggccuggaccggaagcuccagccccugaaguggcgcgucgaggcccugaagcagaagguggacaaggaggugcucgccuucgucaucagcgaccugaacggccagaucgccuccaccagcgggcugcucggcgccaucuccgaccggagcaaggagcuguacuucaacaagcagacgguggggcaguaccuguggaccagccucaaggagagcccccacgugagcaucaagaacaagccguucuaccgccaggacuaccuggacgaguucgagaagaucugggagacccaggcgaccuaccacaaggagcugacgcccgagcucaagcaggagauccgggacaucaucaucuucuaccagcgcccccugaaguccaagaagggccugaucagcgucugcgagcucgagcagcggaaggugaaggugaccaucgacgggaaggagaaggagaucuccaucggccccaaggucgcccccaagagcucccccauguuccaggaguuccgcaucuggcagaaccugaacaacauccugcucaucgacaagggcaacaacagcaaccggccccuguacgaggaggagcgcaaccugcucuacgaggagcuguccgugaaggagaagcugagcaaggccgaggcccugaaggugcucaacaagaacgggaagcagugggaccugaacuacaaggagaucgagggcaaccgcacccaggccguccuguacgacugcuacaaccggaucaucgggaugaccggccacgaggagugcaacuucaagaagcucaaggcguccgacauccgcuacaacgugaagacgaucuucaagaaccugggguucagcaccgacauccuggacuucgacuccagccuccagggccacgagcuggagcggcagcccuccuaccagcuguggcaccuccuguacagcuacgaguccgacaacagccgcaccggcaacgacgcccugcuccggaagcuggagaccgccuucuccaucccgaaggaguacgccgccgugcugagcgacgucguguucgaggacagcuacgggaaccucuccgugaaggcgaugcgcaacauccugccccaccuccaggccggccucgacuacagccaggccugcgagaaggccggguacaagcacucccggcgcagccugacgaagaacgagcuggacaagaaggaguacaaggagaagcucgagcugcugcccaaguccagccuccacaaccccgucguggagaagauccugaaccagaugaucaacgucaucaacgccgugaucgacgaguacggcaagccggacgagauccggaucgagcuggcgcgcgagcucaagaucggggccgccgagcgggagaacaugacccgcuccaucaaccagggcaacgccgagaacaagcggauccgcgagauccuggagaaggaguucgcgcugagcuacaucucccggaacgacaucaucaaguacaagcucuacgaggagcucaagagcaacggcuucaagacccuguacuccgacaccuacaucagcaaggacaagcuguucuccaaggacuucgacaucgagcacaucauccccaaggcccgccuguucgacgacagccuguccaacaagacgaucgaggcccgggacgugaacaucgccaagagcaacaagaccgccuucgacuucaucuccgagaaguacgaccagcaggggaucgaggcguacaagaagaagcucgacauccugcugcaggacggcagcaucagcaaggccaaguacaaccgccuccugaugaaggaggccgacauccccuccggguucaucgaccgggaccugcgcgacacccaguacaucgccaagaaggccuacgagauccucagcgaccugguccgcaacgugacccccacgaccggcgcggugaccucccggcugcgcgaggacuggcagcucgucgacgugaugaaggagcugaacuucgagaaguaccagaagcugggccucguggaggucaucgaggaccgggacgggcgcaagaucaagcggaucaaggacuggaccaagcgcaacgaccaccggcaccacgccauggacgcccugacgaucgccuucaccaagccgagcuacauccaguaccugaacaaccucaacgcccgcuccgacaagaacagcuccaucuacggcaucgagaacaaggagcugcaccgggaggacaacaagcugcgcuucaacgcgccccuccccaucaacgaguuccgggccgaggcccgccggcaccucaagagcauccugguguccgugaaggccaagaacaaggucaugacccagaacgugaacgugaucaagaccaagcacggggucaucaagaaggugcagcugaccccgcgcggcgagcugcacaacgcgacguucuacgggaccaagaagcggccgaucaucaagauggugaaggucggcgccgcccuggacgaggugaccaucaagaaggugagcuccagcuucauccgcgaggcccuccuggaccggcugcacgaguacaacggcgacgccaagaaggcguucaccgggcgcaacuccaucgacaagaaccccaucuacaucgacgaggagcacaagaagacgguccccgcccucgugaagaccaucgagugggagauguaccaccccacccggaagaugaucagcccggaccugaagaucgacaaggugaucgacaagggcauccgcgagauccugcggacccgccucgccaaguucaacggggacgcccagaaggccuucuccaaccuggacgagaaccccaucuacaaggacgaggcgaagaagaucacgcugaagcgcgucagccucgagggcguguccagcgugaucccccugcacaagcugaaggacaugggcgggaagccggucgugggcaaggacgggaagcccguguggggcgacuacguccagaccuccaacaaccaccacaucgccuucuacauggacgagaacgggaaccuccaggacgacguggugaccuucuucaaggccgcccggcgcaagagccagggcguccccgugaucgacaagaacuacaaccacgacaagggguggcacuuccuguucaccaugaagcagaacgaguacuucguguuccccaacgaggccacgggcuucaucccgaccgaggucgaccugauggacgaggcgaacuacgacaugaucagccccaaccucuaccgggugcagaagauguccaagaccaagcagggcaucaccgacaagcgcgacuacugguuccggcaccaccuggagacggugcugaacaacgaccucaagguccgcaacagcaucuucaagcagaucaacucccugaagccccuggaggggaucgugaaggugcggaucaacgccaucggcaagaucgucgccaucggggaguacgacuga

SEQ ID NO: 2046 - RNA, 4143 nt, Artificial Sequence
  Cas9 variant
augaagcgcauccugggccucgaccuggggaccaccagcaucggcugggcccuggugaacgaggccgaguccaacaacgaggcgagcuccaucguccggcucggggugcgcgugaacccccugacggucgacgagaaguccaacuucgagaagggcaaggccaucaccaccaacgccgaccggcagcugcgccacggggcccggaucaaccuccagcgcuacaagcugcggcgccagaaccugcacgacugccuccagaagcagggcuggcugggcaccgaggccauguacgaggaggggaaggcgagcacguucgagaccuacaagcugcgggccaaggccgccgaggaggagaucagccuccacgaguucgcgcgcgugcuguucaugcugaacaagaagcggggcuacaaguccaaccgcaaggccaacaacaaggaggacgggcagcuguucgacggcaugaccaucgccaagaagcuguacgaggagcaccugaccccggccgaguacagccuccagcugcugaacaaggggaagaaguucacgcagggcuacuaccgguccgaccucaacgccgagcuggagcgcaucugggacgagcagaagaaguacuaccccgagauccugaccgacgaguucaagcagcagcucgagggcaagaccaagaccaacacgagcaagaucuuccuggcgaaguacgggaucuacuccgccgaccugaagggccucgaccggaagcugcagccccugaaguggcgcguggaggcccucaagcagcaggucgacaaggaggugcuggccuucgugaucagcgaccugaaggggcagaucgccaacaccuccggccuccugggcgcgaucagcgaccgguccaaggagcuguacuucaacaagcagaccgucgggcaguaccucugggccagccuggaggagaacccccacaucuccaucaagaacaagccguucuaccgccaggacuaccuggacgaguucgagaagaucugggagacccaggccacguuccacaagcagcucacccccgagcugaagcaggagauccgggacaucaucaucuucuaccagcgcccccucaagagcaagaagucccucaucagcgugugcgagcuggagcagcggaaggugaaggccaccaucgacggcaaggagaaggagaucaccaucgggcccaaggucgcccccaagagcucccccguguuccaggaguuccgcaucuggcagaaccugaacaacgugcuccugaucgacaacgacacgaacgagaagcgcccccuggacgaggacgagcgguaccuccuguacaaggagcugagcaucaaggcgaagcuguccaagaccgaggcccucaagauccugaacaagaagggcaagcagugggaccugaacuacaaggagcucgaggggaaccgcacccaggccauccuguucgacugcuacaaccggaucaucacccugacgggccacgaggagugcgacuucaagaagaucaaggccagcgagauccgccacuacgucuccaccaucuucaagaaccucggcuucagcaccgagauccuggacuucgaccccucccuggagaagcacgagcucgagaagcagccgauguaccagcuguggcaccuccucuacagcuacgaguccgacaacagccggaccgggaacgagucccugcugcgcaagcucgagacgaccuucggcuuccccgaggaguacgccaccgugcugugcgacguggucuucgaggaggacuacgggaaccugagcgugaaggcgaugcggaagauccuccccuaccugcaggccggcaacgacuacucccaggccugcgccuacgcgggguacaaccacagccgccacucccugaccaaggaggagcucgaccagaagguguacaaggagcggcuggagcugcuccccaagaacagccugcgcaacccggucguggagaagauccugaaccagaugaucaacgugaucaacgccaucaucgacgaguacggcaagcccgacgagauccggaucgagauggcccgcgagcucaaguccagcgccgccgaccggaagaagacgacccacgcgaucaaccagggcaacgacgagaaccagugcauccgcgagauccuggagaaggaguucgcccuguccuacaucagccggaacgacaucaucaaguacaagcucuacgaggagcugaagcccaacggguucaagacccuguacagcgacaccuacauccccaaggacaagcuguucuccaaggacuucgacaucgagcacaucaucccgaaggcccgccuguucgacgacagcuacuccaacaagacgcuggaggcccgggacaucaaccucgccaagagcaacaagaccgcguucgacuucgucaaggagaaguacggcgagcagggggccgaggccuacaagaagaagcuggacaugcugcucggcaacaacgugaucuccaagcccaaguacaacaagcugcugaugaccgaggccgacauccccagcgacuucaucaaccgcgaccuccggaacacccaguacaucgcccgcaaggcgugcgagauccugggggagcugguccgcaccgugacgcccaccaccggcaagaucaccaaccggcuccgcgaggacuggcagcugguggacgucaugaaggagcugaacuucgagaaguacgagaagcucggccugacggagaucguggaggaccgggacgggcgcaagaucaagcggaucaaggacuggaccaagcgcaacgaccaccggcaccacgccauggacgcccuggccaucgcguucaccaagccguccuacauccaguaccucaacaaccugaacgcccgcagcaacaagggcgacuccaucuacgccaucgagaacaaggagcugcacuacgaggaggggaagcuccgguucaacgcccccauccccgugaacgucuuccgcgccgaggcgaagcggcaccugagcgccauccugguguccaucaaggccaagaacaaggugaugacccagaacgucaacaagaucaagacgaagcacggcaucaucaagaagauccagcucaccccgcgcggcccgcugcacaacgagaccaucuacgggaccaagaugcggcccaucaucaagaaggugaaggugggcgccgcccuggacgaggcgacgaucaacaaggucagcucccccgccauccgcgaggugcuccugaagcggcugaacgaguacagcgggaacgccaagaaggccuucaccggcaagaacacccucgacaagaacccgaucuaccugaacgccgagcgcaccaagacggugcccgcguccgucaagaccguggagugggagaacuaccaccccauccggaagcccaucaccccggaccugaagguggacaaggucaucgacaaggggaucggcgagauccucaaggcccgccuggaggaguucaacggcgacgccaagaaggccuucagcaaccuggaggagaaccccaucuaccucgaccagaccaagaagaucgcgcugaagcggguguccaucgagggggugcugagcacgaucccccuccacacccugaagaaccaggccggcaagcccaucauggggaaggacggcaagccgguccuggggaacuacgugcagaccagcaacaaccaccacaucgccuucuacuacgacgaggacggcaaccuccaggacaacgccguguccuucuucgaggccgcggagcgcaagagccagggcaucuccgucaucgacaaggacuacaaccgggacaagggguggcgcuuccuguucaccaugaagcagaacgaguacuucguguuccccaacgaggccacgggcuucauccccagcgagguggaccugaccgacgaggccaacuacgggaucaucucccccaaccucuaccgcguccagaagaugagccggaucgagaagggcaccuccgugagccgcgacuacugguuccggcaccaccuggagaccauccugaacgacgacucccgccucaagaacagcgccuucaagcggaucaacucccugaagccgcuggaggggaucaucaaggugcgcaucaacagcaucggcaagaucgucgccgugggcgaguacgacuga

SEQ ID NO: 2047 - RNA, 4143 nt, Artificial Sequence
  Cas9 variant
augaagaagggcuacagcaucgggcuggacaucggcaccaacuccgugggguucgccgucaucaccgacgacuacaaggugcccagcaagaagaugaaggugcucggcaacacggacaagcgcuucaucaagaagaaccugaucggggcccugcuguucgacgagggcaccaccgcggaggcccggcgccugaagcggaccgcccgccggcgcuacacgcggcgcaagaaccggcugcgcuaccuccaggagaucuucuccgaggagaugagcaaggucgacuccagcuucuuccaccggcuggacgacuccuuccugaucccggaggacaagcgcgagagcaaguaccccaucuucgccacccucgaggaggagaaggaguaccacaagaaguuccccaccaucuaccaccuccggaagcaccuggccgacuccaaggagaaggcggaccuccgccugaucuaccuggcccucgcccacaugaucaaguaccggggccacuuccuguacgaggacaccuucgacaucaagaacaacgacauccagaagaucuucaacgaguucaucagcaucuacgacaacgccuucgagggguccagccuguccggccagaacgcccagguggaggccaucuucacggacaagaucagcaaguccgccaagcgcgagcgggugcucaagcuguuccccgacgagaaguccaccgggcuguucagcgaguuccucaagcugaucgucggcaaccaggccgacuucaagaagcacuucgaccuggaggacaaggccccgcuccaguucagcaaggacaccuacgacgaggaccuggagaaccugcucgggcagaucggcgacgacuucgcggaccuguucguggccgccaagaagcuguacgacgccauccuccuguccggcauccugaccgugacggaccccagcaccaaggcgccccucagcgcguccaugaucgagcgcuacgagaaccaccagaacgaccuggucgugcugaagcaguucaucaagaacaaccuccccgagaacuacguggaggucuucagcgacgacuccaagaacggguacgccggcuacguggggguggacagcaagauccggaagcgcaacgccaagcuggccaccgaggaggaguucuacaaguaccugaagaacauccucaacaacgucaagggcgccgacuacuuccuggacaagaucgagcgggaggacuuccugcgcaagcagcgcaccuucgacaacggcuccaucccgcaccagauccaccuccaggagaugaacgcgauccugcggcgccagggggagcacuaccccuuccugaaggagaaccgggagaagaucgagaagauccucacguuccgcauccccuacuacgugggcccccuggcccgggggaaccgcgacuucgccuggcugacccggaacagcgaccaggccauccgcccguggaacuucgaggagaucguggacaaggccuccagcgcggaggacuucaucaacaagaugaccaacuacgaccucuaccugcccgaggagaagguccugcccaagcacucccugcucuacgagaaguucgccguguacaacgagcugaccaaggugaaguucaucgccgagggccugcgggacuaccaguuccucgacagcgggcagaagaagcagaucgucaaccagcuguucaaggagaagcgcaaggugacggagaaggacaucauccacuaccugcacaccguggacggcuacgacggcaucgagcucaaggggaucgagaagcaguucaacgccucccugagcaccuaccacgaccugcucaagaucaucaaggacaaggaguucauggacgaccccaagaacgaggagauccuggagaacaucguccacacccugacgaucuucgaggaccgggagaugaucaagcagcgccucgcgcaguacgacucccuguucgacgagaaggugaucaagagccugacccggcgccacuacaccggcugggggaagcucuccgccaugcugaucaacggcauccgggacaagcagaccgggaagacgauccuggacuaccucaucgacgacgccuacuacaaccgcaacuucaugcagcugaucaacgacgacggccugagcuucaaggagaucauccagaaggcccaggucgugggcaagaccgacgacgugaagcaggucgugcaggagcucccggggucccccgccaucaagaagggcauccugcagagcaucaagaucguggacgagcuggucaagaucaugcggcacaaccccgaguccaucgugaucgagauggcgcgcgagaaccagaccaccgcccgggggaagaagaacagccagcagcgcuacaagcgcaucgaggacgcccucaagaaccuggcccccggccuggacagcaacauccucaaggagcacccgacggacaacgugcagcugcagaacgaccggcuguuccucuacuaccugcagaacgggaaggacauguacaccggcgaggcccuggacaucaaccagcucuccagcuacgacaucgaccacaucaucccccaggcguucaucaaggacgacuccuucgacaaccgcguccugaccagcuccaaggacaaccggggcaagagcgacaacgugcccuccaucgaggugguccagaagcgcaaggccuucuggcagcagcugcucgacagcaagcugaucuccgagcggaaguucaacaaccugaccaaggccgagcgcgggggccucgacgagcgggacaaggugggguucaucaagcgccagcugguggagacgcggcagaucaccaagcacgucgcccagauccuggacgcccgcuacaacaccgaggugaacgagaaggacaagaagaaccggaccgugaagaucaucacccucaagagcaaccuggucuccaacuuccgcaaggaguuccggcuguacaaggugcgcgagaucaacgacuaccaccacgcgcacgacgccuaccucaacgccguggucgccaaggcgauccugaagaaguaccccaagcuggagccggaguucguguacggcgaguaccagaaguacgaccucaagcgguacaucagccgcuccaaggaccccaaggagguggagaaggccacggagaaguacuucuucuacagcaaccugcugaacuucuucaaggaggagguccacuacgccgacggcaccaucgugaagcgggagaacaucgaguacuccaaggacaccggggagaucgccuggaacaaggagaaggacuucgccaucaucaagaaggugcucagccugccccaggucaacaucgugaagaagcgcgaggugcagaccggcggguucuccaaggagagcauccugcccaagggcaacagcgacaagcucaucccgcggaagacgaaggacauccugugggacaccaccaaguacgggggcuucgacucccccgucaucgcguacagcauccugcucaucgccgacaucgagaagggcaaggccaagaagcugaagaccgugaagacgcugguggggaucaccaucauggagaaggccgccuucgaggacaaccccaucaccuuccucgagaacaagggcuaccacaacguccgcaaggagaacauccugugccugccgaaguacucccucuucgagcuggagaacgggcggcgccgccugcucgcgagcgccaaggagcugcagaagggcaacgagaucgugcugcccguguaccucaccacgcugcuguaccacuccaagaacguccacaagcucgacgagcccgggcaccuggaguacauccagaagcaccggaacgaguucaaggaccugcucaaccuggugagcgaguucucccagaaguacgugcuggccgacgccaaccucgagaagaucaagagccuguacgccgacaacgagcaggcggacaucgagauccuggccaacuccuucaucaaccuccugaccuucaccgcccugggcgcccccgcggccuucaaguucuucggcaaggacaucgaccgcaagcgguacaccacggucagcgagauccucaacgccacccugauccaccaguccaucaccgggcuguacgagacccgcaucgaccucagcaagcugggcgaggacuga

SEQ ID NO: 2048 - RNA, 4143 nt, Artificial Sequence
  Cas9 variant
augaaccugcgccacgugggcaacuacaacaucgggcucgacaugggcaccgccagcgucgggugggccgcgaucgacgagcagggcgagcugcugcacuucaaggggaagcccaccuggggcucccgccucuucgacagcgccaacacggccgccaccgcccggaugccgcggggccagcgccggcgcuacauccggcgccgguggcgccuggaccugcuccagaaguucuucuccgaggagauggcggagaaggaccccgaguucuucauccggcugcgccagagcucccuguggcccgaggaccgggagggcgggcacaccgccuaccacuggccccucuucaacgacagcgacuucaacgagaaggaguacuacgagaaguucccgaccaucuuccaccuccgccaguggcugauggagacggacgagaaggccgacauccggcucaucuaccuggccuuccacaacaucgugaagcaccgcgggaacuuccugcaggagaacaacgacucccucagcgcgcagaacgccaacaugcgggagucccuggagagcuucugcaucgcccuggaggaguggugcgacgagaaggagcugaccugcuccugcgacccccagaagcuggagcaccuguucaaggaggugaaguaccgcagcgacauccgggacggcuucgccgcccuccuggggcuggcgugcuccggcgagaacgaggucgacgugaaggccauggccaaggagaugggcaaggccaucgugggguacaaggccgacuucagcaagaucuucaccgagugcgacaaggagggcuccagcuuccgccucuccgacgacgaggggcccgaggcguuccuggacaucugccccgacgacggcaucgcccuguucgaggccauccagauggucuacagcuccuucauccucaccggcaugcugacggagaaggggcugagccucagcaagaucuccgccuacaaccaguacggccaggaccuggagagccugaaggcccucgugaaggaguacgugccgaacgaguacuccagcuucuuccgggggcccaccuacuccggcagcaccgaguacgaccccuccaaggcgcagggguacacccgcuacaaccugggccccagcaagaagggcuccggggccaagccgauggccuacgaggacuucaagaaguccgucgagcagcuguucgccaacacgaacgccaucaacgacgagcgcuacaaggagaugaugggccgguucgcggaggagaaguuccuccgccggcugcgcaccagcgacaacgggcggauccccuuccagcugaaccucgaggagaugaccgccaucaucaucaaccagggcaaguacuaccccuuccugcuggagcagcaggagaagcucgagagccuggugcgcuuccggauccccuacuacguggggccgcugacccgcaucaacgcccggcucgacuccaagggcaacgccugcuucgcguggagcaagcgcaaggacggcauggacuccgccagcaucaagcccuggaacugggacgaggucaucgacaagcacgccuccgcccaggccuucaucgagcggaugacggggaccugcaccuaccugcgcggcgagcccgugcugccccggugcagccuccuguacgaggaguacugcgugcugaacgagcugaacggggcgcgcuggacccaggacggcgacaaguucauccgguucgacuacaaggaccgcuccgacaucaucgaggagcuguucaagaagcggcgcgggcggauccaguacgccgccgucgccgacuggaugaagcaggagcgcagccacgccaacgugcacgugagcggcggccagggggagaacgcguucgagucccgccucagcuccuaccacuucuucugcaacgacgucuucggcguggacgagcugccggggagcuacguggacauggucgaggagaucauccucugguccacgcuguucgaggaccggagcauccugcgcgaggagauccagcggaaguacggcgacgugcucaacgaggagcagaucaagaccaucugcaagaagcgcuucuccggcugggggcggcugagccgcaagcugcucugcucccugaaggcccagaccgacaacggccccaagagcaucauggacauccugcaggagggggaccagaacaacggccggguggggcgcgccauggucuuccaggagauccuccacgacgagcagcugggcuucgagcagaagaucgaggaggagaacacccaguccaugcuggagggcgagaaccuccugaucgaggaccugcccgggagccccgccauccggcgcuccaucaaccaggccgugcggaucgucgacgagaucgugggcaucgcggggcacgccccggacaacaucuucaucgaggugacgcgcgaggacgacaccaagaagaagggcaagcggaccaccacgcgcuacagcaacauccagaaggcccucgaggcccugaaggaggagggggcggaggcccugcgggagcucaagaccuacaagcacaacgagcuggacaagcgccugucccucuacuucaugcagaacggcaagagccuguacuccggcaucccccuggacauccggcgccucagcgaguaccagaucgaccacaucaucccccagagcuacaucaaggacgacuccuacgagaacauggcccugguccugcccggggagaaccagagcaaggccgacaaccuccugaucucccaggacauccggaucaagaugaaggccaccuggaccgcgcugcacaaggccggccucaugggggacaagaaguacaacaaccugaugaacagcuccaucagcgacgccaagaugaagggcuucaucaaccgccagcugguggagacgucccagagcgugaagcucacccagaugaugcugucccagaaguacccgggggccaagguccggcccaucaaggccagcaucuccagccagcugcgcgacgcgugcgaccucgugaagugccgcgaggccaacgacuaccaccacgcccacgacgccuaccuggccugccaggugggccgguucguccugaagcgccacuccagcauguucgacaaccccaucggcaugaccaaggugauccgggacuucgugaagcgccaggggcaggaguucaagcggaacggcaagcucccggcguacgccucccgcagcggguucaucguccaguccuucaugcggagcggcuucgacgccgagaccggggagcugcugcgcgacgacuggaacgcccccuucgagaucgcgcggaucaagcgcugccucaacuaccgggacugcuacaucucccgcaugcccauggaggacagcggcgccuucugggacgccacgaucuacagccccaaggccggcaagaagggggcccugccggugaagcagggccugcccguggagaaguacggguccuacagccgggagcaguucgcguacuucuucgucuacaaggccuacaaccccaagaagaaggccuaccgccucgaguucgaggccgugcccgugcgggucgccuccgcgguggagacccgcgagaacgcccuggaggaguacgccaagagcguggccaagcaggccggccuggaguucgucgagguggcgcggccgaagguguacaaguaccagcucaucgagcugggcgaggaccgccuguacaucaccgggaagcgggagguccgcaacgccucccagcucgccuucagccuggacgagaucgaccugcucaagcgccuggccgagggcgaggagaccuccagcgaggagcgggagcgccuguucgacgugcucaucgagaaguacgcccgguacgcgccccgccuggcccggcagcuguccguggacagcauguccgccaccuucgagacgcucaacgccgaggagcagcuggggauccugcucagccuggucgagaucgcgaacggcaagcgcaacaugaucgaccuguccagcgccgggggcuccaagaacgccggcugcaugaaccccaccuucagcuccgagcucagcucccccgggagcaacuucaccuucaucgaccagagcgugaccggcauguucgagcggcgccagcggcuggagcuguga

SEQ ID NO: 2049 - RNA, 4146 nt, Artificial Sequence
  Cas9 variant
auggugaagaagaaguacgccaucggcaucgacaucgggaccaacagcgucggcugguccaucgugaccgacgacuacaaggugcccagcaagaagaugaaggucuucgggaacacggagaagcgcuacaucaagaagaaccugcugggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacgugcagcaccuguucaacgacuucgucgagauguucgacaagaccguggagggguccuaccugagcgagaaccuccccaacguggccgacguccugguggagaagguguccaagagccggcgccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacggacagcaccaccaaggcgccccucuccagcuccauggucaaccgguacgaggagcaccagaaggaccuggcccugcucaagaacuucauccaccagaaccugagcgacagcuacaaggagguguucaacgacaagcugaaggacggcuacgccggcuacaucgaggggaagaccacgcaggagaacuucuaccgcuucaucaagaaggccaucgagaagaucgagggcuccaacuacuucaucgacaagaucgaccgggaggacuuccuccgcaagcagcggaccuucgacaacgggagcaucccccaccagauccaccuccaggagaugcacgccaucauccgccgccaggcggaguucuaccccuuccugguggagaaccaggacaagaucgagaagauccucaccuuccggaucccguacuacgucggcccccuggcccgcgggaaguccgaguucgccuggcugaaccgcaagagcgacgagaagauccggcccuggaacuucgacgagaugguggacaaggagaccuccgccgagaacuucaucacgcggaugaccaacuacgaccgcuaccuccccgaccagaaggugcugccgaagcacagccugcuguacgagaaguucgccgucuacaacgagcucaccaaggugaaguucaucgcggagggcaugcgggacuaccaguuccuggacuccggccagaagaaggacaucgugaagacccuguucaagacgaagcgcaaggucaccgccaaggacaucaaggccuaccucgagaacagcaacggguacgccggcguggagcugaaggggcuggaggagcaguucaacgccucccuccccaccuaccacgaccugcugaagauccuccgggacaaggcguucaucgacgccgaggagaaccaggagauccuggaggacaucgugcugacccucacgcuguucgaggaccgcgagaugauccggaagcgccuggagaaguacaaggacauccucaccgaggagcagcggaagaagcuggagcgccggcacuacaccggcugggggcgccugagcgccaagcucaucaacggcauccuggacaaggucacccggaagacgauccugggcuaccucaucgacgacgggaccuccaaccgcaacuucaugcagcugaucaacgacgacacccugagcuucguggacgagauccggcucgcccagggcuccggggaggcggaggacuaccgcgccgagguccagaaccuggccggcagccccgccaucaagaaggggauccugcagucccucaagaucguggacgagcugaucgaggugaugggcuacgagcccgagcacaucgucguggagauggcccgcgagaaccaguucaccaaccagggccggcgcaacagccagcagcggaucaaccgccuggagaacgcgcucaaggacuucggguccaagauccuggaggagcagaagccguacggcgugagcaaggucaacaacauccaccuccaguccgaccggcuguuccuguacuaccugcagaacgggaaggacauguacacggacgaggagcucgacaucgaccaccugagcgaguacgacaucgaccacaucaucccccaggccuucaucaaggacgacagccuggacaacaaggugcucaccaaguccgccaagaaccgcggcaagagcgacgacgugcccuccauggagaucguccacaaccggaagaacuucuggcgccagcugcucaagagcaagcugaucucccagcggaaguucgacaaccugaccaaggccgagcgcggcgggcugaccaacgaggacaaggcccgguucauccagcgccagcucguggagacccggcagaucacgaagcacguggcgcgcaugcuggacacccgguucaacaccaagcuggacgaggccggcaaccgcauccgggaccccaaggucaacaucaucacccucaagagcaaccuggugucccaguuccgcaaggacuaccagcuguacaagauccgggagaucaacaacuaccaccacgcccacgacgccuacaucaacgccguggucgcgacggcccuccugaagaaguacccgcagcuggcccccgaguucguguacggggaguaccccaccuacaacagcuacaacucccgcaagagcgccaccgagaaggugcuguucuacuccaacaucaugaacuucuucaagcggaucgucgugcacagcaagaccggcgaggugcgcauccgccccgucaucgaggugaacaaggagacgggggagaucgugugggacaagaaguccgacuuccggaccguccgcaaggugcugagcuacccccaggugaacgucgugaagaagaccgaggugcagaaccacggccuggaccggggcaagcccaagggguucuacaacgcgaaccucuccccgcgccccaaggagggcagcgucgagaaccuggugccggccaagcaguccuucgacaccaagcgguacgggggcuacgccgggaucagcaacagcuacgccgugcuggucaacggcaucaucgagaagggcaagaagaaguccaaggccgaggugacggaguuccaggggaucagcauccucgcgcgcaaggacuucgacaagaaccccaagcaguaccugcugaaccucggcuacaaggacaucaaguccaucaucaagcugcccaaguacagccuguucgagcucgagaacgggucccggcgcaugcuggccagcauccuguccaccaacaacaagcggggcgagauccacaaggggaacgagauguaccucccggacaaguucgugacccugcuguaccacgccaugcgcgucaaccggacccucgagcccggccacaagaaguacguggagacgcaccgccacguguucgacgagcugcugaucuacauccucgaguacaacgagaagaucgucggcgccaaggccaacgggaagcggaucguggaggcguacagcgcccgcaaggacaccgacaaccuggaggagcugugcaacuccuucaucaaccuccugaaccugaccgcccucggcagcgccguggacuucgaguuccuggggaccaagaucccccgguaccgcgacuacacgcccuccagccugcucaaggccacccugauccaccaguccgucaccggccuguacgagacccggaucgaccucagcaagcucgggggcgacuga

SEQ ID NO: 2050 - RNA, 4146 nt, Artificial Sequence
  Cas9 variant
augaacuacgugaaggaguaccacaucggccuggacaucgggaccagcuccaucggcugggccgucaccgacagccaguucaagcucaugcgcaucaaggggaagacggccaucggcgugcggcuguucgaggaggggaagaccgcggccgagcgccggaccuuccgcaccacgcggcgccggcugaagcgccggaaguggcgccuccacuaccuggacgagaucuucgcgccccaccuccaggagguggacgagaacuuccuccggcgccugaagcaguccaacauccacccggaggaccccgccaagaaccaggccuucaucggcaagcugcuguuccccgaccugcugaagaagaacgagcggggcuaccccacccucaucaagaugcgcgacgagcugccggucgagcagcgggcccacuaccccgugaccaacaucuacaagcugcgcgaggccaugaucaacgaggaccggcaguucgaccuccgcgagguguaccuggccguccaccacaucgugaaguaccgggggcacuuccugaacaacgccagcguggacaaguucaaggucggccgcaucgacuucgacaaguccuucaacgugcucaacgaggcguacgaggagcugcagaacggggagggcagcuucaccaucgagcccuccaagguggagaagaucgggcagcugcuccuggacacgaagaugcggaagcuggaccgccagaaggccgucgccaaguuccucgaggugaagguggccgacaaggaggagaccaagcgcaacaagcagaucgccaccgcgaucagcaagcugguccugggcuacaaggccgacuucgccaccguggccauggccaacggcaacgaguggaagaucgaccucuccagcgagacguccgaggacgagaucgagaaguuccgggaggagcugagcgacgcgcagaacgacauccugaccgagaucaccucccucuucagccagaucaugcugaacgagaucgugcccaacgggauguccaucagcgaguccaugauggaccgcuacuggacccacgagcggcagcuggccgaggucaaggaguaccucgccacgcagccggccagcgcccgcaaggaguucgaccagguguacaacaaguacaucggccaggcgcccaaggagaagggguucgaccuggagaagggccugaagaagauccucuccaagaaggagaacuggaaggagaucgacgagcugcugaaggccggcgacuuccuccccaagcagcggaccagcgccaacguggucaucccccaccagaugcaccagcaggagcuggaccgcaucaucgagaagcaggccaaguacuacccguggcuggccaccgagaaccccgcgaccggggagcgggaccgccaccaggccaaguacgagcucgaccagcuggugagcuuccggauccccuacuacgugggcccccuggucacgccggaggugcagaaggccaccuccggggccaaguucgcgugggccaagcgcaaggaggacggcgagaucacccccuggaaccucugggacaagaucgaccgggccgagagcgccgaggccuucaucaagcgcaugaccgucaaggacacguaccugcugaacgaggacgugcuccccgcgaacucccugcuguaccagaaguacaacgugcugaacgagcucaacaacguccgggugaacgggcgccggcugagcgugggcaucaagcaggacaucuacuccgagcuguucaagaagaagaagaccgucaaggccagcgacguggccucccucgugauggccaagacccgcggcgucaacaagcccagcguggaggggcuguccgacccgaagaaguucaacagcaaccuggccaccuaccucgaccugaaguccaucgugggcgacaaggucgacgacaacugcuaccagacggaccuggagaacaucaucgaguggcggagcguguucgaggacggggagaucuucgcggacaagcucaccgagguggaguggcugaccgacgagcagcgcuccgcccuggucaagaagcgguacaagggcugggggcgccucagcaagaagcugcugaccggcaucguggacgagaacggccagcgcaucaucgaccucauguggaacacggaccagaacuucaugcagaucgugaaccagcccgucuucaaggagcagaucgaccagcugaaccagaacgccaucaccaacgacgggaugacccugcgggagcgcguggaguccgugcucgacgacgccuacaccagcccccagaacaagaaggccaucuggcaggucgugcggguggucgaggacaucgugaaggcggugggcaacgcccccaaguccaucagcaucgaguucgcccgcaacgaggggaacaagggcgagaucacgcggucccgccggacccagcugcagaagcuguucgaggaccaggcccacgagcucgucaaggacaccagccugaccgaggagcuggagaaggcgcucgaccugagcgaccgcuacuaccuguacuucacccagggcgggaaggacauguacacgggcgacccgaucaacuucgacgagaucuccaccaaguacgacaucgaccacauccucccccagagcuucgugaaggacgacucccuggacaaccgggugcuggucagccgcgccgagaacaacaagaaguccgaccgggugcccgccaagcucuacgccgccaagaugaagcccuacuggaaccagcugcugaagcaggggcucaucacccagcgcaaguucgagaaccugaccauggacguggaccagaacaucaaguaccggagccugggcuucgucaagcgccagcucguggagacgcgccaggugaucaagcugaccgcgaacauccugggguccauguaccaggaggccggcaccgacaucaucgagacccgggccggccucacgaagcagcugcgggaggaguucgaccugccgaagguccgcgaggugaacgacuaccaccacgccguggacgccuaccucaccaccuucgcggggcaguaccugaaccggcgcuaccccaagcugcggagcuucuucgucuacggcgaguacaugaaguucaagcgcggguccgaccucaagcugcgcaacuucaacuucuuccacgagcugauggagggcgacaagagccaggggaaggugguggaccagcagaccggcgagcucaucacgacccgggacgaggucgccaaguccuucgaccgccugcugaacaugaaguacaugcucgugagcaaggaggugcacgaccgguccgaccagcuguacggcgccaccaucgucaccgccaaggagagcgggaagcugacgucccccaucgagaucaagaagaaccgcccgguggaccucuacggcgccuacaccaacgggaccagcgcguucaugaccaucaucaaguucacgggcaacaagcccaaguacaaggugaucgggguccccaccaccuccgccgugggccugaagcgggugggcaagcccgggagcgagagcuacaaccaggagcugcaccgcaucaucaaguccaacccgaaggucaagaaggacuucgagaucguggucccccacgugagcuacucccagcucaucguggacggcgacugcaaguucacccuggccagcgacacguaccagcaccccgccacccagcugguccucuccaaggagagcauggagaucaucgcggacgacuucaaguucgugaaggagaaccccgccaccgccgacgagcagcuggugcgggucuucgacgagaucgugaaccagaugaaccacuacuucaccaucuucgaccagcgcuccaaccggcagaaggugacgaaggcccgcgacaaguucgucagccugccgaccgaguccgaguacgagggggccaagaagacccaggugggcaagaccgaggugaucacgaaccuccugauggggcugcacgcgaacgccgcccagggcgaccucaagguccugggccugagcaccuucggguucuuccaguccagcggcgggcucaaccuguccgaggacgccaugaucguguaccagagccccaccggccuguucgagcggcgcaucugccucaaggacaucuga

SEQ ID NO: 2051 - RNA, 4146 nt, Artificial Sequence
  Cas9 variant
augaagcagauccugaagaaggugcagggcuacaacaucgggcucgacaucggcaccaacagcgucggguggguggugaccgacgagaacgccaaccugcugcaguuccgcaagaagaacauguggggcgcccgccucuucgagaagggggacacggcgcagggccggcggcugucccgcagcacccggcgccgguacgaccgccggcgccagcggauccacuaccugcaggagaugcucgccaccaugguccugcccaucgacgaguccuucuucauccgccugaacgaggccuuccucuggaaggaggacaagagcgugcagcgggacuacauccuguucgccgacaagcaguucaccgaccgcgacuucuacaagcaguucaagacgaucuaccaccuccggaaguuccuccuggacaccaaggagaaggccgacccgcgcuucaucuaccuggcgcuccaccacaugaucaaguaccggggcaacuuccuguaccaggggcaguccuucgacguggucgagaacgugcaggagagcuuccgcgugcugcucgaggagauguacgagcagcugggcaaggagugggaguacggggagcacuucgacgacauccagcggauccuggagaacaccaccaucggcaagaaguccaagcaggagcagaucgccgccauccucacggagcaguacgggaacaagaagcuggccaacgaggucacccgcgcgugccugggcuacagcuucgaccucaccguggugauggagaacgagaaccugcuggacgaguccggcaagaagaucaagaucagcuucuccgacagcaaguacgaggagcaggagcucgagcugcagaaccggcuggaggagaaguucgccgucaucgaggcccucaagcgcaucuacaacuggcuggugcugaaggacacccuccgcgggaagaaguacaucuccgaggccauggugaacaaguacgaggcccaccacgaggaccuggucaagcugaagcgccucuuccggacguaccugagcaccgaggaguacuccugcuucuuccggaaggagaagcagaaggacaaguacaucagcaacuacgugaacuaccgcaagggcgcggagcggugcuccaaggagaagcuguacaaggccauccacgagcuguucgacaccguggccaaggacgacgucguguaccaggagaucguggagaagauggaccagggggaguuccugaccaagcagaacgaggucagcaacgccuacauccccuaccagugcaacgagguggagaugaagcgcauccugaagcagcagggcgaguucuaccccgagcucaaggagaacgccgacaagauccugcagcugcuccuguuccggauccccuacuacgugggcccgcuggucgacgagaagcaguccaaguucgcguggaugaagcgccggacggggauggagcaggucaagaucuaccccuggaacuucgagcaggucguggacaucgaccagaccgccgaggccuucaucacccgcaugaccaacuacugcacguaccuccccgaggagaaggugcugcccaagcagagccugcuguacagcgaguacgagcuccugcaggagcugaacaagaucaagaucaacggcaaguucucccucgagacccggaacaagaucaucgagcagcuguucaagaagcagaagaaggugaccgagaagcagcugaagaaguggcucgugcgcgagcaguacugcaccacgaaggugaccgagaagauggucaagcuggacgagaacgccuacuacaucaccggguuccagaaggagaacgaguucgccagcucccugaccagcuacaucgacuucacgaagauccucggcgagaucaccgagcggaaccgcaagaugaucgaggagaucaucuacuggcugaccguguucgaggagaaguccaucgugaagcggaagauccagaagaaguacgggaacgagaucaacgacaagcagcuggcgcagauccucaagcugaacuacagcggcuggggccgcuucuccgagaaguuccugaacgggaucaagggcuucgaccggcaggggcagaagaagaccaucauggagcuccugcgcgaggacagccggcugcucaacaucaugcagaucaucaacaacgaggagaugggcuucugcaagaucaucgaggccaaccagaagaagcuguacgggaacgagaaccugcucgacgucgugcaggagcugcacggcuccccggccaucaagcgcggcaucuggcagagccugaagaucguggaggagaucaucuccaucaugggcggggucccccagaacaucuucaucgaguucgcccgcgaggacgacgaccgggugcgcacgaacagccgggugaagcagaucgagcgccucuacaagaaguucaaggaggaggucaacgacuucaacgagcacgccgcgaacgagcugaaggagaagcgguaccagaaccgcaucgacgaggagaagguguuccuguacuucaugcagaacgggaagucccucuacagcggcgugacccuggacaucgaccggcugaacgaguacgaggucgaccacaucaucccccgcacccucgugaaggacgacucccuggagaacaaggcccuggugcucaagggggagaaccagcggaagggcgagggccugaucccccacgaguggcagaaccgccagaaggaggucuggaagaagcugcucagcugcgggcugaugggcaagaagaaguacgccaaccugugcaaggaguccuucgggaacgagaaggagcagaagcacuucaucgcccggcagaucguggagacccgccagaucaucaagcaggucgcgaacauccucgcccaguacuaccagggcgugaacguggccgccgugaaggccagccugggcuccgagcugcgggagaacuacacgaucgagaagaaggacgacaacggguucuucauggagaacaagagcuacaccaugcucaagagccgcaagaucaacgacuuccaccacgcgcaggacgccuaccuggccugcgccgucggccuguacaucaaggccgcguucccgaaguacgagaaggagaucgacuacgagggguaccggaaguacuaccagaagaagaaccagcagaaggacggcgugcgcaacgagaagcggcaguucuucuccuacgugaugagccgcuucuccgagcagaucgucgacaaggagaccggggagauccucugggacggcacccagaagcuggccuacaucaagaagaucuucggcuaccgggacugccugaucaccaagaagcucgaggagaacacgggggaguucuacaagcagaccaucaacgccaagcccgagaagggcaaggagaacaacaccaagcugcugcccaucaagaaggggcucagcguggagaaguacggcggguaccagggcggcgaggccgccuacuccugccuggugcgcuaccagcaggggcggaagaccaagcugagccucgagaagaucuccgucaucaucgcgaagaagaucgccgagaaggaggugagccuggaccgcuaccugaaggagaagcucggcguggaggagaucgucauccugcgcaagaaggugaugaagaaccagcugaucgaggacuccgacgggaaccgguucuaccucacggccgccaccgagguggucaacgcgaagcaguucauccuggacggcaagcaccagcaccuccugcgcaccaucgccaucauggagaagggggaguacuacggcuaccggcuggacgagcuggagaacagcauggacgagcucuacgccuacuaccgcaugaagauccagcagcaguaccccgccuacgaguccaucgugaagaagaucguggagagccacgucuacgagucccugcacguggaggagaagaucaaggccgugcaggagaagggcaaguuccugauccagcuccugcggcugaccgaggcgaacgccgagugcaucgaccucaagacgaucagcgacgggcgccuggccgaccggaucggccgcaagaaccacuacaccaucaaggaggggaucaaguucaucgaccaguccaucaccggccuguacgagcgguacaugaccgucuga

SEQ ID NO: 2052 - RNA, 4146 nt, Artificial Sequence
  Cas9 variant
auggacuacgugaaggaguaccacaucggccuggacaucgggaccagcuccaucggcugggccgucaccgacagccaguucaagcucaugcgcaucaaggggaagacggccaucggcgugcggcuguucgaggaggggaagaccgcggccgagcgccggaccuuccgcaccacgcggcgccggcugaagcgccggaaguggcgccuccacuaccuggacaagaucuucgcgccccaccuccaggagguggacgagaacuuccuccggcgccugaagcaguccaacauccacccggaggaccccgccaagaaccaggccuucaucggcaagcuccucuuccccgaccugcugaagaagaacgagcggggcuaccccacccucaucaagaugcgcgacgagcugccggucgagcagcgggcccacuaccccgugaccaacaucuacaagcugcgcgaggccaugaucaacgaggaccggcaguucgaccuccgcgagguguaccuggccguccaccacaucgugaaguaccgggggcacuuccugaacaacgccagcguggacaaguucaaggucggccgcaucgacuucgacaaguccuucaacgugcucaacgaggcguacgaggagcugcagaacggggagggcagcuucaccaucgagcccuccaagguggagaagaucgggcagcugcuccuggacacgaagaugcggaagcuggaccgccagaaggccgucgccaagcuccuggaggugaagguggccgacaaggaggagaccaagcgcaacaagcagaucgccaccgcgaugagcaagcugguccucggcuacaaggccgacuucgccaccguggccauggccaacggcaacgaguggaagaucgaccuguccagcgagacguccgaggacgagaucgagaaguuccgggaggagcugagcgacgcgcagaacgacauccucaccgagaucaccucccuguucagccagaucaugcugaacgccaucgugcccaacgggauguccaucagcgaguccaugauggaccgcuacuggacccacgagcggcagcucgccgaggucaaggaguaccuggccacgcagccggccagcgcgcgcaaggaguucgaccagguguacaacaaguacaucggccaggugcccaaggagaagggguucgaccuggagaagggccucaagaagauccuguccaagaaggagaacuggaaggagaucgacgagcugcucaaggccggcgacuuccugcccaagcagcggaccagcgccaacggggucaucccccaccagaugcaccagcaggagcuggaccgcaucaucgagaagcaggccaaguacuacccguggcucgccaccgagaaccccgcgaccggcgagcgggaccgccaccaggccaaguacgagcuggaccagcuggugagcuuccggauccccuacuacguggggccccucgucacgccggaggugcagaaggccaccuccggcgccaaguucgcgugggccaagcgcaaggaggacggggagaucacccccuggaaccugugggacaagaucgaccgggccgagagcgccgaggccuucaucaagcgcaugaccgucaaggacacguaccugcucaacgaggacgugcugcccgcgaacucccugcuguaccagaaguacaacgugcucaacgagcugaacaacguccgggugaacggccgccggcugagcgugggcaucaagcaggacaucuacaccgagcuguucaagaagaagaagaccgucaaggccggggacguggccucccuggugauggccaagacccgcggcgucaacaagcccagcguggaggggcuguccgacccgaagaaguucaacagcaaccucgccacguaccuggaccugaaguccaucaugggcgacaagguggacgacaaccgguaccagauggaccucgagaacaucaucgaguggcgcagcgucuucgaggacggggagaucuucgcggacaagcugaccgagguggaguggcugaccgacgagcagcgguccgcccucgugaagaagcgcuacaagggcuggggccgccugagcaagaagcugcucaccgggaucgucgacgagaacggccagcggaucaucgaccugauguggaacacggaccagaacuucaugcagaucgugaaccagcccguguucaaggagcagaucgaccagcugaaccagaaggccaucaccaacgacgggaugacccuccgcgagcgggucgaguccgugcuggacgacgccuacaccagcccccagaacaagaaggccaucuggcaggucgugcgcgugguggaggacaucgucaaggcggugggcaacgcccccaaguccaucagcaucgaguucgcccggaacgaggggaacaagggcgagaucacgcgcucccggcgcacccagcugcagaagcuguucgaggaccaggcccacgagcuggugaaggacaccagccugaccgaggagcucgagaaggcgccggaccuguccgaccgguacuacuucuacuucacccagggcgggaaggacauguacacgggcgaccccaucaacuucgacgagaucagcaccaaguacgacaucgaccacauccugccccagagcuucgucaaggacgacucccucgacaaccgcgugcuggugagccgggccgagaacaacaagaaguccgaccgcguccccgccaagcuguacgccgccaagaugaagccguacuggaaccagcuccugaagcaggggcugaucacccagcggaaguucgagaaccucaccauggacguggaccagaacaucaaguaccgcagccugggcuucgugaagcggcagcuggucgagacgcgccaggugaucaagcucaccgcgaacauccugggcuccauguaccaggaggccgggaccgacaucaucgagacccgggccggccugacgaagcagcuccgcgaggaguucgaccugcccaaggugcgggaggucaacgacuaccaccacgccguggacgccuaccugaccaccuucgcggggcaguaccucaaccgccgguaccccaagcugcgcagcuucuucguguacggcgaguacaugaaguucaagcacggguccgaccugaagcuccgcaacuucaacuucuuccacgagcugauggagggcgacaagagccagggcaaggucguggaccagcagaccggggagcugaucacgacccgggacgagguggccaaguccuucgaccgccuccugaacaugaaguacaugcuggucagcaaggaggugcacgaccgguccgaccagcucuacggcgccaccaucgugaccgccaaggagagcgggaagcugacguccccgaucgagaucaagaagaaccgccccgucgaccuguacggcgccuacaccaacgggaccagcgcguucaugaccaucaucaaguucacgggcaacaagcccaaguacaaggugaucggcgugcccaccaccuccgccgucgggcucaagcgggugggcaagccggggagcgaguccuacaaccaggagcugcaccgcaucaucaagagcaaccccaaggugaagaaggacuucgagaucgucgugccccacgucagcuacucccagcugaucguggacggcgacugcaaguucacccucgccagcgacacguaccagcaccccgccacccagcuggugcuguccaaggagagcauggagaucaucgcggacgacuucaaguucgucaaggagaacccggccaccgccgacgagcagcucgugcggguguucgacgagaucgucaaccagaugaaccacuacuucaccaucuucgaccagcgcuccaaccggcagaaggugacgaaggcccgcgacaaguucgugagccugcccaccgaguccgaguacgagggggccaagaagacccaggucggcaagaccgaggugaucacgaaccugcucaugggccugcacgcgaacgccgcccagggggaccugaaggugcucggccugagcaccuucggguucuuccaguccagcggcgggcugaaccucuccgaggacgccaugaucgucuaccagagccccaccggccuguucgagcggcgcaucugccugaaggacaucuga

SEQ ID NO: 2053 - RNA, 4146 nt, Artificial Sequence
  Cas9 variant
augaagaaguccuacgccaucggcaucgacaucgggaccaacagcgugggccacugcgucauguacaccgagaacuacaaggugcccagcaagaagaugaagguguucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucgucgaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacgugcagcaccuguucaacgacuucguggagauguucgacaagaccgucgagggguccuaccugagcgagaaccuccccaacguggccgacgugcuggucgagaagguguccaagagccggcgccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacggacagcaccaccaaggcgccccucuccagcuccauggugaaccgguacgaggagcaccagaaggaccuggcccugcucaaggacuucauccgccagaaccugagcgacagcuacaaggaguucuucaacgacacccugaaggacggcuacgccggcuacaucgaggggaagacgacccaggagaacuucuaccgguucaucaagaaggccaucgagaagaucgagggcuccaacuacuucaucgacaagaucgaccgcgaggacuuccuccggaagcagcgcaccuucgacaacgggagcaucccccaccagauccaccuccaggagaugcacgccaucauccgccggcaggcggaguucuaccccuuccuggucgagaaccaggacaagaucgagaagauccucaccuuccgcaucccguacuacgugggcccccuggcccgggggaaguccgaguucgccuggcugaagcgcaagagcgacgagaagauccggcccuggaacuucgacgagaugguggacaaggagacguccgccgagaacuucaucacccgcaugaccaacuacgaccaguaccuccccgaccagaagguccugccgaagcacagccugcuguacgagaaguucgccguguacaacgagcucaccaaggugcgguacgucacggagcagggcaaguccuucuucuucgacgcgaacaugaagcaggagaucuucgacggcguguucaagguguaccgcaaggucaccaaggagaagcugauggacuuccuggggaaggaguucgacgaguuccggaucguggaccucaugggccuggacaaggacaacaagagcuucaacgccucccuggggaccuaccacgaccucaagaagaucgugagcaaggaccugcuggacaaccccgagaacgaggacauccucgagaacgucgugcugacccugacgcuguucgaggaccgcgagaugauccggaagcgccuggagaaguacaaggacguccugaccgaggagcagcggaagaagcucgagcgccggcacuacaccggcugggggcgccuguccgccaagcugaucaacggcauccggaacaagaccacgcgcaagaccauccucgacuaccugaucgacgacggcaccagcaaccggaacuucaugcagcugauccacgacgacacccucuccuucguggacgagauccgccuggcccaggggagcggcgaggccgaggacuaccgcacggaggugcagaaccuggcggggucccccgccaucaagaagggcauccuccagagccugaagaucgucgacgagcugaucggggugaugggcuacaaccccgagcacguggucguggagauggcccgggagaaccaguucaccaaccagggccgccgguccagccagcagcgcuacaagaagaucgagaacgccaucaagaaccucgacuccaaccugaacagcaagauccugaaggaguacccgaccaacaaccaggcgcuccagaacgaccggcuguuccuguacuaccuccagaacgggaaggacauguacaccgacgaggagcuggacaucgaccagcugagccaguacgacaucgaccacaucaucccccaggccuucaucaaggacgacucccucgacaacaaggugcugaccaagagcgccaagaaccgcggcaaguccgacgacguccccagccuggagaucgugcacaagaagaagaacuucuggaagcagcuccuggacucccagcugaucagccagcggaaguucgacaaccucacgaaggccgagcgcgggggccugaccaacgaggacaaggcccgguucauccagcgccagcugguggagacccggcagaucaccaagcacgucgcgcgcauccucgacacgcgguucaacaccaagcuggacgacgccggcaaccgcauccgggaccccaaggugaacaucaucacccugaaguccagccucgugucccaguuccgcaaggacuaccagcuguacaagguccgggagaucaacaacuaccaccacgcccacgacgccuaccugaacgccgugguggcgaccgcccuccugaagaaguacccgcagcuggcccccgaguucgucuacggggacuaccccaaguacaacagcuacaagucccgcaagagcgccacggagcgggugcuguucuacuccaacaucaugaacuucuucaagcgcguggucaagagcuccaagaccggcaccgugaagauccggcccaucaucgaggugaacaaggagaccggggagaucgucugggacaagaaguccgacuuccgcacggugcgcaaggugcugagcuacccgcaggucaacguggugaagaagaccgagguccagaaccacggccuggaccgggggaagcccaagggcuucuacaacgccaaccucagcccccgccccaaggagggcagcguggagaaccuggugccggcgaagcaguccuucgacaccaagcgguacgggggcuacgccgggaucagcaacuccuacgccguccuggugaacggcaucaucgagaaggggaagaagaaguccaaggccgaggugaccgaguuccagggcaucagcauccucgcgcgcaaggacuucgagaagaaccccaagcaguaccugcugaaccucggcuacaaggacaucaagagcaucaucaagcugcccaaguacucccuguucgagcucgagaacgggagccggcgcaugcuggccuccauccugagcacgaacaacaagcggggcgagauccacaaggggaacgagauguaccucccggacaaguucgucacccugcuguaccacgccaugcgcgugaaccggacccucgagcccggccacaagaaguacguggagacccaccgccacgucuucgacgagcugcugacguacauccucgaguacaacgagaagaucgugggggccaaggccaacggcaagcggaucguggaggcguacuccgcccgcaaggacaccgacaaccuggaggagcugugcaacagcuucaucaaccuccugaaccugaccgcccucggcuccgccgucgacuucgaguuccuggggaccaagaucccccgguaccgcgacuacacgcccagcucccugcucaaggccacccugauccaccagagcgugaccggccuguacgagacccggaucgaccucuccaagcucgggggcgacuga

SEQ ID NO: 2054 - RNA, 4146 nt, Artificial Sequence
  Cas9 variant
augaagaagaucaucggccuggaccucgggaccaccagcaucggcugggccuacgugcacgaggccgaguccgcgcaggagcgcagcgagaucguccggcugggggcccgcguggugccccugacgaccgacgagcaggacgaguucaagaagggcaaguccaucaccaccaacgccgcccggcucagcaagcgcucccugcggcgcaacgccgaccgguuccagcugcgccgggacgagcucgcgggggucaugaaggaggccggcuggaucgacgagacgaccgugcuggccgagcagggcccgcgcagcaccuucgagacccugcggcuccgcgccaaggcggccuccgaggaggugacgcuggccgaguucgcccggauccugcuccagaucaaccgcaagcggggguacaagagcaaccgcaagaccgacggcgacgaggagggggcccugaucgacggcauggacgucuccaagcagcugaacgcgagcgggcagacccccggcgagugggugcucgcccggaugcaggagggcaacgccgugauccccgccuucuacugcuccgaccugagcgaggagcuggaccgcaucuggcggaagcagcaggccucccaccaggcguggaugaccgaggagcuccacacgguccugcgccacgccgacgggcggagcgccauccgccugauggacaaggccggcguggugcccgacuccgucaacgugaaggagcgccggcgcgugauguacgaguggcgggccgcggccguccgcgacugccucccggccgggcggguggccgccgcgcugaugcaggucagcaaggagaucggccgcgccgacuccuaccugggccggaucggggaccgcagcaaggagcucuacuuccaccggcagaccgugggccaguaccuguggcgccugaucugcgacaaccccaaccagucccucaagaaccugguguucuaccggcaggacuaccagcacgaguucgagacccuguggagcauccagaccaaguaccacguggagcucacggaggaccugcgcaagcgggucgggcgcaucaucuucuuccagcggccccucaagagcaagaagggccucgugaaccgcugcgagcuggugcacuacuccgucugcgagaacagcggggacgaccugaccgagaagguggacgucggccccaaggugugcccgaaguccagcccccucuuccaggaguucaagguguggcagguccugaacaacguggaggugauccaccccuccacccaggaggcccggcgccuggagauggaggagaaggagcuccuggccagcgagcugcuguuccgggaccgcaugaagaagaucgacguccugaagcuccuguucuccaacuggcgcgaccuggaccugaacuacaaggagcucgagggcaaccggaccauggcggccuucuaccgcguguacgagcaggucaucgcccagacggggcacggcgacuacgacuucgccaagaugcgggccgcgaaggugaaggagcuggccgaggggguguucgccggccugggguucgaggugggccugcucaccuucgacgccgagcuggacagccccgccuacgagcagcagccgugcuaccgccuguggcaccuccuguacuccuacgagggcgacaagagcgcgaccgggaacaagugccugcucaagaagcugugccggcugaccggcaugaacgccgagcucgucgggcuguucaugcagauccgcuucuccggcgacuacgggagccuguccacgaaggccaugcggcgcauccuccccuaccugaaggccggcaacaccuacgacguggccugcgaguacgcgggcuuccggcacagcgcccgcucccugacccgggaggagcucgcccagaaggaguacaaggacuaccuggaccugcucccccgcaacagccugcggaaccccguggucgagaagauccugaaccagaugauccacguggugaacgggcucuccagcaccuacggcaagccggacgagauccgcgucgagauggcccgggagcugaagaaguccgcgcgcgagcgggaggagaugacgagcgccaucagcaagaccaccaaggagaacgccgagaucaccgccauccugcagcgcgacuucgggcuccgguacgugucccgcaacgacauccugcgguacaagcuguacugcgagcuccgcaucaagggcaacggcugccgcacgcuguacagcaacaccuacaucaaccccaacgagcuguucucccgggaguucgacaucgagcacaucaucccccagagccgccucuucgacgacuccuucagcaacaagacccuggagucccggaccgccaaccuggagaagggggaccgcacggcgugggacuacgugaacgagaaguacggcgccgagcgggccgacgaguaccgcgcccaggucgaggcccucuaccgggacgggaccaucagcaaggcgaagcgcgacaagcugcugaugcccggcgacaagaucccggaggacuucaucgaccgggacauccgcaacacccaguacaucgccaagaaggcccucgagaucuucgaggacuucgugcccuccguggucgccaccagcgggaacgugaccgcccggcugcgcgaggacuggggccugguggacgucaugaaggagcucaacugguccaaguacgagagccagggcauggugcacaucgaguacgaccgggacgggcgccccauccggcgcaucguggacuggacgaagcggaacgaccaccgccaccacgcgauggacgcccuggccgucgccuucaccaagcgguccuacauccaguaccugaaccaccucaacgcgcgcaaggaggccaccagcguggccuacgccauccagcacaaggagauggagcuggacggcuccaaccgcuggcgguucaagugccccuucggggaccgcagcgccuuccggcgcgaggcgaaggcccagcuggagcggauccucguguccaucaagagcaagaacaagguccugaccccgagcgugaaccgcacgaagaagcggggcggguucaacaagaagguggaguggacgccccgcggcgcccugcacaacgagaccgucuacggccggauccgccgguacgacgugaaggagcuccgcgugggguccagcuucaccgccgaggucaucggcaagguggccgacucccgguaccgcgcggcccugaugcaccggcuggccgaguucgggggcgaccccaagaaggccuucaccgggaagaacagccucgagaagaacccccuguacaccgacgaggcccacaccgcgugcgugccguccagcgucaaggugguguccuucgucgagaucggcaccauccgcaagggcguggaccccaaccugaacguggacaaggucguggacacgcacaucaagaacauccuccuggcccggcugagcgccuacgggggcgacgccaagaaggccuucuccaaccucgacgcggaccccaucuggcugaacaaggagaaggggaucgccaucaagcgcgugaccaucagcgacgacuccgagguccggccgauccacgugaagcgcgacaugcggggccgccuggucugcgacgagcacgggcgccccgugcccagcgacuacgugcagcuccggaacaaccaccacgucgccaucuuccgcgacgccaacggcgagcugaaggagcggguggugaccuucuucgaggcggucgagcgcgugcggcagcugcgcuccgagggccgggccguggaggucaucgacaagaacuacaagugcgaggagggguggaccuuccucuucagcaugaagaucaacgaguacuucguguuccccgacgccgccuccggcuucgacccgcgcgagaucgaccugacggaccccgccaacuacgcgcugaucagcccccaccucuuccgggugcagaagcuguccagcaaggacuacuacuuccgccaccaccuggagaccaccgucaacgacgugaagcagcuccgggacaucaccuggaagcgcaucuccagccugcaggaccuggccgggacggugaagguccgggugaaccacaucggccagaucguggccgucggcgaguacuga

SEQ ID NO: 2055 - RNA, 4146 nt, Artificial Sequence
  Cas9 variant
auggugaagaagaaguacgccaucggcaucgacaucgggaccaacagcgucggcugguccaucgugaccgacgacuacaaggugcccagcaagaagaugaaggucuucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacgugcagcaccuguucaacgacuucgucgagauguucgacaagaccguggagggguccuaccugagcgagaaccuccccaacguggccgacguccugguggagaagguguccaagagccggcgccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacggacagcaccaccaaggcgccccucuccagcuccauggucaaccgguacgaggagcaccagaaggaccuggcccugcucaagaacuucauccaccagaaccugagcgacagcuacaaggagguguucaacgacaagcugaaggacggcuacgccggcuacaucgaggggaagaccacgcaggagaacuucuaccgcuucaucaagaaggccaucgagaagaucgagggcuccaacuacuucaucgacaagaucgaccgggaggacuuccuccgcaagcagcggaccuucgacaacgggagcaucccccaccagauccaccuccaggagaugcacgccaucauccgccgccaggcggaguucuaccccuuccugguggagaaccaggacaagaucgagaagauccucaccuuccggaucccguacuacgucggcccccuggcccgcgggaaguccgaguucgccuggcugaaccggaaguccgacgagaagauccgccccuggaacuucgacgagaugguggacaaggagaccuccgccgagaacuucaucacgcggaugaccaacuacgaccaguaccuccccgaccagaaggugcugccgaagcacagccugcuguacgagaaguucgccgucuacaacgagcucaccaaggugcgcuacgugaccgagcagggcaaguccuucuucuucgacgcgaacaugaagcaggagaucuucgaccggacguucaaggucuaccgcaaggugaccaaggagaagcugauggacuuccugagcaaggaguucgacgaguuccggaucguggaccuccugggccuggacaaggacaacaaguccuucaacgccagccucgggaccuaccacgaccugaagaagaucgucuccgaggacuuccuggacaacagcgagaacgaggacauccucgagaacgugguccugacccugacgcuguucgaggaccgcgagaugauccggaagcgccuggagaaguacaaggacgugcugaccgaggagcagcggaagaagcucgagcgccggcacuacaccggcugggggcgccuguccgccaagcugaucaacggcauccgggacaaggugacccgcaagacgauccucgacuaccugaucgacgacgggaccagcaaccggaacuucaugcagcugaucaacgacgacacccucuccuucgucgacgagauccgccuggcccagggcagcggcaaggccgaggacuaccgcgcggaggugcagaaccuggccgggucccccgccaucaagaagggcauccuccagagccugaagaucguggacgagcugaucgaggucaugggguacgaccccgagcacaucgugguggagauggcccgggagaaccaguucaccaaccagggccgccggaacucccagcagcgcuacaagaagaucgagaacgcgaucaagaaccucgacagcaaccugaacagcaagauccugaaggaguaccccacgaacaaccaggcccuccagaacgaccggcuguuccuguacuaccuccagaacgggaaggacauguacaccgacgaggagcuggacaucgaccagcugucccaguacgacaucgaccacaucaucccgcaggccuucaucaaggacgacagccucgacaacaagguccugaccaaguccgccaagaaccgcggcaagagcgacgacgugcccucccuggagaucguguacaagaagaagaacuucuggcagcagcuccuggacagccagcugaucucccagcggaaguucgacaaccucaccaaggccgagcgcggcgggcugaccaacgaggacaaggcgcgguucauccagcgccagcuggucgagacgcggcagaucaccaagcacguggcccgcauccucgacacccgguucaacaccaagcuggacgaggccggcaaccgcauccgggaccccaaggugaacaucaucauccucaagagcaaccucgucucccaguuccgcaaggacuaccagcuguacaaggugcgggagaucaacaacuaccaccacgcccacgacgccuaccugaacgcgguggucgccacggcccuccugaagaaguacccccagcuggccccggaguucguguacggggaguaccccaccuacaacagcuacaacucccgcaagagcgccaccgagaaggugcuguucuacuccaacaucaugaacuucuucaagcggaucgucgugcacagcaagaccggcgaggugcgcauccggcccgucaucgaggugaacaaggagacgggcgagaucgugugggacaagaaguccaacuuccgcaccguccgcaaggugcugagcuacccccaggugaacgucgugaagaagaccgaggugcagaaccacgggcuggaccggggcaagccgaagggguucuacaacgcgaaccucagcccccgccccaaggagggcagcgucgagaaccuggugcccgccaagcagagcuucgacaccaagcgguacgggggcuacgccggcaucuccaacagcuacgccgugcuggucaacgggaucaucgagaagggcaagaagaaguccaaggcggaggugacggaguuccaggggaucagcauccucgcccgcaaggacuucgacaagaacccgaagcaguaccugcugaaccucggcuacaaggacaucaaguccaucaucaagcugcccaaguacagccuguucgagcucgagaacgggucccggcgcaugcuggccagcauccuguccaccaacaacaagcggggcgagauccacaagggcaacgagauguaccuccccgacaaguucgugacccugcuguaccacgccaugcgcgucaaccggacccucgagccggggcacaagaaguacguggaggcccaccgccacguguucgacgagcugcugacguacauccucgaguacaacgagaagaucgucggcgcgaaggccaacgggaagcggaucguggaggccuacagcgcccgcaaggacaccgacaaccuggaggagcugugcaacuccuucaucaaccuccugaaccugaccgcccucggcagcgcgguggacuucgaguuccuggggaccaagaucccccgguaccgcgacuacacgcccuccagccugcucaaggccacccugauccaccaguccgucaccggccuguacgagacccggaucgaccucagcaagcugggcggggacuga

SEQ ID NO: 2056 - RNA, 4146 nt, Artificial Sequence
  Cas9 variant
auggugaagaagaaguacgccaucggcaucgacaucgggaccaacagcgucggcugguccguggugaccgacgacuacaagguccccagcaagaagaugaagguguucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgacaacaaggacguccagcaccuguucaacgaguucguggagauguucgacaagaccguggagggguccuaccugagcgagaacauccccgacgucgccgacauccucguggagaagguguccaagagccggcgccuggagaacguccugcaguacuuccccaacgagaagaagaacggccuccuggggaacuuccugucccucgcccugggccugcagccgaacuucaagacgaacuucgagcucgccgaggacgcgaagauccaguucagcaaggagaccuacgaggaggaccuggaggagcugcucggcaagaucggggacgacuacgccgaccuguucaucgccaccaagucccuguacgacggcauccuccuggccgggauccugagcaccacggacuccaccaccaaggccccgcucagcuccagcauggugaaccgguacgaggagcaccagaaggaccuggcgcugcucaaggacuucauccgccagaaccugagcgacuccuacaaggagguguucaacgacgcccugaaggacggcuacgccggcuacaucgaggggaagaccacgcaggaggacuucuacaaguucgucaagaagaccaucgagaagaucgagggcagcgacuacuucaucgacaagaucgaccgggaggacuuccuccgcaagcagcggaccuucgacaacggguccaucccccaccagauccaccugaaggagaugcaggccaucaucauccgccaggccaaguucuaccccuuccuggaggagaaccaggacaagaucgagaagauccucaccuuccgcaucccguacuacgugggcccccuggcgcgggggaacagcgaguucgccuggcugaaccgcaaguccgacgagaagauccggcccuggaacuucgacgagaucguggacaaggagacgagcgccgagaacuucaucacccgcaugaccaacuacgaccaguaccuccccgaccagaagguccugccgaagcacucccugcuguacgagaaguucgccguguacaacgagcucaccaaggugcgguacgucacggagcagggcaagagcuucuucuucgacgccaacaugaagcaggagaucuucgacggcguguucaagguguaccgcaaggucaccaaggagaagcugauggacuuccuggggaaggaguucgacgaguuccggaucguggaccuccugggccuggacaaggacaacaaguccuucaacgcgagccucgggaccuaccacgaccugaagaagaucgucuccaaggaccugcucgacaaccccgagaacgaggacauccuggagaacguggugcugacccucacgcuguucgaggaccgcgagaugauccggaagcgccuggagaaguacaaggagguccucaccgaggagcagcggaagaagcuggagcgccggcacuacaccggcugggggcgccugagcgccaagcucaucaacggcauccgggacaaggugacccgcaagacgauccuggacuaccugaucgacgacggcaccuccaaccggaacuucaugcagcucaucaacgacgacacccugagcuucguggacgagauccgccuggcccagggguccggcgaggccgaggacuaccgggccgagguccagaaccucgcggggagccccgccaucaagaagggcauccugcagucccugaagaucguggacgagcucaucgaggugaugggguacgagcccgagcacaucgucguggagauggcccgcgagaaccaguucaccaaccagggccgccggaacagccagcagcgcuacaagaagaucgagaacgccaucaagaaccuggacuccaaccugaacagcaagauccucaaggaguacccgacgaacaaccaggcgcugcagaacgaccggcuguuccucuacuaccugcagaacggcaaggacauguacaccgacgaggagcuggacaucgaccagcucagccaguacgacaucgaccacaucaucccccaggccuucaucaaggacgacucccuggacaacaaggugcugaccaagagcgccaagaaccgcgggaaguccgacgacguccccagccucgagaucguguacaagaagaaguccuucuggaagcagcugcuggacagccagcucaucucccagcggaaguucgacaaccugaccaaggccgagcgcggcgggcugaccaacgaggacaaggcccgguucauccagcgccagcucguggagacgcggcagaucaccaagcacgucgcgcgcaugcuggacacccgguucaacaccaagcuggacgaggccggcaaccgcauccgggaccccaaggugaacaucaucacgcucaagagcaaccuggugucccaguuccgcaaggacuaccagcuguacaagguccgggagaucaacaacuaccaccacgcccacgacgccuaccucaacgccgugguggcgaccgcccugcugaagaaguacccgcagcucgcccccgaguucgucuacggcgaguaccccaccuacaacagcuacaacucccgcaagagcgccaccgagaaggugcuguucuacuccaacaucaugaacuucuucaagcggaucgugguccacagcaagacgggggaggugcgcauccggcccgugaucgaggucaacaaggagaccggcgagaucgugugggacaagaaguccgacuuccgcaccgugcggaagguccugagcuacccccaggugaacguggucaagaagaccgaggugcagaaccacgggcucgaccgcggcaagcacaagggguucuacaacgccaaccugagcccccgccccaaggagggcuccguggagaaccugguccccgcgaagcagagcuucgacacgaagcgguacggcggguacgccggcaucuccaacagcuacgccgugcucgugaacgggaucaucgagaagggcaagaagaaguccaaggccgaggucaccgaguuccaggggaucagcauccuggcgcgcaaggacuucgacaagaacccgaagcaguaccugcucaaccugggcuacaaggacaucaaguccaucaucaagcugcccaaguacagccucuucgagcuggagaacggcucccggcgcaugcuggccagcauccucuccaccaacaacaagcgcggggagauccacaagggcaacgagauguaccugcccgacaaguucgugacccugcucuaccacgccaugcgggugaaccggacgcuggagccggggcacaagaaguacgucgagacccaccgccacguguucgacgagcugcucaucuacauccuggaguacaacgagaagaucgugggcgccaaggccaacgggaagcggaucgucgaggcguacagcgcccgcaaggacaccgacaaccuggaggagcucugcaacuccuucaucaaccugcugaaccucaccgcccugggcagcgccguggacuucgaguuccugggcacgaagaucccccgguaccgcgacuacacccccuccagccuccugaaggccacccugauccaccaguccgugaccgggcucuacgagacgcggaucgaccugagcaagcugggcggggacuga

SEQ ID NO: 2057 - RNA, 4146 nt, Artificial Sequence
  Cas9 variant
auggugaagaagaaguacgccaucggcaucgacaucgggaccaacagcgucggcugguccguggugaccgacgacuacaagguccccagcaagaagaugaagguguucgggaacacggagaagcgcuacaucaagaagaaccugcucggcacccugcuguucgacgaggggaacaccgccgagaaccggcgccucaagcggaccgcgcgccggcgcuacacgcggcgccggaaccgcauccuguaccugcaggagaucuucgccgaggagaucaacaagaucgacgacuccuucuuccagcggcucgacgacagcuuccugaucguggaggacaagcagggcuccaagcacccgaucuucggcacccugcaggaggagaaggaguaccacaagcaguuccccaccaucuaccaccuccgcaagcagcuggccgacagcucccagaaggccgacauccggcugaucuaccucgcccuggcgcacaucaucaaguaccgcgggcacuuccuguucgagggcgaccucaagagcgagaacaaggacguccagcaccuguucaacgacuucguggagauguucgacaagaccguggagggguccuaccugagcgagaaccuccccaacgucgccgacgugcugguggagaaggucuccaagagccggcaccuggagaacauccuccacuacuuccccaacgagaagaagaacggccuguucgggaacuuccuggcccucgcccugggccugcagccgaacuucaagacgaacuucgagcucgcggaggacgccaagauccaguucuccaaggagaccuacgaggaggaccuggaggagcugcucggcaagaucggggacgacuacgccgaccuguucaucgccaccaagagccuguacgacggcauccuccuggccgggauccuguccaccacgaacagcaccaccaaggcgccccucuccagcuccauggugaaccgcuacgaggagcaccagaaggaccuggcccugcucaagaacuucauccaccagaaccugagcgacagcuacaaggagguguucaacgacaagcugaaggacggcuacgccggcuacaucgaggggaagaccacgcaggagaacuucuaccgguucaucaagaaggccaucgagaagaucgacggcuccaacuacuucaucgagaagaucgagcgcgaggacuuccuccggaagcagcgcaccuucgacaacgggagcaucccccaccagauccaccuccaggagaugcaggccaucauccggcgccaggcgaaguucuaccccuuccuggaggagaaccaggacaagaucgagaagauccucaccuuccgcaucccguacuacgucggcccccuggcccgggggaaguccgaguucgccuggcugaaccgcaagagcgacgagaagauccggcccuggaacuucgacgagaugguggacaaggagaccuccgccaagaacuucaucacgcgcaugaccaacuacgaccaguaccuccccgaccagaaggugcugccgaagcacagccugcuguacgagaaguucgccgucuacaacgagcucaccaaggugcgguacgugaccgagcagggcaaguccuucuucuucgacgcgaacaugaagcaggagaucuucgacggcgucuucaagguguaccgcaaggugacgaaggagaagcugauggacuuccuggggaaggaguucgacgaguuccggaucgucgaccuccugggccuggacaaggagaacaagagcuucaacgccucccucgggaccuaccacgaccugaagaagaucgugagcaaggacuuccuggacaacuccgagaacgaggacauccucgagaacgucgugcugacccugacccucuucgaggaccgcgagaugauccggaagcgccuggagaaguacaaggacauccugacggaggagcagcggaagaagcucgagcgccggcacuacaccggcugggggcgccugagcgccaagcugaucaacggcauccgggacaaggugacccgcaagaccauccucgacuaccugaucgacgacggcacguccaacugcaacuucaugcagcugaucaacgacgacacccucagcuucgucgacgagauccggcuggcccagggguccggcgaggccgaggacuaccgcgcggaggugcagaaccuggccgggagccccgccaucaagaagggcauccuccagucccugaagaucguggacgagcugaucgaggucaugggguacgaccccgagcacaucgugguggagauggcccgggagaaccaguucaccaaccagggccgccgcaacagccagcagcgguacaagaagaucgagaacgcgaucaagaaccucgacuccaaccugaacagcaagauccugaaggaguaccccaccaacaaccaggcccuccagaacgaccgccuguuccuguacuaccuccagaacggcaaggacauguacacggacgaggagcuggacaucgaccagcugagccaguacgacaucgaccacaucaucccgcaggccuucaucaaggacgacucccucgacaacaagguccugaccaagagcgccaagaaccgggggaaguccgacgacgugcccagccuggagaucguguacaagaagaaguccuucuggaagcagcuccuggacagccagcugaucucccagcgcaaguucgacaaccucaccaaggccgagcggggcgggcugaccaacgaggacaaggcgcgcuucauccagcggcagcuggucgagacccgccagaucacgaagcacguggcccggaugcucgacacccgcuucaacaccaagcuggacgaggccggcaaccggauccgcgaccccaaggugaacaucaucacccugaaguccaaccucgucucccaguuccggaaggacuaccagcuguacaaggugcgcgagaucaacaacuaccaccacgcccacgacgccuaccugaacgcgguggucgccacggcccuccugaagaaguacccccagcuggccccggaguucguguacggcgaguaccccaccuacaacagcuacaacucccgcaagagcgccaccgagaaggugcuguucuacuccaacaucaugaacuucuucaagcggaucgucgugcacagcaagaccggggaggugcggauccgccccgucaucgaggugaacaaggagacgggcgagaucgugugggacaagaaguccgacuuccggaccguccgcaaggugcugagcuacccccaggugaacgucgugaagaagaccgaggugcagaaccacgggcuggaccggggcaagccgaagggguucuacaacgcgaaccucagcccccgccccaaggagggcagcgucgagaaccuggugcccgccaagcagagcuucgacaccaagcgcuacggcggguacgccggcaucuccaacagcuacgccgugcuggucaacgggaucaucgagaagggcaagaagaaguccaaggcggaggugacggaguuccaggggaucagcauccucgcccggaaggacuucgacaagaacccgaagcaguaccugcugaaccucggcuacaaggacaucaaguccaucaucaagcugcccaaguacagccuguucgagcucgagaacggcucccgccggaugcuggccagcauccuguccaccaacaacaagcgcggggagauccacaagggcaacgagauguaccuccccgacaaguucgugacccugcuguaccacgccaugcgggucaaccgcacccucgagccggggcacaagaaguacguggagacgcaccggcacguguucgacgagcugcugaucuacauccucgaguacaacgagaagaucgucggcgccaaggcgaacgggaagcgcaucguggaggccuacagcgcccggaaggacaccgacaaccuggaggagcugugcaacuccuucaucaaccuccugaaccugaccgcccucggcagcgccguggacuucgaguuccugggcaccaagaucccccgcuaccgggacuacacgcccuccagccugcucaaggcgacccugauccaccaguccgucaccgggcuguacgagacccgcaucgaccucagcaagcugggcggggacuga

SEQ ID NO: 2058 - RNA, 4149 nt, Artificial Sequence
  Cas9 variant
augaagaagaucgugaacuacaaccugggccucgacaucgggaccagcuccaucggcuacgccgccaucgacgaccaggggcgccccguccggcaccagaacaagaccgugaugggcgugcgccuguucaaggaggggaagacggcggagagcacccggaucuuccgcggcacccggcgccggcugucccaccgccacuggcggcucggcuaccuggaccgcaucuucgacaacgagaucgccaaggucgacgagaacuuccugccgcggcucaaggccagcaagcgcgcccgguccgacgagaagcgcagcuuccgggggucccugcuguuccccgagaccggcgacgacgccuacuaccagaaguaccccacgaucuaccaccuccgcuacgcgcugaucacccagaagaagcaguucgacauccggcugaucuaccucgcccugcaccacaugaucaaguaccgcgggaacuuccuggacaccacccccgugagcgccuucaacauccacgacaucgaccucacggaccaguucgccucccugaacgacugcuaccagcugcucgacauggacuucgaguuccaguucgaccugaacaacaucgagcagguccagaagcugcuccuggacgagacccugagcaagaccaagcggcaggcggccguguccaaggugcucgugaugagcaccggcaacaaggccuucgacgaccagcagaacgggaucgccuccgaguucaucaaggcccugcugggcggcccguucgaccucagcaagauccugaaccuguccgucgcggacgucaagagcuggaagcuccacaugacggacaaggacguggacgacacccugaacucccugguggaggagcucgacgagaaccacaagcagaucgugaaccugcugcagaugaucuacagccaggugaugaugcucgggcugcugaacggccagcaguccaucagcgccagcaugaucgagcgcuacgacgaccacgccaagcacugggccgcccucaagaagcugcugcccgcgcucggggagcaggagcaguccaccaucauccacgccuacaccgccuacacgggccacagccggaccaagcagcugucccgcgccgaguucuacaccaaggucaacagcauccugaagaagcacgagaacaucgccgaggcgaccggccucaucgagcugaucgaccgcaacgaguucaugcccaagcagcgggacgccgugaacggggugaucccccaccagcugcaccagcgcgagcuccagcugaucauccagaaccagcagaaguacuacccguuccuggccgccaaggccuaccccgacgcggacgagacgaugaucgagcagcugcucuccuuccggguccccuacuacgccggcccccugguggaccgcgacuucaucaacgagagcuccgaccaggagcaggccaugcagaacaccaaguucagcuggcugaagcggcgcgaggccggggagaucaccccguggaacuucgagcagaagguggacguccaggagaccgcgaaccgguucaucaagcgccucacgaccaaggacaccuaccugaugaccgaggacgugcugcccaaggagucccucaucuaccagcgguucgaggugcugaacgagcugaacgccauccgcaucaacgaccggcgccucacggccgagaacaagcagcuggccuuccagcagcuguucauggccggcaacaccaagaacgucagcaucaagaaguuccggaacuucguguucgacucccucaaguuccccgagaaggucaagaucaccggguucgcgggccagcacaacuuccuggccaagcugagcaccuaccacgacuucaagaagaucuucggcgagcgcguggaccacacggaccuccagcccgacuucgagcggaucguggaguggugcaccaucuucgaggaccgccacaucuaccgggagaagcugaaggagauccaguggcugucccagagcgagaucgaccagcucguccugauccgcaaccacggguggggccggcuguccaagcgccuccugaccgggauccgcgacagcgacggccggaccgugauggaccagcugugguucgggacggacaacuucaugcgcaucaucucccagagcgacuucgccgccgccaucgcgaacgagaaccggacccagcucaaccagcacggccuggaggacgugcuggacuccgccuucaugagcccgcagaacaagaaggccauccgccagguccucaaggugguggacgacaucgagcagacccugggcugcccgcccaagaaggucaugaucgaguucacccggagccccgacaagaagaagcagcgcaccgugacgcggcuggagaaggugcagcaggccuacaaggccgucgcggaccagcucgccgggcaguccaucgugagcgagcuggaccaguacgccaacacccacuccaagcugagcgacaccuacuaccucuacuucaugcagcugggccgcgaccuguacuccgggaagcccaucgacaucgacagccccaugcucgacgacgaccacauccugccccgggccuucaugaaggacaacucccuggacaaccgcgcgcucaccgagaagcccaucaacaacacgaaggccgccaaguucccgagcaagguguucggccagcagaaggaggucaccgacuucuggaagcugcugcggcgcugcgggcucauguccaacaucaaggagaagcaccuguaccuggaccccgacaacguggacaaguggacccggcgcggcuucauccaccggcagcucguggagaccagccaggucaucaagaucguggccaacauccugaacgaccgcuaccagcagucccagacggaggugcuggagguccccgcccggcucggcaccgagcugcgcgagugcuucgggugguacaaggugcgggaggugaacgacuaccaccacgucuucgacgcguaccuggccgccuucaucggcaacuaccucuaccgccgguaccccaagcugcagccguacuucguguacgggaacuucgccgagcugaacaaggcccagcucaagaacaucaagagcuucaacuuccuguacaacaucaccgacaacaagcgcguggucaaggacaucgagaccggccagacgcugugggacgaccagauccgccagcagauccagcacaucuacgaguacaaguacaugcucaccucccacgaggcguucacccagcacaaggagcuguacggccagaccaucuacccccggcgcgaguucaagcccgggacgcugaaggccaucaagcaggaccagccgcaggagcucuacggcggguacaagaaccugaccgccgccuacaugugcaucgugaagauccaggcccggaagcgccgggcggccgaguaccgcgugguccggguggccaccgagagccuguccgcccuccagcaggcgaagcgccugggcgugcaggccuacgagcggugccugcgccaggagcucguccggaacaacgagauccugcgcaccaacgccgaccccaacagcgcgccccgggaguucgaggugcugcucgaccgcgugcugugccaccagaugaucaucuccgacgggcagaaguaccugcucggcagccacgccuacaagaucaacugcaugcagcugguccugagcaacaacuccaugaagauccucagcacguccaucgugaagcugaagcagaugaccaacgagccccuggugcaggucuaccgggagauccucgacguggugaacaaguacuucacccuguacgacgucaacagcuuccgcgagaaccugaaccaguucuucgacaaguuccggacccucccgaucacgaacgaguacgaguccagcaaguccggcaagaagcugauccaccgcgggcagcuggagacccucacccugauccugcggggccuccacgccaacagcgacaaggugcaguacggggaccaguccacccugcugggcggguuccagacgaaggacggcaucaagcucagcaaggacuccgugauccaguacaccagccccgccggccugaacguccgcaccgugaagcugcgcgaccucgagcagaaggaggcccagaaguga

SEQ ID NO: 2059 - RNA, 4149 nt, Artificial Sequence
  Cas9 variant
augguggacgagaagaucuucuggggccuggacaucgggaccgacagcgucggcugggccgugaccaacuccgaguacaagcucaagaaguacaagaacaaccugauguggggcgugcaccuguucgacgaggccaagcagagcgcggagcgccgguccuuccgcacggcccggcgccggcucgaccgccggaagcagcgcaucauccugcugcaggaguucuucguccgggccgugugcgagaaggacgagaacuucuuccgccggcucaaggagagcgcccugcugcccgaggacgccgagcaccgcaccaacaacaucuucuucgacgacccggacuacaccgacaaggacuacuucgaggaguaccccaccauccaccaccucaucugcgagcugauggaguccaaggagccccacgacgugcggcuggucuaccucgcgugcguguaccugcuggcccaccgcgggcacuuccuccugcccgugagcgaggacgacaucuccaaggucacggaguucgagccgcuguacgagagcuucuacaaggcccucgaggagaagcuggacgacgagccgcccuucgaccgguccgccgacgacuucgcggagauccucaagagccacaagaccguguccgccaagaacaaggacuucgacaagcuccuguucgggggcaaggugaagaccuacgacaacgagaacaucagcuacuccgcccugaucaagcuccugagcggcgggaccgagaagcuguccaaguucuucgccaacgaggaguacacggaccucgagaaggacagcgucugcgugcgcaacgccgacuucggcgacacccuggagaugcuggaggggcagaucgacgagcucgacuucgcgcugcugaaguccgucaagagccucuacgacuggucccugcugguggacauccucgagggcaagagccugaucagcgaggccaagaaggacaaguacgacgagcacggguacgaccuggacgcccucaaguaccuguuccgggaguaccugaccaaggacgacuacaacgagauguucaaggagguguccggcaagcagaacuacgccagcuacguguacaacgccuccagcgacaagacccgcgacuccaaguacaagaagugcagccagaaggacuucugcaaguucacgaagaaguuccucuccaagaucaagcccaacgagaaggacaagcccugccuggacaagcugcucgagaagugcgagcagaacagccugugccccaagcaggucaccaccgacaaccgggugauccccuaccagcuguacuacguggagcucaagaagauccuggagaacgcgugcggcuaccugcccuuccugaacgagcgcgacgaguacgggaccgucgccgacaagauccucuccaucaugaaguuccgggugccguacuacgugggcccccuggucgacagcaagaagucccccaacgccuggcuggugcgcaagcucgacgggaagaucacgcccuggaacuucaccgacauggucaacgaggacgagagcgagaacgccuucauccgccggaugaccugcaagugcaccuacguggccggccaggacgugcugccgaaguacucccugcucuacagcaaguucuccguccugaacgagaucaacaacaucaagcugaacggcgagcccaucagcgugcagacgaagcaggagaucuacaccgagcuguucgagcgcaacaagucccgggugagcaagaagaagauccgcgacugccugaucucccacggguacgcggccgacagcgacgaggucaccggcaucgacgacaucgccaagagcgcccugcgguccuaccacgacuucaagaagaugcucagcaacgggauccugaccgagcagcaggucgaggagaucaucgagcacaucacggugaccaccgacaacauccgccugaagaaguggcucaagacccaguuccccaugcuggccgacgaggacgugaaguacaucacgaagcugaaguacaaggacuacggccggcucucccgcugcuuccuggaggacgugcugcccguggacaccaagaccggggaggcggagagcgacaagaacaucaucaccaugcucugggagacgaacgagaacaucaugcagcugcuguccagcaaguaccgguacuccgagaacaucgagcacaugaaccgccaguacuacgcccucccggagaaccacaagagcauguccgagcggcugaaggacauguacguccccaccgccgugcgccgggccgugacccgcaccuucgacaucgucaaggagcugaagaagauccagggccgggaccccgacaagaucuucaucgagauggcgcgcggcacgggggagacccccaagggcaagcggaccaacagccgcaaggaccagauccucgagcacuggcacgggcuggacaacaaggacaucaacgaccugaagaaguccggcaucugggagcaccucgacaccaucgacgacgccaagcugcggagcgacaaguacuuccuguacuucaugcagcucgggcgcugcauguacaccgagaagccgauccccuucgaggagguggagaacgagcacaaguggaacaucgaccacaucuggccccaggccaagaucaaggacgacucccuggacaacaaggugcuggucagcuccaacgagaacggcaagaaguccgacagcuaccccaucagcgacgacauccgccacagcauggccggccucuggcacucccuguacaagaaggggcugaucagcgagaagaaguaccagcggcucacgcgcuccaccccguucaccgacgacgagcugagcggcuucaucgcccggcagcugguggagacccgccaguccacgaaggcgguggccacccuccugaaggagcaguuccccaacaccgagaucgucuacgugaaggccgggcuggugagcgacuuccggcaggagaugggcaugcucaagugccgcgaggucaacgaccugcaccacgccaaggacgccuaccugaacaucgugcucgggaacguguacaacacccgguucacgaaggacccccugaacuucgucaagaacaacgagaaguacuccaucaagaucuuccagaagaacagcgacggcaagaagaccggcgugaucacccgcaagguggagcgcgggggcgaggucgcgugggacccggagaccuccuucgccaucgugcggaagaugaugagcaagaacuccauccgguacgugcgcuacgccuacaugcgcaagagcgggcagaacggcggcuucuucgaccagaacccccugcggaaggggaagggcauggucuccaucaagcacaaccucagcaucgagaaguacgggggcuacgacaacgccacgaucuccuucuucagccugguguccaucaaggacuucggggugauccugcucgccgucgagcugcugagcgcgaacaaguuccucaagaacaucuccgaggccaaggaguacgccgccgacaagcugagcaaggagcugaacgugaagaucgugcccaacgacgucgcguucccccucaacaaccgguacaacguggugaagaucaacgccguccuggagcuggacggcuaccgcgugaugaucgccgccaagcagaacagcuccaucaaguucgugagcaacgagucccucauccugagcucccagcacauggccuacgucaagaagaucaccaaguucaucgagaagcggaagcaggacaaggugugcaugaucaacgcguucagcggcaucuccaucgaggacaacaucgagcuguacgacgugcucgucagcaagugcaacaucaagccguucaacaucauguacgagaaccuggggaucaagcuguccgacaaccgcgacaacuucaucaagaaguccguggagaaccaggugcucauccugagcgagaugguccggcuguucaagaccggccgcaaggccggggugaaccucgaggaggucggcgggcggaagaacagcggcgugaagacccugaacacgugccuguacaaggugaaggacuacuccaacaucuuccucgucgaccagagccccaccggccugaucgagcacaagucccccaaccugcucgaccuguga

SEQ ID NO: 2060 - RNA, 4155 nt, Artificial Sequence
  Cas9 variant
augaacaagcccuacagcaucggccuggacaucgggaccaacuccgugggcuggagcaucaucaccgacgacuacaaggucccggccaagaagaugcgcgugcucgggaacacggacaaggaguacaucaagaagaaccugaucggcgcccuccucuucgacgggggcaacaccgcggccgaccggcgccugaagcggaccgcccgccggcgcuacacccggcgccggaaccgcauccuguaccuccaggagaucuucgccgaggagauguccaagguggacgacagcuucuuccaccggcuggaggacuccuuccuggucgaggaggacaagcgcggcagcaaguaccccaucuucgccacgcuccaggaggagaaggacuaccacgagaaguucuccaccaucuaccaccuccggaaggagcuggcggacaagaaggagaaggccgaccugcgccugaucuacaucgcccuggcccacaucaucaaguuccgggggcacuuccucaucgaggacgacagcuucgacgugcgcaacaccgacaucuccaagcaguaccaggacuuccuggagaucuucaacaccacguucgagaacaacgaccugcucagccagaacguggacgucgaggcgauccugaccgacaagaucuccaagagcgccaagaaggaccggauccuggcccaguaccccaaccagaaguccaccggcaucuucgccgaguuccucaagcugaucguggggaaccaggccgacuucaagaaguacuucaaccuggaggacaagacgccccuccaguucgcgaaggacagcuacgacgaggaccuggagaaccugcucggccagaucggggacgaguucgccgaccuguucuccgccgccaagaagcuguacgacagcgugcuccuguccggcauccugaccgucaucgaccucagcaccaaggccccgcuguccgcgagcaugauccagcgcuacgacgagcaccgggaggaccugaagcagcucaagcaguucgugaaggccagccugcccgagaaguaccaggagaucuucgccgacuccagcaaggacggcuacgccggguacaucgagggcaagaccaaccaggaggccuucuacaaguaccuguccaagcuccugaccaagcaggaggacagcgagaacuuccuggagaagaucaagaacgaggacuuccuccgcaagcagcggacguucgacaacggguccaucccccaccaggugcaccugaccgagcugaaggcgaucauccgccgccagagcgaguacuaccccuuccucaaggagaaccaggaccggaucgagaagauccugaccuuccgcaucccguacuacaucggcccccuggcccgggagaaguccgacuucgccuggaugacccgcaagacggacgacagcauccggcccuggaacuucgaggaccucgucgacaaggagaaguccgccgaggccuucauccaccgcaugaccaacaacgacuucuaccugcccgaggagaaggugcugccgaagcacagccugaucuacgagaaguucaccguguacaacgagcucaccaagguccgguacaagaacgagcagggcgagacguacuucuucgacuccaacaucaagcaggagaucuucgacgggguguucaaggagcaccgcaaggugagcaagaagaagcugcuggacuuccucgcgaaggaguacgaggaguuccggaucgucgacgugaucggccuggacaaggagaacaaggccuucaacgccucccuggggaccuaccacgaccucgagaagauccuggacaaggacuuccuggacaaccccgacaacgagagcauccucgaggacaucgugcagacccugacccuguucgaggaccgcgagaugaucaagaagcggcucgagaacuacaaggaccuguucacggagucccagcugaagaagcucuaccgccggcacuacaccggcugggggcgccugagcgccaagcugaucaacggcauccgggacaaggagucccagaagaccauccucgacuaccugaucgacgacggccgcagcaaccggaacuucaugcagcugaucaacgacgacgggcgcuccaaccggaacuucaugcagcucaucaacgacgacggccugagcuucaagagcaucaucuccaaggcgcaggccgggagccacuccgacaaccugaaggaggucgugggcgagcucgccgggagccccgccaucaagaagggcauccugcagucccugaagaucguggacgagcucgucaaggugaugggcuacgagcccgagcagaucgucguggagauggcccgcgagaaccagaccacgaaccaggggcgccggaacagccgccagcgguacaagcugcuggacgacggcgugaagaaccucgcguccgaccugaacgggaacauccugaaggaguacccgaccgacaaccaggcccuccagaacgagcgccuguuccuguacuaccuccagaacggccgggacauguacaccggggaggcccuggacaucgacaaccugagccaguacgacaucgaccacaucaucccccaggccuucaucaaggacgacuccaucgacaaccgcguccucgugagcuccgccaagaaccggggcaagagcgacgacgugcccucccuggagaucgucaaggacugcaagguguucuggaagaagcugcucgacgcgaagcugaugagccagcgcaaguacgacaaccugaccaaggccgagcggggcgggcucacguccgacgacaaggcccgcuucauccagcggcagcugguggagacccgccagaucaccaagcacgucgcccggauccuggacgagcgcuucaacaacgagcucgacagcaagggccggcgcauccggaaggugaagaucgugacccugaaguccaaccuggucagcaacuuccgcaaggaguucggguucuacaagauccgggaggugaacaacuaccaccacgcccacgacgcguaccucaacgccguggucgccaaggccauccugaccaaguacccccagcuggagccggaguucguguacggcgacuaccccaaguacaacagcuacaagacgcgcaaguccgcgaccgagaagcuguucuucuacagcaacaucaugaacuucuucaagaccaaggugacccuggccgacggcacggucguggugaaggacgacaucgaggucaacaacgacaccggggagaucgugugggacaagaagaagcacuucgccaccgugcggaagguccuguccuacccccagaacaacaucgugaagaagaccgagauccagacgggcggguucagcaaggaguccauccucgcccacggcaacagcgacaagcugaucccccgcaagaccaaggacaucuaccuggacccgaagaaguacgggggcuucgacucccccaucguggccuacagcguccucgugguggcggacaucaagaagggcaaggcccagaagcugaagaccgucaccgagcugcucgggaucacgaucauggagcgcucccgguucgagaagaaccccagcgccuuccuggaguccaagggcuaccugaacauccgcgccgacaagcucaucauccugcccaaguacagccuguucgagcucgagaacgggcggcgccggcugcuggccuccgcgggcgagcuccagaaggggaacgagcuggcccugccgacccaguucaugaaguuccucuaccuggccagccgcuacaacgaguccaagggcaagcccgaggagaucgagaagaagcaggaguucgugaaccagcacgugagcuacuucgacgacauccugcagcucaucaacgacuucuccaagcgggucauccuggccgacgccaaccuggagaagaucaacaagcucuaccaggacaacaaggagaacaucagcguggacgagcuggcgaacaacaucaucaaccuguucaccuucaccucccucggcgcccccgccgccuucaaguucuucgacaagaucguggaccgcaagcgguacacgagcaccaaggagguccugaacagcacccugauccaccaguccaucaccgggcucuacgagacgcgcaucgaccugggcaagcugggggaggacuga

SEQ ID NO: 2061 - RNA, 4155 nt, Artificial Sequence
  Cas9 variant
augaagcugcgcggcaucgaggacgacuacagcaucgggcucgacaugggcaccuccagcguggggugggccgucaccgacgagcggggcacgcuggcccacuucaagcgcaagcccaccugggggucccggcuguuccgcgaggcgcagaccgccgccguggcccggaugccgcgcggccagcggcgccgguacgugcgccggcgcuggcggcucgaccugcugcagaagcuguucgagcagcagauggagcaggccgaccccgacuucuucauccgccuccggcagagccgccugcuccgggacgaccgcgcggaggagcacgccgacuaccgguggccccuguucaacgacugcaaguucaccgagcgcgacuacuaccagcgguuccccacgaucuaccacguccgcuccuggcugauggagaccgacgagcaggccgacauccgccucaucuaccuggcccugcacaacaucgugaagcaccggggcaacuuccuccgcgaggggcagagccuguccgccaagagcgcgcggccggacgaggcccugaaccaccuccgcgagacccugcgggugugguccagcgagcgcggcuucgagugcuccaucgccgacaacgggagcauccuggccaugcucacccaccccgaccugucccccagcgaccggcgcaagaagaucgcgccccuguucgacgucaaguccgacgacgccgccgccgacaagaagcucggcaucgcccuggcgggggccgugaucggccugaagacggaguucaagaacaucuucggcgacuucccgugcgaggacagcuccaucuaccucagcaacgacgaggccguggacgccguccgguccgccugccccgacgacugcgcggagcuguucgaccgccugugcgagguguacagcgccuacgugcuccaggggcugcugagcuacgcccccggccagaccaucuccgccaacauggucgagaaguaccggcgcuacggggaggaccucgcccugcugaagaagcucgugaagaucuacgcgcccgaccaguaccggauguucuucagcggcgccaccuacccgggcaccgggaucuacgacgccgcccaggcgcgcggcuacacgaaguacaaccuggggcccaagaaguccgaguacaagcccagcgaguccaugcaguacgacgacuuccggaaggccguggagaagcuguucgccaagaccgacgcccgcgccgacgagcgguaccgcaugaugauggaccgguucgacaagcagcaguuccuccgccgccugaagaccagcgacaacggcuccaucuaccaccagcugcaccucgaggagcugaaggcgaucgucgagaaccaggggcgguucuaccccuuccugaagcgcgacgccgacaagcucgugagccugguguccuuccggaucccguacuacgucggcccccugagcacccgcaacgcccggacggaccagcacggcgagaaccgcuucgccugguccgagcggaagcccgggaugcaggacgagcccaucuucccguggaacugggagagcaucaucgaccgcuccaagagcgccgagaaguucauccuccggaugaccggcaugugcaccuaccugcagcaggagcccgugcugcccaaguccagccugcucuacgaggaguucugcgugcugaacgagcugaacggggcgcacugguccaucgacggcgacgacgagcaccgcuucgacgccgccgaccgggaggggaucaucgaggagcuguuccgccggaagcgcaccgucagcuacggcgacguggccggcuggauggagcgggagcgcaaccagaucggggcccacgugugcggcgggcagggcgagaagggguucgaguccaagcucggcagcuacaucuucuucugcaaggacgucuucaagguggagcggcuggagcagagcgacuaccccaugaucgagcgcaucauccucuggaacacgcuguucgaggaccggaagauccugucccagcgccucaaggaggaguacggcagccggcuguccgcggagcagaucaagaccaucugcaagaagcgcuucaccggguggggccgccugagcgagaaguuccucaccgggaucacgguccagguggacgaggacuccgugagcaucauggacguccugcgggagggcugcccgguguccggcaagcgcgggcgggccauggugaugauggagauccugcgcgacgaggagcucggcuuccagaagaaggucgacgacuucaaccgggccuucuucgccgagaacgcgcaggcccugggggugaacgagcugcccggcagccccgccgugcgccggucccucaaccagagcauccgcaucgucgacgagaucgccuccaucgccgggaaggcgcccgccaacaucuucaucgaggugacccgggacgaggacccgaagaagaagggccgccggaccaagcgccgguacaacgaccugaaggacgcccuggaggccuucaagaaggaggaccccgagcucuggcgcgagcugugcgagaccgcccccaacgacauggacgagcggcugagccucuacuucaugcagcgcggcaagugccuguacuccgggcgggcgaucgacauccaccagcugagcaacgccggcaucuacgagguggaccacaucaucccgcgcacguacgucaaggacgacucccucgagaacaaggcccugguguaccgggaggagaaccagcgcaagaccgacaugcugcucaucgaccccgagauccgccggcgcaugagcggguacuggcggaugcugcacgaggccaagcugaucggcgacaagaaguuccgcaaccuccugcggucccgcaucgacgacaaggcccugaagggguucaucgcgcggcagcucguggagaccggccagauggucaagcuggugcgcagccugcucgaggcccgguaccccgagaccaacaucaucagcgugaaggccuccaucagccacgaccugcgcacggccgcggagcuggucaagugccgggaggccaacgacuuccaccacgcccacgacgccuuccucgccugccgcgugggccuguucauccagaagcggcaccccugcguguacgagaacccgaucgggcugucccaggucgugcgcaacuacgugcggcagcaggcggacaucuucaagcgcugccggaccauccccggcagcuccggguucaucgucaacagcuucaugaccuccggcuucgacaaggagaccggggagaucuucaaggacgacugggacgccgaggccgagguggagggcauccgccggagccucaacuuccgccagugcuucaucucccggaugcccuucgaggaccacggcguguucugggacgccacgaucuacagcccccgcgccaagaagaccgcggcccugccgcugaagcaggggcucaaccccucccgcuacggcagcuucucccgggagcaguucgccuacuucuucaucuacaaggcccgcaacccccggaaggagcagacccuguucgaguucgcccagguccccgugcgccugagcgcgcagauccggcaggacgagaacgcccucgagcgcuacgcccgggagcuggccaaggaccaggggcuggaguucauccgcaucgagcgguccaagauccucaagaaccagcugaucgagaucgacggcgaccgccugugcaucaccgggaaggaggaggugcggaacgccugcgagcucgcguucgcccaggacgagaugcgcgucauccggaugcuggugagcgagaagccggugucccgcgagugcgucaucagccuguucaaccggauccuccugcacggcgaccaggccucccgccggcugagcaagcagcucaagcuggcccugcucagcgaggcguucuccgaggccagcgacaacgugcagcgcaacgugguccugggccugaucgccaucuucaacggguccaccaacauggugaaccucagcgacaucggcggguccaaguucgccggcaacgugcggaucaaguacaagaaggagcuggccagccccaaggucaacgugcaccugaucgaccaguccgugacgggcauguucgagcgccgcaccaagaucgggcucuga

SEQ ID NO: 2062 - RNA, 4158 nt, Artificial Sequence
  Cas9 variant
augaccaagcccuacagcaucggccuggacaucgggaccaacuccgugggcugggccgucaucacggacgacuacaaggugccgagcaagaagaugaaggugcucgggaacaccuccaagaaguacaucaagaagaaccugcugggcgcccuccuguucgacagcgggaucaccgcggagggccgccggcugaagcgcaccgcccggcgccgguacacgcgccggcgcaaccggauccucuaccugcaggagaucuucuccaccgagauggccacccuggacgacgccuucuuccagcgccucgacgacagcuuccugguccccgacgacaagcgggacuccaaguaccccaucuucggcaaccugguggaggagaagguguaccacgacgaguuccccaccaucuaccaccuccgcaagcaccuggccgacagcuccaagaaggcggaccugcggcucgucuaccuggcccuggcccacaugaucaaguaccgcgggcacuuccucaucgagggcgacuucaacagcaagaacaacgaccugcagaagaacuuccaggacuuccuggacacguacaacgccaucuucgaguccgaccucagccuggagaacuccaagcagcuggaggagaucgugaaggacaagaucagcaaguccgcgaagaaggaccggauccucaagcuguucccgggggagaagaacagcggcaucuucuccgaguuccugaagcucaucguggggaaccaggccgacuuccgcaaguacuucaaccuggacgagaagaccagccugcaguucuccaaggagagcuacgacgaggaccucgagacccugcugggccacaucggcgacgacuacagcgacgucuuccucaaggccaagaagcuguacgacgccauccugcucuccgggauccugaccgugacggacaacggcaccgaggcgccccugagcuccgccaugaucaugcgguacaaggagcacgaggaggaccucgcccugcugaaggccuacauccgcaacaucagccucgagaccuacaacgagguguucaaggacaacaccaagaacggguacgccggcuacaucgacggcaagacgucccaggaggacuucuacgucuaccugaagcggcugcucgccgggcuggagggcgcggacuacuuccuggagaagaucgaccgcgaggacuuccuccggaagcagcgcaccuucgacaacgggagcauccccuaccagaucuaccugcaggagaugcgcgccauccuggacaagcaggccaaguucuaccccuuccuggccaagaacaaggagcggaucgagaagauccucaccuuccgcaucccguacuacgugggcccccuggcccgggggaacuccgacuucgcguggagcauccgcaagcggaacgagaagaucacccccuggaacuucgaggacgugaucgacaaggaguccagcgccgaggccuucaucaaccgcaugacguccuucgaccuguaccuccccgaggagaagguccugccgaagcacagccugcucuacgagaacuucaccguguacaacgagcugaccaaggugcgguucaucgccgagggcaugcgcgacuaccaguuccuggacuccaagcagaagaaggacaucguccggcucuacuucaagggcaagcgcaaggugaccgacaaggacaucaucgaguaccugcacgccaucgacggguacgacggcaucgagcugaaggggaucgagaagcaguucaacagcucccucagcacguaccacgaccugcugaacaucaucaacgacaaggaguuccucgacgacuccagcaacgagaccaucaucgaggagaucauccacacccugaccauguucgaggaccgggagaugaucaagcagcgccuguccaaguucgacaacaucuucgacaagagcgugcucaagaagcugagccggcgccacuacacgggcugggggaagcuguccgcgaagcucaucaacggcauccgggacgagaaguccggcaacaccauccuggacuaccugaucgacgacggggucagcaaccgcaacuucaugcagcucauccacgacgacgcccugagcuucaagaagaagaucaagaaggcccagaucaucggcgacaaggacaacaucaagcaggucgugaagucccugcccgggagccccgccaucaagaagggcauccuccaguccaucaagaucguggacgagcuggugaaggucauggggcgggagcccgagagcaucgugguggagauggcgcgcgagaaccaguacaccaaccagggcaaguccaacagccagcagcggcugaagcgccucgaggagucccugaagggccuggggagcaagauccucaaggagaacgucccgacccgccuguccaagaucgacaacaacgcccugcagaacgaccggcucuaccuguacuaccugcagaacggcaaggacauguacacgggggaggagcucgacaucgaccgccugagcaacuacgacaucgaccacaucaucccccaggccuuccugaaggacgacuccaucgacaacaaggugcucgugagcuccgccagcaaccggggcaagagcgacgacguccccucccuggagguggugaagaagcgcaagacccugugguaccagcuccucaagagcaagcugaucucccagcggaaguucgacaaccucaccaaggccgagcgcggcgggcugagccaggaggagaaggcgggcuucauccagcggcagcuggucgagacccgccagaucacgaagcacguggcccggcuccuggacgagcgcuucaacaacaagaaggacgagaacaaccggacccugcgcaccgugaagaucaucacccucaaguccagccuggucucccaguuccggaaggacuucgagcuguacaaggugcgcgagaucaacgacuuccaccacgcccacgacgccuaccucaacgccguggucgcgagcgcccugcugaagaaguaccccaagcucgagccggaguucguguacggggacuaccccaaguacaacuccuuccgggagcgcaagagcgccaccgagaagguguacuucuacuccaacaucaugaacaucuucaagaaguccaucccccuggccgacggcacggucaucgaccggccccugaucgaggugaacgaggagaccggggagagcguguggaacaaggucgccgaccucaacaccgugcgcaaggugcugagcuacucccaggucaacaucgugaagaagguggaggagcagaaccacggccuggaccggggcaagccgaagggccucuucaacgcgaaccugagcuccaagcccaagcccaacagcaaggagaaccuggucggggccaaggaguaccucgaccccaagaaguacgggggcuacgccgggaucuccaacagcuucgccauccuggugaagggcaccaucgagaagggcgcgaagaagaagaucacgaacgugcuggaguuccaggggaucagcauccucgaccgcaucuacuaccggaaggacaagcugaacuuccugcucgagaagggcuacaaggacaucgagcugaucaucgagcugccgaaguacucccucuucgagcugagcgacgggucccgccgcaugcuggccagcauccucuccaccaacaacaagcggggcgagauccacaaggggaaccagaucuucaucagccagaaguucgucaagcugcuguaccacgccaagcgcaucuccagcaccuucaacgagaaccaccggaaguacguggagaaccacaagaaggaguucgaggagcuguucuacuacauccuggaguucaacgagaacuacgugggcgccaagaagaacggcgagcugcucaaguccgccuuccagagcuggcagaaccacuccaucgacgagcugugcagcuccuucaucgggcccaccggcagcgagcgcaaggggcuguucgagcucacgucccggggcggggcggccgacuucgaguuccugggcgucaagaucccccgcuaccgggacuacaccccgagcucccugcucaaggacgccacccugauccaccagagcgugaccggccuguacgagacgcgcaucgaccuggggaagcucggcgaggacuga

SEQ ID NO: 2063 - RNA, 4158 nt, Artificial Sequence
  Cas9 variant
augcagaccuacuucggcaugaagaagauccuggggcucgaccugggcaccaacagcaucgggugggcccuggugaacgaggccaacgacgacaacgagaaguccagcaucaucaagcucggcguccgcgugaacccccugacgguggacgagcaguccaacuucgagaagggcaagagcaucaccaccaacgcggagcggaccaucaagcgcuccauccggcgcagccugcagcgguacaagcuccgccgggagaaccugaucgagauccugaaggagcacaacuucaucacggacgacaccauccucuccgaggacgggaacgccagcaccuucgagaccuaccgccugcgggccaaggccgccuccgagaagaucagccuggaggagcucggccgcguccugcugaugaucaacaagaagcggggguacaaguccagccgcaaggcgaagaaccaggaggagggccagcucaucgacgggauggagguggccaaggagcuguacgagaagaacaucacgcccggccaguucguguuccagcugcucaagcagggcgggaaguucauccccgacuucuaccgguccgaccugcaggccgaguucgacaagaucugggaguuccagaagcuguuccacgccgagauccucgucgacgacuucaagaagcagcuggagcgcaagggcaagcugaacagcuccaagaucuuccucgggcgguucggcaucuacaccgcggagaacaaggggaacgacaagcgccugcaggccuaccaguggcggguggacgcccugaccaaggagcucaccaaggaggagcuggccuacgugaucagcgaccugaacggcaucaucuccagcuccagcggcuaccucgggagcaucuccgaccgcagcaaggagcuguacuucaacaaccagacggucggccaguuccugauggcccagcucgaccacagcccccacaccagccugaagaaccagguguucuaccggcaggacuaccuggacgaguucaacacccucugggagaaccaggcgcacuaccacaaggugcugaccuccgaccucaagagcgagauccgcgacgucaucaucuucuaccagcggcgccugaagacgcagaaggggcugaucuccuucugcgaguucgagagccgcaagaucgagguggagaucgacggcaagaagaagaucaagaacguggggucccgggucugccccaagagcuccccgaucuuccaggaguucaagaucuggcagauccugaacaacaucgagcuccuggagaaguccuccaaggccaagcgcuuccuggaccaggaggagaaggagcuccuguucaaggagcugagcaucaaguccaagaucagcaaguccgacgcccucaagcugcuguucaagaacagccgggagcuggaccucaacuacaaggagaucgagggcaaccgcacccaguccgcccuguucgacgccuacagcaagaucaucgagcugagcggccacggggaguacgacuucuccaagauggaggcgagcaacaucaucgagcucgugcaggagguguucaccggccugaacuacaacaccgagauccuguacuucgacuccagccucgaggggaaggacuucgagaaccagcccauguaccggcuguggcaccuccuguacuccuucgagggcgacgacagcaagacggggaacgagaagcugaucaacaagcuguccgagcucuacggcuucgagaagaaguacagcaucguccuggccaacguguccuuccaggaggacuacggcagccuguccaccaaggccauccgcaagauccaccccuaccucaaggaggggauccaguacgacguggccugcgaguucgccggcuaccggcacagcaaguccagccugaccaaggaggagaucgagaacaagauccugaaggaccagcucgagauccugcccaagaacucccugcgcaacccggucguggagaagauccucaaccagaugaucaacguggucaacgcgcugaacgagagcuacgggaagcccgacgagauccggaucgagcuggcccgcgagcucaagaaguccgccaaggagcgggaggagcugaccgccagcaucggcgagacgaccaucaagcacgagaaguaccgcgccauccuggagaacgaguucgggaucagccacgugucccggaacgacaucauccgcuacaagcucuaccuggagcuggagaaccggggcuacaagacccucuacagcaacaccuacgucucccaggagaagcuguucagcaaggaguucgacaucgaccacaucaucccccaguccugccuguucgacgacagcuucuccaacaagacgcucgagagcaaguccgugaacaucgagaagggcaacgacaccgcguucgacuacguguucgccaaguacggggaggccggccugagcgacuacaucauccacaucgaggagcuguucaaggacgggaagaucuccaagaccaagcucaacaagcugaagaugaagggcaacgagauccccagcgacuucaucgcccgcgacauccgggacacccaguacaucgcgcgcaucgccaagaacauccuggaggagacgguccggaacgugguguccaccagcggcuccaucaccgaccgccuccgcgaggacuggcagcugaucgacgucaugcaggagcugaacugggagaaguacagcgcccucgggcugaccgagaucuacgagaaccgggagggccacacgauccgccggaucaaggacuggaccaagcgcaacgaccaccggcaccacgccauggacgcccugaccaucgcguucaccaagcgcucccacauccaguaccucaacaaccugaacgcccggagcgacaaguccgggagcaucuacggcaucgagaccaaggagcuguaccgcgacgaccacgggaagcucaaguucaagccgcccaucccccugaacgaguuccgggccgaggccaagaagcaccuggagaacacgcucaucagcaucaaggccaagaacaagguggcgaccaucaacaucaacaccaccuccacgaaggagggcaagaacaagaagcgccagcugacgccccggggccagcugcaccucgagaccaucuacgggagcauccagcaguacgugaccaagcaggagaaggucggcgccuccuucaacgaggagcagaucagcaagguggccaagcagaaguaccgccaggcccugcugaaccggcuccgcgaguucgacaacgacccgaagaaggccuucaccgggaacaacuccuucgagaagaaccccaucuaccuggacgugcugcagacccagaagguccccgacaagguggagaccgugagcaaggagaucaucuacaccauccggaaggacaucacgcccgagcucaagaucgagaaggucaucgacaagaagaucaagaccauccugcagucccgccugaacgaguacagcggcgacuccaagcgggcguucagcaaccucaaggagaacccgaucuggcugaaccaggagaaggggaucgagaucaagcgcgugaccaucuccggcaucagcaacgccguggccauccacgacaagaaggacaagaacggcaaccugauccucgacaacgagggguccacccaggccgucgacuucgugaacacgggcaacaaccaccacguggcgaucuacaaggacgagcgggggaaccugcacgagagcgucguguccuucuucgaggccugcacccgcgugaaccugggcgggcccgucaucuucaagaacuacaacaagagcgacggcugggaguuccucuucuccaugaagcagaacgaguacuucguguuccccaacgagaagaccggcuucaaccccaacgagaucgaccugcuggacccggacaacuaccggcucaucagccccaaccuguuccgcgugcagaagaucuccagcaagaacuacgucuucaaccaccaccuggagaccagcgccaucacgggggagacccucaagaacaagaagcagcuguccagcgugaccuaccacuucauccagucccugccgcccaucaaggacaucgugaagguccgcaucaacaacaucggccagaucgugugggugggggaguacuga

SEQ ID NO: 2064 - RNA, 4158 nt, Artificial Sequence
  Cas9 variant
auggacgagcugcagaacuucgagaagggcaagagcaucaccaccaacgccgaccgcacggccgggcgguccaugcgccggaaccuccagcgcuacaagcugcggcgcgagaaccugaucgaggugcucaaggaguacaacuucaucaccgacgagaugauccugagcgagaacggcaaccggaccaccuucgagacguaccgccugcgggcgaaggccgccgucgaggagaucucccucgagcaguucgcccgcgugcugcugaugaucaacaagaagcggggguacaagagcucccgcaaggccaagggcgcggagaacgggacccucaucgacggcauggagguggccaagaagauguacgacgagggcaucacccccggggagcugugccugcagcuccugaccgccggcaagcgguacuucccggacuucuaccgcagcgaccugcaggccgaguucgaccggaucuggaacuuccagaagcaguucuaccccgacucccucaucgacaaggucaaggacgaggugcgcgggaagaacaagagccagacgugggcgauccuggccaaguacuucguguggaaggaggucgagaacuccuggaacgaggaggaggcccagacccggcgcguggagaaggaguaccggcuggugggcaucaagcgcggggucaagcgggaggagcucaagcuggagaacuuccaguggcgcgugaaggcccugagcgagcgcaugaaccccgaggagcucgccaucgugcugcaggagaucaacgagcagaucuccaacagcuccggcuaccugggcgcgaucagcgaccgguccaaggagcucuacuucaaccgccagaccgucgggcaguaccagauggccgugcuggacaacaaccccaacaucggccugcggaacaugguguucuaccgccagggguaccucggcgaguucaacaccaucugggagaagcaggccgaguuccacaaggagcugacggaggaccugaagaaggagauccgggacaucgucaucuucuaccagcgccggcucaagagccagaagggccugaucaacaucugcgaguucgagcgccggcagaucgagguggagaucgacgggaagaagaagaucaagaccaucggcucccgcgugaucccgcggagcagcccccuguuccaggaguucaagaucuggcagacccucaacgacaucgaggucagcgugcugggggugaagaacaagcgcaagaagcaggacgacaacagcaccacgcugcucgacuccgccgagaacaucgacagccugaagcugaacgucucccggccccucgacgccgacgagaagucccugcuggcgaaggagcuguucauccgcgacaagcucaccaaguccgacgugcugaagcuccuguucaacaacccccagaaccugaaccucaacuucaagaacaucgacggcaaccggaccgggagcgcccuguaccaggccuucuccaagauccuggagaucagcggccacgaguccaucaacuucaagaaguccgccgacgagaucguggagcaggucaagaccaucuucagcgcccugggcuggaacacggaggugcucugcuucgacagcgagaaggagcuggacaagcagccguacuucaagcuguggcaccuccuguacuccuucgagggggacagcacccccaccggcgacgggaaccugauccagaagaucgcggaccucugcggcuucgagaaggacuacgccuccauccuggccaacaucaccuuccaggaggacuacgggagccuguccacgaaggccauccgcaagauccucccccaccugaaggacggcaaccaguacgacgucgccugcgaguacgcgggcuacaagcacagcaaguccagccugaagaaggaggagaucaagaacaaggugcucaaggacaagcuggagcugcuccccaagaacagccugcggaacccgguggucgagaagauccugaaccagauggugaacgugaucaacgccaucaucaccaccuacgggaagcccgacgagauccgcaucgagcucgcccgggagcugaagaagaaggccaagaagcgcgaggagcugaccaagacgaucgucgacaccaccaagacccacgagggcauccgcgcgauccuccagaacgacuucgggaugucccacgugagccggaacgccaucauccgcuacaagcuguacgaggagcugaaggacaacggcuacaagacgcucuacuccaacaccuacauccccaaggagaagcuguucagcaaggacuucgacaucgagcacaucaucccccaggcccggcuguucgacgacuccuucagcaacaagacccucgaggugaaguccaucaacaucgagaaggggagcaagaccgccuacgacuucgucgaggagaaguacggcgagcagggccugcaggaguaccugaaccgcugcgagguccucuuccgggacaagaagacgaagcugcgcaagcugaagaugcaggaguccgagaucccggagggguucaucgaccgggaccuccgcaacacccaguacaucgccaagaaggcgcugagcaugcugaacgagaucugccggcgcgugguggccaccaccggcgccaucaccgacgagcuccgggaggacuggcagcugguggacgugaugaaggagcugaacugggagaaguacaagguccucgggcugguggaguacuucgaggacaacgacggccgccugaucggccggaucaaggacuggacgaagcgcaacgaccaccggcaccacgccauggacgcccucaccguggcguucaccaaggacgucuucauccaguacuucaacaacaagaacgccucccugaagcccgacaccaacgaggccgccauccgcaacaaguacuuccagaacgggaaggccaucccgcccaugagccuggacgaguuccgggcggaggccaagaagcaccucaacgacacgcugaucuccaucaagaccaagaacaagguggugaccaucaaccugaaccgcaccaagaagaagaacggcaucaacaagaagcagcagcagacgccccgggggcagcuccaccuggagaccgucuacggcagccacaagcaguacguggugaaggaggagaaggucaacgccuccuucgacgccgcgaagaucgccaccgugaacaagcccgccuaccgcgacgcccugcuccggcgccugcaggagaacgggaacgacagcaagaaggccuucaccggcaagaacucccuggacaagcagcccguguggcucgacgcgaagcagaacgagugcguccccgagaaggugaagacggugaugcuggagaccgucuacaccgugcgcaagccgaucgacgagaagcugaacguggacaaggucguggacgcccggauccgcaagcuccugcaggaccggaucaaggaguacggcaacgccaagagcgccuucgccaaccuggacgagaaccccaucuggcucaacaaggagaaggggaucaccaucaagcgcgugagcgucuccggcaucagcaaggcgcagucccugcacgagaagaaggacaaggacgggaacuucauccuggacaaggacagccggcgcauccccguggacuucgugaacacgggcaacaaccaccacgucgccaucuaccggaagcccgugcucgacaagaaggggcaggccguguucgacgagaacggcgagcugaaguucgagcuggaggaggucgugguguccuucuucgacgccgucacccgcgugaaccucagccagccgaucaucgacaaggacuacaagcgguccgagggcuggaaguuccuguucagcaugaagcagaacgaguacuucguguuccccaacgagaagaccggguucgaccccaaggagaucgaccugcucaacccggagaacuacgcccugaucucccccaaccuguuccgcguccagaagaucgcgagcaaggacuacguguuccggcaccaccucgagaccguggucgccgaccgcaaggagcugcaggagaucacguggaagcggaucuccagccuguccauccucaaccgcaucaucaaggugcgggucaaccacaucggccagaucgugaugaucggggaguacuga

SEQ ID NO: 2065 - RNA, 4158 nt, Artificial Sequence
  Cas9 variant
augaccaagcccuacagcaucggccuggacaucgggaccaacuccgugggcugggccgucaucacggacgacuacaaggugccgagcaagaagaugaaggugcucgggaacaccuccaagaaguacaucaagaagaaccugcugggcgcccuccuguucgacagcgggaucaccgcggagggccgccggcugaagcgcaccgcccggcgccgguacacgcgccggcgcaaccggauccucuaccugcaggagaucuucuccaccgagauggccacccuggacgacgccuucuuccagcgccucgacgacagcuuccugguccccgacgacaagcgggacuccaaguaccccaucuucggcaaccugguggaggagaaggccuaccacgacgaguuccccaccaucuaccaccuccgcaaguaccuggcggacagcacgaagaaggccgaccugcggcucguguaccuggcccuggcccacaugaucaaguaccgcgggcacuuccucaucgagggcgaguucaacuccaagaacaacgacauccagaagaacuuccaggacuuccuggacaccuacaacgcgaucuucgagagcgaccugucccucgagaacagcaagcagcuggaggagaucgucaaggacaagaucuccaagagcgccaagaaggaccggauccugaagcuguucccgggggagaagaacuccggcaucuucagcgaguuccugaagcugaucguggggaaccaggccgacuucaagaaguacuucaaccucgacgagaaggcgccccugcacuucuccaaggagagcuacgacgaggaccuggagacccuccugggcuacaucggcgacgacuacuccgacguguuccugaaggccaagaagcucuacgacgccauccugcugagcgggauccucaccgucacggacaacggcaccgaggcgccccugagcuccgccaugaucaugcgcuacaaggagcacgaggaggaccuggcccuccugaaggccuacauccggaacaucagccuggagaccuacaacgagguguucaaggacgacaccaagaacggguacgccggcuacaucgacggcaagacgucccaggaggacuucuacgugcaccucaagaagcugcuggucgggcucgagggcgccgacuacuuccuggagaagaucgaccgcgaggacuuccugcggaagcagcgcaccuucgacaacgggagcauccccuaccagauccaccuccaggagaugcgggccauccuggacaagcaggccaaguucuacccguuccuggccaagaacaaggagcgcaucgagaagauccugaccuuccgcauccccuacuacgugggcccccucgcgcgggggaacuccgacuucgccuggagcauccgcaagcggaacgagaagaucacccccuggaacuucgaggacgugaucgacaaggaguccagcgccgaggccuucaucaaccgcaugacguccuucgaccuguaccugccggaggagaagguccuccccaagcacagccugcuguacgagaccuucaacguguacaacgagcucaccaaggugcgguucaucgccgaguccaugcgcgacuaccaguuccuggacagcaagcagaagaaggacaucguccggcuguacuucaagaacaagcgccgggugaccgacaaggacaucaucgaguaccuccacgcgaucgacggcuacgacggcaucgagcugaaggggaucgagaagcaguucaacuccagccuguccacguaccacgaccuccugaacaucaucaacgacaaggaguuccuggacgacagcuccaacgaggccaucaucgaggagaucauccacacccucaccaucuucgaggaccgcgagaugaucaagcagcggcugagcaaguucgagaacaucuucgacaaguccgugcugaagaagcucagccgccggcacuacaccggcugggggaagcugagcgccaagcugaucaacggcauccgcgacgagaaguccgggaacacgauccucgacuaccugaucgacgacggcgucagcaaccggaacuucaugcagcugauccacgacgacgcccucuccuucaagaagaagaucaagaaggcgcagaucaucggcgacaaggacaacaucaagcaggucgugcaggcccugcccgggcgccccgccaucaagaagggcauccugcagagcaucaagaucguggacgagcucgugaaggucauggggcggcgcccggaguccaucgugguggagauggcccgggagaaccaguacaccaaccagggcaagagcaacucccagcagcgccugaagcgccuggaggagagccucaaggagcugggguccaagauccugaaggagaacauccccgccaagcucagcaagaucgacaacaacgcgcugcagaacgaccggcuguaccucuacuaccugcagaacggcaaggacauguacaccggcgaggagcuggacaucgaccgccucuccaacuacgacaucgaccacaucaucccccaggccuuccugaaggacaacagcaucgacaacaagguccugguguccagcgccuccaaccgggggaaguccgacgacgugcccagccucgaggucgugaagaagcgcaagacccugugguaccagcugcucaagagcaagcugaucagccagcggaaguucgacaaccugacgaaggccgagcgcggcgggcucuccccggaggccaaggcgggcuucauccagcggcagcugguggagacccgccagaucaccaagcacgucgcccggcugcucgacgagcgcuucaacaacaagaaggacgaggacaacaagacccugcggacggugaagaucaucacccucaagagcucccucgugagccaguuccgcaaggacuucgagcuguacaagguccgggagaucaacgacuuccaccacgcccacgacgccuaccugaacgccgugguggcguccgcccuccugaagaaguaccccaagcuggagcccgaguucgucuacggcgacuaccccaaguacaacagcuuccgcgagcggaaguccgccaccgagaagguguacuucuacagcaacaucaugaacaucuucaagaaguccaucagccucgccgacgggaccgugaucgagcgcccgcugaucgaggucaacgaggagaccggcgaguccguguggaacaagguggcggaccugaacacgguccggaaggugcucagcuacucccaggugaacaucgucaagaagguggaggagcagaaccacgggcuggaccgcggcaagcccaaggggcuguucaacgccaaccucagcuccaagcccaagcccaacagcaaggagaaccuggugggcgccaaggaguaccuggacccgaagaaguacggcggguacgccggcaucuccaacagcuucgccguccucgugaaggggaccaucgagaagggcgcgaagaagaagaucaccaacauccuggaguuccaggggaucuccauccuggaccggaucaccuaccgcaaggacaaguucaacuuccuccuggagaagggcuacaaggacaucgaccugaucaucgagcuccccaaguacagccuguucgagcugagcgacggcucccggcgcaugcucgccagcauccuguccacgaacaacaagcgcggggagauccacaagggcaaccagaucuucaucagccagaaguacgugaagcugcucuaccacgccaagcggaucuccaacaccuucaacgacaaccaccgcaaguacgucgagaaccacaagaaggaguucgaggagcuguucuacuacauccuggaguucaacgagaacuacgugggggccaagaagaacggcgagcuccucaagagcgccuuccaguccuggcagaaccacagcaucgacgagcugugcuccagcuucaucgggcccaccggcuccgagcggaagggccuguucgagcugaccagccgcgggggcgcggccgacuucgacuuccugggggugaagaucccgcgguaccgcgacuacacgcccuccagccuccugaaggacgccacccugauccaccaguccgucaccggccucuacgagacccggaucgaccuggggaagcugggcgaggacuga

SEQ ID NO: 2066 - RNA, 4158 nt, Artificial Sequence
  Cas9 variant
augaagaacaagaccugguaccugggccucggggugggccccaccagcaucgggugggccgccacggacuccaacuacaagcugcugcgcaagaacaagaagcggcucuggggcguccgccuguucgaggaggcgaagaccgccguggaccggcgcaccuuccgggccgagcgccggcgccuggcccggcgcaaguggcggaucagccuccuggaggagcuguucgccaaggagguguccaagaacgacccgaacuucuuccuccgccugaaggagagcaaguaccacuucgaggacaagucccugaugaacgaguacauccucuucaacgacaaggacuacaccgacaaggacuacuacaaggaguaccccacgaucuaccaccuccggcugagccugaccaccgaggagaaccccgacauccgcaaggucuaccuggcggugcacuccaugcugaagaaccgggggcacuuccuccugcagggccagagcuucaacgacuccaacaucgacagcgugaucaaggagcugcucgagcuggagaccgucaagaucaacuucgaggugacggacgaggugauccacucccugaagaagaucgcccucgagaagaagaaccugagcgacaagaacaacgacgucaagaagcuguaccccaaggagaagcagcuccaggagaucuucaagcugguguucggcgggaagaccucccuggacaagcucuacgacaucgaggaguacaaggagcuggacaacagcgugaaguccaucagcuucaaggagaaggucuacgaggaggugcgcccggacuacgagcagauccuguccaacuacaucgagcuccuggaccuggccaagcucguguacgacagcaucguccuggccgacaucaagaaggagggcaagaccaucuccgagagcaagguggagcuguacaacaagcacaaggacgaccucgcgaaccugaagaagcuggugaagaucgacagcaagcucuccgaggacaagaagaaggaggucuacuucaccaucuucaaggaggacaaggagaaggggacgaacuacgugaacuacacccaccggagccaggagggcaaguccugcagcuacgaggacuucaagaaguuccugaagaaggagcuggagaagcucgaggacucccccaccaagaccacgauccuggaggagcuggaccucgagaccuuccugccccugcagcgcaccaaggacaacagcgugguccccuaccagauccacaaggaggagcuggugaagauccucgacaacgccgccaaguaccacuccuuccuggccgagaaggacgacagcggguacuccacccgggagaaggugguccagcuguucgaguuccgcaucccguacuacaucggcccccucaacgcccaccacaacacggagaacggcggguacagcugggcgauccggaagaagggcauggaguccgugcccgucacccccuggaacuucaaggacgugaucgacgagagcgccuccgccgaggccuucgugaacaaccugaagaacaagugcgccuaccugagcggggaggacguccucccgaagaacucccugcuguacagcgaguacgcgcuccugaacgagcugaacgcccuccgcuacgagggcaaccgcaucuccguggaggcccgggacgugaucgucaccaagcuguucaaggagcagggcaagaaggugaccaagaagacgaucaaggagcugcucaagaccgagggguucaucgacggcaagggggagaucgugggcaucgacaacaucgucaagaacgaccucaagagcuaccgcgacuucaagaagauccuggccgacaaguucgacaaggagcggguggagaacaucauccuguggaucacccuguacggggagucccgcaagcugaucaaggagaagaucaccaagguguacggcgacuucuacacggucgacgagaucgagaagaugagccggcucaccuacaaggacuggggcauccugagccgcaagcugcucaccgagcugguguccgagaagcuguacaacgaggagaccggggagugccucaacaucaucggcgccaugcggcaggggacgauccuguucauggagcugcucgcggacaaguucgacuacaugagccagaucaagaaccacaacaaggagaacaaggacgacaucaccgagaucacccccgacauccuggagaaccugcacgccucccccgccgugaagcgcagcaucuggcagaccguccggaucguggaggagcucaagacgaucaucggcugcgugcccaccaagaucuucaucgagaccaccaagcgcaacaacgccccguacaagguccccacccugaaccggaacgaccuggugacgaaguacaagaccauccgcgagcacgagaucuucgagcucgagaaggagcugaagaacacccuggacuucacccucaacaagaaccggcugaucaacgaggagcccuccaagcugaaggccacgaagcucuaccuguacuacacccagcuggggcgcugcauguacaccggcaagaagaucgaccucggcgagcuguucgacaacaacaacaaguacgacaucgaccacaucuacccccagagcaaggugaaggacggguccuucaacaacaucguccuggugaccaaggcgagcaacgacaugaaggccgacguguucccgcucaaguccaaguuccagacgaaggagaacaagaucuucuggcgguuccugaaggagaagaagcugaucaccgaggagaaguacaaccgccucguccggaccgaggaguucagcaacggcgagcugaccggguucaucacgcgccagcugguggagaccucccaggccaucaaggugaucagcaacguccuccgggagcugaaccccgagaccaccaucugcuacuccaaggccgagaacgugagcuccuuccgccagagcuucggcaagaucaaggaggcgaaccgcaaggccgagaacaacgagaagcugauccgggugcaggagaucaacgacuacuacaacgccaaggacgccuaccucuccaucgucguggggaacguguacgacgucaaguucacgcgcaacgugcacaacuucaucaagaacaacaaggacgcccggcgcuacagccugaacggccuguucuacaccgacgugaagaacgcgaacaccaucgccugggagauggacaagaccguccacgugguggagaagacgaugaacaacaacaacauccucaucacccggcgcaccagcgagcagaagggcgcccuguacgacgccacccuguacaaggccaaggucgcggagaaggccaaggaggggacguacuacccccucaagaccaccgacuccaagaucaaggacgugggcaaguacgggggcuucaccaagaucaagaucgccuacuacagcaucuucgaguacacgcuggacggcaagaaggggaagcagaagaucacccggaucgugcccaucccgaucuacaucucccagaacaucaaggacgacaaggcccugcucgaguacgcccagacccgccugcccggcaaggaccugaagaucaaguaccggaagcucugcaucgggagccuggucaagaucaacaacuucaacuacuacaucggcgggaagaccaacaacaacuucacguucgacuccgcgguccaggugauccuggacaaggacagcgaguccuacaucaaggagcucgccaaguaccugaacuggaagaaggagaacaaggacggcaagcugugggagagcaucaccgaggacaagaacauccagcucuacgacucccuggugaagaagaugaacaccggcaucuucauccgcaagacccccaacaaguacacggagcugcucacccuggaggugaagaacaaguucaucaacaucgacaucgacgagcaggucaagcugcuccuggagauccugaaccuccugaccaacaagaaguucaccagcaagcugaacgagaucgggaucaccgccucccggggcgugugcagcuucaaccucuccaaccagagccaguucuccaucaucgagcagagcgugacggggguguacgagaaggagaagcugaucaucgagaagaagaaggagggcauccuguga

SEQ ID NO: 2067 - RNA, 4161 nt, Artificial Sequence
  Cas9 variant
augaaccagaaguacagcaucggccuggacaucgggaccaacuccgugggcugggccgucaucaccgacgacuacaaggugcccgccaagaagaugaaggugcucgggaacacggacaagcagagcaucaagaagaaccugcugggcgcgcuccuguucgacuccggggagaccgccgaggccacccgccugaagcggaccgcccgccggcgcuacacgcggcgccggaaccgccuccgguaccugcaggagaucuucgccgaggagaugaugcaggucgacgagagcuucuuccagcgccuggacgacuccuuccucguggacgaggacaagcggggcgagcgccacccgaucuucggcaacaucgcggccgaggugaaguaccacgacgaguuccccaccaucuaccaccuccggaagcaccuggccgacaucagccagaaggccgaccuccgccuggucuaccuggcgcucgcccacaugaucaaguuccgggggcacuuccugaucgagggccagcugaaggccgagaacaccaacgugcaggcccucuucaaggacuucguggaggucuacgacaagaccguggaggagucccaccugagcgagaucacgguggacgcccuguccauccucaccgagaaggucagcaagucccgccggcuggagaaccugaucgcgcacuaccccgccgagaagaagaacacccucuucgggaaccugaucgcccuguuccucggccugcagcccaacuucaagaccaacuuccagcugagcgaggacgccaagcuccaguucuccaaggacacguacgaggaggaccuggaggggcugcucggcgaggugggcgacgaguacgccgaccuguucgcgagcgccaagaaccuguacgacgccauccuccuguccgggauccugaccguggacgacaacagcaccaaggccccgcucuccgccagcauggucaagcgcuacgaggagcaccagaaggaccugaagaaguucgaggacuucaucaaggugaacgcgcuggaccaguacaacgccaucuucaaggacaagaacaagaagggcuacgccggguacaucgaguccggcgugaagcaggacgaguucuacaaguaccucaagggcauccugcugcagaucaacgggagcggcgacuuccucgacaagaucgaccgggaggacuuccugcgcaagcagcggaccuucgacaacgggagcaucccccaccagauccaccuccaggagaugcacgccauccugcgccgccagggcgagcacuaccccuuccugaaggagaaccaggacaagaucgagaagauccugacguuccggauccccuacuacgucgggccgcuggcccgcaagggcucccgguucgcgugggccgaguacaaggccgacgagaagaucacccccuggaacuucgacgacauccucgacaaggagaaguccgccgagaaguucaucacccgcaugacccugaacgaccuguaccuccccgaggagaaggugcugcccaagcacagccugcucuacgagacguucaccguguacaacgagcugaccaaggucaaguacgugaacgagcagggcgaggcgaaguucuucgacgccaacaugaagcaggagaucuucgaccacguguucaaggagaaccggaaggucaccaaggacaagcugcucaacuaccugaacaaggaguucgaggaguuccgcaucgugaaccugacggggcucgacaaggagaacaaggucuucaacagcucccugggcaccuaccacgaccugcggaagauccucaacaagagcuuccuggacaacaaggagaacgcccagaucaucgaggacaucauccagacccugacccucuucgaggaccgcgagaugauccggcagcgccugcagaaguacuccgacaucuucacgaaggcccagcugaagaagcucgagcggcgccacuacaccggguggggccggcugagcuacaagcugaucaacgggauccgcaacaaggagaacaagaagaccauccucgacuaccugaucgacgacggcuacgccaaccggaacuucaugcagcugaucaacgacgacgcgcucuccuucaaggaggagaucgccaaggcccagaucaucggcgacguggacgacaucgccaacgugguccacgaccugccggggagccccgccaucaagaagggcauccugcaguccgugaagaucguggacgagcucgucaaggugauggggcacaaccccgcgaacaucaucaucgagauggcccgcgagaaccagaccacggaccggggccgccggaacagccagcagcgccugaagcugcuccaggacucccugaagaaccuggacaaccccgugaacaucaagaacgucgagaaccagcagcuccagaacgaccgccuguuccuguacuacauccagaacgggaaggacauguacaccggcgagacccucgacaucaacaaccugagccaguacgacaucgaccacaucaucccgcaggccuacaucaaggacgacuccuucgacaaccgggugcugaccagcuccagcgagaaccgcggcaaguccgacaacgugcccagcaucgaggucgugugcgcccggaaggccgacuggaugcgccuccggaaggcggggcugaucagccagcgcaaguucgacaaccugacgaaggccgagcggggcgggcucaccgagaacgacaaggccggcuucaucaagcgccagcugguggagacccggcagaucaccaagcacgucgcccaggugcuggacgcgcgcuucaacgccaagcacgacgagaacaagaaggugauccgggacgucaagaucaucacccucaaguccaaccuggugagccaguuccgcaaggacuucaaguucuacaaggugcgggagaucaacgacuaccaccacgcccacgacgccuaccugaacgccgucaucggcacggcgcuccugaagaaguaccccaagcuggccuccgaguucguguacggggaguucaagaaguacgacgugcgcaaguucaucgccaagagcgacaaggagaucggcaaggccaccgccaaguacuucuucuacuccaaccucaugaacuucuucaagaaggaggucaaguucgcggacgggaccgugguggagcggcccgacaucgagaccagcgaggacggcgagaucgccuggaacaagcagacggacuucaagaucguccgcaaggugcuguccuacccccaggugaacaucgucaagaagaccgaggugcagacccacgggcuggaccggggcaagccgcgcggccucuucaacgccaaccccagccccaagccgaagcccgacuccagcgagaaccuggugggggucaagcggaaccuggaccccaagaaguacggcggguacgccggcaucuccaacagcuacgccgugcucgugaaggcgaucaucgagaagggggucaagaagaaggagaccauggugcuggaguuccagggcaucuccauccuggaccgcaucacguucgagaaggacaagcgggccuuccuccugggcaagggguacaaggacaucaagaagaucaucgagcugcccaaguacagccucuucgagcugaaggacggcucccgccgcaugcuggccagcauccucuccaccaacaacaagcgcggggagauccacaagggcaacgagcuguucgugccgcagaaguucaccacccugcucuaccacgccaagcggaucaacaaccccaucaacaaggaccacaucgaguacgucaagaagcaccgggacgacuucaaggagcugcugaacuacgugcucgaguucaacgagaaguacgugggggcgacgaagaacggcgagcgccugaaggaggccgucgccgacuucgacagcaagagcaacgaggagaucugcaccuccuuccugggcgccgugaacagcaagaacgccgggcuguucgagcugaccucccugggcagcgcguccgacuucgaguuccucggggugaagaucccccgguaccgcgacuacaccccgagcucccugcugaaggacagcacgcucauccaccaguccaucaccggccuguacgagacccggaucgaccugagcaagcucggggaggacuga

SEQ ID NO: 2068 - RNA, 4161 nt, Artificial Sequence
  Cas9 variant
augaccaagaucaccgaggacuacaucgugggccuggacaucgggacgaacagcugcggcugggucgccauggacuccaagaacaccauccuccgcaugcacgggaagaccgccaucggcagccaccuguucgacgcggggaacuccgccgccgaccggcgcgccuuccggaccacgcgccggcgcaucaagcggcgcaaguggcggcugaagcuccuggaggagaucuucgacagccaccuggccaagguggaccccuacuucuucgcgcgccucaaggaguccggccugagcccgcuggacacccggaagaacguguccagcaucaucuaccccaccucccucgaggacaagaaguucuacgucgacaaccccaccaucuaccaccuccgcuacaagcugaugacggaggaccggaaguucgaccugcgcgagguguaccuggccauccaccacaucgugaaguaccggggcaacuuccuguacaacacccccgucaaggccuucgaggccagcaagaucgacgugaaggggucccucaagaagcugaacgagcuguacgagggccucgacagcgaguucaacguggagcuggacuccaacaacgcgcuggagaucgagaacaucauccgcgacaagaagaucuucaagaucaacaaggucaaggagaucaaccagcuccugagccugaagaccgaggacaaggagcggaccaagcucaugaaggacguguccaagcagaucgugaacgccauccugggguacaagacgaaguucgagaccauccugcucaaggacgucagcaaggacgaggccgacgacugggaguucaagcugaccgacguggacgccgacaacaaguucgagaaccugaucggcgaccucaacgagaacgagcaggagauccugcuggugauccgcaagcucgccaacgcgaucacccuguccaacaucgucgaggaggggaagacgcugagcgaguccaugaaggacaaguacaagaagcacagcgacgaccucaagcugcugaagcaggucaucagcgaccacccggaccgggacaaggccaagaagcucgcccuggccuacgaccuguacgugaacaaccgccacggcaagauccuccaggccaaggacauccuggagaagaagaagacccuguccaaggaggacuucuacaaggagaucaagaagaaccucgacgacagcaaggagucccaggagauccuggacgcgaucagccuggacuccuucaugcccaagcagcggaccaacgagaacggcgugauccccuaccagcuccaccagcuggagcuggacaagaucaucgagaaccaggggaaguacuaccccuuccugaaggaggugaacccggugagcucccaccucaagcaggcccccuacaagcuggacgagcugauccgcuuccgcguccccuacuacgugggcccccucaucagcccgaacgaguccaccaagaacaagcagacgaagaagaaccagaacuucgccuggaugauccggaaggagcaggggcagaucacccccuggaacuucgaccagaagguggaccgcauggccagcgccaacaaguucaucaagcggaugaccaccaucgacacguaccugcugggcgaggacguccuccccgcgaacucccugcuguaccagaaguucaccgugcucaacgagcugaacaacgucaagaucaacggcaagcgcaucagcgugccccugaagcaggagcucuacaacaaccuguucaagaagaacuccaccgugaccacgaacaagcucaagagcuaccugaaggagaacuacaagcugaucaaggucgagaucaaggggcuguccgacgagaagaaguucaacagcggccucaccaccuacaacaagcugaagaaccugaagaucuucgaccagcagaucgacgacccgaacuacaacaaggacuucgagcggaucaucgagugguccaccaucuucgaggacaaggccaucuacaaggagaagcucaagacgaucgacuggcugagcgaccgccagaucgacaagcuguccaagauccggaugcagggguggggccagcucagcaagaagcugcugagccagcucaccgacaacaacgggcagaccaucaucgagcagcugugggacucccagaacaacuucaugcagaucgugaaccaggccgacuucaaggacgccaucgccguggcgaaccagaaccugcucgucgacaccagcguggaggacauccugaacgaggccuacacgucccccgccaacaagaaggccauccgccagguggucaaggugguggacgacaucgucaaggcgaccagcggcaaggugcccaagcagaucgccaucgaguucacccgggacgccgacgacaacgccaagaucucccagagccgcgccaacaagcugcggaagguguacaaggagauguccaacgagcucgcgagcgagaccauccgcaacgagcuggagcgggucgccaaggaccagaagcugcucaaggacaagcacuaccuguacuucaugcagcugggccgcgacgccuacaccggggagcucaucgacaucgacaaccuggagcaguacgacaucgaccacgugcugccccaguccuucaucaaggacgacagccucgagaaccgggugcuggucaagaaggccgugaacaacggcaaguccgacaacgugccggucaagcuguacgggaaccgcauggccacggaccucggcaugaccauccggcacaugugggagaaguggaaggagcaggggcugaucaccaagaccaaguacaacaaccugaucaucgaccccgacaagaucaacaaguacgagagcuccggcuucauccaccgccagcucguggagacgagccagaucaucaagcugguguccaccauccugcagagcaaguaccccgacaccgagaucaucgucgugaaggcgcgguacaaccacuaccuccgcaagcgccugaaccuguacaagucccgggaggugaacgacuaccaccacgccaucgacgccuaccucagcgccaucugcggcaaccugcuguaccaggucuaccccuaccuccgcccguucuucguguacgggcaguacaagaaguucagcuccgagcccgagaaggagaagaucaucuacgacaagacccggcgcuacaacuucaucagccagaucuucgagaacaaggacaacgacaucaucucccgggagacgaagaagaagguguucgacaagaaggacaucaucgagaagcugaagcgcgccuacaacuacaaguacaugcuggucagccgggagaccgagacccacgaccaggagauguucaagaugaccguguacccccgccucucccgggacacgaagaagucccgcaaccugauccccaagaagaaggacaugccgaccgagaucuacggcggguacaccaacaacagcgacgcguacaugaucaucgcccggaucaacaagaagaagggccccgaguaccgcguguucgggguccccaugcgggagcuggugaaccuccgcaaggccgagaagaacggccacuacaaggccuaccugaagcagguccuggagccggagaucauguacagcaagaacggcaagaagaacaagaccaucuccagcuucgagaucgugaaggcgaaggugcccuacaagcaggucauccucgacggggacaagaaguucaugcuggccuccagcacguacgugcagaacgccaagcagcugacccucucccaguacagcaugcaggccaucaccgacaacugcgagaacgacaccgaggaggagaaggcccugguggaggcguacgacgagauccugacgaacaucgacaaguaccucccccuguucgacaucaacaaguuccgggagaagcugcacgccggccgcgagaaguucguggaccucccccuggccgagaagaaggagaccauccugcagguccucaacgggcugcacgacaacgccgugaugccgaagaucaagucccugggccucagcacgccccugggcuucaugcaguuccacaccggggugucccugagcgagaacgccaagcucaucuaccagucccccaccggccuguucgagaagcggcugaagaucagcgaccucuga

SEQ ID NO: 2069 - RNA, 4164 nt, Artificial Sequence
  Cas9 variant
augagcgacuccaagaaguucgagggcgagaacgucaagagcggggacaagaagaccaacaagaaccacggcaaggugcugaaguccagccccaaggagauccgcaagaacaccgaguacuucaucgggcucgacaucggcacguccagcguggggugggccgugaccaacaccgacuacgagauccugaaguucaacggcaagcggauguggggcucccgccuguucaacgaggccagcaccgcggaggagcggcgcgggcaccgggucaaccgccggcgcauccagcggcgccgggaccgccucaaccugcuggaggagaucuucuccgaggagauggccaagguggacccggaguucuucaugcggcucaaggagagcaaguuccaccuggaggacaaggacgagcgcauccugggcgaguccaacaucaucuucaaggggagcgaggacggcgacaagaaguacuacgagaaguaccccacgaucuaccaccuccggcacaagcugaugcaguccugcgaggacguggacauccgcgagcuguacauggcccuccaccacaucaucaaguaccgggggcacuuccuguucaagggcgacuucgaggagaccggcaccagcaucgagaacaucaucaucgagcugcucgagcugaucaacaacaaccugggggucaagaaguucgaguacaacgagucccucaucaacgagcugaagaacaucgugagcaacaccuccaacacgaucaccaacaagaagaagcugcucggcgaguucuucaacaagaaggaguacaaggcccacaagagccuguucauccuguccaucggggccagcgugaagcccgucgaccucuuccuggaggaggaguacaaggacaucgacgacaucaagaacaucagcuucaagaaccuggaguacgaccaggugcgcgacaccuacgaguccaucuuccucgacaagaucgaguucaucgacguggcgaagcggcuguacgacgccaccauccugcucagcaucaagcccgagggcaagacgcuguccgaggccaaggucgacaucuacaacaagcaccacaacgaccuggagcuccugaagaaggugcugaagaccgacaaggagaaguacgacagcauccucaagcuggacaucaagaagggcaacaacuacgugaacuacgucaagaaguccaagaacgggaucagcugcuccaaggaggaguuccacaacgcccugaagaaggugcucgugaagaucgagaagaccgacgacaucaaguacauccugaacgagaucgagcuggagcgcuuccucccgcugcagcgggucaaggacaacagcgugauccccuaccagauccaccgcuacgagcugaagaagauccucgagaacgcguccaagaaguucaccuuccugaacgaggagagcgacggccacacgaacaucgagaagaucaucaagaucauggaguaccgcauccccuacuacguggggccccugaacgaccaccacuccgucuacaacaacggcuucgccugggugagccggaagcgcuccgggcggaucaccccguggaacuucgacgagaugguggacaaggaggagagcgccgagcgcuucaucgagaaccucaccaacaagugcuccuaccugaucggcgaggacguccugcccaaggagagccugcucuacuccgaguucagccugcugaacgagcucaacaacaucaaguacgacggcaucucccugcccaucgacaucaagaaguccaucguggagaagaucuuccgggucgagaagaagcgcgugaccaagaaguacaucaaggaguuccugaagcaggagggguacagcgacggcaagggggaggugagcggcaucgacaucgacaucaagagcgaccucaaguccuaccgggacauggucaagaucuucgggacggagaucgacuaccgcauggccgagaacaucaucaagugggugacccuguucggcgacagcaaggaccugcucaagaccaagaucaacaaggaguacggcgagaagguguccaaggaccagcugaagaaggucugcaagcugaaguaccgggacugggggcgccucagcaagaaguuccugaccggcauccgguccagcgugcuggugaacgacgccacgggggagggcuacaccaucaucgaggcgaugcgcaacaccgacaacaaccucaugcagcugcugcggaacgaguacgacuaccucaagaagaucgaccagaucaacaugcugucccgcaaggacaucgacgagaucagccacgacauccuggacgaccucuacugcucccccgccgucaagcggagccuguggcagaccaucaagaucguggaggagaucaagaagaucauggggcacgagccgaagaagguguucgucgaggugacgcgcaccaacaaggccgacaagaagaccaccaucacgcggaagaaccgccugcucgagcuguacuccgccaucaacgccgagagccgggacugggugaacgagcugaacuccaccgaggucagcaaguucaacuccaagaagcucuaccuguacuacacccagaugggcaagugcauguacaccggcaagaacaucgacaucgagagccuguucacggacauguacgacaucgaccacaucuucccccgcagcaagaccaaggacaacuccuucgagaaccucgugcuggugacccgcaaggcgaacgccgacaagcgggacgucuaccccaucgaccccaagauccagaccgagcgcaagagccugugggacaugcuccacgacaagaagcugaucggggacaagaaguacgaccggcugacccgcacgaccggcuucaccgacgacgagauguccggguucaucgcccggcagcucguggagaccagccaggccuccaaggccgcggccgagaugcugaagcugaucaacaacgacagcgagaucguguacgucaaggccgagaacguguccgacuuccgccacgagaacgaguucaucaaggugcgggagaucaacgaccaccaccacgccaaggacgccuaccucaacaucgucgugggcaacguguacaacgagaaguucacgaagaacccggcgaacuacaucaagaagggcgggggcaacaacuacagccugaacugcaucuucaaccgcaaccuggaccggaacgggaagcgcaucugggacgagaagaaguccaucgacaccgucaaccggaugaugaaguccaacgacgugcgcgugaccuucaagaaccgggucgacaagggccccauccucaacaaggugaccauccacaaggccagcgaguucauggacgacgggaagaagaacaagaagggcuuccccaucaagagcuccgagaagaacggcaacaaccgccugugcaaccuguacaaguacgggggcuacaaggaccucaacuacagccacuacacgaucgugcgguacaacgucuacgagaagaaggggcuggacaucaaguacuacaugauccccaucccguacuaccugugccucugcaacaucaaccagcacgacuacguguacgacuacaucuccaaccgcagcaagaaggacgugaacaacaucgagaucaucgucaacgagcugaagaugggcucccugaucaacaucgacggguacaacuacuaccucggcggcagcaagcccaagaccuucuacguggaccccgccuaccagaucauccuggacaaggagaucgagcggugcaucaaggagaucgugaaggccaagaacaacgaguaccgcuucaucaacaccgacaagaucaacaagaaccugaacaugaagaucuacaaguacaucgucaacaagaagaucaucgggguguuccggaaccgcaagugggacaagggcgaguaccucaacuccagcgagaccaucgagaaguucagcgggcuguccguggagagccagugcaacgucauccugcggcucaucaacgacaugcgcggcuccaacaagggcggggcgaacagcaaguucgacgagcuggagaugacgaucucccgcgccgagaucccccagacccugagcaacguguccagcuucaagaucaucaaccaguccaucaccggccucuucgagaacgaggugaccaucgucuga

SEQ ID NO: 2070 - RNA, 4167 nt, Artificial Sequence
  Cas9 variant
augaccaagcccuacagcaucggccuggacaucgggaccaacuccgugggcugggccgucaucacggacgacuacaaggugccgagcaagaagaugaaggugcucgggaacaccuccaagaaguacaucaagaagaaccugcugggcgcccuccuguucgacagcgggaucaccgcggagggccgccggcugaagcgcaccgcccggcgccgguacacgcgccggcgcaaccggauccucuaccugcaggagaucuucuccaccgagauggccacccuggacgacgccuucuuccagcgccucgacgacagcuuccugguccccgacgacaagcgggacuccaaguaccccaucuucggcaaccugguggaggagaaggccuaccacgacgaguuccccaccaucuaccaccuccgcaaguaccuggcggacagcacgaagaaggccgaccugcggcucguguaccuggcccuggcccacaugaucaaguaccgcgggcacuuccucaucgagggcgaguucaacuccaagaacaacgacauccagaagaacuuccaggacuuccuggacaccuacaacgcgaucuucgagagcgaccugucccucgagaacagcaagcagcuggaggagaucgucaaggacaagaucuccaagcuggagaagaaggaccggauccucaagcuguucccgggggagaagaacagcggcaucuucuccgaguuccugaagcucaucguggggaaccaggccgacuucaagaaguacuucaaccuggacgagaaggccagccugcacuucuccaaggagagcuacgacgaggaccucgagacccugcugggcuacaucggcgacgacuacuccgacguguuccucaaggccaagaagcuguacgacgccauccugcucagcgggauccugaccgucacggacaacggcaccgaggcgccccugagcuccgccaugaucaugcgcuacaaggagcacgaggaggaccucgggcugcugaaggccuacauccggaacaucagccucgagaccuacaacgagguguucaaggacaacuccaagaacggcuacgccggcuacaucgacgggaagaccaaccaggaggacuucuacguguaccugaagaaccugcucagcaacuucgagggcgccgacuacuuccuggagaagaucgaccgcgaggacuuccugcggaagcagcgcacguucgacaacggguccauccccuaccagauccaccuccaggagaugcgggcgaucaucgacaagcaggccaaguucuaccccuuccuggccaacaacaaggagcgcaucgagaagauccugaccuuccgcaucccguacuacgucggcccccuggcccgggggaacagcgacuucgccugguccauccgcaagcggaacgagaagaucacccccuggaacuucgaggacgugaucgacaaggagagcuccgcggaggccuucaucaaccgcaugaccagcuucgaccucuaccugcccgaggagaaggugcugccgaagcacucccuccuguacgagacguucaacgucuacaacgagcugaccaaggugcgguucaucgccgagagcauguccaaguaccaguuccucgacagcaagcagaagaaggacaucgugcgccuguacuucaaggacaagcggaaggucaccgacaaggacaucaucgaguaccugcacgccaucgacggcuacgacggcaucgagcucaaggggaucgagaagcaguucaacuccagccuguccaccuaccacgaccugcucaacaucaucaacgacaaggaguuccuggacgacagcuccaacgaggccaucaucgaggagaucauccacacgcugaccaucuucgaggaccgcgagaugaucaagcagcggcucagcaaguucgagaacaucuucgacaagagcgugcugaagaagcugucccgccggcacuacaccggcugggggaagcucagcgcgaagcugaucaacggcauccgcgacgagaaguccgggaacaccauccuggacuaccucaucgacgacggcaucagcaaccggaacuucaugcagcugauccacgacgacgcccuguccuucaagaagaagauccagaaggcccagaucaucggcgacgaggacaaggggaacaucaaggagguggucaagagccuccccggcucccccgccaucaagaaggggauccugcagagcaucaagaucguggacgagcuggugaaggucaugggcgggcgcaagcccgaguccaucguggucgagauggcgcgggagaaccaguacacgaaccagggcaagagcaacucccagcagcgccucaagcggcuggagaagucccugaaggagcucggcagcaagauccugaaggagaacaucccggccaagcugagcaagaucgacaacaacgcccuccagaacgaccgccuguaccuguacuaccuccagaacgggaaggacauguacaccggcgacgaccuggacaucgaccggcuguccaacuacgacaucgaccacaucaucccccaggccuuccucaaggacaacagcaucgacaacaaggugcugguguccagcgccagcaaccgcgggaaguccgacgacguccccagccuggagguggugaagaagcgcaagacccucugguaccagcugcugaaguccaagcucaucagccagcggaaguucgacaaccugaccaaggcggagcgcggcggccugucccgggaggacaaggccagcuucauccagcgccagcucgucgagacgcggcagaucaccaagcacguggcccgccugcuggacgagaaguucaacaacaagaaggacgagaacaaccgggccgugcgcaccgucaagaucaucacccucaaguccacgcuggugagccaguuccggaaggacuucgagcuguacaaggugcgcgagaucaacgaccuccaccacgcccacgacgcguaccugaacgccgucguggccuccgcccugcucaagaaguaccccaagcuggagccggaguucguguacggggacuaccccaaguacaacagcuuccgggagcgcaaguccgccaccgagaaggucuacuucuacagcaacaucaugaacaucuucaagaaguccaucagccuggcggacggcaccgugaucgagaagccccucaucgaggugaacgaggagaccggggaguccgucuggaacaaggagagcgaccuggccaccgugcggcgcgugcuguccuacccccaggucaacguggugaagaaggucgagaagcagaaccacggccucgaccgggggaagccgaagggccuguucaacgccaaccugagcuccaagcccaagcccaacagcaacgagaaccucgugggcgccaaggaguaccuggaccccaagaaguacgggggcuacgcggggaucagcaacuccuucgccgugcuggucaagggcacgaucgagaagggggccaagaagaagaucaccaacgugcucgaguuccagggcaucagcauccuggaccgcaucaacuaccggaaggacaagcugaacuuccuccuggagaagggcuacaaggacaucgagcugaucaucgagcucccgaaguacucccuguucgagcugagcgacgggucccgccggaugcucgccagcauccuguccaccaacaacaagcgcggcgagauccacaaggggaaccagaucuuccugagccagaaguucgugaagcuccuguaccacgccaagcggaucuccaacaccaucaacgagaaccaccgcaaguacgucgagaaccacaagaaggaguucgaggagcuguucuacuacauccucgaguucaacgagaacuacgugggcgcgaagaagaacgggaagcugcugaacagcgccuuccaguccuggcagaaccacagcaucgacgagcucugcuccagcuucaucggccccacgggcuccgagcgcaaggggcuguucgagcugaccagccggggcuccgccgccgacuucgaguuccucggggugaagaucccccgcuaccgggacuacaccccgagcucccugcugaaggacgccacccucauccaccagagcgucacgggccuguacgagacccgcaucgaccuggcgaagcugggggagggcuga

SEQ ID NO: 2071 - RNA, 4167 nt, Artificial Sequence
  Cas9 variant
augaccaagcccuacagcaucggccuggacaucgggaccaacuccgugggcugggccgucaucacggacaacuacaaggugccgagcaagaagaugaaggugcucgggaacaccuccaagaaguacaucaagaagaaccugcugggcguccuccuguucgacagcgggaucaccgccgagggccgccggcugaagcgcaccgcgcggcgccgguacacgcgccggcgcaaccggauccucuaccugcaggagaucuucuccaccgagauggccacccuggacgacgccuucuuccagcgccucgacgacagcuuccuggugcccgacgacaagcgggacuccaaguaccccaucuucggcaaccugguggaggagaaggucuaccacgacgaguuccccaccaucuaccaccuccgcaaguaccuggccgacagcacgaagaaggccgaccugcggcucguguaccuggcgcuggcccacaugaucaaguaccgcgggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgugaaggacaagaucuccaagcuggagaagaaggaccggauccucaagcuguucccgggggagaagaacagcggcaucuucuccgaguuccugaagcucaucgucgggaaccaggccgacuuccgcaagugcuucaaccuggacgagaaggcgagccugcacuucuccaaggagagcuacgacgaggaccucgagacccugcugggcuacaucggcgacgacuacuccgacguguuccucaaggccaagaagcuguacgacgccauccugcucagcggguuccugaccgugacggacaacgagaccgaggcgccccugagcuccgccaugaucaagcgguacaacgagcacaaggaggaccucgcccugcugaaggaguacauccgcaacaucagccucaagaccuacaacgaggucuucaaggacgacaccaagaacggcuacgccggguacaucgacggcaagacgaaccaggaggacuucuacguguaccugaagaaccugcucgccgaguucgagggcgccgacuacuuccuggagaagaucgaccgggaggacuuccugcgcaagcagcggaccuucgacaacggguccauccccuaccagauccaccuccaggagaugcgcgccauccuggacaagcaggcgaaguucuaccccuuccuggccaagaacaaggagcgcaucgagaagauccugaccuuccggaucccguacuacgugggcccccucgcccgcgggaacagcgacuucgccugguccauccggaagcgcaacgagaagaucacccccuggaacuucgaggacgucaucgacaaggagagcuccgccgaggcguucaucaaccggaugacgagcuucgaccuguaccugcccgaggagaaggugcucccgaagcacucccugcuguacgagaccuucaacguguacaacgagcucaccaagguccgcuucaucgccgagagcaugcgggacuaccaguuccuggacuccaagcagaagaaggacaucgugcgccuguacuucaaggacaagcggaaggugaccgacaaggacaucaucgaguaccuccacgccaucuacggcuacgacgggaucgagcugaagggcaucgagaagcaguucaacagcucccugagcacguaccacgaccuccugaacaucaucaacgacaaggaguuccuggacgacuccagcaacgaggccaucaucgaggagaucauccacacccucaccaucuucgaggaccgcgagaugaucaagcagcggcuguccaaguucgagaacaucuucgacaagagcguccugaagaagcucucccgccggcacuacaccggcugggggaagcugagcgccaagcugaucaacggcauccgcgacgagaaguccgggaacacgauccucgacuaccugaucgacgacggcaucagcaaccggaacuucaugcagcugauccacgacgacgcgcucagcuucaagaagaagauccagaaggcccagaucaucggggacgaggacaagggcaacaucaaggagguggugaagucccugcccggcagccccgccaucaagaaggggauccugcaguccaucaagaucgucgacgagcucgugaaggucaugggcgggcgcaagcccgagagcaucgugguggagauggcccgggagaaccaguacaccaaccagggcaaguccaacagccagcagcgccugaagcggcuggagaagucccucaaggagcuggggagcaagauccugaaggagaacaucccggcgaagcucuccaagaucgacaacaacgcccugcagaacgaccgccuguaccucuacuaccugcagaacggcaaggacauguacaccggcgacgaccuggacaucgaccgccucagcaacuacgacaucgaccacaucaucccccaggccuuccugaaggacaacuccaucgacaacaagguccuggugagcuccgccagcaaccgggggaaguccgacgacuuccccagccucgagguggucaagaagcgcaagaccuucugguaccagcugcucaagagcaagcugaucucccagcggaaguucgacaaccugacgaaggccgagcgcggcgggcugcuccccgaggacaaggcgggcuucauccagcggcagcugguggagacccgccagaucaccaagcacguggcccggcugcucgacgagaaguucaacaacaagaaggacgagaacaaccgcgccguccggaccgugaagaucaucacgcucaagagcacccuggugucccaguuccgcaaggacuucgagcuguacaagguccgggagaucaacgacuuccaccacgcccacgacgccuaccugaacgcggugaucgccagcgcccugcucaagaaguacccgaagcuggagcccgaguucguguacggcgacuaccccaaguacaacuccuuccgcgagcgcaagagcgccaccgagaaggucuacuucuacuccaacaucaugaacaucuucaagaaguccaucagccuggccgacgggcgggugaucgagcggccccucaucgaggugaacgaggagaccggcgagagcgucuggaacaaggaguccgaccuggcgaccgugcgccgggugcugagcuacccgcaggucaacguggugaagaaggucgaggagcagaaccacgggcucgaccgcggcaagcccaaggggcuguucaacgccaaccuguccagcaagcccaagcccaacuccaacgagaaccucgugggcgccaaggaguaccuggacccgaagaaguacggcggguacgccggcaucagcaacuccuucgcggugcuggucaaggggacgaucgagaagggcgccaagaagaagaucaccaacgugcucgaguuccaggggaucagcauccuggaccggaucaacuaccgcaaggacaagcugaacuuccuccuggagaagggcuacaaggacaucgagcugaucaucgagcuccccaaguacucccuguucgagcugagcgacggcagccggcgcaugcucgccuccauccugagcaccaacaacaagcgcggggagauccacaagggcaaccagaucuuccugucccagaaguucgugaagcuccuguaccacgccaagcggaucagcaacaccaucaacgagaaccaccgcaaguacgucgagaaccacaagaaggaguucgaggagcuguucuacuacauccucgaguucaacgagaacuacgugggggccaagaagaacggcaagcugcugaacuccgcguuccagagcuggcagaaccacuccaucgacgagcucugcagcuccuucaucgggcccacgggcagcgagcggaagggccuguucgagcugaccucccgcgggagcgccgccgacuucgaguuccucggcgugaagaucccgcgguaccgcgacuacacccccuccagccugcugaaggacgccacccucauccaccaguccgucacggggcuguacgagacccggaucgaccuggccaagcugggcgagggguga

SEQ ID NO: 2072 - RNA, 4167 nt, Artificial Sequence
  Cas9 variant
augaccaagcccuacagcaucggccuggacaucgggaccaacuccgugggcugggccgucaucacggacaacuacaaggugccgagcaagaagaugaaggugcucgggaacaccuccaagaaguacaucaagaagaaccugcugggcguccuccuguucgacagcgggaucaccgccgagggccgccggcugaagcgcaccgcgcggcgccgguacacgcgccggcgcaaccggauccucuaccugcaggagaucuucuccaccgagauggccacccuggacgacgccuucuuccagcgccucgacgacagcuuccuggugcccgacgacaagcgggacuccaaguaccccaucuucggcaaccugguggaggagaaggccuaccacgacgaguuccccaccaucuaccaccuccgcaaguaccuggccgacagcacgaagaaggcggaccugcggcucgucuaccuggcccuggcccacaugaucaaguaccgcgggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgugaaggacaagaucuccaagcuggagaagaaggaccggauccucaagcuguucccgggggagaagaacagcggcaucuucuccgaguuccugaagcucaucguggggaaccaggcggacuuccgcaagugcuucaaccuggacgagaaggccagccugcacuucuccaaggagagcuacgacgaggaccucgagacccugcugggcuacaucggcgacgacuacuccgacgucuucaucaaggccaagaagcucuacgacgccauccugcugagcggguuccucaccgugacggacaacgagaccgaggccccgcugagcuccgcgaugaucaagcgguacaacgagcacaaggaggaccuggcccuccugaaggaguacauccgcaacaucagccugaagaccuacaacgagguguucaaggacgacaccaagaacggcuacgccggguacaucgacggcaagacgaaccaggaggacuucuacgucuaccucaagaaccugcuggccgaguucgagggcgccgacuacuuccucgagaagaucgaccgggaggacuuccugcgcaagcagcggaccuucgacaacggguccauccccuaccagauccaccuccaggagaugcgcgcgauccucgacaagcaggccaaguucuaccccuuccuggccaagaacaaggagcgcaucgagaagauccugaccuuccggaucccguacuacgugggcccccuggcccgcgggaacagcgacuucgccugguccauccggaagcgcaacgagaagaucacccccuggaacuucgaggacgugaucgacaaggagagcuccgcggaggccuucaucaaccggaugacgagcuucgaccucuaccugcccgaggagaagguccugccgaagcacucccuccuguacgagaccuucaacguguacaacgagcugaccaaggugcgcuucaucgccgagagcaugcgggacuaccaguuccucgacuccaagcagaagaaggacaucguccgccuguacuucaaggacaagcggaaggugaccgacaaggacaucaucgaguaccugcacgccaucuacggcuacgacgggaucgagcucaagggcaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgcgagaugaucaagcagcggcucuccaaguucgagaacaucuucgacaagagcgugcugaagaagcugucccgccggcacuacaccggcugggggaagcucagcgcgaagcugaucaacggcauccgcgacgagaaguccgggaacacgauccuggacuaccucaucgacgacggcaucagcaaccggaacuucaugcagcugauccacgacgacgcccugagcuucaagaagaagauccagaaggcccagaucaucggggacgaggacaagggcaacaucaaggaggucgugaagucccuccccggcagccccgccaucaagaaggggauccugcaguccaucaagaucguggacgagcuggucaaggugaugggcgggcgcaagcccgagagcaucgucguggagauggcgcgggagaaccaguacaccaaccagggcaaguccaacagccagcagcgccucaagcggcuggagaagucccugaaggagcucgggagcaagauccugaaggagaacaucccggccaagcuguccaagaucgacaacaacgcccuccagaacgaccgccuguaccuguacuaccuccagaacggcaaggacauguacaccggcgacgaccuggacaucgaccgccugagcaacuacgacaucgaccacaucaucccccaggccuuccucaaggacaacuccaucgacaacaaggugcuggucagcuccgccagcaaccgggggaaguccgacgacuuccccagccuggagguggugaagaagcgcaagaccuucugguaccagcuccucaagagcaagcugaucucccagcggaaguucgacaaccugacgaaggcggagcgcggcgggcugcugcccgaggacaaggccggcuucauccagcggcagcucgucgagacccgccagaucaccaagcacguggcccggcugcuggacgagaaguucaacaacaagaaggacgagaacaaccgcgccgugcggaccgucaagaucaucacgcucaagagcacccuggugucccaguuccgcaaggacuucgagcuguacaaggugcgggagaucaacgacuuccaccacgcccacgacgcguaccucaacgccgucaucgccagcgcccugcugaagaaguacccgaagcucgagcccgaguucguguacggcgacuaccccaaguacaacuccuuccgcgagcgcaagagcgccaccgagaagguguacuucuacuccaacaucaugaacaucuucaagaaguccaucagccuggcggacgggcgggucaucgagcggccccugaucgaggugaacgaggagaccggcgagagcguguggaacaaggaguccgaccucgccaccguccgccgggugcugagcuacccccaggugaacgucgugaagaagguggaggagcagaaccacgggcuggaccgcggcaagcccaaggggcuguucaacgccaaccuguccagcaagcccaagcccaacuccaacgagaaccuggucggcgccaaggaguaccucgacccgaagaaguacggcggguacgcgggcaucagcaacuccuucgccgugcuggugaaggggacgaucgagaagggcgccaagaagaagaucaccaacguccuggaguuccaggggaucagcauccucgaccggaucaacuaccgcaaggacaagcugaacuuccugcucgagaagggcuacaaggacaucgagcugaucaucgagcugcccaaguacucccucuucgagcugagcgacggcagccggcgcaugcuggccuccauccucagcaccaacaacaagcgcggggagauccacaagggcaaccagaucuuccugucccagaaguucgugaagcugcucuaccacgccaagcggaucagcaacaccaucaacgagaaccaccgcaaguacguggagaaccacaagaaggaguucgaggagcuguucuacuacauccuggaguucaacgagaacuacgucggggcgaagaagaacggcaagcuccugaacuccgccuuccagagcuggcagaaccacuccaucgacgagcugugcagcuccuucaucgggcccacgggcagcgagcggaagggccucuucgagcugaccucccgcgggagcgccgccgacuucgaguuccugggcgugaagauccagcgguaccgcgacuacaccccguccagccuccugaaggacgccacccugauccaccaguccgugacggggcucuacgagacccggaucgaccuggcgaagcugggcgagggguga

SEQ ID NO: 2073 - RNA, 4167 nt, Artificial Sequence
  Cas9 variant
augaagcgcauccugggccucgaccuggggaccaacagcaucggcugggcccuggugaacgaggccgagaacgagaaggagaucuccaagaucaucaagcucgggguccgggugaacccccugaccaucgacgagaagacgaacuucgagaagggccgcccgcugagcaccaacgcggaccggacccucaagcgcggggcccggcgcaaccugcagcgguacaagcugcgccgggagaaccucaucgagauccugaucgacaaccacaucaucaccaaggagacgccccugaccgagaucggcaagggcaccaccuaccagacgcucucccugcgcgccaaggccgugcgggagcgcaucgaccuggaggacuucgccaagguccuccuggcgaucaacaagaagcggggguacaagagcucccgcaaggccagcaacgacgaggagggccaggccaucgacgggauggccaucgcgaaggagcuguacgagcggggcaucacccccgggcaguacgugcucgagcugcuggagaacgaccgcaaguacauccccgacuucuaccgguccgaccucaagcaggaguucaacaagaucuggaacaaccagaagaccuucuacccggagauccugaccgacgagcuguucaaggagcucgacggcaagaacaagagccagacgugggccaucugccagaagcccuucaacaucaagggcaucaagcgcaucaccaaggggcgggagaagaccaucgagaacuaccacuggcgcgugaagggccuguccgggaagcugaaccucgagaagcuggccaucauccugcaggagaucaacaacgacaucaaccagagcuccggcuaccucggcgggaucagcgacaaguccaagaagcuguaccugaacaaggagaccgucggcgaguuccucuacaagcagaucgccaagaacccccacacgagccugaagaaccagguguucuaccggcacgacuaccuggacgaguucgagcagaucuggaagacccaguccaacuucaacgccaaccucaccgacgagcugaagcaggagauccgcgacgugaucaucuucuaccagcgcaagaucaagagccagaagucccugaucagcuucugccaguucgaguccugggagcaggaguacuucgacaaggagaccgggaagacgaagacccggaccgucggccgccgggugauccccaagagcagcccccucuuccaggaguucaagaucuggcagaaccugaaccaccugguguucaccaacuccgagacggacgagaagaucgagaucaaggaggucgagcaggagauccgcaaggagcuguucgaggagcugaaccugcgcggggaccucaaccccaacgaccugcugaagauccuccggagccaguucaagaucggcaagcuguccaacuggaagugcaacuucgagaagaucgagggcaaccggaccaacgcggcccuguucaacaucuaccagaagaucagcgacuucgagggguacggcaucgacuggaacaaguccaacgccaagaagauccgcaaggagcugaaggccaccuuccccgagaucgggaucgacgccagcauccucgaguucgacgcguacaagaagcagcugaccaaccaguccagcuacgagcuguggcaccuccuguacuccgccgaggaggacuucaagaucagcgagcaggacaagcugaucuacggcaacuccagcgugucccucaagaagaagcugcaccugaaguucggguucaaccccgaguacgccaagaugcucgccaaccugagccugauguccgacuacggcaaccucagcgccaaggcgaucaagaagauccugccguaccuggaggacggccaccucuacuccgaggccugccggcuggccggguacaaccacagcaagucccugacggccgaggagcucgagaaguucgagcccaaggccaagcuggaccugcucaagaagaacagccugcgcaaccccguggucgagaagauccugaaccagauggugaacguggucaaccaggugaucgacaccuacggcaagcccgacggggugcggaucgagcucgcgcgcgagcugaagaaguccgccaaggagcgggccgagaugaccaagggcaucgccgacgggacccgccggaacgaggagaucaagaagaucaucacgcagaaguucggcaucccgaaccccaccaaguccgaccugguccgcuaccggcucuggcaggagcuggagagccgcggcuacaaggacaucuucaccgacaaguacaucucccccgacaagaucuucagcuccgagaucgacaucgagcacaucauccccaaggcgcuccucuucgacgacagcuucuccaacaagacccugagcuuccggaacgugaaccugaagaaggccaaccgcacggcccucgacuucaucacccaggacuaccaguccaacguggaggccuacaaggagcgcgucgagaccuggaacaaggacaaccacaucagcaaggggaagcggaacaagcugcugaugucccucaaggacaucccggacggcuucaucgagcgcgaccugcggaacagccaguacaucgcccgcaaggcgaagcggaugcuguacgagguguuccccaacgagguccucgccaccuccgggagcaucaccgacaagcugcgcuccgacugggaccugaucaacgugaugaaggagcucaaccugcccaaguacaaggcccugggccucacggaguacgaggagcggcuggacaagggcaccgaggagcuguucaagcacgaggugaucaaggacuggaccaagcgcaacgaccaccggcaccacgccauggacgcccucgcggucgccuucaccacgcacaaccacauccaguacaucaacaaccugaacgcccgcaaggacaucacccaggacaaccaccccaucaucaagaacaucgagaaccugaucaccgaggugaacagcaaggggaagcggguguucaaggccccgauguccagcuuccgcgagagcgccaaggagcagaucgaggcgauccucgucuccuucaagaacaagaacaagguggugaccaagaacaucaaccagacgaagaaggagggcggguucaacuaccagaacgccaagaccccgcggggccagcugcacaaggagaccaucuacggcaagagcaagcagccccuggagaagcccgucaagaucaacaaccgcuucugcaagaagcaggucgggcucaucaucaacuucaaggagcaggaggccgugcugcaccaccugaagaaguacgacaacaacgagaagaucgccuucuccaacaagacccucaagagcgacccgauccaggugaacggcagcccccugcgggaggugaagaucuucgaggagaucuucacgauccgcaaggacaucaaccccgacaacuucaagacccagaagcaccuggacaagaucaucgacaaggggaucaaggaggugaugaagaagcggcucgaggaguacaacggcgacuucaagaccgcguucagcgaccuggacaagaacccgaucuggcugaaccaguccaaggggaucaccaucaagcgcgccacgaucagcggcgucaccaacgccgagccccuccaccaggccaaggaccaccuggggaacaucauccuggacgacaacggcaaggagauccccaucgacuacguguccaccggcaacaaccaccacguggccaucuaccaggacgagagcgggaaccuccaggaggaggucguguccuucuacgaggcggugauccggaagaaccaggaccagcccaucaucaagaagcgccacccgaagggcuggaaguuccuguucaccaugaagcagaacgagauguucgucuucagcuccgagaacuucaaccccagcgagaucgaccugcucgacgagaagaacgccgccaucaucucccccaaccuguuccgggugcagaagaucgccacgaagaacuacauguuccgccaccaccuggagaccgaggugaccaacaaccucgacuucaccuaccgccacuuccaggccacggaguggcugcggaaccugugcaagguccgcaucgaccacaucgggcggaucgugcagaucggcgaguacuga

SEQ ID NO: 2074 - RNA, 4170 nt, Artificial Sequence
  Cas9 variant
augaucauccgcaccuacgagcugaagaccaucacgaccaucgccauccucaagauguuccagcugcugaccggcgggcucagcaugaccaagcugggcaagcccuacgggaucggcguggacaucggguccaacagcaucggcuucgccgcggucgacgagaacucccaccugauccggcucaagggcaagacggugaucggggcccgccuguucgaggagggcaaggccgccgccgaccggcgcgcgagccggaccacccgccggcgccugucccggaaccgcuggcggcucagcuuccugcgcgacuucuucgagucccacaucaccccgacggggcccaacuucuucaugcggcagaaguacagcgagaucucccccaaggacaaggcccgcuacaaguacgagaagcggcuguucaacgaccgcaccgacgccgaguucuaccagcaguaccccaccauguaccaccuccggaaccgccugcugaccgacccgagcaaggccgacgugcgggagaucuacuucgcgauccaccacauccucaagucccgcggccacuuccugacgagcggguacgccaaggacuucaacaccaacaaggucgcccugaacgagaucuuccccgcccuccaggacgccuacgcccagguguaccccgaccuggacaucaccuucgacgagaacaaggugaacgaguucaagaccguccugcucaacgagaaggcgacgcccuccgacacccagcgggcccuggugaaccugcuccuggccgaggacggcgacaaggacauccugaagcagcagaagcagguccucaccgaguucgccaaggcgguggugggccugaagaccaagcugaacguggcccucgggacggaggucgacagcuccgaggccaccguguggaacuucagccugggccagcuggacgacaagugggccgggaucgaguccgccaugaccgacgagggcaccgagauccucgaccagauccgcgaccuguaccgcgcgcggcugcucaacggcaucgugccggccgggaagacgcugagccaggccaaggucgacgacuacgcccagcaccacgaggaccuggagcuguucaaggacuaccugaagcagcuggaggacgacggcaccgccaaggcgauccgccagcucuacgaccgguacaucgacggggacgacgccaagcccuucgugcgcgaggacuucgugaaggcccugaccaaggaggucaccgcccaccccaacgcgaagucccccgagcugcucgagcggcuggcccagccggacuucaugcugaagcagcgcaacaaggccaacggcgccauccccgugcagaugcagcagcgggagcucgaccagaucaucaagaaccagagcguguacuacgacuggcuggccgcgcccaaccccgucgagaagcaccgcaagagcaugccguaccagcuggacgagcugcucaacuuccggauccccuacuacguggggccccuggugacggccaaggagcagaaggccgcccagggcggcgucuucgccuggauggugcgcaaggaccccgacgggaacaucaccccguacaacuucgacgagaaggucgaccgggaggcguccgccaacaccuucauccagcgcaugaagaccacggacaccuaccugaucggcgaggacgugcuccccaagcagagccugcuguaccagcgguacgaggugcucaacgagcugaacaacguccgcgugaacaacgagaagcuguccaucgagcagaagcagcaggucauccgggagcuguucgagcgccacaacagcgugaccaucaagcaguucgccgagaaccuccgggcccacggggacuacgcccacauccccgagauccgcggccuggcggacgagaagcgguuccucuccagccuguccaccuaccgccagcucaagagccuccugcccgacgccaucgacgacccggccaagcaggccgacaucgagaacaucaucgcgugguccacgguguucgaggacgccgccaucuucaagaccaagcugaaggagaucaacuggcucgacagccagaccaucaccaagcuguccaacauccgcuaccggggguggggccaguucagccacaaguuccugaacggccucacccuggggaacggccacacgaucauccaggagcuguuccucuccaacaacaaccugaugcagauccugaccgacgagacccuccagaagaagaugaccgagcugaacgccgacaagcugaaggccgcgaacaucaacgacgccaucgacgacgccuacacgagccccuccaacaagaaggcccuccgccaggugcugcgggucaucgaggacaucaagcgcgccgcggacgggcaggaccccagcuggcuguacguggagaccgccgacggcgggggcacccccggcaagcggacccgcgcccggcagcaccagcuccaggagaucuacgccaacgccgcgcacgagcugaucgacuccgccgugcgcggggagcuggaggacaagaucgccgacaaggccgacuucaacgaccggcucguccuguacuucaugcagggcgggcgcgacaucuacacgggcaccccgcugaacaucgaccagcucagcuccuacgacaucgaccacauccugccccagagccugaucaaggacaacagccucgacaaccgggugcuggugcacgcgaucaucaaccgcgagaagaacgccaccuucgccuccaccaucuacgcccagaagaugaacgccacguggcggcaguggcacgaggcgggccugaucagcgggcgcaagcuccggaaccugcagaugcgccccgaccagaucgacaaguacgccuccggcuucgucgcccggcagcugguggagacccgccagaucaucaagcucaccgagcagaucguggccgcccaguacccggagaccaagaucaucgcggucaaggccgggcugagccaccagcugcgggaggagcucgaguuccccaagaaccgcgacgugaaccacuaccaccacgccuucgacgccuuccuggccgcgcggaucggcacguaccugcucaagcgcuuccccaaccugcaggccuucuucaccuacgggaaguucaagaaggccgacgugaagaagcugcgcggcuucaacuucauccgggacaucacccacgccgaggacaagaucgucgugaaggacaccggcgaggugaucugggacaagaagcgcgacgucgacgagcucgaccggaucuacaacuucaagcgcaugcugaucacgcacgaggugcacuucgagaaggccgaccuguucaagcagaccguguacggggcgaaggacuccaaggaggccggcgggaagaagcagcucaucagcaagaagaagggcuaccccgucgacaucuacgggggcuacacccaggagaccggcuccuaccugagcguggugcggcugacgaagaaggccauguacgccgucgugaagguguccacccgcgacgcggccaagcucgccgucgccaagagcaucuccgagcagaaggagaacgagacccugaacgacaucaucgacgagaagcugagcaagaucuccaagaacgggaagaucacccacgagcuguucgagguggugcucccgcgggucggccagaagacgcuguucaagaacagcaaguacaaccucuuccuggugaacuccgacaccuacaugcacaacuaccaggagcuguggaugccccgcgaguaccagaagauguggaaggacaucagccucuccaaguacggggacgcccagaccgaggaccagcuggaccagaucuucggcuucaucgugagccaggucaacagcuacuucaaccuguacgacaucaaccaguuccggaagaagcucaacgacgcggccgacaaguucgccacccugcccaugcgcgacacggacgacaugcaggggaagaucgccaccaucggccagcugcucaucggccugcaggccaacgcggcccgguccgaccugcgcaaccucgacaucaagacgccccuggggcugcuccagaucccgaacggcaucagccuggacuccgacaccagcgugguguaccagucccccaccgggcugcucgagcgggagguccaccugagcgaccuguga

SEQ ID NO: 2075 - RNA, 4170 nt, Artificial Sequence
  Cas9 variant
auggcccgcgacuacagcgugggccuggacaucgggaccuccagcgucggcugggccgcgaucgacaacaaguaccaccucauccgggccaaguccaagaaccugaucggggugcgccuguucgacagcgccgugaccgccgagaagcggcgcggcuaccggacgacccgccggcgccucucccggcgccacuggcggcugcgccugcucaacgacaucuucgccgggccccugaccgacuucggcgacgagaacuuccuggcgcggcucaaguacagcuggguccacccgcaggaccaguccaaccaggcccacuucgccgccggccugcuguucgacagcaaggagcaggacaaggacuucuaccgcaaguaccccaccaucuaccaccuccggcuggcgcugaugaacgacgaccagaagcacgaccuccgcgagguguaccuggccauccaccaccuggugaaguaccgggggcacuuccucaucgagggcgacgucaaggccgacuccgccuucgacgugcacacguucgccgacgcgauccagcgcuacgccgagagcaacaacuccgacgagaaccugcuggggaagaucgacgagaagaagcucagcgccgcccugaccgacaagcacggcuccaagagccagcgggccgagaccgcggagaccgccuucgacauccuggaccuccaguccaagaagcagauccaggccauccucaagagcguggucgggaaccaggccaaccugauggccaucuucggccuggacuccagcgcgaucuccaaggacgagcagaagaacuacaaguucagcuucgacgacgccgacaucgacgagaagaucgccgacagcgaggcccugcuguccgacacggaguucgaguuccucugcgaccugaaggccgcguucgacggccugacccucaagaugcugcugggggacgacaagaccgugagcgccgccauggugcgccgguucaacgagcaccagaaggacugggaguacaucaagucccacauccgcaacgccaagaacgcgggcaacgggcucuacgagaaguccaagaaguucgacggcaucaacgccgccuaccuggcccugcagagcgacaacgaggacgaccgcaagaaggccaagaagaucuuccaggacgagaucagcuccgcggacauccccgacgacgucaaggccgacuuccucaagaagaucgacgacgaccaguuccugcccauccagcggaccaagaacaacggcacgaucccgcaccagcugcaccgcaacgagcucgagcagaucaucgagaagcaggggaucuacuaccccuuccugaaggacaccuaccaggagaacagccacgagcugaacaagaucaccgcccucaucaacuuccgggugcccuacuacgugggcccccuggucgaggaggagcagaagaucgccgacgacgggaagaacaucccggaccccaccaaccacuggauggugcgcaaguccaacgacacgaucacccccuggaaccugagccagguggucgaccucgacaaguccggccggcgcuucaucgagcggcugaccgggaccgacacguaccugaucggcgagcccacccugccgaagaacagccuccuguaccagaaguucgacgugcugcaggagcucaacaacauccgcguguccggccggcgccuggacauccgggccaagcaggacgcguucgagcaccuguucaagguccagaagaccgugagcgccaccaaccucaaggacuuccuggugcaggccggguacaucuccgaggacacgcagaucgagggccuggccgacgucaacgggaagaacuucaacaacgcccucaccaccuacaacuaccuggugagcguccugggccgcgaguucguggagaaccccuccaacgaggagcuccuggaggagaucaccgagcugcagacgguguucgaggacaagaagguccuccggcgccagcuggaccagcuggacgggcucagcgaccacaaccgggagaagcugucccgcaagcacuacaccggcuggggccggaucagcaagaagcugcucaccaccaagaucgugcagaacgcggacaagaucgacaaccagacguucgacgugccccgcaugaaccagagcaucaucgacacccuguacaacaccaagaugaaccugauggagaucaucaacaacgccgaggacgacuucgggguccgggccuggaucgacaagcagaacaccacggacggcgacgagcaggacguguacucccucaucgacgagcuggccgggcccaaggagaucaagcgcggcaucgugcagagcuuccgcauccuggacgacaucaccaaggcggucggguacgccccgaagcggguguaccucgaguucgcccgcaagacccaggagucccaccugaccaacagccggaagaaccagcuguccacccuccugaagaacgccggccugagcgagcucgugacgcaggucucccaguacgacgccgcggcccugcagaacgaccgccuguaccucuacuuccugcagcagggcaaggacauguacagcggggagaagcugaaccucgacaaccuguccaacuacgacaucgaccacaucaucccccaggccuacaccaaggacaacagccuggacaaccgggugcucguguccaacaucaccaaccgccgcaagagcgacuccagcaacuaccugcccgcccugaucgacaagaugcggcccuucugguccguccucagcaagcagggccugcuguccaagcacaaguucgccaaccucacccggacgcgcgacuucgacgacauggagaaggagcgguucaucgcgcgcagccugguggagacccggcagaucaucaagaacguggccagccugaucgacucccacuucgggggcgagaccaaggccgucgccauccgcagcucccucaccgccgacaugcggcgcuacguggacaucccgaagaaccgggacaucaacgacuaccaccacgcguucgacgcccugcuguucagcacggugggccaguacaccgagaacuccgggcucaugaagaagggccagcugagcgacuccgccgggaaccaguacaaccgcuacaucaaggaguggauccacgccgcgcggcugaacgcccagagccagcgcgucaaccccuucggcuucguggugggguccaugcggaacgccgcccccggcaagcucaaccccgagaccggcgagaucaccccggaggagaacgccgacuggagcaucgcggaccuggacuaccugcacaaggucaugaacuuccgcaagaucacggugacccgccggcucaaggaccagaaggggcagcuguacgacgagucccgcuaccccagcgugcugcacgacgccaaguccaaggccagcaucaacuucgacaagcacaagcccgucgaccucuacggcggguucuccagcgccaagcccgccuacgcggcccugaucaaguucaagaacaaguuccggcuggugaacgugcuccgccaguggaccuacuccgacaagaacagcgaggacuacauccuggagcagauccggggcaaguacccgaaggccgagaugguccugucccacauccccuacgggcagcucgugaagaaggacggcgcccuggugaccaucagcagcgccacggagcugcacaacuucgagcagcucuggcugccccuggcggacuacaagcucaucaacacccugcugaagaccaaggaggacaaccucgucgacauccugcacaaccgccuggaccucccggagaugaccaucgaguccgccuucuacaaggccuucgacagcauccuguccuucgccuucaaccgguacgcccugcaccagaacgcgcucgugaagcugcaggcccaccgcgacgacuucaacgcccugaacuacgaggacaagcagcagacgcucgagcggauccuggacgcccugcacgcgagccccgccuccagcgaccucaagaagaucaaccuguccagcggcuucgggcgccuguucucccccagccacuucacccucgccgacaccgacgaguucaucuuccaguccgugaccggccuguucagcacgcagaagaccgucgcccagcuguaccaggagaccaaguga

SEQ ID NO: 2076 - RNA, 4170 nt, Artificial Sequence
  Cas9 variant
augaagaacuacaacaucagccuggugcccuccccgagcggcgucggguacgccgugaccgacgacaaccucaacaucaucaagcccgugcaccacgucuccggcaucgggagccgccuguucaacgagggcuccagcaagcaggaccggcgcaacucccggagcgcccgccggucccgccaccggcagcaggggcgcaucaaggcgcugaacagcaucaugaaggacgagaucaucaagguggaccccaccuucuucgaccggcucuaccaguccgagcugagcccccuggacaagaacaagaaguaccgcaacaucaucuucgacaagccguccguggagagcuacuacuacaagaaguuccccacgaucuaccaccucgagaaguaccugaucaacaccgacggcaaggccgacauccggcugaucuacugggcccuccacucccugcugacccaccgcggccacuucuacaacaccacgcccgucagccaguucaagcccggggcccucaacaucaaggacaaguucaucgagcugaaccagcugaaccaggugaagaccuucgaguucuccguggccaacaccccggagaucgagcacauccucaaggaccgguacaucagcaagcagaacaagaucaaccagcuggcggagcuccucuucgagcaggagcccgagaaggacauccagaaggccaacaccaaggucgccaagacgaucgccaaggcgauccugggcaacaaguuccagcuggacgagaucaucgggcucgacgugaacaaguccgagaagaaggaguggagccugcagcugagcgaccucaaccuggacuccaagaucgacgagcugagcgacucccucaccgaccagcagcugcgcauccuggagauccuccaggagauguacgccgccaccacccugcuggacauccuccagggcagcgacucccugcuggacgccaagaucaagagcuacaacgaguacaagcagaaccggcuccuguucuucgaccugcucaagacgcugcccgacaagaaggcccaccuccugcgccagggguacacccuguaccugaacaaccaccaccgggaccucgcguccgcccgcaaggaccugggcaucguggccgccaccaacuucagcaagaccgaccuguacgcccucaucaagaagacgcugaaggacgagcccgagaccccggaguccaagaagguccugggccugaucgacaagggggaguuccucaacaagcagcggaccgaccugaacaccuacauccccuaccagcugaacgcgcucauccugaacaagauccugaagaaccagggcaagcacuaccccuuccucaucaaggagaaccccgccgagccggaccgcaaggaggcccccuacgagaucagccagcugaugcaguucacgauccccuacuacugcgggccccuggccaccccggaggagcagaagaaccuccccgaguccagccgguucggcuggcuggugcgcaaggaggagggccgcaucacccccuggaacuucuacaacaagaucaacgugaucgagaccgccaacgcguucaucaagcgguccaucgggaaggacacguaccugcucagcgagcccguccugccggacaacucccugcucuaccagaaguacaaggugcugaacgagcugagcuccaucagccucguggacgccaacaccaagaaggagaagaagcugaccgccaagaucaagcagcugcucuacaaggagggcuucaagaagcacgucaccguguccaagacgauggcccugaagauccugaacgacaacaacgugcccaccagcgacauccucgggcugagcaccggcaagaaguucgacaacucccugagcaccuacaacuccuggaagaaggccuuccccgagcagaucgacaacccccacuaccgccaggaccucgaguacaugaucgaguggagcacggucuucaccgaccggaagauccugguggagaagcugaaggagaucgaguggcuccgcccggagcagaucaaguucgugcuggagcaccggcugaccggguggggcaagcucuccaagcgccugcuggucgagcucaaggacaacaagggcaagagcaacaucgacaaccuguucaacaccaagaagaacuucaugcagaucgugucccagcaggucuacaacacgcagaucgaggcgaucgcccugaagaccaccaagaaccagagccucgacaacauccuggaggccgccuacaccucccccgcgaaccggaaggccauccgccagaccaugaagguggugaacgagaucgucacgcuggccgggaagggcacccaccccgacaagaucuuccucaccuuccagcggagcaaggagcaggaggggaagcugaccacggaccgcgccuccagccugcucaagaucuaccggggcaucaaggacccgcugugcaccaaggagcugguggacgagcucuccaagaacgugcgcgccaaccugaucaagaccaaggaguaccuguacuaccagcagcucgggcgggacgcgcugaccggcgagaucaucgacaagacggaccugcgcaacuacgccguccuccacaucaucccccggagcgugguggucgacgacuccaucaacaaccuggugcugaccaaggugaagaacgccaaggagagcaucgucgugcaguacggcuccaagaacaucagcgacaucagcauguccgugaaggacuucuggaaccgccuccagaagcuggggcuguucagcaagggcaagcuccggaaccugaccaccgaccugacggagcucaaccaguacgagaagcagggguucaucgcccgccagcuggucgagaccaaccagaucgugaagcugcucgccaccauccugcagggccaguucccccacaccaagaucaucgaggugcggcaggagcagaucgcgaacauccgcuaccagcuggacaucuaccgccuccgggaccugaacgucuacuaccgcgggauggacgccuaccuggccgccguggugggcacguaccucuacaccgucuaccccaaggcccggcgcuucuucguguacggcaaguaccugaagcaggacaagaacaaccgggaggaggggcaguucaagaccuccggccacagcuucaacuuccuguggaagcuguucuacgggggcgaggacgagaucuacgugcagggcaccaacaacaucgcguucaacaagaaggaccugcugcagaagaucaaggaggucaacaacuacaaguuccagaacgugucccucgccacggggacccgccggagcgaccuguucaagcagaccaucuacccgcgccaggagcgggacgugaagaagucccgcacccugaucacgaagaagaacggccucuucaccgacaucuacgggggcuacaccgggaacgucaacagcuacuucgugcuggugcagaccaaguacaagaaggaccccgacaaguucaaccuguacggcguccccaaccgguacguggccaugcucgagcaguccaagagcaagggcaacuacgagacgaagcugaaggaggugauggagcccaucaucaagaacuccaacaagcgcaugaucggguacaagauccugaaggaccggauccucuacaaccagaucaucgaggacaacggcuacaaguucuucaucaccagcucccaguaccgccacaacuuccggcagaugauccugagcgaccaguccaagaagauccugauggacuacgucuucgacccgaacuucuaccgccacaagaagaccgaggacgugaacaacgacaaggacgccaagcucaucaagguguacgacgagauccuguaccagaucgaccacuaccugcagaucuucaccaucgggcaccacaucgacaagcucaagaaggcgcggccccuguucgagaagugcacgcuggccgagaaggcccagguccugaacgacauccucaucaucgccggcagcaaccagaccgagcuggcccugaagccccucaagaccaccaagcugacguucuccaagcagaacugcccccugaccaaggacgcgaucuucuacuaccagagcccgaccgggaugaucacccgcaaggaguccaucaaggacauccucaagcagaacaucuga

SEQ ID NO: 2077 - RNA, 4173 nt, Artificial Sequence
  Cas9 variant
augagccgcaagaacaucguggaggacuacgccaucucccuggacaucggcaacgccagcgucggguggguggcguucacccccaacuaccggcucgugcgcgccaagggccacgagcugaucggggcccggcuguucgagccggccuccaccgccgaggagcgccggauggcgcgcacgacccggcgccgguacagccgccggcgcuggcggcuccgcaugcuggacuccauguucgaccaggcccugagcgaggucgaccccuccuuccucaugcggcgcaaguacagcugggugcaccccgaggacaagaacaacgaggcccacugguucggcggggugcuguucgacuccaacgagcaggacaagcgguucuacgagaaguaccccaccaucuaccaccuccgcaagagccugauggaggacgacgagcggcacgacauccgcgaggucuaccuggccauccaccacaugaugaaguaccggggcaacuuccugaccgagggcgagcucgcgccguccagcguguucgacguggaggacuuccugaagcugcucacggagauccugcaguacgccgacgagggggagaccgacgaggaccuggagcuccaggccgacgccaacggccugaccgaggcccugugcaccacgaaggggucccgcagcauccgcgcgaagaacgccaucuccauccucaaggagggcgccgcccugagcaagcggcaggaggccaucaucuccgcggucuucgccgggcuggagggcaacaagcucgaccugaccaagguguuccccaacaaggaguacacccccgaggacaagaagacccuggcccucuacuucaacaaggccgacuacgacgagaagcgcguggccaucggcgacagcgggcugcuggaggacaacgagugcgacuuccucgacugcauccggcgccaguacuccgcgaucgcccugaagcagcugcucggcgacuucacgagcaucagcgaguccaugugcgcccgguacgagcagcaccagcgcaacugggaccugaucaagcgguacugccgcgaggagagcaacgccgagaacaucaacaagaacuacggggcccuggucggcugggagaucgugggcgggcagcggcgcuccauccggggcgcgaaggacuacgagaacaagcgcaaggccgccaacaaguucuucgaggagcucaucaaggggagcgcccugcccgaccaggagaaggagcggcugcuccacgacaucgagaacgacgagcuguucccggugcagcgcgacuccggcaacggggucauccccuaccagcugcaccucaacgagcugaagaagaucauccagaagcagggccgguacuaccccuuccugcucgagaccuacaucaaggacggcaaggaggugaacaagcuggaggggcugcucgcguuccgcgugcccuacuacgucggcccgcuggugagccgggacgacaugcaguccagcgacaaccgcgagaaccacuggaugauccggcgcaagaagggggugaucacccccuggaacuucgacgagauggucgacaaggacaaguccggccacgaguucaucaagagccugguggggaccgacuccuaccugcucggcgagacgacccugcccaagaacagccugcucuaccaggaguucgaggugcugaacgagcugaacaacguccgccucuccauccggaccggcaaccacugggccgacaagcgccgggugcgccuggggcacaacgagaagaagcugcuccuggaggagcuguucgccaagcaggccaccgucacgaagaaggccgcggagaaccuccugcggcgcaccuacggcaacaccuacgagaucagcgggcuggccgacgagaagaaguucguguccagccucuccagcuacggcaagaugugccggacccugaaggccuccuacgugaacagccacaaggacgucguggagaagaucaucgagcugcagacgguguucgaggacaagaagacccucaagcaccagcugcagcugcucggggagcuggccgagaccaacugcgagcugcucagcaacacccacuacacgggcuggggcaagcugucccgcaagcugcucaccagcaaggucguggugugcaagaucgggaacgacuucgcccccgcgaagcacuccaucaucgagaucaugcgggagaccgaccgcaacuucauggagaucaucaccgacaaggaccugggcgucggggaguggaucaaccagcagaacgugggcgccgaggacggcaacagcuaccaggacaucaucgacgaccugcggguguccccgaaggucaagcgcgggaucaaccaggccauccgggugaucgacgacaucagcaaggccgugggcaaggagcccucccgcaucuuccucgagcuggccggggacguccagcagagcgcgcggacggugucccgcaagagccggcugcagggccucuacaaguccgccgggcugcagaaggaguuccgcgaccuggccgagagccucaacgagugcuccgacaacgaccugcgggacgaccgccuguuccucuacuacacccagcugggcaaggacauguacaccggcgagccccugaaccucgaccggcugagcuccgacuacgacaucgaccacaucaucccccaggccgugacccagaacgacagccuggacaaccgcguccucguggcgcgcguggccaacgcccggaagacggacuccuuccaguaccugccggagaucgccaaccgcaugcggaacuucuggcaggagcugcucgacgccgggcugaucagccgcgucaaguucgaccggcugaaccgccagaacgacuucagcucccacgagaaggagcgguucgugcagcgcagccucguggagacccggcagaucaugaagaacgucgcgaccaucaugcgcaagcgguacggcaacuccgccgccgugaucgggcugaacagcgagcugaccaaggagaugcgccaguaccucggcuucucccacaagaaccgggacaucaacgacuaccaccacgcccaggacgcccugugccuggggaucgcgggccaguucgccgugaaccgcggcuucuucgccaacgggauggucagcgacggcgccgugaacuccuacaaccucuaccugcaggacuaccugcggggguaccgcgagaagaugagcgccggcgagcggcgccggaacaaggcguucggguucaucgugggcuccaugaacagccaggacuccgacaagcgcaucaaccccaagaccggcgagaucgccugggacgacgaggacaaggucuaccuccgcaaggugaugaacuaccggaagaugcugaucacgcagaaggugggggacagcuucggcgcccuguacaacgagacccgcuacgggaccuccgccaaggagggcgucaacgggauccccuucgacaagcacaagcaggacaccgcgcucuacggcggcuucagcuccgccaagacgguguacgugguccugaucgaggccaagaagaagacccggcuggugaacaucaccaugcaggaguacgccgagcucggggaccaccccagcgacgacgcccugcgcgcggugcuggccaagaagaagccggaguacggcaaggcccggauccuccugcgccacaucccgcccaugcagcugauccgguacgggggcgcccucgucaccgugaaguccgccacggagcugaacaacgcgcagcagcuguggcuccccuacaaggaguacugccuguucgacgacgugaucagcuccgccaucgacgucgacgaggcccgccugugccagaugcucgacgugauccuggacgccauccagaaguacuaccccaagcagcgguucgacgagaccggccugagcgccuuccacaacgcguucaacgaggugagcgccgaggacaagaagcgcaucgucggggagauggugggcaugcuccacgccgacgccaagaacgccaaccugaaggcgcuggggauguccggccggugggggcgcaugagcaaccaguccggcuacaccuucgccgacagcgacgaguucaucuuccagucccccagcggccucuucgagaagcggaucuccgugggggagcugaagaagcgccgggcccgcuga

SEQ ID NO: 2078 - RNA, 4173 nt, Artificial Sequence
  Cas9 variant
augaaggaggugaaggacuacaucaucggccuggacaucgggaccaacagcugcggcuacgucgugaccgacaagcagaacaacauccucaagcugaaggggaagacggccaucggcgcccgccuguucaaggagggggaggcggccgccgaccggcgcgccuuccggaccacccgccggcgccucgcccggcgccgguggcgccugggccugcucgaggagaucuucgacgaggagauggcgaagguggacuccagcuucuuccggcgccugaaggaguccgacuacagccccaaggacucccggaagcaguucaacagcaucgucuucgaguccagcgaggccgacaaggacuucuacgacaaguacccgaccaucuaccaccuccgcaacgcccucaugcacgacgaccagaagcacgaccugcgggagaucuuccuggccgugcaccacaucgugaaguaccgcggcaacuuccuccgggaggacuccgucaaggcguucaaggccgccaaguucacgcugcagggggaggacggcaucgggcccguggacaagcugaacgaccuccugaaggagaucuacaucgaggccgcccccgagcuggcgaccgacaaccucagcaagaucgaggagaucaucaaggacaagaagcuguacaagcaggacaagcugaagcaggucgccacccuccugaccaaggaggccgacacgaaggacaaggccaagcugaacaaggacguggccaagcaggucgcgaacgccuucaugggcuacaugaucaucuucgacaccaucuucaaccucuccgacguggacagcaaggacuacaaggugaaguucuccgacgccaacaucgacgagaagcuggacacccugaccagccuccugacggacaagcagaccgaguucgugcuggagcuccagaacaucuacaacaccaucgugcugaacgagaucguccccgacgggaagucccugagcgaguccauggugaagaaguacgacgaccacaaggaggaccucaagcuguucaaggccuaccugaacagccucaccgacgugaagaaggucaaggagcugaaggccgcguacgugcuguacgugaacaaccgcaaggccaaccuccuggccgccaagaagcugcucggcaagaaggccgacaacaugaacaacuucgagaucuucuccaaguucgucgcggacaaccuggacgacagcgagcuggccaacaagauccgggcccgccucgaccugggcgaguuccugccgaagcagcggacgaaccagaacggggugauccccuaccagcuccaccagguggagcugacccagauccuggagaagcagggcaaguacuaccccuuccugaucgcccccaacccggucgagagccaccgcaacaacgcgcccuaccgcaucuccgagcucgugagcuuccggguccccuacuacguggggccccugaucgacccgaacaacgccgaguccgagcaggacaaggccaacagcuccuucgccuggauggugcgccagaagcagggccagaucacccccuggaacuucgaggagauggucgacaccacggagagcgccaacaaguucaucaagcggaugaccaccaaggacaccuaccugcucggcgaggacgugcugcccgcguccagccugaucuaccagaaguucgugauccucaacgagcugaacaacaucaaggucaacgggaucaagcugacguccgaggagaagcaccagaucuucgacgagcuguucaaggugcagaaguccgugagccugaagaaccuggucaacuuccucaccgcccacggcugcguggcccccaacgugaccgggcugagcgacggcaccaaguucaacuccagcuacuccacguacaucgacuaccgcaagaucuucggggccgagaucgacaacaaggacaagcaggccgacuucgagaagaugaucgaguggagcaccgucuucgaggaccggaagaucuucaagcgcaagcuggaggagaucaccuggcucaccccggaccagaucaagcaggucuccagcaagcgguacuccggcuggggccgccugagcaagaagcugcucacgcagaucaccgacgagaacggggugaacauccugcagcggcuguggaacgagagcgagaaccucaugcagauccuguccgaccccgugaucaaggagaagaucguggcggccaacagcuccuucaccaaggccaccgacauggaggacauccuggccgaggccuacacgagcccccagaacaagaaggcgauccgccaggugaugcgggucguggacgacaucaucgccgccgcccacggcaagaagcccucccagaucgcgaucgaguucgcccgcgaggaccaggacaacccgcagaugaccaagagccggaaggcccagcucgaccagaucuacgccaagaucuccgacgaguuccuggacaacgccgugaagaacgagcugaagaacaugaaggacaacaagccccucgcgaaggacaaggucuuccuguacuucaagcagauggggcgcgacgccuacaccggcgagaagcugagccucgacaaccugcaggacuacgacaucgaccacaucuacccccaguccuucaucaaggacgacagcuucgacaaccgggugcuggugcagcgcgccgucaacaacgggaaguccgacaacgugcccgugcuccuguucggcaacaagcaggccgccgaccugggcaugaccauccggcagauguggaagaaguggcucgagcuggggcugaucagcaagcgcaaguucaacaaccucaucaccgacccggagaagaucuccagcuacauggcguccggcuucgucaaccggcagcugguggagacgagccaggugaucaagcuggucgccaacauccuccaggccaagcugcccgacaccgagaucaucgaggugaaggccuccuacaacagcauccugcgcaaggaguucaaccucuacaagagccgcgaggugaacgacuaccaccacgccaucgacgcguaccugaccaccaucgucgggaacuaccuguaccagguguaccccaagcuccggcccuacuucguguacggccaguucaagaaguucgggaaggccgaguccaaggaggacgacccggucaagaagaucaagcaguucaacuucaucuaccagcugcuguggggcaaggacgacgccaucugcaucagccacacggaccagcaggucuucucccgcagcgacaucaucaacaagcucaccaccgccuacaacuucaaguacaugaacgugucccaggagguguacaccaacagcaacaacguguucaagcagacgguguuccccaucaucgagcgggacaccgcgaagucccgcagccugauccccaagaagcuggaccggccgaccgacaucuacggcggguacuccaacaacaacgacgccuaccucgcccuggucaagguggacaagaagaagggcagcgaguaccgcguggucgggauccccaugcgggccgccgcgaugcugaaggccuccaagaacuacgacgaggaccuccgcaaggugaucgagcccauggugaugcuggacaagaacggcaaggccaagcggggcaucgagggguuccgcguccuggugggcaagaugcccuucaagcaggccgugcucgacggggacaagaaguucaugcugaccggcacgaacgacaugccgaaccugaagcagcucguccugagccagcagaacaugaaguacauccuggacuacaucgacgacaucgacugccggaagcacaaguucgggaacaagacccaggacggcaacaagugccuccuggagguguucgacgagaucauccagaucgucgacaagcacuucgagcuguucgacaaccgcuccuuccgggagaagcuccgcaacagccgggugaacuucaucaaccuggcccuguccaagaaggcggaggcccuccuggccauccugaacggccuccacgccaacagcaugcgcaccaccaucaaggagcugaagaucuccgaccuggggcggauccagagcuccgugaucagccccgaggcccagcucaucuaccagagccccacgggccuguucgagcgccgggucaaggugaaggaccuguga

SEQ ID NO: 2079 - RNA, 4176 nt, Artificial Sequence
  Cas9 variant
auggagaacaagcaguacuacaucggccuggacguggggaccaacagcgucggcugggccgugaccgacacguccuacaaccuccugcgcgccaaggggaaggacauguggggcgcgcggcuguucgagaaggccaacaccgccgccgagcgccggaccaagcgcaccagccggcgccgguccgagcgcgagaaggcccggaaggcgaugcucaaggagcuguucgccgacgagaucaaccgcguggaccccagcuucuucauccggcuggaggaguccaaguucuuccucgacgaccgcagcgagaacaaccggcagcgcuacacgcuguucaacgacgccaccuucaccgacaaggacuacuacgagaaguacaagaccaucuuccaccuccgguccgcccugaucaacagcgacgagaaguucgacguccgccugguguuccuggcgauccucaaccuguucucccaccgggggcacuuccugaacgccagccucaagggcgacggcgacauccaggggauggacguguucuacaacgaccuggucgaguccugcgaguacuucgagaucgagcugccgcgcaucacgaacaucgacaacuucgagaagauccucagccagaagggcaagucccggaccaagauccuggaggagcugagcgaggagcucuccaucagcaagaaggacaaguccaaguacaaccugaucaagcugaucagcgggcucgaggccuccgugguggagcuguacaacaucgaggacauccaggacgagaacaagaagaucaagaucggcuuccgcgagagcgacuacgaggagagcucccugaaggucaaggagaucaucggggacgaguacuucgaccucguggagcgggccaagagcgugcacgacaugggccugcuguccaacaucaucggcaacagcaaguaccucugcgaggcccgcgucgaggcguacgagaaccaccacaaggaccugcugaagaucaaggagcuccugaagaaguacgacaagaaggccuacaacgacauguuccgcaagaugaccgacaagaacuacuccgccuacguggggagcgugaacuccaacaucgccaaggagcggcgcagcgucgacaagcggaagaucgaggaccuguacaaguacaucgaggacaccgcccucaagaacauccccgacgacaacaaggacaagaucgagauccuggagaagaucaagcugggcgaguuccucaagaagcagcugacggcguccaacggggugauccccaaccagcugcagagccgcgagcuccgggccauccugaagaaggccgagaacuaccugcccuuccucaaggagaagggcgagaagaaccugaccguguccgagaugaucauccagcuguucgaguuccagaucccguacuacgucggcccccucgacaagaaccccaagaaggacaacaaggccaacagcugggccaagaucaagcagggcgggcgcauccugcccuggaacuucgaggacaagguggacgugaaggggucccggaaggaguucaucgagaagaugguccgcaagugcaccuacaucagcgacgagcacacccugccgaagcagucccugcucuacgagaaguucauggugcugaacgagaucaacaacaucaagaucgacggcgagaagaucagcguggaggcgaagcagaagaucuacaacgaccuguucgucaaggggaagaaggugucccagaaggacaucaagaaggagcucaucagccugaacaucauggacaaggacuccguccugagcggcacggacaccgugugcaacgccuaccucagcuccaucggcaaguucaccgggguguucaaggaggagaucaacaagcagagcaucgucgacaugaucgaggacaucaucuuccugaagaccguguacggcgacgagaagcgguucgugaaggaggagaucgucgagaaguacggggacgagaucgacaaggacaagaucaagcgcauccugggcuucaaguucuccaacugggggaaccucagcaaguccuuccuggagcuggagggcgccgacgugggcacgggggaggugcggagcaucauccagucccucugggagaccaacuucaaccugauggagcugcucagcucccgcuucaccuacauggacgagcuggagaagcgggucaagaagcuggagaagccccucagcgaguggaccaucgaggaccuggacgacauguaccuguccagccccgugaagcgcaugaucuggcaguccaugaagaucguggacgagauccagacggucaucggcuacgcccccaagcggaucuucguggagaugacccgcagcgagggggagaaggugcggaccaagucccgcaaggaccggcucaaggagcuguacaacggcaucaaggaggacagcaagcagugggucaaggagcuggacuccaaggacgagagcuacuuccgcagcaagaagauguaccucuacuaccugcagaaggggcgcugcauguacuccggcgaggugaucgagcuggacaagcucauggacgacaaccuguacgacaucgaccacaucuacccgcggagcuucgugaaggacgacucccuggacaaccucguccuggugaagaaggagaucaacaaccgcaagcagaacgaccccaucacgccccagauccaggccagcugccagggcuucuggaagauccugcacgaccagggguucauguccaacgagaaguacagccggcucacccgcaagacccaggaguucuccgacgaggagaagcugagcuucaucaaccggcagaucguggagaccggccaggcgaccaagugcauggcccagauccugcagaaguccaugggggaggacgucgacgugguguucagcaaggcccgccucgucuccgaguuccggcacaaguucgagcuguucaagagccgccugaucaacgacuuccaccacgccaacgacgcguaccucaacaucguggugggcaacuccuacuucgucaaguucacgcggaaccccgccaacuucaucaaggacgcccgcaagaacccggacaaccccguguacaaguaccacauggaccgguucuucgagcgcgacgucaagagcaaguccgagguggccuggaucggccagagcgaggggaacuccggcaccaucgugaucgugaagaagaccauggccaagaacagcccccugaucaccaagaaggucgaggaggggcacggcuccaucacgaaggagaccaucgugggggugaaggagaucaaguucggccggaacaaggucgagaaggcggacaagacccccaagaagccgaaccugcaggccuaccgccccaucaagaccagcgacgagcggcucugcaacauccugcgcuacggcgggcggaccagcaucuccaucagcggcuacugccugguggaguacgugaagaagcgcaagacgauccggucccucgaggccauccccgucuaccuggggcgcaaggacagccuguccgaggagaagcuccugaacuacuuccgguacaaccugaacgacggcgggaaggacagcguguccgacauccgccucugccugcccuucaucagcaccaacucccuggugaagaucgacggcuaccucuacuaccugggcgggaagaacgacgaccgcauccagcuguacaacgccuaccagcucaagaugaagaaggaggaggucgaguacauccggaagaucgagaaggccgugagcauguccaaguucgacgagaucgaccgcgagaagaacccggugcugaccgaggagaagaacaucgagcuguacaacaagauccaggacaaguucgagaacaccgucuucagcaagcggaugucccucgugaaguacaacaagaaggaccugagcuucggcgacuuccugaagaacaagaaguccaaguucgaggagaucgaccucgagaagcagugcaaggugcuguacaacaucaucuucaaccugagcaaccucaaggaggucgaccuguccgacaucgggggcagcaaguccacggggaagugccgcugcaagaagaacaucaccaacuacaaggaguucaagcugauccagcagagcaucaccggccucuacagcugcgagaaggaccugaugaccaucuga

SEQ ID NO: 2080 - RNA, 4176 nt, Artificial Sequence
  Cas9 variant
augaaggagaucaaggacuacaucaucggccuggacaucgggaccaacagcugcggcuacguggucaccgacaagcagaacaacauccucaagcugaaggggaagacggccaucggcgcccgccuguucaaggagggggaggcggccgccgaccggcgcgccuuccggaccacccgccggcgccucgcccggcgccgguggcgccugucccugcucgaggagaucuucgacgaggagaugaacaagguggaccccagcuucuuccggcgccugaaggaguccgacuacagcccgaaggaccggcgcaagcaguucaacuccaucguguucgagagcuccgaggcggacaaggccuucuacgagaaguaccccaccaucuaccaccuccggaacgcccugaugcacgacaaccagaagcacgaccugcgcgagaucuuccuggccguccaccacaucgugaaguaccggggcaacuuccuccgcgaggacagcgugaaggcguucaaggccgccaaguucacgcugcagggcgaggacgggaucggccccgucgacaagcugaacgaccuccugaaggagaucuacaucgaggccgcccccgagcuggcgaccgacaaccucuccaagaucgaggacaucaucaaggacaagaagcuguacaagcaggacaagcugaagcagaucgccaaccuccugccgaaggccguggacagcaaggacaaggccaagcugaacaaggacaucgccaagcaggucgcgaacgcccucaugggguacauguuccggcuggacacccuguucuccuucaccgacguggacgugaaggacuacaagcucaaguucagcgacgccaacaucgacgagucccuggacgcccugacgagccuccugaccgacgcccagaucgaguucgugcuggagcuccaguccaucuacaacaccaucguccugaacgagaucgugcccgacggcaugagccuguccgagagcauggugaagaaguacgacgaccacaagaaggaccucaagcuguacaaggaguacaucgacucccugagcgaccagaagaaggcgaagcagcucgaggccgccuacgcccuguacgucaacuaccgcaaggccgaccugcucgcggccaagaagcuguucgagaagaagaagaucggggacaagaaguucguggacgugaucagcaacuucgaggucuucggcaaguucguguccgacaaccuggacgacagcgagcucgccaacaagaucaaggcccggcuggaccugggcgaguuccuccccaagcagcgcaccaaccagaacggggugauccccuaccagcugcaccaggucgagcugacgcagauccuggagaagcagggcaaguacuacccguuccucaucacccccaaccccguggagucccaccgcaacaacgcgcccuacgagaucagcgagcugguguccuuccgggucccguacuacguggggccccugaucgacaaccagagcaucaaggacaagcagaacaagaacaaguucgccuggaugguccgccagaagcagggccagaucacccccuggaacuucgaggagaugguggacaccacggaguccgccaaccaguucaucaagcggaugacccgcaaggacaccuaccuccuggccgaggacgugcugcccaagagcucccucaucuaccagaaguucaugauccuggacgagcugaaccggaucaagaucgacggcaagaagcucaccagcaagcugaagcacgacaucuucgagaagcuguucaagaagcagaaguccaucaaccucgacaaccugaagaacuaccugcucgccgaggggaacaucccgggccugaucgaggggcugagcgacggcaucaacuucaacaacuccuucagcacguacaucgacuaccgcaacaucuucggggacgagaucgacaaccccaacaagcaggcggacuucgagaagaugaucgagugguccaccgucuucgaggaccggaagaucuucaagcgcaagcucaaggagaucaccuggcugacccccgagcagaucaagcaggucagcuccaagcgguacagcggcuggggccgccuguccaagaagcuccugacgcagaucaccgacgagaacggggugaacauccugcagcggcucuggaacgagcccgagacccugaccgaggugcuggccaacccggugaucaagcgcaagaucagcgaggccaacagccucuucgugcagaucaacaaggucgagaacauccuggacgacgccuacacgagcccccagaacaagaaggccauccgccaggugauccggguggucgacgacaucaucgcggccgcccacggcaagaagcccagccagaucgccaucgaguucgcccgguccagccagaacaaggcgaaggugcccgacacccgcaagaagcagcuggacaagaucuacaacaagaucuccagcgagauccucgacuccagcaucaagaacgagcugaagaaccugaaguccaacaaguaccucagcaaggacaagcuguuccuguacuucaagcagauggggcgggacgccuacaccggcgacaagcucucccuggaccagcugcagaacuacgacaucgaccacaucuucccgcgcagcuucaucaaggacgacucccucgacaaccgggugcugacccagaagcccaucaacgccaagaaguccgacuacgggauccccgcccuggaguucggcaacaaguacguccccgaccucggcaucacggugaaggagauguggaagcuguggcaggagaacgggcugaucuccaagagcaagcucaucaaccugugcaccaacccgaagaagaucggcuccaagcgcgcgagcggguucaucaaccgccagcugguggagaccagccaggucaucaagcucguggccaucauccugcaggccgaguuccccgacaccgagaucaucgaggugaaggcccugcagaacacgacccuccgggaguccuuccaccuguacaagaaccgcagcgucaacgacuaccaccacgccaucgacgcguaccugaccaccaucgugggcaacuaccucuaccagguguaccccaagcugcggccguacuucgucuacgggcaguucaagaaguucaaccaggagaagaacaucgacauccugaagcgccucaagaacuucaacuuccugcggcagcugaucuucaacaccgacgacaacaucuacaucuccggcacgaaggagaucguguucaacaagaaggacaucauccacaagcucgagaccgccuacggcuacaaguacaugaacaucagccgcgagugcuaccaggagaccuccagccuguucaaccagacccuguacgcccacaacuccagcgugaagaacucccucauccccaagaagaaggggcugcccacggagaucuacggcggguacagcggcaacaaggacuccuucuucguccuggugaagaucgugaagaagcggaccaaccucuaccgcaucgucggcauccccacccgggagcuggccaagcugaacagcuccaacaacuacaaccaggcccucaacaagaucguggagagcaagcugugccugaaggagaccgaguccuucaagauccucaucaagcgccugcuguacgggacgcucaucguggacaacggccagaaguuccggaucgggagcuucaaggagaagcacaacguccagcagcuggugcugcagcucaaguccaugaaguacaucaaguucuacaucgacggcgggcagaacuacuucaccgacguggagcgcaagaagcuggagaagcaggaccgggacaagugccugcucuacgucuucgacgacaucaugaacguggugaacaagcgcuucacccuguucgacaugagcaaguacgagaaggacggcgacucccugcgggagaaguucaacugccucgacuucaacgacaaggucagcauccugagcgaccugcucaaggcguuccacgccaacuccgaccgcaccagcaucacgaagcugaagaucaccaaccugggccggcaccaggccgggaagaacggcaucacccucaccacgaacgcccagaucaucuaccaguccccgaccgggcuguucgagcgccggaucaagaucaaggaccuguga

SEQ ID NO: 2081 - RNA, 4176 nt, Artificial Sequence
  Cas9 variant
augaagaagauccugggccucgaccuggggaccaacagcaucggcugggcccuggugaacgaggccgagcacgagcacgagcaguccagcaucgucaagcucggggugcgcgugaacccccuguccgucgacgagaagaccaacuucgagaagggccggccgcugagcaucaacgcggaccgcacguccaagcggagcgcccgccggaaccuccagcgcuucaagcugcggcgcaagaaccugaucaaccuccugcugaagcaccacaucaucuccaacgagaccauccucaccgagguggggaagaacaccacgcaccagacccugaagcugcggagcaaggccacccaggagaagaucucccucgaggaguucgcccgcauccugcugagcaucaacaagaagcggggcuacaaguccagccgcaaggagaagaacgaggacgagggcuucaccaucgacgggauggccaucgcgaaggagcucuacgacaaccagcugacgcccggccaguacguguacaacauccugcaggacgggaagaacuacauccccgacuucuaccgguccgaccuccaggccgaguucgacgacgucuggcaguuccagaagaaguucuacagcuccauccugaccgacgaguucuaccugaagcucaagggccaggggaaggagaacacccgcaagcuguuccuggccauccaccagguguacaccgccgagaacaagggcaagcgggacgcggugaagcuccaguacuacaaguggcgcagcgaggccgucaagaagcagcuguccaucgaggagguggccuacgugcuggucgagaucaacaacaacaucaacaagagcuccggcuaccucggggccaucagcgaccggagcaaggcccuguacuucaacaacgagacggugggcgaguaccuguacgggcagcucgugaagaaccgccacaacucccugcggaaccaggucuucuaccgccaggacuaccuggacgaguucgagaagaucugggagacccaggcgaaguucuacgacgagcucaccaacgagcugaagcaggagauccgggacguggugaucuucuaccagcgcaagcucaagagccagaagcaccucaucuccgacugccuguucgagaagcaccacaaggccauccccaagagcuccccgcuguuccaggaguucaagaucuggcagaaccucaacuaccuggaguucguccacacccagagcaaggagaagaucuucuucuccgagcuggacgacgagacgcgccaguucguguucgccgagcucaacauccggggcacccugaagaucaaggagaucaagaagcugaucggccucgagacccccguguacuggaaguccaacuucgacgagaucgaggggaaccgcaccaaccagguccuguacaacguguaccagaacaucgccgacgaccugggcuacggguucgacuggagcaagaagcacgccuucgagaucaacgcggagcugcaggccaucuucaaggacgugggcaucgacacggccauccucaacuucgacgccagcaucgaggagaacgacuucgacaagcagaaguccuaccagcuguggcaccuccuguacagcgccgaggacaccgacaaggcgaccgaggaggacaagcugaucuacgggaacaucaacaccaagcugaagaagcagcuccaccagaaguacggcuucgaggccaaguacggcaaccugcuggccaacaucucccuccagcaggacuacgggaaccugagcgccaaggccaucaagaagauccugcccuaccucgaguccggcaacagcuucuacgaggcgugcacgaucgucggguacaaccccuccaacagccugaccaaggagcagcagcagaaccggaagcugaaggacaagcucgagcugcugccgaagaacucccuccgcaaccccguggucgagaagauccugaaccagaaggugaaccugaucaaccagcucaucgacgaguacggcaagcccgacgaggugcggaucgagcuggcccgcgagcugaagaaguccgccaagcagcgggccgaccucagcaagcacaucaacgacgcgacccugaagaaccagaacauccgcaagacccugcagaaggacuucgggauccagaaccccagcaagaacgacgucauccgguacaagcucuacgacgagcugaaggacaacggcuacaagacgcuguucaccaacaaguacaucccgaaggagcagcuguucagcaaggacguggacaucgagcacaucauccccaaggccauccuguucgacgacuccuucagcaacaagacccuggccuaccgcaacgugaaccucgccaaggccgacgcgaccgccuucgacuucaucuccagcaagcaccuggacgaccuggacaacuacaaggcccgggucgagacccucuuccaguccaagcgcaucagcaagggcaaguacaagaagcugcugaugacccggcagaaccuccccgaggacuucaucgagcgcgaccugcggaacucccaguacaucgccaagaaggccaccgcgaugcugaaggagguguuccgcagcgugguccccaccuccgggcggaucacggacaagcuccgcgaggacugggaccuggugaacgugaugaaggagcugaaccucccgaaguaccggacccugggccugaccgaguucaucgagcgcaagaacgggaacaagaucgagcagaucaucgacuggaccaagcgcaacgaccaccggcaccacgccauggacgcccucaccgucgccuucacgacccacaaccacauccaguaccugaacaaccugaacgugacccacggccucaacgggguggacaccgaccacgagaagucccgccuguacgccaucaagcaggcgaucacgaaggucuacaucgugggcaagaccaagaagcggaaguucaucccgcccauggagaacuuccgcagccacgccaagaaccaccuggagggcauccucaucagcuucaagaacaagaacaagguggucaccaagaacaagaaccggaccaagacgaagaccaaggggguguucaacgagaagauccagcugacgccccgcggccagcugcacaaggagaccaucuacgggcacgccaagaaggugaucgucacgaaggagaagguguccagcaaguucacccacgagaagauccuccaggugaccaagcccgccuaccgggaggcgcugcugaagcgccucgccuccuucaagaacgaccccaagaaggccuucagcggcaagaacgcccugagcaagaacccccuguacuucgacaucaccuccggcaagaagguccccgacacggugaagcucagcuacuucgagaacuccuacgugauccggaaggaggucaacagcgacaacuucaagaacgagaagucccugcagaaggugcuggacguggggauccgccggauccucgagaagcgccuggccgacuacaacggcaacgcgaaggaggccuucagcaaccuggagaagaacccgaucuggaaggacaaggagaagggggucugcaucaagaaggugcggaucgaggcccucaagaacgccgagccccugcacgugaagaaggaccaccugggcaagaucauccucgacgacgagaacaaguccacccccgucgacuucaucagcaccgggaacaaccaccacguggccaucuacgaggacaaggacggcaagcugcacgacaagguggucuccuucuacgagguggugagccgcgucaaccugggccuccccaucaucgacaaguccuucaacagccaccuggacuggaaguuccuguucuccaugaagcagaacgagauguucguguucccgagcgaggacuucaaccccaaggagaucgacaucgggaaccccaagaacaacgagcucaucuccaaguaccuguuccgggugcagaaguucagcaaggucaccuacggcaacuccgcggugcgcgacuacguguuccggcaccaccuggagacggagcucaucgacaagaaggagcugaaggggaucaccuacuaccagcucaagagcaucggcaugcuggagaagcuggucaaggugcgcaucaaccacaucgggaagaucgugcacaucggcgaguacuga

SEQ ID NO: 2082 - RNA, 4176 nt, Artificial Sequence
  Cas9 variant
augaagaccauccugggccucgaccuggggaccaacagcaucggcugggcccuggugaaggaggccgagaacgagaacgaggucuccgacaucaucaagcucggggugcgcgugaacccccugacggucgacgagcugaccaacuucgagggcgggaaggcguacagcaacaacgccgagcggacccucaagcgcggcgcccggcgcaaccugcagcgguacaagcugcgccgggagaaccucaucgagauccugcugaagaacggccucaucaacaaggacaccgcccugacggagguggggaaggagaccacccaccagacccugaagcuccgcuccaagagcgccaacgagaaggugucccuggaggaccuggcgaagauccuccugagcaucaacaagaagcggggcuacaaguccagccgcaaggucaacgccgaggacgacgggguggccaucgacggcauggagguggccaagcugcucuacgacgagaacaugacgccgggggaguacguccugcggcugcucgaguccggcaagaagcaccuccccgacuucuaccgcagcgaccugcaggaggaguucaaccucguguggaagaagcaguccgaguucuacccccugauccugaccaaggagcuguucuucgagcugcacggcaagaacaagagccagaccugggcgaucugcaaggagccccuggggaucgugggcgucaagcucaagggguccgccaaggagcagaaguucgcccgguaccgccugcggaaggaggcccugacccagcagaucgagcucgagcaccuggccaucgugcugcaggacaucaacaacgacagcaacaaguccagcggcuaccucggcgcgaucuccgaccgcagcaaggagcuguucuucaacaaggagacgguggggcaguaccaguacaagcagcugcagaaggacccgaacaccucccucaagaaccaggucuucuaccggcaggacuaccuggacgaguucgaggugaucuggcgcaaccaggccaaguucuacccccagcugaccaacgagcucaagcaggagauccgggacguggucaucuucuaccagcgcaagcugaagucccagaagaaccugaucagcuucugccaguucgaguccacccagcagaacuacguggagaaggagacgggcaagaccaagauccggaccaucgggcgccgcgugaucccccggagcagcccccucuuccaggaguucaagaucuggcagagccugaacaaccugaaguucgucaacuccgagagcaaccagaucauccaguucaucgagcuggaggacgacgugaagaagguggucuucgacgagcucaaccugcgcggcgaccugaagccgaaccaggugcucaagauccuguccaaguacaugaagaucgggaagcugacccaguggaagugcaaccucgaggagaucgagggcaaccggacgaacagcgcccuguacaacgucuuccagaugaucgccgaggaggagggcuacggguucaacuggggcaagaaguccgcccuggagaucaagagcgagcucaaggcgaucuucuccagcaucgggaucaacgacuccauccuggacuucgacuucagcaagaagcuggaccagcagcucuccuaccagcuguggcaccuccuguacagcgccgaggagggcaacuccaagaucaccgaggaggacaaguucaccuacgggaacaccggcguggcccugaagaagaagcugcaccucaaguucggcuucaagcccgaguacagcacgcugaucuccaaccugcgcuucaccagcgacuacgggaaccucagcuccaaggccaucagcaagauccugcccuuccugcgggacggcuccgacuacagcaaggccugccaguacgcgggguacaaccacuccaacagccucuccgccgacgagcuggacaaccgcgagcugaagcccaagcucgagcugcugaagaagaacagccuccggaacccgguggucgagaagauccugaaccagauggugaacguggucaaccaggugaucgacaacuacggcaagcccgacgaggugcgcaucgagcuggcccgggagcucaagaaguccgccaaggagcgcagccagaugaccaagaacaucuccgacgccacccggcgcaacgcggagaucaagaaguaccugagcaaggaguucgggauccccaaccccacgaagggcgacgucauccgguaccgccugugggaggagcucgccuccaacggcuacaaggaccuguuccgggacaaguacaucccgaaggagaagcuguucagcaacgagaucgacaucgagcacaucauccccaaggcccuccuguucgacgacuccuucagcaacaagacccuggccuucaagguggacaaccucaagaaggcggaccgcaccgccuucgacuucauguccaccgacuucagcaaggacguggacagcuacaucgggcggaucgagacgcugcacaaggacggcaagaucuccagcuccaaguacaagaagcugaugauccccaagagcaagcucgucgacggguucaucgagcgcgaccugcggaacacccaguacaucgccaagcaggcccgcaagaugcugcucgagguguucaagaccgugguccccaccacgggcaagaucaccgacaagcugcgcgaggacugggaccugaucaacgugaugaaggagcucaacuucccgaaguacaaggcccugggccugaccaagaagaucgagcgguucgacgugggguccgagaagaucaagagcaucaacgucaucgagggcugguccaagcgcaacgaccaccggcaccacgcgauggacgcccucgccguggccuucaccacccacaaccacauccaguaccugaacuaccugaacgcccgcaaggacauccaccacgagaugcacgggacgaucaagagcaucgagaaccagaucaucggcaaggacgugauggggaagcggcgcuucaucccgcccaucuccgaccuccggaugaaggcgaagcugcagaucgagagcauccugaucuccuucaagaacaagaacaaggucgugaccuggagcgugaacaagaccaagcucaagggcaaggacaacuacaacaagcgccggcagcugacgccccgcggccagcugcacaaggagaccgucuacgggaagaucaagcucaucgaccccaagccccugaagcugaacaacaaguucacccucgugcgggccuccaugaucguggacaagguccaccgcgagaucgugcugcagcaccugagcaaguacgacaacaacuccgagguggccuucgacagcaagaccaucaagaucgaccccauccucaucgagggcaucgggcugaaggaggucgugugcuacgaggacguguucaagauccggaagaagaucuccggcgacaacuucaagaacgagaagcaccuggagaaggucaucgacgagaaggugaagcagauccucaaggaccgcgugaucaaguuccaggggaacuucaaggaggccuucagcaaccuggaggagaaccccaucuggcugaacaaguccaagggcaucgccgucaagagcguggcgaucaagggcgugaacaacgccgagagccuccacgaggggaaggaccacuucggcgaccagauccuggacaagaacaagaagcagaucccggucgacuucguguccaccgggaacaaccaccacgugggcaucuacgaggacaaggacgggaaccugcaggagcgggucgugagcuucuucgaggccgugacgcgcgucaacgagggccuccccaucaucgacaagaccuacaacuccgacaucggcuggaaguucaaguucaccaugaagcagaacgagauguucguguuccccagcgacgacuucgacccgaacgaguucgaccugaccgacgggaagaacgccgcgaagaucucccccaaccuguaccgggugcagaagaucgccacgaagaacuacauguuccgccaccaccucgagaccgucgugaccaacgaccuggaguucaccuacaagagcauccgguccacgggcuggcugcgcaaccucgugaagguccggaucaaccaccugggggagaucguguacgucggcgaguacuga

SEQ ID NO: 2083 - RNA, 4176 nt, Artificial Sequence
  Cas9 variant
augaagaagauccugggccucgaccuggggaccaccagcaucggcugggcccuggugaacgagaaggagaacaacgaggagcucuccagcaucauccgccuggggguccgggugaacccccugacgguggacgagaaguccaacuucgagaagggcaaggacaucaccaccaacgccgaccgcaccaagugccggagcgcgcgccggaaccuccagcgcuucaagcugcggcgcgaggcccuggccgacugccucaagcggcacgggcugaugacggacgagaccccgcugugcgagaccaacaacuccaucaucuucaagaccuacagcaaccgcgccaaggccgucugcgagaagaucgcgcucgacgacuucgugcgggugcuguucaugaucaacaagaagcgcggcuacaaguccagccggaagcugaacacggacgacgagggcacccucgucgacgggauggacguggccaagcugcuguacaacgagcagaucacccccggcgaguaccuccugcgccuguucaagaaggggaagaagacccggcccgacuucuaccucuccgaccugaaggccgagcuggagcgcaucugggacuuccagcggacguucuaccccgagauccucugcaacgcccugaaggaggaccugaagggcaagagccgcacccaguccagcgcgaucuucuacgccaaguacaagguguccaccgccaagaucgccgggaaggacaagcggcuccaggagcugaccuggcgcacggacgcccugcggaagcagcucaccaucgacgaggucgcguacgugaucugcagcaucaacggcgaggugaacggcuccagccagcgccuguccaugaucagcgaccgcuccaagcugcucuacuucaaccaccagaccaucgggcaguaccugaugcagcggcuggaggagaacccgaacgccggccucaagaacaucaucuucuaccgccaggacuacgaggacgaguucaacgacaucuggaacagccaggccaccuaccacaaggagcugacgcccgagcugaagaaggaggucaaggacaucaucuucuaccagcgggggcucaagagcugcaaguggcugaucaacuacugcgagcuggagcacgaggagaucgaggugaagacccccgagggcaagcuccgcaagaucaccaucggcuccaagaccugccccaagagcuccccgcuguuccaggaguucaagaucuggcagguccugaacaaccuccaggugagcccccugaacucccggcgcaaggccaagcggaagaaggacgaggagcccagccuguucuccgacgaggacaugaacacggccugccgcuaccucaacgaggaggagaagcugacccuguucaaggagcugagcaucaagaaggagcucaagaagaaggacgcgcugaagcuccuguucgagaacuacaaggagcuggaccugaacuacaaggugaucuccgggaacgugaccauggccaaccucuaccgggccuuccaggacaucaucagccugaccggcaacggggaguucgacuuccaggccaugcccgccgaggaggcggagaagacggucgaggagaucuucggcgggcugggcuacaagaccgccuuccuccacuucgacgccucccugcacgacaaggaguucgagcgccagccggccuaccggcuguggcaccuccuguacagcuacgccggcgaccaguccaagaccgggaucgaggcgcuggugaagcgcauccaggagcucugcggcuucgagcccgaguacgcccggauccuggccaacaucagcuucauccccgacuacgggaaccuguccagcaaggccaugcgcaagauccuccccuacaugcaggacggcuacgaguacuccgaggcgugcagcaaggccggguaccggcacuccgccagcagccugaccaaggaggagaucaacaagaagaacuacaagacgcaccuggacgagaucaagcgcaacucccuccggaacccgaucguggagaagauccugaaccagauggucaacguggugaacagcgucaucgacaccuacuccaacaucgacgagauccgcaucgagauggcccgggagcugaagaaguccaagcccgagcgcgaggacaugagcuucgccaucagcaaggcgaccaaggagaccgagcgcaucaagggcauccucgagcaggaguucaagauccagcacgugacgcggaacgacaucauccgcuaccggcuguacgaggagcugaagcccaacggcuacaagacccucuacuccaacaccuacaucccccgcgaggaccuguucagcaagaaguucgacaucgagcacaucaucccgaaggcccggcuguucgacgacuccuacagcaacaagacccucgagcugcgcgacaucaacaucgagaaggggaaccagaccgccuacgacuucguccuguccaaguacggcgaggaggggcucuacaaguacgagcagcggguggaggaguucaagaagaacaacgagcaggccggcacgaagugccgcaagcugcugaugcgggaggccgacauccccagcgacuuccucaaccgcgaccugaacgacucccaguacaucgcgaagaaggcccacgagcugcuccgggagaucgugcccaccgucaccgccaccacggggagcaucaccaaccgccugcgggaggacuggaagcuggugaacgugaugaaggagcucaacugggagaaguacgacaagcugggccugaccgaggaguacaaggacaaggacggcaacaccguccgccacaucaaggacuggacgaagcggaacgaccaccgccaccacgccauggacgcccucaccaucgcguucaccaagcccuccuucauccaguaccugaacaaccugaacgcccggagcaaccgcgggggcuccaucuacgggaucgagcagaaggagcucgagcgggagaacaacaagcugguguucaucccgcccaucgaccccaagaucuuccgcaagcaggccaaggagcaccugagcaacauccucaucagcaucaaggccaagaacaagguggucaccaagaacgugaacaagacgaaguccaagagcggcaccaaccggaaggugcagcugacgccccgcggccagcugcaccucgagaccgucuacgggaagauccgcaccuacaagaccgaggagaucaaggugggcaccaagcugaccgaggagcugaucgcgaagguggccgacaagaagauccgggaggcccucaugcagcgccuguccgaguacgggggcaacaucaagaaggccuuccagaacaucagcaagcacccgaucuggcugaacgggucccacacgaagcacguccccgagaaggugaagaucguguucuucgaggacgucuucaccauccggaaggccaucacccccgacaucaagaucgacaaggugaucgacagcaagauccgccggauccuccaggagcgccugaacgaguucggcggcgaggcguccaaggccuucagcaaccuggacgagaacccgaucugguucaaccgggacaaggggaucgccaucaaguccgugaagauccgcggcaucgccaaggggaccgccauccgggucaagaaggacauccacggcaagacgaucaucgggaacaacggcuaccccguggcgaacgacuacgugaacaccggcaacaaccaccacgucgccaucuuccgcgacaaggacgggaaccuccaggagcacaucgugagcuucuacgaggccaccgcccgggccauccagaaccugcccaucguggaccgcaacuacaacuccgagaaggacuggaaguuccuguucagcaugaagcagaacgaguacuucgucuuccccaacccgaacaccggcuucaaccccuccgagaucagccucaaggacgagaagaacuacgcgcugaucucccccaaccuguuccgggugcagaagcucagccacuacuacuacguguuccgccaccaccuggagacgaacgucgacaccaaccugcagcucaaggacaucaccuggaagcggaucaccgccgugaacaaccugacgggggccgugaagguccgcaucgaccaccugggccggaucguggacgugggggaguacaaguga

SEQ ID NO: 2084 - RNA, 4176 nt, Artificial Sequence
  Cas9 variant
augaagaacuaccacaucggccuggacaucgggaccagcuccgugggcuucgccgcccgcgacgacgacaacaaccucauccgggucaaggggaagaacgugaucggcgcgcgccuguucagcgaggggcagaccgcccaggagcggcgcauggcccggaccucccgccggcgcuacaaccggcgcaaguggcggcugcgccuccuggacgagaucuuccacgacgagaucauccacaaggacgccgaguucuucaaccggcugaagcagagcuuccucucccccaaggacgagcgcaagcaguacuucggcagccugcuguucccggagaccggcgacuccgaguacuaccacaacgggaaccagaccaucuaccaccuccggcaccgccugaucacccaggacgagaaggccgacauccgggagaucuaccuggcgcuccgccacaucaucaaguaccggggcaacuuccuggacgacacgcccgugagcuccuucgaggccagcgaccugaagcucgccuccuucguccccaccaucaacgaccuguucgagaccaucgacgugaacuacgaguucagcauggacaacaucaacgagaucgaggacauccugcucaacaacaagcugcgcaacuccgacaagagcaagcagcugaccgaccuccugacggagcccaucgugaacaucgacgacaagucccuggagaagcaguucaacaaggagcggaccgacaucagcaaggagaucgccaaguccgucguggggagcaagaugaacgugaacaagcuccuguccuucgagagcagcgagggcuccaagaucgcguucagcuucuccgacgccagcuccgaggacaagaugauggagcugagcgacauccucgacgacucccgcaugaacauccugaacauccugaaggucaucuacagccgcgugcggcucaaccagaucaucccguccgggaugggccugagcgaguccaugguggccgccuacgacagccacaagcagcagcugaaggaccucaagacccugcugaacguccuccccuucaacgagcgcuacgccgugaagaucgcguacgccgccuacaucggcaacaucgacaagcagaaguucaccaaguccgagaucaaggccaucgacaagcugaaggagaaguccgccaucaugaacgugcuggacuucaaguccgggcacaucacgaacgaggagcucagcaacgucaucaaggcggugaucguggacaaguaccugaacgacgaggacuucgaguaccacggcaucgucgagaagaucaaccaggacaucuccaacgggagcuaccugcucaagcagcggaacaaccagaacggcaacaucccccaccagcugcaccagauggagcuggaccagaucaucgagaaccaguccaaguacuaccacuuccucggcgagcugaaccccaacagcaaccgcaaccacaucgccaaguacaagaucagcgagcugguggccuuccgggugccguacuacgucgggccccucaucacccccgaggagcaggagaagaccuccggcgccagcuucgccuggaugaagcgcaagaaggacggggcgaucacccccuggaacuucgaggagaagguggacaaggaggagacggccucccgguucaucaagcgccugaccgugaaggacaccuaccugcugaacgaggacguccucccggacaacagccugcuguacgagaaguucaaggugcucaacgagcugaacgucgugaaggccaacaacaagcggcugaccguggaggagaagcagggcgccuucgacaaccucuucaagaagaugaagacggucaccgccaagcgccugaagaacuaccugguguccaaccacaaccacaucaacagcguggagaucaccgggcucuccgacggcgacaaguucaacaacagccuguccaccuacaucgacuucaagaagaucuucggcgacaagaucgacaaccccgggcugcucgacgacuucgaggacaucaucgaguggagcacggucuucgaggaccggaagaucuucgaggagaaggugcgcaaggacaucuccuggaucagcgaguccgagaucaagagcguggucuccaagcgguacagcggcugggggcgccuguccaagaagcugcucaacugcaucaccaacaacgagggccggaacaucaucgacgagcugugggaggagagcgagaccuucauggaggcggugagcaagcccgaggugaaggagcagaucgacgggaucaacuccgacuucaucaagaacaccgacaucgagagcguccuggccgacgccuacacgagcccccagaacaagaaggccauccgcgagacccacaagcucgugaaggacauccagaaggcgaugggcggccaggccccggccagcaucuccaucgaguucacccggaacccccaggacaaggggcagcugacccgcagccggcacuccgaggugagccgcaaguacaaggagaucuccaaggagaucagcaagacgcugaacgacgagcucaaguccaagaagaacagcauggacgucgacaaguacuaccuguacuucaugcagaugggcaucgaccuguacgacggguccagcaucgacaucgacgaccucaacaacuaccagaucgaccacaucaucccccaguccuucuacaaggacgacagcuucgacaaccgcgugcugacccacuacuccaacaaccagaagaagggcaacaacacgccccugaacgggcucaacaucaacgacaagacccgggccaucuggaaccaccuccgcgaccugggccugaucaccaagaagaaguacaacggccugacccugaaggggauggaccagcucagcaaguacaccaagcacggcuucauccggcgccagcugguggagaccucccaggucaucaagcugguggccaacauccucagcgacgaguucagcaccgacgacacgaagaucaucgaggugaaggcgaagaugaacucccagauccggcaggucuucaaccuguacaaggugcgcgagcugaacgacuaccaccacgccguggacgccuaccucaccaccuucaucgggggcuaccuguacaaccgguacccgaaccugcgcaacauguucgucuacggcgacuucaagaaguucagcgccgacguggacaaccucaagaccuucaacuuccugcacgagaucacgaaccccuccgacaaguucgaggaccggaucuucgacgagaaguccggggagcugauccucgaccgcaagcacgccaucgagaccaucaagaagaucuaccaguacaaguacaugcugaucacccgggaggugagcaccaagaacggccagcugagcgaccagacggucuacuccgcgaagcgcaucaacaacgugaaggcccccauccccgugaagaaggacuucaacccggagcucuacggguuccggaccggcaacgucgaccaccacauggugaucgugaaguaccccaagaaggacagcuacgacuacaaggucguggggaucccccugcgcuucgugcagaagcugaaggagaccaaggacaacaaggacuacgagaaccuccugaaccagaucguccagaugaagcugaaccggaagaagcaggacuucaucgugguggucgacaacgugauguacggccagcucauccaggacggcgggcagaaguucacccugggcuccagcacguaccgcuacaacgccaagcagcuggugaucgacaacggguaccucaagcugaucgccgacgagcgguacaagaacucccugaccgacgaggagaaguccaaccaguacaucacccucuacaacgagauccugaaggucgugaacggccgcuucgacguguucgacgucaacagcuuccggaagaagcugaacaacgggguggacaaguucaucaagcucaacaccguggacaagcgcaucaucaucaugaagauccugagcggccugcacugcggccccuccaucgucccgcucaaggagcuggggcugacgacgccccucggccagcugcagagcaccuccgggaucagccuguccgagaacaccaucaucaucuaccagagccccagcggccucuucgagcggaaggugcgccugggggaccuguga

SEQ ID NO: 2085 - RNA, 4176 nt, Artificial Sequence
  Cas9 variant
augaagaacuaccacaucggccuggacaucgggaccagcuccgugggcuucgccgcccgcgacgacgacaacaaccucauccgggucaaggggaagaacgugaucggcgcgcgccuguucagcgaggggaagaccgcccaggagcggcgcaucucccggaccagccgccggcgcuacaaccggcgcaaguggcggcugcgccuccuggacgagaucuuccacgacgccaucgugcacaaggacgccgaguucuucaaccggcugaagcaguccagccucucccccaaggacgagcgcaagcaguacuucggcagccugcuguucccggaggucggcgacggggacuacuuccgggacggcaaccagaccaucuaccaccuccgccaccggcugaugacccaggacgagaaggccgacauccgcgagguguaccuggcgcuccggcacaucaucaaguaccgcgggaacuuccuggacgacacccccguguccagcuucgaggccuccgaccugaagcucgccagcuucguccccacgcugaacgaccuguucgagaccaucaacgugaacuacgagcucuccaucgacaacgugaaccagaucgagaacauccugcugaacaacaagcuccggaacagcgacaaguccaagcagcugaccgaccugaucgccgagcccgucaccaacaucgacgacaagagccucaagaagcaguucgacaaggagcgcaaggacaucuccaaggagaucgcgaaggccguggugggcagcaagaugaacgucaacaagcugcuguccuucgagagcagcgacggguccaagaucagcuucuccuucagcgacgccuccagcgaggacaagaugcucgagcuguccgacauccuggacgacagccgcaugaacauccucaacgugcugaaggugaucuacucccggguccgccugaaccagaucaucccgagcggcaugggccucuccgagagcaugaucgccgccuacgaccugcacaagcagcagcugaaggaccucaagacgcugcuggacguggugcccuucaacgagaaguacgcggucaagaucgccuacgccgccuacaucgggaacaucgacaagcagcgguucaccaaggccgaggugaagaccaucgacaagcuccgcgacaagaaguccaucaccagcgugcuggacuucaaguccggccacaucacgaacgaggagcugaacaacgucaucaaggaggugaucguggacaaguaccucaacgacgagaccuucgaguaccacgacaucgucgagaagaucaaccaggacaucagcaacgggaacuaccugcugaagcagcggaacaaccagaacggcaacaucccccaccagcuccaccagauggagcuggaccagaucaucgagaagcaguccaaguacuaccccuuccugggcaagcucaacccgaacagcaagcgcucccacaucgcgaaguacaagaucagcgagcugguggccuuccggguccccuacuacguggggccccugaucacccccgaggagcaggagaagaccagcggcgccuccuucgccuggaugaagcgcaaggaggacggggccaucacgccguggaacuucgagaagaugguggacaaggagagcaccgcgucccgguucaucaagcgccugaccgucaaggacaccuaccuccugaacgaggacgugcugcccgacaacagccuccuguacgagaaguucaaggugcugaacgagcucaacgucgugaaggccaacaacaagcggcugacgguggaggagaagcagggcgccuucgacaaccuguucaagcagaugaagaccgucaccgccaagcgccucaagaacuaccugguguccaaccacaaccacaucaacagcgugaagaucaccgggcuguccgacggcgagaaguucaacaacagccucuccgucuacaucgacuucaagaagaucuucggcgacaagaucgacgacagcaagcuguucgacgacuucgagaacaucaucgagugguccacgguguucgaggaccgggacaucuucgaggagaaggugcgcaaggacaucagcuggaucuccgagagcgagaucaacgccgucguguccaagcgguacagcggguggggccgccuguccaagaagcuccugaacgggaucaccaacgacgagggccggaacaucaucgacgagcugugggaggagagcgagaccuucauggaggcggugagcaagcccgaggucaaggagaagaucgacgagaucaacuccaacuucaucaagaacaccgacaucgagagcgugcucgccgacgccuacacgagcccccagaacaagaaggccauccgcgagaccuacaagcuggugaaggacauccagaaggcgaugggcgggcaggccccgagcuccaucagcaucgaguucacccggaacccccaggacaagggcgagcugacccgcucccgccacagcgagaucgccaagaaguacaaggagcucuccaaggaggucagcaagaagcugaacgacgagcugaaguccaagaagaacagcauggacguggacaaguacuaccucuacuucaugcagauggggaucgaccuguacgacggcacguccaucgacaucgacgaccugaacaacuaccagaucgaccacaucgugccccagagcuucuacaaggacgacuccuucgacaaccggguccucacccacuacagcaacaaccagaagaaggggaacaacacgccccugaacggccugaacaucgacuccaacacccgcgagguguggaaccaccucaucgggcugggccugaucaccaagcggaaguacaacaaccucacccugaagggcauggaccagcugagcaaguacaccaagcacggguucauccgccggcagcucguggagaccucccaggucaucaagcugguggccaacauccugagcgacgaguacagcaaggacgacaccaagaucaucgaggugaaggccaagcucaacucccagauccgccaggucuucaaccuguacaagauccgggagcugaacgacuaccaccacgcgcucgacgccuaccugacgaccuucaucggcggguaccuguacaaccgcuacccgaaccuccggaacauguucguguacggcgacuucaagaaguucagcgccaagaucgacaaccuggagaccuucaacuuccugcacgacaucaccaaccccuccgacaaguucgaggaccgcaucaucgacgagaaguccggcgaggugauccucgaccggcgccacgccaucgagacgaucaagaagaucuaccaguacaacuacaugcugaucacccgggaggucuccaccaagaacgggcagcugagcgaccagaccguguacuccgcccgccggaucaacaaggugaacagccccauccccgucaagaaggacuccaacccggagcucuacggcuuccgcacggggaacguggaccaccacauggugaucgucaaguaccugaacaaggacaaguacgacuacaagaucaucggcaucccccugcgguucguccaggugcucaagaacagcaacgacaacaccgaguacaagaacauccugaacaagaucgugcaguccaagcugaagggcaagagcaccgacuuccgcgugauccucgacaacgugauguacgggcagcugauccaggacggcgggcagaaguucacccugggcuccagcacguacaaguacaacgcgaagcagcucgucaucaacauggacgacauccggauccugguggacaaccgcuacuucaacucccugagcgacgacgacgccuccggggaguucaucaagaucuacaacgagauccucaaggugaucaacgcccgguucgaccuguucgacaucaacaaguuccgcgagaagcugaacaacggcaaggaguacuucgagaaccucagcaucgacgagaagaaccagguccugcugaagaugcucuccgggcugcacugcggcagcgccaacgugcccaucaaggagcugggccucaccacgccccuggggaagcugcagaucccgagcggcaucgugcucuccgaggacgccaucgucaucuaccagagccccuccgggcuguucgagcgcaagauccggcugaaggacaucuga

SEQ ID NO: 2086 - RNA, 4176 nt, Artificial Sequence
  Cas9 variant
augaaccugcgcaacuaccccggcgaguacagcaucgggcucgacaugggcaccggguccgugggcuggagcgucguggacgagaaggggaaccugcugcacuucaagaagaagccgaccuggggcucccggcuguucgacagcgugaugcccgccuccgaggcccgcguccaccggggccagcgccggcgcuacgagcggcgccgguggcgccuggaccugcuccaggggcuguucaagaacgagaugaacaagguggaccccgaguucuucaugcggcugaaccagagccgcacgaucgagggcgaccccaucuucaccaaguccuucaccaaggcggacuacuacgaccgguucccgaccaucuaccaccuccgcgccuaccugauggagagcaacgagcccgccgaccugcggcucaucuaccuggccaugcacaacaucaucaagcaccgcgggaacuuccugcgggaggaggagaagucccucagcgccaagcacgcggacuccaagaaggccgugacgcaguucgucgacgcccugaaggaguggugcuucagccgcggcuacgaguucgggaaggaccccgccaaguccaucgagaagugccugagcgacuccaagagcucccggagccagcucgcguccgagaucgccaaggcccuggccgugagcaccgacgccgcggccgccgacaagaagcuggccgacaaccucgccaaggcgauggugggccugcagugcgaguucaaguacgucuucggcgaguucgacugcgagagcaccaagcuggcccucuccgacgacgagaagcuggagcugcuccgcgccgccugccccgacgacagcguggagcugcuggacgcccucugcgcgguguacuccgccuacguccugcaggggcugcucagcuacgccccgggccagaccaucucccacaacaugaucgccaaguacgaccuguacaagacggaccugaagacccuccgggcccuggugcgcgaguacgcgcccggggccuacgacgaguucuuccgcggcgccaccuaccacgacgccaaccccgacgacagcuccaaggacuacagcuacgcggacgccgagggcuacaccgccuacaaccugcacaagcucuccuacgacgacuucgccaaggccgugaagaagcugcucgggggcacggacgcggucaccgacgagcgguaccucaacaugauggagcgcuucgagaagcagcaguuccugcggcgccugaagaccagcgacaacggggccaucuacuaccagcuccaccuggaggagcugaccgccaucaucaagaaccagggccgguucuacuccuuccucaaggaguacgaggggaaguucgagagccugguguccuuccgcauccccuacuacgugggcccgcugacgagcgucaacgccgcccaggacucccacaaccacaaccgguuccaguggagcgagcgcaagcccggcauggagcgggaggugaucacccccuggaacugggacaccaucaucgacaagaacaaguccgcggagaacuucaucaugcgcaugaccggggacugcacguaccuggccggcgagaaggugcuccccaagcagagccugcuguacgaggaguucugcguccucaacgagcugaacggggugcggugguccgacgacggcgacgacuggcagcgcuucgacgccgcccagcgggaggggaucgugcgcgagcuguuccacaaguaccggcgcgucaccuacaagaugcucgaggacuggcuggugcgggagggcgacgccaaccacccgaucgucaagggcgggcagggcgagaccgggcuggagagcaagaugggcagcuaccucuucuucgcgaaggggaucuucggccugggcgagcugucccccgccgaguaccccgccaucgagaagaugaucaaguggaacacccucuucgaggaccgcagcauccugaaggagaagcuggaggacgaguucggggagcggggcaacgggaugcucgacgccucccagaucaaggcgaucugcaagaagcgcuucacgggcuggggccgccugagcgagcaguuccugaccgggcucaagguggagucccccgccggccgggccgugagcaucauggacguccugcgcgaggggaacccgugcuccgagcggcgccagggcgagaccguggugaugauggaggcccugcgggacgaggggcucggcuuccagaagaagaucgacgagcacaaccgcaacuacuacggccagcacgggaaggaccugggcgucaacgagcugcccgggagccccgccauccggcgcucccucaaccaggcgauccggaucguggaggagaucgccagcaucgccggccacgcccccgccaacaucuucaucgaggugacccgcggggaggacgcgggcaagaagggcaagcggacggucaagcgcugggacaagaucggggaggcccugaagaagcugaaggaggagggcguggccguggaggucauggacgacuucaaggagcagaaggccaucaacgccaaccucgacgagcggcugucccuguaccucaugcagaacgggaagugccuguacagcggcaaggcgaucaaccuggagaagcuccuggccggguccggcgaguacgagguggaccacaucaucccgcgcgccuacaucaaggacgacagcaucgagaacaaggcccuggugcuccgggaggagaaccagcacaagaccgaccagcugcugaucgacaaguccauccgcuggaagaugcgggagaccuggagccagcuccacgacgcgggccugaucggggacaagaaguaccacaaccugcuccgcuccaacaucaacgagaaccagcugcggggcuucaucgcccgccagcuggucgagaccagccagauggugaagcucgcccaggcccugcuggaggcccgguucgcgaacgaggagacgcgcaucgugcccgucaaggccagcaugucccacaaccuccgcgaggccgccgaccuggccaagugccgggaggcgaacgacuuccaccacgcccacgacgccuuccuggccagccgcaucggccucuucgugcagaugcggcaccccgggaucuacgagaaccccaucggguacucccacgugaucaagaaguacguccaggagcagagcgagguguucaagaagacccaccgcaugccgggcuccgccggcuucgugaucaacagcuucauguccagcggguucgacaaggacaccggcgaggucuucaaggacuccugggacgcggaggccgagguggacgggauccggaaggcccugaacuaccgccagugcuacaucagccggaugccccagcaggacaccggcgccuucuggaacgccacgguguacagcccccgcgacccgaagaugggccccaagcuggcgcucuccaccaagcaggggcuggaccccaagcuguacggcggguucuccagccagcaguucgccuacuucuucaucuacgaggccaagaagaagggcaagcccaccuuccgguucucccaggucccgguguggcucgccgcgcgcaucgaggccaacccccuggcccuggaggaguacgcccgggggcucgccaagggcgagggccuggaguucgugagcauccagcgccccaagaucuacaagaagcagcugaucgaggucaacggggacaagcucaucaucaccggcgcgaaggaggugcgguccggggccgagcuggccuucaaccaggacgagaucagcgccaucuccaugugcagcaagcugcgcgccgcggaggccggccucgacggggccuucagcgaggagguguccgccaucuggaaccggaucagcaacgcccccguccaguccugcggccgccugcugcggcagcucacccugccgaaguaccagagcaacuucgacuccagcuccaacgaggagaaggcggccguggugcugggccucaucgcccugcugaacgggaacaaccgcaucgucgaccucagcggcgucgggggcuccagccacgccggggcgaugaugauguccuaccccaagcugcuggacgaccccaaggugcccuucuucaucaucgaccagagcgugacgggcauguucgagcggaagacccgcgugggccucuga

SEQ ID NO: 2087 - RNA, 4176 nt, Artificial Sequence
  Cas9 variant
augaagaagauccugggccucgaccuggggaccaccagcaucggcugggcccuggugaacgagaaggagaacaacgaggagcaguccagcaucauccgccucgggguccgggugaacccccugacgguggacgagaaguccaacuucgagaagggcaaggacaucaccaccaacgccgaccgcaccaagugccggagcgcgcgccggaaccugcagcgcuucaagcuccggcgcgaggcccuggccgacugccugaagcggcacgggcucaugacggacgagaccccgcugugcgagaccaacaacuccaucaucuucaagaccuacagcaaccgcgccaaggccgucugcgagaagaucgcgcuggacgacuucgugcgggugcuguucaugaucaacaagaagcgcggcuacaaguccagccggaagcugaacacggacgacgagggcacccuggucgacgggauggacguggccaagcuccuguacaacgagcagaucacccccggcgaguaccugcuccgccuguucaagaaggggaagaagacccggcccgacuucuaccuguccgaccucaaggccgagcuggagcgcaucugggacuuccagcggacguucuaccccgagauccugugcgacgcccucaaggaggaccugaagggcaagagccgcacccaguccagcgcgaucuucuacgccaaguacaagguguccaccgccaagaucgccgggaaggacaagcggcugcaggagcucaccuggcgcacggacgcccugcggaagcagcugaccaucgacgaggucgcguacgugaucugcagcaucaacggcgagaucaacggcuccagccagcgccucuccaugaucagcgaccgcuccaagcugcuguacuucaaccaccagaccaucgggcaguaccucaugcagcggcuggaggagaacccgaacgccggccugaagaacaucaucuucuaccgccaggacuacgaggacgaguucaacgacaucuggaacagccaggccaccuaccacaaggagcucacgcccgagcugaagaaggagcugaaggacaucaucuucuaccagcgggggcucaagagcugcaaguggcugaucaacuacugcgagcuggagcacgaggagaucgaggugaagacccccgagggcaagcuccgcaagaucaccaucggcuccaagaccugccccaagagcuccccgcuguuccaggaguucaagaucuggcagguccugaacaaccuccaggugagcccccugaacucccggcgcaaggccaagcggaagaaggacgaggagcccagccuguucuccgacgaggacaugaacacggccugccgcuaccucaacgaggaggagaagcugacccuguucaaggagcugagcaucaagaaggagcucaagaagaaggacgcgcugaagcuccucuucgagaacuacaaggagcuggaccugaacuacaaggugaucuccgggaacgucaccauggccagccucuaccgggccuuccaggacaucaucucccugaccggcaacggggaguucgacuuccaggccaugcccgccgaggaggcggagaagacgguggaggagaucuucggcgggcugggcuacaagaccgccuuccuccacuucgacgccagccugcacggcaaggaguucgagcgccagccggccuaccggcuguggcaccuccuguacuccuacgccggggaccagagcaagaccggcaucgaggcgcuggugaagcgcauccaggagcucugcggguucgagcccgaguacgcccggauccuggccaacaucuccuucauccccgacuacggcaaccugagcuccaaggccaugcgcaagauccuccccuacaugcaggacggguacgaguacagcgaggcgugcuccaaggccggcuaccggcacagcgccagcucccugaccaaggaggagaucaacaagaagacguacaagacccaccuggacgagaucaagcgcaacagccuccggaacccgaucgucgagaagauccugaaccagauggugaacguggucaacuccgugaucgacaccuacggcagcaucgacgagauccgcaucgagauggcccgggagcugaagaaguccaagcccgagcgcgaggacaugagcuucgccaucaacaaggcgaccaaggagacggagcgcaucaaggggauccucgagcaggaguucaagauccagcacgugacccggaacgacaucauccgcuaccggcuguacgaggagcugaagcccaacggcuacaagacccucuacuccaacaccuacaucccccgcgaggaccuguucagcaagaaguucgacaucgagcacaucaucccgaaggcccggcuguucgacgacuccuacagcaacaagacccucgagcugcgcgacaucaacaucgagaaggggaaccagacggccuacgacuucguccuguccaaguacggcgaggaggggcucuacaaguacgagcagcggguggaggaguucaagaagaacaacgagcaggccggcagcaagugccgcaagcugcugaugcgggaggccgacauccccuccgacuuccucaaccgcgaccugaacgacagccaguacaucgcgaagaaggcccacgagcugcuccgggagaucguccccaccgugaccgccaccacgggcuccaucaccaaccgccugcgggaggacuggaagcuggugaacgucaugaaggagcucaacugggagaaguacgacaagcuggggcugaccgaggaguacaaggacaaggacggcaacaccgugcgccacaucaaggacuggacgaagcggaacgaccaccgccaccacgccauggacgcccucaccaucgcguucaccaagcccagcuucauccaguaccugaacaaccugaacgcccgguccaacaagggcgggagcaucuacggcaucgagcagaaggagcucgagcgcgagaacaacaagcugguguucaucccgcccaucgaccccaagaucuuccggaagcaggccaaggagcaccugagcaacauccucaucuccaucaaggccaagaacaaggucgugaccaagaacgugaacaagaccaagagcaaguccgggaccaaccgcaagguccagcugacgccccggggccagcugcaccucgagaccguguacgggaagauccgcacguacaagaccgaggagaucaaggugggcaccaagcugaccgaggagcugaucgcgaaggucgccgacaagaagauccgcgaggcccucaugcagcggcugagcgaguacgggggcaacaucaagaaggccuuccagaacaucuccaagcacccgaucuggcugaacagcucccacacgaagcacgugcccgagaaggugaagaucgucuucuucgaggacguguucaccauccgcaaggccaucacccccgacaucaagaucgacaaggugaucaacagcaagauccggaacauccuccaggagcgccugaacgaguucggcggggaggcggccaaggccuucuccaaccuggaccagaacccgaucugguucaacaaggacaagggcaucgccaucaagagcgucaagauccgggggaucgccaacggcaccgcgauccgcgugaagaaggacauccacgggaacacgaucaucggcaacaacggcuaccccauccccaacgacuacgugaacaccgggaacaaccaccacgucgccaucuuccgggaccgcgacggcaaccuccaggagcacaucguguccuucuacgaggccaccgcccgggccauccagaaccugcccaucguggaccgcaacuacaacagcgagaaggacugggaguuccuguucuccaugaagcagaacgaguacuucgucuucccgaaccccaacaccggguucaacccccucgagaucgaccugcggaacgaggagaacuacgcgcugaucagccccaaccucuuccgcgugcagaagcugucccacuacuacuacguguuccggcaccaccuggagacgaacgucgacaccaaccuccagcugaaggacaucaccuggaagcgcaucaaggccaucaacaaccugaccggcguggugaagguccggaucgaccaccucgggcgcaucguggacgugggcgaguacaaguga

SEQ ID NO: 2088 - RNA, 4176 nt, Artificial Sequence
  Cas9 variant
augaagaagcgcaucgacgacuacauccugggccucgacaucgggaccaacagcugcggcugggccgugaccgacaagaagaacaaccugcugaagcuccgggggaagacggccaucggcucccaccuguucgaggaggggcacaccgcggccgaccgccggggcuuccgcaccacccggcgccggcugaagcgccggaaguggcgccuccggcugcuggaggagaucuucgccgagcccauggccgaggucgacccgggcuucuucgugcgccuccaccagagcugggugagcccccuggacaagagccggaagaaguaccaggccaucgucuuccccacggcgaaggaggaccaggaguacuaccagaaguaccccaccaucuaccaccuccgcgacgcccugaugacccaggaccggcaguucgaccugcgcgagaucuuccuggccauccaccacaucgugaaguaccgggggaacuuccuccaggacaccgccgugaaggacuucgaggcguccaagaucgaggucggcccgauccugacgaacaucaacaacgccuucgccgacaagaucguggaggggcaggaccugaucgagcucaacguggccaacgccgcggagaucgaggccgucauccgcggcaaggacgccgacaagacccuguacaagauggacaaggugaagaagaucgccaagcugcucaccgacagcaccgccaaggagcagaagaacguggcgaagcagaucgccaacgccaucaugggguacaagacgcagcuggagaccauccugggcaaggagaucgacaagaacgacaaggcccagugggaguucaagcucuccgacgccgacgacaagcuggacgcgcugcuccccgaccuggacgagagcgaccagaccgucguggccgagaucgagaagcuguucuccgccaucacccucagcacgaucguggacgagaacaagucccugagccaguccauggucgagaaguacaacaagcaccaccaggacuacaagcugcucaaggccuacaucgagagccugcccgaccgggcccaggcgaagaagcugcuccuggccuacgaccuguacgugaacaaccgccacggccaccuccuggaggccaagaccgaguucaagcaggacuccacccugaccaaggaggacuucuacaagacggugaaggacaaccucgacgacagcgagcuggcccacaagaucgcgcaggagaucgccgccgacaacuucaugcccaagcagcggaccaacuccaacggggucaucccguuccagcugcaccagaucgagcucgacaagaucaucgccaaccagagcaaguacuaccccuuccuggccgcggagaaccccguggaggaccaccgcaagcaggcccccuacaagcuggacgagcucgugcgcuuccgggucccguacuacgugggccccaugaucaccgccgacgagcaggagaagaccuccggcaagagcuucgccuggauggugcgcaaggagcaggggcagaucacgcccuggaacuucgagcagaaggucgaccggcaggagagcgccaacaaguucaucaagcgcaugaccaucaaggacaccuaccugcugggcgaggacgugcugcccgcgaacucccuccuguaccagcgguucgagguccugaacgagcucaacaacauccgcgugaacgggagccggaucuccguggaccugaagcagcagaucuucaacgaccuguucgaggagaagaagaccgucacggagaaggcccucaucagcuaccugaagcagaaccugcaccucccgaccguggagaucaagggccuggccgaccccaccaaguucaacuccagccuggccuccuacuaccaccucaagaaccugcacguguucgacaaggagcuggccgacccccaguaccagaaggaguucgagaagaucaucgaguacagcuccaucuucgaggacaagaagaucuuccaggacaagcuccacgcggaguucaaguggcugacccccgcccaguucaaggccaucagcacguggcgccugcagggguggggccggcucucccgcaagcugcuggucgagcuccacgacaccaacgggcagaacaucaucgagcagcugugggacagccagaagaacuucaugcagaucgugaccgagccggacuucaaggaggccaucgcgaaggagaaccagaacaucacccaggagaacggcguggaggagauccuggccgacgccuacacgucccccgccaacaagaaggccauccggcaggucgugaagguggucgcggacguggugaaggccgccagcggcaaggcccccgcccaguucgcgaucgaguucacccgcgaccccgacaagaacccgcagcucucccacauccgggggaccaagcugcugaaggccuaccaggagaccgccggcgagcucgucgaccagaaccugaccaacagccugaaggaggccaugacgucccgcaagcuccugaaggacaaguacuuccuguacuucaugcagaccgggcgggacgccuacaccggcaagaagaucaacaucgacgaggugagcaccaacuaccagaucgaccacauccucccccaguccuucaucaaggacgacagcuucgacaaccgcgugcugacggcgacgccccugaacgccgagaaguccgacgacguccccuacaagcgguucgccaacaacuacguguccgaccucaagaugaccgugggggagauguggaagcacuggcagaaggccggcaucaucaacaagcacaagcugggcaaccugcuccuggacccggaccgccugagcaaguuccagaaguccggguucaucaaccggcagcucgucgagaccagccagaucgugaagcugguguccgucauccugcagaacaaguaccccgacgcggagaucaucaccgugaaggccggcgacaacagcgcccuccgccagcgccuggaccuguacaagucccgggacgugaacgacuaccaccacgccaucgacgccuaccucagcaucgucugcgggaacuuccuguaccagguguaccccaaguaccgcccguacuucguguacggccaguucaagaaguucucccaggaccccgaccugcagaaggaccucaucaagcacuucaagggguucaccuucauguggccccugcugcagaaggacaacagcgagcggaaggcgcucgaggagaucaaggagaacaacuccgaccgcaucgucuucuacaagcaccccgacaucuucgacaagcugcggaaggccuacaacuacaaguacaugcuggugagccgcgagaccuccaccgagagcuccagcauguucaacaugacgaucuacccgcggggcgagcgcgaccggaagaagacccgcaagcucauccccaagggcaacgggcuggaccccaagaucuacggcggguacuccggcaacaccgacgccuacauggugaucgucaagaucgagaaggccaaggagagcaucuacaaggugaucggcauccccaugcgggcccuggcggggcucaagcaggccaagaaccagggcaacuacaaggaggagcugcacaagguggucgagccgcagaucaugcuggacaagaacgggaagcccaagcgcggcguggagggguuccggguggucaaggaccacgugcccuucaagcaggucgugcucgacggcgacaagaaguucaugcuguacagcgccaaguacgagaccaacgccaagcagcugacgcucucccaggagaccaugcgcaucgugaccgacaaccugaagaaguccgaggaccaggacaagcugcucgugaaggccuacgacgagauccugcagaaggucgaccaguaccugccccucuucgacgugaacaaguuccggaacagccugcaccugggccgcgcgaaguuccucgaccuggccgugaacgacaagaagaucacccugagcaacauccucaacgggcugcacgacaaccuggucgugccgaaccucaagaacaucggcaucaagacgcccuucgggcugaugcagucccccagcggcaucacccuguccagcaacgccauccucaucuuccagucccccaccgggcuguucgagaagcgggugcgcaucgccgaccuguga

SEQ ID NO: 2089 - RNA, 4176 nt, Artificial Sequence
  Cas9 variant
auggagaacaagcaguacuacaucggccuggacguggggaccaacagcgucggcugggccgugaccgacacguccuacaaccuccugcgcgccaaggggaaggacauguggggcgcgcggcuguucgacgaggccaagaccgccguggagcgccggaccaagcgcaccagccggcgccgguccgagcgcgagaaggcccggaaggccaugcucaaggagcuguucgcggacgagaucaacaaggucgaccccaacuucuucauccgccuggaggagagcaaguucuuccucgacgaccgguccgagaacaaccgccagcgguacacgcuguucaacgacgccaaguucaccgacaaggacuacuacgagaaguacaagaccaucuuccaccuccgcagcgcccucaucaacuccgacgagaaguucgacgugcggcugguguuccuggccauccucaaccuguucagccaccgcgggcacuuccugaacgcgucccucaagggcgacggcgagauccagggggucgacaucuucuacaacgaccuguacgaggugugcgaggaguucgagaucgaccugccgcagaucagcaacaucgacaacuucgagaagauccucucccagaagggcaagagccggaccaagauccuggaggagcuguccgaggagcucagcaucuccaagaaggagaagaucaaguacagccugcugaagcucaucugcgggaugaagaucaagguggucgacaucuacgccgacgaggacauccaggaggacgacaagaagaaggaccugggcuuccgcgaguccgacuacgagaaguccucccuggaggugaaggagaucaucggggacgaccacuucgagcucaucgagcgggccaaggccgugcacgacaucggccugcuggccaacaucaucggcaacagcaaguaccucugcgaggcgcgcgucgaggccuacgacaaccaccacaaggaccugcagaagaucaaggagcugcucaagaaguacgacaucaaggccuacacggacauguuccggaagaugaccgacaagaacuacagcgccuacgugggguccgugaacagcaacaucgccaaggagcgccgcuccgucgacaaccggaagaucgaggaccuguacgaguacaucaagaagaucgcgcugaagaacaucagcgacgacaacgaggacaagaucgagauccucaagaagaucgagaccggcgaguuccugaagaagcagcugaccgccuccaacggggugauccccaaccagcuccagagccgcgagcugcgggccauccugaagaaggccgagaacuaccuccccuuccugaaggagaagggcgagaagaaccugacgguguccgagaugaucauccagcuguucgaguuccagauccccuacuacgucggcccgcuggacaagaaccccaagaaggacaagaacgccaacagcugggcggugauccccuccgggggccgcauccugcccuggaacuucgaggacaagguggacgucaaggggagccggaaggaguucaucgagaagauggugcgcaagugcaccuaccucuccgaggagcacacccugccgaagcagagccugcuguacgagaaguucauggugcucaacgagaucaacaacaucaagaucgacggcgagaagaucuccgucgaggccaagcagaagaucuacaacgaccuguucaugaaggggaagaaggugagccagaaggccaucaagcaggagcugaucucccucaacaucaugagcaaggacuccguccugagcggcaucgacaccgugugcaacgccuaccuguccagcaucgccaaguuccggggcguguucgacgagaacgucaacaaccagagcacgaucgacaugaucgaggacaucaucuuccucaagaccguguacuccgacgagaagcgcuucgugaaggaggagaucgucgagaaguacggggacgagaucgacaaggacaagaucaagcggauccugggcuucaaguucagcaacugggggaacaucuccaagagcuuccuggagcucgagggcgcggacguggggaccggcgagauccgcuccaucauccagagccugugggagaccaacuucaaccugauggagcuccuguccagccgguucacguacauggacgagcuggagaagcgcgugaagaagcucgagaagccccuguccgaguggaccaucgaggaccuggacgacauguaccucagcucccccgucaagcggaugaucuggcagagcaugaagaucguggacgagauccagaccgugaucggcuacgcccccaagcgcaucuucgucgagaugacccgguccgagggggagaaggugcgcaccaagagccggaaggaccgccugaaggagcuguacuccgccaucaaggaggacagcaagcagugggugaaggagcucgacgccaaggacgaguccuacuuccggagcaagaagauguaccuguacuaccugcagaagggccgcugcauguacagcggggaggucaucgagcucgacaagcugauggacgacaaccuguacgacaucgaccacaucuacccgcgcuccuucgugaaggacgacagccucgacaaccuggugcuggucaagaaggagaucaacaaccggaagcagaacgaccccaucacgccccagauccaggcguccugccagggcuucuggaaggugcuccacgagcagggguucaucagcaacgagaaguacucccgccugacccggaagacccaggaguucagcgacgaggagaagcuguccuucaucaaccgccagaucguggagacgggccaggccaccaagugcauggcccagauccuccagaaguccaugggcgaggacgucgacgugguguucagcaaggcccggcuggucagcgaguuccgccacaaguucgagcuguucaagucccggcucaucaacgacuuccaccacgccaacgacgcguaccugaacaucgugguggggaacagcuacuucgucaaguucacccgcaaccccgccaacuucaucaaggacgcccggaagaacccggacaaccccgccuacaaguaccacauggaccgcuucuucgagcgggacgugaaguccaagagcgagguggccuggaucggccaguccgaggggaacgcgggcaccaucgccaucgucaagaagacgaugagcaagaacagcccccugaucaccaagaagguggaggagggccacgggagcaucaccaaggagaccaucgugggcgucaaggagaucaaguucgggcgcaacaagguggagaaggccgacaagacgcccaagaaggccaaccuccaggccuaccggccgaucaagaccuccgacgagcgccugugcaacauccugcgguacggcgggcgcaccagcaucagcaucuccggcuacugccucguggaguacgucaagaagcggaagaccauccgcagccuggaggcgauccccguguaccugggccggaaggacucccucagcgaggagaagcugcugaacuacuuccgcuacaaccucaacgacgggggcaaggacuccgugagcgacauccggcugugccugcccuucaucuccaccaacagccucgucaagaucgacggguaccuguacuaccugggcgggaagaacgacgaccgcauccagcucuacaacgccuaccagcugaagaugaagaaggaggagguggaguacauccgcaagaucgagaaggccguguccaugagcaaguucgacgagaucgaccgggagaagaaccccguccugacggaggagaagaacaucgagcucuacaacaagauccaggacaaguucgagaacaccguguucuccaagcgcaugagccuggugaaguacaacaagaaggaccuguccuucggcgacuuccucaagaacaagaaguccaaguucgaggagaucgaccuggagaagcagugcaagguccuguacaacaucaucuucaaccucagcaaccugaaggagguggaccugagcgacaucggcggguccaagagcaccggcaagugccggugcaagaagaacaucaccaacuacaaggaguucaagcucauccagcaguccaucacggggcuguacagcugcgagaaggaccugaugaccaucuga

SEQ ID NO: 2090 - RNA, 4176 nt, Artificial Sequence
  Cas9 variant
augaagcgcaacaacgacuacuacaucggccuggacauggggaccaacagcgugggcugggccaccacgaacccccaggggcggcuccugcgcuucaacaagaaggacauguggggcucccggcuguucgaggaggccaagaccgcggccaagacccgcaccuuccggacgagccgccggcgcuacgaccggguccgccagcggaucgaguuccuccaggacaucuucgccccgaucaucgccaagaaggacuucgaguucuucaugcgccugaaggaguccaaguuccaccuggaggacaagaagaccgacgggaaguucgcccucuucaacgacgcggacuucaccgacguggaguacuucgaccgguaccccaccaucuaccaccuccgcgccgcccugaucaagcccaaccacaucacggacccccggcugcuguaccuggccauccaccacaucaucaagaaccgcggccacuuccucuucgcgggcaccgacauggagagcauccgguccuuccagaucguguacacccagcugagcgagcaccugaaguccaucaaccucgacuucgagcugccggucgacgcccaggacaaguucgccgccauccugcucaacgagaagcugaacaagcgcgacaagaagaagcagcugaaggagcucugcccccacaaggacaagcggcuggaguacgccuucaacgcgaucaucgggggcaagaccaagcugaaggacaucuucgggguggaggaguacgacgagggcacgaagaaggccguggacuucgagaaggccgacuacgacgaggacaaggacgagaucgagagcgucaucaaggagaacauccacgugcucaacgcccugaaggccguguacgacuggaccauccugaccaacauccucggggacuacgcguacaucuccgagagccaggucgcccuguacgaggcccacaagaaggaccugcgcauccucaagucccugaucaagaaguacgccaagagccaguacgccgacgcguuccggcacgagaacgugaagggcaacuacgccaacuacgugggcuccaccaacuacgacaacaagcagcccgucaucgacaaccccagcgugacgcaggaggacaucaacaaguacuucgccgacauccugcucuccaucaccccggacgagagcgaccgcgaguccuaccaguacaucaccgagcgccugcacaagggggaggcccugcccaagcuccggaccaaggccaacagcgugcugccccaccagauccacaagaucgagcuggagaagauccucgcgaacgccgccaagaacuuccccuuccugcaggagaaggacuccagcggcuacacggccgcgcagaagaucgucaagaucaugauguuccgcaucgaguacuacguggggccgcugaacaccuaccaccacguggaccagggcggccacgccuggaugguccggaaggccgaggggaagaucacccccuggaacuucgacgagaagguggacaaggaggccagcgccgagaaguucauccgcaacaugaccaacaagugcacguaccucaucggcaaggacgugauccccaagcagucccugcuguacagccgguacaagguccucaacgagcugaacaaccugaaggugaacggggcgcccaucuccguggcccucaagcagaagaucuacgaggagcuguucaagaagcaggucaacgugaccuucaaccagcugaagaccuuccugaagacccagggcgaggacgccgacgagaucauccucagcggggucgacgaggccgcccacaaguucacgaacaaccugcagaccuaccacaaguuccgcgcgauccugcgggacaagaucgaguucgagccgcagcgcuccaugguggaggacaucauccgguggaagugccucaugggcgacgacaucaccauguggaagcacaagaucgagaaggaguacggcgaccagcugagcgaggagcagcugaagaagaucacccgccucaacuucaacggguggucccggcugagccaggaguuccugacggacgugcccggcgucgacaucgaguccggggagguguacagcggcaucauggacgcccucuggcgcaccaacgagaacaucaugcagcugcuguccagccgguucaccuucgccgccgaggugaagaagcagaaccaggggaccggccgcaucgagaagaucacguacgacgaggucaugaaggacaccuaccucucccccgccgugaagcggagcguguggcaggcgaucacccuggucgaggagauccgcaagauccggaaggccgaccccaagcgcaucuucguggagaugacccggcagccggacgccaagaaggagcgcaagcugucccgccggacccagcuccugaacgccuaccgcgcgaucggcaacgacaucgccgaguacgagaaggagcacgugagcacgcugaucacccagcucgaguccaagaaggacgaggaccugcggcgcaagaagcuguaccucuacuucacccagauggggcggugcauguacaccggcgagcgcaucgaccugagcucccugcuccgggacacgaacagcaacaucuacgacaucgaccacaucuacccccgcagccugaccaaggacgacucccuggacaacaccguccucugcaagaaggagaucaaccugaagaaggggaacaaguacauccaccggguguucaccgacaaggagcugaagaagcaguacggcuacuggaaggcccucaaggagaagaagcugaucagcgagcgcaaguucucccggcugaugcgcacgaccgaccucaccgccgacgagcuggccggguucaucagccggcagcugguggagaccucccagauggucaaggcgacggccgacauccucgagaagaucuaccccaacgugaccaucguguacgucaaggcccgcaccgugagcgacuuccggcacgacuacgagcugcccaaggugcgcgcccugaacgacugccaccacgcccacgacgcguaccucaacaucgucgugggcaacguguacuacgagaaguucaccaaguccccguuccgguucaucgccaaccagaagggcaagggggacaucaaguacaaccuguaccgccuguucgacaaggacgucaaggugggcgaccggaucaucuggaacgccaaggaggaccucgcccgcgugaaggccacgcuggagcgggacaccgucaacguggugcgcaugcccgucgagcagcgcgggcaguucuucgacgcgaccauccagaagaagggcaccacgaagaacaugcuggugcucccccugaagggcagcgacgagcggcugcaggacaccuccaaguacggguacuacgugcgccccagcggcauguccuucauggucgugcagcacgaggugaagggcaagagccgggucaccaucgagccggcccuccugguguacaagaacaagcugaaguccgaggacgacuacgccaaguacugcgaggacgugcucaagcugcagaagcccaagguccuguucaagaacaucaaguucgggagcaagauccucuucgacggguaccccuuccugcugaagggccgcaccgagaaccggaucaucauggccgacgcgcagucccucuuccugggcaaccaggagcugaagauccucaagcgcgugacgaagaucagcgacgacaucgaccacaagguggagucccggaucaagaucaccgacgaggaguggaccacccuguggaaguccgucguggagcagaucgugacggggaaguuccgcaaccggcugggcacccucaacgggauccugcagggccgcaagaucaagcugagcaaggacgaggaggcccggcucaacgagcuggacagcaaggaccaggagaccuuccugagccagauccuccuggagcgcuuccugcaguucuccaccgaggagaagacgcggcuccugcugcaggucaucagcuucuccgggaacaccaccggcguggaccuccgccugaucggcgggagcuccggcaccgggacgaucaagaccaacaagaacaucaccgaccacagcgugauccugaucaacgaguccccgaccggccucuucaccaaccggacgguccugaaccagcccuga

SEQ ID NO: 2091 - RNA, 4176 nt, Artificial Sequence
  Cas9 variant
augaagcgcaacaacgacuacuacaucggccuggacauggggaccaacagcgugggcugggccaccacgaacccccaggggcggcuccugcgcuucaacaagaaggacauguggggcucccggcuguucgaggaggccaagaccgcggccaagacccgcaccuuccggacgagccgccggcgcuacgaccggguccgccagcggaucgaguuccuccaggacaucuucgccccgaucaucgccaagaaggacuucgaguucuucaugcgccugaaggaguccaaguuccaccuggaggacaagaagaccgacgggaaguucgcccucuucaacgacgcggacuucaccgacguggaguacuucgaccgguaccccaccaucuaccaccuccgcgccgcccugaucaagcccaaccacaucacggacccccggcugcuguaccuggccauccaccacaucaucaagaaccgcggccacuuccucuucgcgggcaccgacauggagagcauccgguccuuccagaucguguacacccagcugagcgagcaccugaaguccaucaaccucgacuucgagcugccggucgacgcccaggacaaguucgccgccauccugcucaacgagaagcugaacaagcgcgacaagaagaagcagcugaaggagcucugcccccacaaggacaagcggcuggaguacgccuucaacgcgaucaucgggggcaagaccaagcugaaggacaucuucgggguggaggaguacgacgagggcacgaagaaggccguggacuucgagaaggccgacuacgacgaggacaaggacgagaucgagagcgucaucaaggagaacauccacgugcucaacgcccugaaggccguguacgacuggaccauccugaccaacauccucggggacuacgcguacaucuccgagagccaggucgcccuguacgaggcccacaagaaggaccugcgcauccucaagucccugaucaagaaguacgccaagagccaguacgccgacgcguuccggcacgagaacgugaagggcaacuacgccaacuacgugggcuccaccaacuacgacaacaagcagcccgucaucgacaaccccagcgugacgcaggaggacaucaacaaguacuucgccgacauccugcucuccaucaccccggacgagagcgaccgcgaguccuaccaguacaucaccgagcgccugcacaagggggaggcccugcccaagcuccggaccaaggccaacagcgugcugccccaccagauccacaagaucgagcuggagaagauccucgcgaacgccgccaagaacuuccccuuccugcaggagaaggacuccagcggcuacacggccgcgcagaagaucgucaagaucaugauguuccgcaucgaguacuacguggggccgcugaacaccuaccaccacguggaccagggcggccacgccuggaugguccggaaggccgaggggaagaucacccccuggaacuucgacgagaagguggacaaggaggccagcgccgagaaguucauccgcaacaugaccaacaagugcacguaccucaucggcaaggacgugauccccaagcagucccugcuguacagccgguacaagguccucaacgagcugaacaaccugaaggugaacggggugcccaucuccgucgcgcucaagcagaagaucuacgaggagcuguucaagaagcaggucaacgugaccuucaaccagcugaagaccuuccugaagacccagggcgaggacgccgacgagaucauccucagcgggguggacgaggccgcccacaaguucacgaacaaccugcagaccuaccacaaguuccgcgccauccugcgggacaagaucgaguucgagccgcagcgcuccaugguggaggacaucauccgguggaagugccucaugggcgacgacaucaccauguggaagcacaagaucgagaaggaguacggcgaccagcugagcgaggagcagcugaagaagaucacccgccucaacuucaacggguggucccggcugagccaggaguuccugacggacguccccggcguggacaucgaguccggggagguguacagcggcaucauggacgcgcucuggcgcaccaacgagaacaucaugcagcugcuguccagccgguucaccuucgccgccgaggucaagaagcagaaccaggggaccggccgcaucgagaagaucacguacgacgaggugaugaaggacaccuaccucucccccgccgugaagcggagcgucuggcaggccaucacccugguggaggagauccgcaagauccggaaggcggaccccaagcgcaucuucguggagaugacccggcagccggacgccaagaaggagcgcaagcugucccgccggacccagcuccugaacgccuaccgcgccaucggcaacgacaucgcggaguacgagaaggagcacgucagcacgcugaucacccagcucgaguccaagaaggacgaggaccugcggcgcaagaagcuguaccucuacuucacccagauggggcggugcauguacaccggcgagcgcaucgaccugagcucccugcuccgggacacgaacagcaacaucuacgacaucgaccacaucuacccccgcagccugaccaaggacgacucccuggacaacaccgugcucugcaagaaggagaucaaccugaagaaggggaacaaguacauccaccggguguucaccgacaaggagcugaagaagcaguacggcuacuggaaggcccucaaggagaagaagcugaucagcgagcgcaaguucucccggcugaugcgcacgaccgaccucaccgccgacgagcuggccggguucaucagccggcagcuggucgagaccucccagauggugaaggccacggcggacauccucgagaagaucuaccccaacgugaccaucgucuacgugaaggcccgcaccgugagcgacuuccggcacgacuacgagcugcccaagguccgcgcccugaacgacugccaccacgcccacgacgccuaccucaacaucguggugggcaacgucuacuacgagaaguucaccaaguccccguuccgguucaucgcgaaccagaagggcaagggggacaucaaguacaaccuguaccgccuguucgacaaggacgugaaggugggcgaccggaucaucuggaacgccaaggaggaccucgcccgcgucaaggccacgcuggagcgggacaccgugaacgugguccgcaugcccguggagcagcgcgggcaguucuucgacgccaccauccagaagaagggcaccacgaagaacaugcuggugcucccccugaagggcagcgacgagcggcugcaggacaccuccaaguacggguacuacguccgccccagcggcauguccuucaugguggugcagcacgaggucaagggcaagagccgggugaccaucgagccggcgcuccugguguacaagaacaagcugaaguccgaggacgacuacgccaaguacugcgaggacguccucaagcugcagaagcccaaggugcuguucaagaacaucaaguucgggagcaagauccucuucgacggguaccccuuccugcugaagggccgcaccgagaaccggaucaucauggccgacgcccagucccucuuccugggcaaccaggagcugaagauccucaagcgcgugacgaagaucagcgacgacaucgaccacaaggucgagucccggaucaagaucaccgacgaggaguggaccacccuguggaaguccgugguggagcagaucgucacggggaaguuccgcaaccggcugggcacccucaacgggauccugcagggccgcaagaucaagcugagcaaggacgaggaggcgcggcucaacgagcuggacagcaaggaccaggagaccuuccugagccagauccuccuggagcgcuuccugcaguucuccaccgaggagaagacgcggcuccugcuccaggugaucagcuucuccgggaacaccaccggcguggaccugcgccugaucggcgggagcuccggcaccgggacgaucaagaccaacaagaacaucaccgaccacagcgucauccugaucaacgaguccccgaccggccucuucaccaaccggacggugcugaaccagcccuga

SEQ ID NO: 2092 - RNA, 4179 nt, Artificial Sequence
  Cas9 variant
augaaguccauccugggccucgaccuggggaccaccagcaucggcugggcccuggugaaggagagcgagaacgacaacgagaaguccgagaucgucaagcucggggugcgccuggugccccugacgaccgacgagcggaccgacuucgagaagggcaagagcaucaccacgaacgccgaccgcaccuccaagcggagcaugcgccggaaccuccagcgcuacaagcugcggcgcgaggcgcuggucuccgagcucaagaaggagcacuggaucgacgagggguaccgguucagcgaggacggcccgggcuccaccuucagcacccugcgccugcgggccaaggccgccgaggaggagaucucccuccaggaccuggccaaggugcugcuccagaucaacaagaagcgcggguacaagagcucccggaagcugaacagcgcggaggacggccaggccaucgacgggauguccguggccaagguccuguacgaccgcggccucacgcccggggaguacguguaccagcggaugcuggacggccaguacgccauccccgaguucuacaagagcgaccugcaggcggaguucgacaagaucuggaaccuccagaaguccuacuaccccgagcugaccgccgagcuguacgacaagcucaccgacaagaacaagagccagaccugggccaucugccgcgacgagcugggcgugcagggguucaaguccagcuucacgggcaaggagcggcugaaggaggccuacuucaaccgccagcaggccagcaagcagaaggucgaccucgaggugcugaccugcgugcugcaggacaucaacgggcagaaggcgucccucagcggccugcuguccgccaucagcgaccgguccaaggagcucuacuucaaccgcaugaccgucggccagaugcuggugcggcagauccaggaggacccgaaccgcagccugcgcaacaccguguucuaccggcaggacuacaucgacgaguucgagaagaucugguccguccagagccgcuuccaccccgagcucacgcaggagcggaagaagaagcugaaggacaucaucaucuucuaccagcgcccccugaagucccagaaggggcucaucagccugugcgaguucgagucccgggagguggacaucagcguggacggcgucaucaagaagaagaagaucgggccccgcgugugcccgcgguccagcccccuguuccaggaguucaagguguaccagaccgucaacaacauccucgugaacggcgagccccuggacgacaacgaccgcgagaagcuggugggggagcucgccuuccgggagaagaugaagggccaggacguccugaagcugcucuacaagaccuccaagggcaugcgcaucaacuucgaggagguggaggggaaccggaccauggccacgauccugaaggccugcgagaagaucgucgagggccugggguacgacacccgcgaccugagcaagaucaccgcguccgagaaggugagccggaucgaggagaucuucgccaaggagggcuucaaguccgacuuccuccacuucgacagcagccugcccuccccggaguucgagagccaggccuccuacagccuguggcaccuccuguacuccuacgagaacgacaagagcguguccgggaacgagagccuggucgagaagaucaagaagcucugcuccauggacgaggccagcgccaagauccuguccggcugcaccuuccugagcgacuacggcucccucagcgcgcgcgccaugcggaagauccugcccuacaugaaggacgggcuggaguacuccgccgccugcgccauggcgggcuaccgccacagcaagcggucccucacgaaggaggagcuggacagccgcguguacguggaccggcuggagcuccugcccaagaacagccugcgcaaccccgucguggagaagauccucaaccagaugaucaacguggucaacuccgugguggacaccuacgggaagccggacgagauccgcaucgagauggcccgggagcugaagaaguccgccagcgagcgcgagaaggcccagaaggacaucgcggccgccagcaaggucaacgaguccaucguggccacccugaagggcagccccuucuucaucgacucccccagccggaacgacaucauccgcuaccggcucugggaggagcugaagcccaacggguacaagacccuguacuccggcacguacaucccgaaggagcgccucuucagcaaggacuucgacaucgagcacaucaucccccaggcccugcuguucgacgacuccuucgcgaacaagaccaucgagagccggcagugcaacaucgagaaguccaaccgcaccgccauggacuacgucaagagcaaguacgacuccuucggcgugcaggccuacaucgaccgggugaaggggcucaccggcgugagcaagacgaagaucacccgccugcugauggaguccaaggacauccccgaggacuucaucaaccgggagcuccgcgacagccaguacaucgcccggaaggcccgcgagauccuggaguccauggucaaguucguggugcccaccaccgggagcgucacggcgcggcugcgcgaggacuggcagcucgugaacgugaugcgggagcugaacugggacaaguacgagaagcugggccucaccagcuuccgcgaggaccgggacggccgcgagaucccggucaucgaggacuggaccaagcggaacgaccaccgccaccacgccauggacgcccugaccaucgccuucacccgccggcaguucauccaguaccugaaccaccucaacgccaagaucgacacgguggacaagaccgacaucgaccugcgcgacuacaaccuggaggacaucuccuucgacgggcuccgggacggcgacaaguucgggaucgugaaggcgcugcagaagaaguaccuguacaaggacgacaagcagaaguaccgcuucgucccgcccaugccccucgacgaguuccggaucgaggccaagcgccagaucgaggacgugcuggugagcuucaaggccaagaacaaggucugcaccaagaacgugaacaccacgaaggugcggggcgggcagcagcgcaagauccagcugacgccccggggcccccuccacgaggacaccaucuacggcaagcgccugcaguacgucaccaaggaggagaaggucgggggcuccuucgacgaggccaagaucgcgagcgugugcaagaaguccuaccgggaggcccugaugcgccggcucauggagugcgggggcgaccccaagaaggccuucaccgggaagaacagccuggagaagaacccgguguggguggacgaguuccacuccggcgaggugccccugcgcguccggaccgugagcauggccuccguguacaccguccgcaagagcgugggccagucccucaacaucgagaaggugcuggacaagcacaucaaggagauccugcgggcccgccucgaggaguacgggggcaacgcgagcaaggccuucuccaaccuggacgagaaccccaucuggcugaacaaggagaaggggaucgccgucaagcgggugaccaucgacagcggcaagaaccccaucccgcuccgcuccaagcuggacaaggacgggcagaucaucuacggcgagggccagaacccccaggagagcgacuucgugguccccgggggcaaccaccacgccgccaucuaccgcacgcccuccgggaagcugcaggacgugguggucagcuucuacgaggcggugucccggaagaaccucggccuggaggucaucgaccgcaacuucaagaaggacgaggggugggaguuccuguucacccucaagcagaacgaguacuucguguucccgaaccccgccaccggcuucagccccgaggacuacgaccugaccgaccccgccaacaacgccaucaucagcccgaaccuguaccgggugcagacggucuccgugggcgacuaccgcuuccggcaccaccucgagaccaccguggaggacaacgagaagcugcgcgacaucgccuggaagcggaucgggcccagcggccuggucggggcggugaaggugcgcaucgacaaccucggccggauccuggccgucggcgaguacgacuga

SEQ ID NO: 2093 - RNA, 4179 nt, Artificial Sequence
  Cas9 variant
auggagaacaagaacuacagcaucggccuggacaucgggaccaacuccgugggcugggccgucaucaccgacgacuacaaggugcccagcaagaagaugaagguguucgggaacacggacaagcacuucaucaagaagaaccucaucggcgcccugcuguucgacgagggggcgaccgccgaggaccgccggcucaagcgcaccgcccggcgccgguacacccgccggaagaaccgccugcgguaccugcaggagaucuucuccgaggagaucagcaagcucgacuccagcuucuuccaccgccuggacgacuccuuccuggucccgaaggacaagcggggcagcaaguaccccaucuucgccacgcucgaggaggagaaggaguaccacaagaaguuccccaccaucuaccaccuccgcaagcaccuggccgacuccaaggagaagaccgaccugcggcugaucuaccuggcgcucgcccacaugaucaaguaccgcggccacuuccuguacgaggagagcuucgacaucaagaacaacgacauccagaagaucuucaacgaguucaucuccaucuacgacaacaccuucgaggggagcucccugagcggccagaacgcccagguggaggccaucuucacggacaagaucuccaagagcgcgaagcgggagcgcgugcucaagcuguucuccgacgagaaguccaccagccuguucagcgaguuccucaagcugaucgucgggaaccaggccgacuucaagaagcacuucgaccuggaggagaaggcgccccuccaguucagcaaggacaccuacgacgaggaccuggagaaccugcucggccagaucggggacggcuucaccgaccuguuccugguggccaagaagcucuacgacgccauccugcuguccggcauccucacggugaccgacccgagcaccaaggcgccccuguccgccagcaugaucgagcgguacgagucccaccagaaggaccuggccgcccucaagcaguucaucaagaacaaccugcccaagcgcuacaacgaggucuucagcgaccaguccaaggacggguacgccggcuacaucgacgggaagaccacgcaggaggcguucuacaaguacaucaagaaccugcucagcaaguucgagggcgccgacuacuuccuggacaagaucgagcgggaggacuuccugcgcaagcagcggaccuucgacaacggcuccaucccccaccagauccaccuccaggagaugaacgccauccugcgccgccagggggagcacuacccguuccugaaggagaaccgggagaagaucgagaagauccucaccuuccgcauccccuacuacgugggcccccuggcccgggggaaccgcgacuucgccuggcugacccggaacagcgaccaggcgauccgccccuggaacuucgaggagaucguggacaaggccuccagcgccgaggaguucaucaacaagaugacgaacuacgaccucuaccugccggaggagaagguccugcccaagcacucccugcucuacgagaccuucgccguguacaacgagcugaccaaggugaaguucaucgccgagggccugcgggacuaccaguuccucgacagcgggcagaagaagcagaucgucaaccagcuguucaaggagaagcgcaaggugaccgagaaggacaucauccacuaccugcacaacguggacggcuacgacggcaucgagcucaaggggaucgagaagcaguucaacgcgucccugagcacguaccacgaccugcucaagaucaucaaggacaaggaguucauggacgaccccaagaacgaggagauccuggagaacaucguccacacccugaccaucuucgaggaccgggagaugaucaagcagcgccucgcccaguacgacuccaucuucgacgagaaggugaucaaggcccugacccggcgccacuacacgggcugggggaagcugagcgccaagcucaucaacggcaucugcgacaagcagaccggggacaccauccuggacuaccugaucgacgacggcaagaucaaccggaacuucaugcagcucaucaacgacgacggccuguccuucaaggagaucauccagaaggcccagguggucgggaagaccgacgacgugaagcaggucgugcaggagcugcccggcagcccggccaucaagaaggggauccuccagagcaucaagaucguggacgagcuggucaaggugaugggcuacgcccccgaguccaucgugaucgagauggcccgcgagaaccagacgaccgcccgggggaagaagaacagccagcagcgcuacaagcggaucgaggacucccugaagaaccucgcgcccggccuggacagcaacauccugaaggagaaccccaccgacaacauccagcuccagaacgaccgccuguuccuguacuaccuccagaacggcaaggacauguacaccgggaagccgcuggacaucgaccagcuguccagcuacgacaucgaccacaucaucccccaggccuucaucaaggacgacuccaucgacaaccggguccucacgagcuccaaggacaaccgcggcaagagcgacaacgugcccucccuggaggugguccagaagcgcaaggccuucuggcagcagcugcucgacagcaagcugaucuccgagcggaaguucaacaaccugaccaaggccgagcgcgggggccucgacgagcgggacaaggugggcuucauccgccggcagcugguggagacccgccagaucaccaagcacgucgcccagauccuggacgcgagcuucaacaccgaggugaacgagaagaaccagaagauccggacggugaagaucaucacccucaaguccaaccuggucagcaacuuccgcaaggaguucgagcuguacaaggugcgggagaucaacgacuaccaccacgcccacgacgccuaccucaacgccguggucgccaaggcgauccugaagaaguaccccaagcuggagccggaguucguguacggggacuaccagaaguacgaccucaagcgcuacaucucccgguucaagcccagcaaggagaucgagaaggccaccgagaaguacuucuucuacagcaaccugcugaacuucuucaaggaggaggugcacuacgccgacggcaucaucgucaagcgcgagaacaucgaguacuccaaggacaccggggagaucgccuggaacaaggagaaggacuucgcgacgaucaagaaggugcucagcuacccccaggugaacaucgucaagaagaccgagauccagacccacggccuggaccgggggaagcccaagggccuguucaacuccaacccgagccccaagcccuccgaggacagcaaggagaaccucgugccgaucaagcagggccuggacccccgcaaguacgggggcuacgccgggaucuccaacagcuacgccgugcuggucaaggccaucguggagaagggcgccaagaagcagcagaagaccauccucgaguuccaggggaucuccauccuggacaagaucaacuucgagaacaacaaggagaacuaccugcucaagaagcgguacaucgagauccugagcacgaucacccugcccaaguacucccucuucgaguuccccgacggcacccgccggcgccuggcgagcauccuguccaccaacaacaagcggggcgagauccacaaggggaacgagcucgugcugccgggcaaguacacgacccugcucuaccacgccaagaacaucaacaagaagcuggagcccgagcaccuggaguacgucgagaagcaccgcaacgacuucgccaagcuccuggagugcgugcugaacuucaacgacaaguacgugggggcccucaagaacggcgagcggauccgccaggccuucaccgacugggagaccgucgacaucgagaagcugugcuucagcuucaucgggcccgagaacuccaagaacgcgggccuguucgagcucacgagccagggcuccgccagcgacuucgaguuccugggggugaagaucccccgcuaccgggacuacgccccguccagccugcucaaggccacccugauccaccagagcaucaccggccuguacgagacccgcaucgaccucuccaagcugggggaggacuga

SEQ ID NO: 2094 - RNA, 4179 nt, Artificial Sequence
  Cas9 variant
augaacaacaacaacuacagcaucggccuggacaucgggaccaacuccgugggcugggccgucaucaccgacgacuacaaggugcccagcaagaagaugaaggugcucgggaacacggacaagcacuucaucaagaagaaccugaucggcgcccuccucuucgacgagggggcgaccgccgaggaccgccgguucaagcgcaccgcccggcgccgguacacccgccggaagaaccgccugcgguaccugcaggagaucuucuccgaggagaugagcaaggucgacuccagcuucuuccaccgccucgacgacuccuuccuggugccggaggacaagcggggcagcaaguaccccaucuucgccacgcuggccgaggagaaggaguaccacaagaaguuccccaccaucuaccaccuccgcaagcaccuggcggacuccaaggagaagaccgaccugcggcucaucuaccuggcccuggcccacaugaucaaguaccgcggccacuuccucuacgaggagagcuucgacaucaagaacaacgacauccagaagaucuucuccgaguucaucagcaucuacgacaacaccuucgagggguccagccuguccggccagaacgcccagguggaggcgaucuucacggacaagaucagcaaguccgccaagcgggagcgcauccugaagcuguucgccuacgagaaguccaccgaccuguucagcgaguuccugaagcucaucgucgggaaccaggccgacuucaagaagcacuucgaccuggaggagaaggcgccccugcaguucagcaaggacaccuacgacgaggaccucgagaaccugcugggccagaucggggacgacuucgccgaccucuuccugguggccaagaagcuguacgacgccauccuccugagcggcauccugaccgugacggacuccagcaccaaggccccgcucuccgccagcaugaucgagcgguacgagaaccaccagaaggaccuggcggcccugaagcaguucauccagaacaaccuccaggagaaguacgacgaggucuucuccgaccagagcaaggacggcuacgcccgcuacaucaacgggaagaccacccaggaggccuucuacaaguacaucaagaaccugcuguccaaguucgagggcagcgacuacuuccucgacaagaucgagcgggaggacuuccugcgcaagcagcggacguucgacaacggguccaucccccaccagauccaccuccaggagaugaacgccaucauccgccgccagggcgagcacuaccccuuccucaaggaguacaaggagaagaucgagaccauccugaccuuccggauccccuacuacgugggcccgcuggcgcgcgggaaccggaacuucgccuggcucacccgcaacagcgaccaggccauccggcccuggaacuucgaggagaucguggaccaggccuccagcgccgaggaguucaucaacaagaugacgaacuacgaccuguaccugcccgaggagaagguccuccccaagcacucccugcuguacgagaccuucgcgguguacaacgagcugaccaaggugaaguucaucagcgagggccuccgcgacuaccaguuccuggacuccgggcagaagaagcagaucgucaaccagcuguucaaggagaagcggaaggugaccgagaaggacaucauccaguaccuccacaacguggacggcuacgacgggaucgagcugaagggcaucgagaagcaguucaacgccagccuguccacguaccacgaccuccugaagaucaucaaggacaaggaguucauggacgacccgaagaacgaggagauccuggagaacaucguccacacccucaccaucuucgaggaccgcgagaugaucaagcagcggcuggcccaguacgccagcaucuucgacaagaaggugaucaaggcgcugacccgccggcacuacacgggcugggggaagcucuccgccaagcugaucaacggcaucugcgacaagaagaccgggaagaccauccuggacuaccucaucgacgacggcuacagcaaccgcaacuucaugcagcugaucaacgacgacgggcugagcuucaaggacaucauccagaaggcccagguggucggcaagaccaacgacgugaagcaggucgugcaggagcuccccggcucccccgccaucaagaaggggauccugcagagcaucaagcugguggacgagcucgucaaggugaugggccacgcccccgaguccaucgugaucgagaucgcgcgggagaaccagacgaccgcccgcgggaagaagaacagccagcagcgguacaagcgcaucgaggacgcccugaagaaccuggccccgggccucgacuccaacauccugaaggagcaccccaccgacaacauccagcugcagaacgaccggcuguuccuguacuaccugcagaacgggaaggacauguacaccggcgaggcccucgacaucaaccagcugagcuccuacgacaucgaccacaucgucccccaggcguucaucaaggacgacagccuggacaaccgcgugcucacguccagcaaggacaaccggggcaaguccgacaacgugcccagccuggaggucgugcagaagcgcaaggccuucuggcagcagcugcucgacuccaagcugaucagcgagcacaaguucaacaaccugaccaaggccgagcgcgggggccucgacgagcgggacaaggugggguucauccgccggcagcuggucgagacccgccagaucaccaagcacguggcccagauccuggacgcccgguucaacaccgaggugaacgagaaggacaagaagaaccgcacggucaagaucaucacccucaaguccaaccuggugagcaacuuccggaaggaguucaagcuguacaaggugcgcgagaucaacgacuaccaccacgcgcacgacgccuaccucaacgccgucguggccaaggcgauccugaagaaguacccgaagcuggagcccggcuucguguacggcgacuaccagaaguacgacaucaagcgguacaucucccgcagcaaggaccccaaggaggucgagaaggccaccgagaaguacuucuucuacagcaaccuccugaacuucuucaaggaggaggugcacuacgccgacgggaccaucgugaagcgggagaacaucgaguacuccaaggacacgggcgagaucgccuggaacaaggagaaggacuucgccaccaucaagaagguccugagccucccccaggugaacaucgugaagaagaccgagauccagacccacgggcuggaccgcggcaagccgcgggggcuguucaacuccaaccccagccccaagcccuccgaggaccgcaaggagaaccucgucccgaucaagcagggccuggacccccggaaguacggcggguacgcgggcaucagcaacuccuacgccgugcuggugaaggccaucaucgagaagggggccaagaagcagcagaagacgguccucgaguuccagggcaucagcauccuggacaagaucaacuucgagaagaacaaggagaacuaccugcucgagaagggguacaucaagauccuguccaccaucacccugcccaaguacagccucuucgaguucccggacggcacccgccggcgccuggccuccauccugagcacgaacaacaagcggggcgagauccacaaggggaacgagcucgugauccccgagaaguacaccacccugcuguaccacgcgaagaacaucaacaagacccucgagcccgagcaccuggaguacguggagaagcaccgcaacgacuucgccaagcugcucgaguacguccugaacuucaacgacaaguacgugggcgcccugaagaacggggagcggauccgccaggccuucaucgacugggagacgguggacaucgagaagcucugcuucuccuucaucggcccccgcaacagcaagaacgccgggcuguucgagcugaccucccagggcagcgcguccgacuucgaguuccucggcgucaagaucccgcgguaccgcgacuacacccccagcucccugcugaacgccacccucauccaccagagcaucacggggcuguacgagacccggaucgaccugagcaagcucggcgaggacuga

SEQ ID NO: 2095 - RNA, 4179 nt, Artificial Sequence
  Cas9 variant
augaagaacuaccacaucggccuggacaucgggaccagcuccgugggcuucgccgcccgcgacgacgagaacaaccucauccgggucaaggggaagaacgugaucggcgcgcgccuguucgccgaggggaagaccgcccaggagcggcgcauggcccggacgagccgccggcgcuacaaccggcgcaaguggcggcugcgccuccugaacgacaucuuccacgacgagaucgugcacaaggacaaggacuucuucaaccggcugaagcaguccagcaucucccccaaggacgaccgcaagaaguacuucggcagccuccuguucccggagcuguccgacagcgaguucuaccacaacggcaaccagaccaucuaccaccuccggcaccgccugaugaccuccaacgagaaggccgacauccgggagaucuaccuggcgcuccgccacaucgucaaguaccgggggaacuuccuggacgacacccccgugagcuccuucgaggccagcgaccugaagcucggcuccuucauccccacgcugaacgaccuguucgagaccaucgacgugaacuacgucuucaacagcgagaacaccaaccagaucgaguccauccuccugaacaacgaccugcgcaacagcgacaaguccaagcagcucguggaccugcuguaccggaacgugagcgacgucgacgacaagucccucgagaagcaguucaacaaguuccgcaaggacaucagcaaggagaucgccaagagcuucgugggguccaaguucaacgugaacaagcugcuggccuacgagaccgacgacggcagcaagaucucccucagcuucuccgacgcgagcuccgacgacaagaugcuggagcuggccgacaaccucgacgacgagcgcaucaacauccugaacgcccugaaggucaucuacagccgggugcgccucaaccagaucauccccaacgggaugggccuguccgagagcaugaucgccuccuacgagcugcacaagaagcagcucaacgaccugaagaagcugcucaacgugcugccguuccacgagaaguacgccgucaagguggcguacgccgccuacaucggcaacauggacgcccagaaguucacgcaggccgagcugagcaccaucgagucccucaaggagaaggacagcaucaagaaggugaucgacugcaagaccgggcacaucaccaacgagucccugaucagcgucaucaaccagaucguggugaaccccuaccuggagaacuccgacuucgagcucaucgacaucgucaagaagaucgaccaggacaucaagaacggcgaguaccugcugaagcagcggaacaaccagaacgggaacaucccccaccagcuccaccagauggagauggaccagaucaucgagaagcagagcaaguacuaccccuuccugggcgagcugaacccgaacgagaaccgccggcacaucgcgaaguacaagaucuccgagcugguggccuuccgcgugcccuacuacgucggcccccucaucacgcccgaggagcaggccaagaccagcggggccagcuucgccuggaugaagcggaaggaggacggcgagaucaccccguggaacuucgaccagaagguggaccgcgaggcgaccgccucccgguucaucaagcgccugacggucaaggacaccuaccuguucaacgaggacgugcuccccgacaacagccugcuguaccagcaguucaaggugcucaacgagcugaacgucgugaaggugaacaacaagcggcugucccaggccgagaagcagggggccuucaacgaccucuucaaggucaccaagaccgugacggccaagcgccugaagaacuaccuggugagcaacuucaaccaccucgacaccaucgagaucaccggccuguccgacggggagaaguucaacaacggccugaccagcuacgucgacuuccagaagaucuucggcgacaagaucaacaaccucgagcugauggacgacuucgagucccugaucgaguggagcacgguguucgaggaccggcacaucuucgaggagaaggugcgcaacgagaucaacuggaucuccgagagcgagcucaagcagcuggucgcgaagcgguacuccggguggggccgccugagcuccaagcuccugguggggaucaacaacgacgagggccggaacaucaucgagcagcuguucgagaccagcgagaccuucauggaggccaucucccgccccgaggugaagaagcagaucgacgagaucaacagcgacuucaucaagaacaccgacaucgaguccguccucgccgacgccuacacgagcccccagaacaagaaggcgauccgggagaccuacaagaucgugaaggacauccagaaggccaugggcgggaaggccccggagagcaucuccaucgaguucacccgcaaccccgaggacaagggcgagcugacccgcagccggcacuccgagaucagccgcaaguacaaggagcuguccaaggagaucagcaaggagcucaacgacgagcugaaguccaagaagaacagcauggacaucgacaaguacuaccuguacuucaugcagauggggaaggaccucuacgacggcaaguccaucgacaucgacgaccugaacaacuaccagaucgaccacaucgugccccagagcuucuacaaggacgacuccuucgacaaccggguccugacguacuacaccaacaaccagaagaaggggaacaacacgccccucaacggccugaacaucagcaacgagacccgcaagcuguggucccaccuccacgaccuggggcugaucagcaagcggaaguaccucaaccugaccaugcagggccuggacucccucagcaaguacaccaagcacggcuucauccgccggcagcugguggagaccucccaggugaucaagcuggucgccaacauccucagcgacgaguucuccgccgacaacaccaagaucaucgaggugaaggcgaagaugaacagccagaugcgccacagcuucaaccuguacaagauccgggagcugaacgacuaccaccacgcccucgacgccuaccugaccacguucaucgggggcuaccuguacaaccgcuacccgaagcuccgggggauguucguguacggcgacuucaagaaguucgacgucaacgacgccaacaacgugaagacccugaacuuccugcacgacaucaccaaccccuccgacaaguucgugaaccagaucuacgacgagcagagcggcgagcucauccuggaccgcaagcacgccaucgagaccaucaagaagaucuaccaguacaaguucaugcugaucacgcgggaggucuccaccaaggacgacaagcucagcgaccagaccguguacuccgcgaagcgcaucaacaacguggccagccccauccccgucaagaaggacuccaacccggagcuguacggguuccggaccggcaacguggaccaccacauggugaucgucaaguaccccaagaaggacagcuucguguacaagguggucgggauccccauccgcuucaugcaggagcugcgguccagcaagaaccaguccgaguacgagaacacgcucaaccagaucgugcaggccaagcugaaccgcaagaaguucgacuuccggguggucguggacaacgugauguacggccagcugauccaggacgggggccagaaguucacccucggcagcuccaccuaccgcuacaacgccaagcagcugguccuggacauggacagccuccggauccuguccgacgagaaguaccgcaacagccugaccgacgacgagaagaacuccgaguucaucaacaucuaccagcagguccucaacguggugaacgagaaguucgacguguucgacgugcgcgggacgcgggacaagcugaccaagggccuggacaaguuccucaacaucaccagcaacgacaaggagaucguccugcugaagauccucuccgggcugcacugcaacgccgcgcgcgugaagaucaacgagaucggcaucaacaccagcuucggggagcugcagacgacccacggcaucgugcucagcgagaacuccuacaucaucuaccagagccccuccggccuguucgagcggaagguccgccugaaggaccucuga

SEQ ID NO: 2096 - RNA, 4179 nt, Artificial Sequence
  Cas9 variant
auggccaacaagaccugguaccugggccucgacaucgggagcgccuccgugggcugggcggccaccgacacgggguacaagaucauccgcaagaacaagaagcggcuguggggcguccgccuguucgaggaggccaagaccgccgaggaccggcgcggguaccggagcucccgccggcgccucgcccggcgcaaguggcggcugaaccugcucgaggagcuguucaccagcgaggugaagaagguggacgagaacuucuuccugcgccucaaggagucccaguaccacuacgaggacaagacccacaagguccccuacgcgaucuucaacgacaaggacuacacggacaaggacuacuacaaggacuacccgaccaucuaccaccuccggagcaagcugaugaccgaggagaaccccgacauccgcaagguguuccuggccauccaccacaucaucaagaaccggggccacuuccugcugcagggccaguccuucaaggacgggaaccucaacaaccugaucaaggagcugcucgagcuggacauccugcacgugggcuucgaggucaccgaggaggugguggacaagaucgccgacaucagccucgagaagaagacguccaaggacaagcugaacgacaucaaggagcuguaccccaaggagaagcagcuccuggaggucuuccgccugaucuucgggggcaagaccagccucgacaagcuguucgccaucgacgaguacaaggagcuggacgcggccaucaaguccgugagcuucaaggagaagaucuacgaggaggugcggcacgacuacgagcagguccucuccaacuacaucgagcugcuggaccucgccaagcugguguacgacagcaucauccuguccgacaucaagaaggaggggaagacccucagcgaguccaagguggagcuguucgagaagcaccgcgacgaccugcucaagcugaagaaccuggucaagaacgacagcaagcucuccgaggacaagaagguggagcuguacgcccugaucuucaaggaggacaaggacaagggcaccaacuacgugaacuacauccgcaagagcgaggagggcaaggggugcaacuacgaggacuucaagaaguuccucgucaaggagcuggccaagcuggaggagagcuccgugaagacggagaucaucaaggaccucgagcuggagcaguuccugccccugcagcggaccaaggacaacagcguggucccguaccagauccacaaggaggagcucgugaagauccuggacaacgcggcccgguaccacuccuuccugaacgagaaggacgagagcggcuacaacgugcgcgagaaggucauccagcuccuggaguuccgcauccccuacuacguggggccccugaacuccagcaagaaggccaaggagggcggcuucgccugguccguccggaacaccggguacgagaacacccccgugacgccguggaacuacagcaaggugaucgacgaguccgccagcgcggagaaguucaucaccaaccucaccaacaagugcaccuaccugaagggcgaggacguccugcccaaguccagccuccuguacuccgaguucgcccugcucaacgagcugaacgcccugaaguacgacgggaaccgcaucagccucgaggcccggaacacgaucaucgagaagcuguucaagcagcagggcaagaaggugaccaagaccuccaucaagaaccugcucaaggccgagggguacaucgacggcaagggcgagaucaccgggaucgacaucacggugaagaacgaccucaagagcuaccgcgacuucaagaagauccugggcaacaaguucaacuccgagcacgucgagaacaucauccuguggaucacccuguacggggagagccggaagcugaucaaggcgaagaucgaguccguguacggcgagguguacagcaaggacgagaucaccaagaugagccgccucgucuacaaggacugggggcgguucucccgcaagcugcugaccgagcucgugagcaagaagcuguacaacgaggagacgggcgagugccugaacaucaucggcgccaugcggcagaacaacauccucuucauggagcugcuggccgaccgcuucgacuacuccaagcagaucguggaguucaacaaggagcuccaggaggacgucaccgagaucgcccccgagauccuggacgaccuguacgugagccccgccgugaagcgguccaucuggcagaccguccgcaucguggaggagcucaagaagaucaucgggugcgcgccggccaagaucuucguggagaccacgcggagcaaccaggagaagaagaagcccaccgacucccgcaagaagcagcuggagcuggccuacaaggccgucaagaaggacgugaaggagcucgagaaggagaucggcaccaucaacuucgacgugcugaacgaccggcugagcuccgucgagcccagcaagcucaaggcgaagaagcuguaccuguacuacacccagcucgggcgcugcauguacuccgaggagcccaucaacaucagcgagcuguucgacaacaacaaguacgacaucgaccacaucuacccgcaguccaagaucaaggacgacagcuucacgaacaccgugcuggugaagcgggaguccaacgccgccaagaccgaccgcuacccccucggcagcgacauccagacccccuccaaccggcgcuucuggaaguuccugaaggagaaggggcugaucagcgacgagaaguacaaccgccucguccggaccgaggaguucagcgacgaggagcuguccggcuucaucgcccgccagcugguggagacgagccaguccgugaaggccgucgcgagcauccucggcgagcugaaccccgagaccuccaucugcuacagcaaggccgagaacguguccagcuuccggcagaacuucgggaagaucaagaagggcgaccgcgacuccaagaacaacgaccagcugaucaaggugcgggagaucaacgacuaccaccacgccaaggacgccuaccucaacgucgugguggggaacgucuacgacaccaaguucacccgcaacguguucaacuucaucaaggacaagaaggacggccggaaguacagccugaacaagguguucuacgagaacgucuccgacagcaagacgguggccugggagauggacaagaccauccaccagguggagaaggucaugaacaacaacaacaucauggugacccgccggaccuccgagcagaagggcgggcuguucgacgcgacgguguacaaggccaaggucgccgccaaggccaaggacggcguguacuacccgcucaagaccagcaacuccguggucaaggacguggcgaaguacgggggcuacaccagcaucgggaucgccuacuacuccaucuucgaguacaccaucgugaacaagaagggcgaggagaagaucacgcgcaucauccccauccccaucuacaucagccagaacaucaaggacuccaccgcccugaucgaguucggcaagagccagaucuucugccgggccuacgagaagaucaaggacuucaagcugcucuaccgcaagcugugcaucgggagcaagaucaacaucaacaacuaccaguacuacaucggcgggaaguccgacgagcgguucuacuacgacagcgcgauccaggucacccuggacaagaaguccgagaaguaccucaagauccugagcaaguaccagaacuggaagaaggagaacaaggacggcgagcugugggagaacaucaccaaggagaacaacaucgagcucuacaacaagcugguggagaagaugaacuccgagaucuucacgaagaagaaguccaacaaguacaacgagcugaacagcgaggagauccgcaacaacuucaucaagaucagcguggaggagcaggccaagguccuccuggagauccugaaccuccugaccaacaagaaguccaucuucgaccucaagagcaucgacaucaaggccgcccgggggaagaucuccuucaaccugaccagccugauccaguucuccaucaucgagcagagcaucaccggcuucuacgagaaggagaucacgaucaucggcgacaaggggaacgacauggagaacaacaacuccuga

SEQ ID NO: 2097 - RNA, 4179 nt, Artificial Sequence
  Cas9 variant
augaacaacaacaacuacagcaucggccuggacaucgggaccaacuccgugggcugggccgucaucaccgacgacuacaaggugcccagcaagaagaugaaggugcucgggaacacggacaagcacuucaucaagaagaaccugaucggcgcccugcuguucgacgaggggaccaccgcggaggaccgccggcugaagcgcaccgcccggcgccgguacacgcgccggaagaaccgccugcgguaccuccaggagaucuucuccccggagaucagcaaggucgacuccagcuucuuccaccgccuggacgacuccuuccuggugcccgaggacaagcggggcagcaaguaccccaucuucgccacccucgccgaggagaaggaguaccacaagaacuuccccaccaucuaccaccuccgcaagcagcuggccgacuccaaggagaaggcggaccuccggcugaucuaccuggcccucgcccacaugaucaaguaccgcggccacuuccuguacgaggagagcuucgacaucaagaacaacgacauccagaagaucuucaacgaguucaucuccaucuacgacaacaccuucgaggggagcucccugagcggccagaacgcccagguggaggcgaucuucacggacaagaucuccaagagcgccaagcgggagcgcguccucaagcuguucccggacgagaaguccaccgggcuguucagcgaguuccucaagcugaucgugggcaaccaggccgaguucaagaagcacuucgaccuggaggagaaggcgccccuccaguucuccaaggacaccuacgacgacgaccuggagaaccugcucgggcagaucggcgacggcuucgccgagcuguucguggcggccaagaagcuguacgacgccauccuccugagcgggauccugaccgucacggaccccagcaccaaggcgccccucuccgccagcaugaucgagcgguacgagaaccaccagaaggaccuggccgcccugaagcaguucauccagaacaaccuccaggagaaguacgacgagguguucuccgaccagagcaaggacggcuacgccggguacaucaacggcaagaccacccaggaggccuucuacaaguacaucaagaaccugcuguccaaguucgagggcagcgacuacuuccucgacaagaucgagcgcgaggacuuccugaagaagcagcggacguucgacaacggguccaucccgcaccagauccaccuccaggagaugaacgccaucauccgccggcagggcgagcacuaccccuuccuccaggagaacaaggagaagaucaagaagauccugaccuuccgcauccccuacuacguggggccccuggcgcgcggcaacggggacuucgccuggcucacccggaacagcgaccaggccauccgcccguggaacuucgaggagaucgucgaccaggccuccagcgccgaggacuucaucaacaagaugaccaacuacgaccuguaccugcccgaggagaaggugcuccccaagcacucccugcuguacgagacguucgcgguguacaacgagcugaccaaggucaaguucaucgccgagggccuccgggacuaccaguuccuggacagcggccagaagaagcagaucgugaaccagcuguucaaggagaagcgcaaggugaccgagaaggacaucacccaguaccuccacaacgucgacggguacgacggcaucgagcugaaggggaucgagaagcaguucaacgccucccugagcacguaccacgaccuccugaagaucaucaaggacaaggccuucauggacgacgcggagaacgaggccacccuggagaacaucauccacacccucaccaucuucgaggaccgggagaugaucaagcagcgccuggcccaguacgacucccuguucgacgagaaggugaucaaggcccucauccggcgccacuacacgggcugggggaagcugagcgccaagcugaucaacggcaucugcgacaagaagaccggcaagaccauccucgacuaccugaucgacgacggguacuccaaccggaacuucaugcagcugaucaacgacgacggccucagcuucaaggacaucauccagaaggcccagguggucgggcgcaccaacgacgugaagcagaucgugcacgagcugcccggcuccccggccaucaagaaggggauccugcagagcaucaagaucgucgacgagcucgugaagaucaugggccacacgcccgagagcaucgucaucgagauggcccgggagaaccagaccaccgcccgcggcaagaagaacucccagcagcgguacaagcgcaucgaggacgcccugaagaaccuggcgcccgggcucgacagcaacauccugaaggaguaccccaccgacaacauccagcugcagaacgaccggcuguuccuguacuaccugcagaacggcaaggacauguacacgggggagccgcucgacaucaaccagcuguccagcuacgacaucgaccacaucgugccccaggccuucaucaaggacgacucccuggacaaccgcgugcucaccagcuccaaggacaaccggggcaagagcgacaacguccccucccuggagguggugcagaagcgcaaggccuucuggcagcagcugcucgacagcaagcugaucuccgagcggaaguucaacaaccugaccaaggccgagcgcggcgggcucgacgagcgcgacaaggucggcuucauccggcgccagcugguggagacccggcagaucaccaagcacguggcccagauccuggacgcgcgcuucaacacggaggucaccgagaaggacaagaagaaccggaacgugaagaucaucacccucaagagcaaccugguguccaacuuccgcaaggaguucaagcuguacaagguccgggagaucaacgacuaccaccacgcccacgacgccuaccucaacgccgugguggcgaaggccauccugaagaaguaccccaagcuggagccggaguucgucuacggggacuaccagaaguacgaccucaagcgcuacaucagccgguccaaggaccccaaggacguggagaaggccaccgagaaguacuucuucuacagcaaccugcugaacuucuucaaggaggaggugcacuacgccgacggcacgaucgucaagcgcgagaacaucgaguacuccaaggacaccggggagaucgccuggaacaaggagaaggacuucgcgaccaucaagaaggugcucagccugccccaggugaacaucgucaagaagaccgagauccagacgcacggccuggaccggggcaagccccgcggccucuucaacagcaacccgucccccaagcccagcgaggacuccaaggagaaccuggugccgaucaagcaggggcuggacccccggaaguacgggggcuacgccgggaucagcaacuccuacgccgugcucgucaaggccaucaucgagaagggcgccaagaagcagcagaagaccgugcuggaguuccagggcaucagcauccuggacaagaucaacuucgagaagaacaaggagaacuaccuccuggagaagggguacaucaagauccuguccaccaucacccuccccaaguacagccuguucgaguuccccgacggcacgcgccggcgccuggcguccauccucagcaccaacaacaagcgcggggagauccacaagggcaacgagcuggugaucuccgagaaguacaccacccugcucuaccacgccaagaacaucaacaagacgcuggagccggagcaccuggaguacgucgagaagcaccggaacgacuucgccaagcuccuggagagcgugcuggacuucaacgacaaguacgugggggcccucaagaacggcgagcggauccgccaggccuucaucgacugggagaccgucgacaucgagaagcugugcuucuccuucaucggcccccggaacagcaagaacgcggggcuguucgagcucaccucccagggcagcgccuccgacuucgaguuccugggggugaagaucccccgcuaccgcgacuacacccccagcucccugcucaacgccacgcugauccaccagagcaucaccggccuguacgagacccggaucgaccucagcaagcugggggaggacuga

SEQ ID NO: 2098 - RNA, 4179 nt, Artificial Sequence
  Cas9 variant
augaacaacaacaacuacagcaucggccuggacaucgggaccaacuccgugggcugggccgucaucaccgacgacuacaaggugcccagcaagaagaugaaggugcucgggaacacggacaagcacuucaucaagaagaaccugaucggcgcccuccucuucgacgagggggcgaccgccgaggaccgccgguucaagcgcaccgcccggcgccgguacacccgccggaagaaccgccugcgguaccugcaggagaucuucuccgaggagaugagcaaggucgacuccagcuucuuccaccgccucgacgacuccuuccuggugccggaggacaagcggggcagcaaguaccccaucuucgccacgcuggccgaggagaaggaguaccacaagaaguuccccaccaucuaccaccuccgcaagcaccuggcggacuccaaggagaagaccgaccugcggcucaucuaccuggcccuggcccacaugaucaaguaccgcggccacuuccucuacgaggagagcuucgacaucaagaacaacgacauccagaagaucuucuccgaguucaucagcaucuacgacaacaccuucgagggguccagccuguccggccagaacgcccagguggaggcgaucuucacggacaagaucagcaaguccgccaagcgggagcgcauccugaagcuguucgccuacgagaaguccaccgaccuguucagcgaguuccugaagcucaucgucgggaaccaggccgacuucaagaagcacuucgaccuggaggagaaggcgccccugcaguucagcaaggacaccuacgacgaggaccucgagaaccugcugggccagaucggggacgacuucgccgaccucuuccugguggccaagaagcuguacgacgccauccuccugagcggcauccugaccgugacggacuccagcaccaaggccccgcucuccgccagcaugaucgagcgguacgagaaccaccagaaggaccuggcggcccugaagcaguucauccagaacaaccuccaggagaaguacgacgaggucuucuccgaccagagcaaggacggcuacgcccgcuacaucaacgggaagaccacccaggaggccuucuacaaguacaucaagaaccugcuguccaaguucgagggcagcgacuacuuccucgacaagaucgagcgggaggacuuccugcgcaagcagcggacguucgacaacggguccaucccccaccagauccaccuccaggagaugaacgccaucauccgccgccagggcgagcacuaccccuuccucaaggaguacaaggagaagaucgagaccauccugaccuuccggauccccuacuacgugggcccgcuggcgcgcgggaaccggaacuucgccuggcucacccgcaacagcgaccaggccauccggcccuggaacuucgaggagaucguggaccaggccuccagcgccgaggaguucaucaacaagaugacgaacuacgaccuguaccugcccgaggagaagguccuccccaagcacucccugcuguacgagaccuucgcgguguacaacgagcugaccaaggugaaguucaucagcgagggccuccgcgacuaccaguuccuggacuccgggcagaagaagcagaucgucaaccagcuguucaaggagaagcggaaggugaccgagaaggacaucauccaguaccuccacaacguggacggcuacgacgggaucgagcugaagggcaucgagaagcaguucaacgccagccuguccacguaccacgaccuccugaagaucaucaaggacaaggaguucauggacgacccgaagaacgaggagauccuggagaacaucguccacacccucaccaucuucgaggaccgcgagaugaucaagcagcggcuggcccaguacgccagcaucuucgacaagaaggugaucaaggcgcugacccgccggcacuacacgggcugggggaagcucuccgccaagcugaucaacggcaucugcgacaagaagaccgggaagaccauccuggacuaccucaucgacgacggcuacagcaaccgcaacuucaugcagcugaucaacgacgacgggcugagcuucaaggacaucauccagaaggcccagguggucggcaagaccaacgacgugaagcaggucgugcaggagcuccccggcucccccgccaucaagaaggggauccugcagagcaucaagcugguggacgagcucgucaaggugaugggccacgcccccgaguccaucgugaucgagaucgcgcgggagaaccagacgaccgcccgcgggaagaagaacagccagcagcgguacaagcgcaucgaggacgcccugaagaaccuggccccgggccucgacuccaacauccugaaggagcaccccaccgacaacauccagcugcagaacgaccggcuguuccuguacuaccugcagaacgggaaggacauguacaccggcgaggcccucgacaucaaccagcugagcuccuacgacaucgaccacaucgucccccaggcguucaucaaggacgacagccuggacaaccgcgugcucacguccagcaaggacaaccggggcaaguccgacaacgugcccagccuggaggucgugcagaagcgcaaggccuucuggcagcagcugcucgacuccaagcugaucagcgagcacaaguucaacaaccugaccaaggccgagcgcgggggccucgacgagcgggacaaggugggguucauccgccggcagcuggucgagacccgccagaucaccaagcacguggcccagauccuggacgcccgguucaacaccgaggugaacgagaaggacaagaagaaccgcacggucaagaucaucacccucaaguccaaccuggugagcaacuuccggaaggaguucaagcuguacaaggugcgcgagaucaacgacuaccaccacgcgcacgacgccuaccucaacgccgucguggccaaggcgauccugaagaaguacccgaagcuggagcccgaguucguguacggcgacuaccagaaguacgacaucaagcgguacaucucccgcagcaaggaccccaaggaggucgagaaggccaccgagaaguacuucuucuacagcaaccuccugaacuucuucaaggaggaggugcacuacgccgacggcaccaucgugaagcgggagaacaucgaguacuccaaggacacgggggagaucgccuggaacaaggagaaggacuucgccaccaucaagaagguccugagccucccccaggugaacaucgugaagaagaccgagauccagacccacggccuggaccgcgggaagccgcggggccuguucaacuccaaccccagccccaagcccuccgaggaccgcaaggagaaccucgucccgaucaagcaggggcuggacccccggaaguacggcggcuacgcggggaucagcaacuccuacgccgugcuggugaaggccaucaucgagaagggcgccaagaagcagcagaagacgguccucgaguuccaggggaucagcauccuggacaagaucaacuucgagaagaacaaggagaacuaccugcucgagaagggcuacaucaagauccuguccaccaucacccugcccaaguacagccucuucgaguucccggacgggacccgccggcgccuggccuccauccugagcacgaacaacaagcggggcgagauccacaagggcaacgagcucgugauccccgagaaguacaccacccugcuguaccacgcgaagaacaucaacaagacccucgagcccgagcaccuggaguacguggagaagcaccgcaacgacuucgccaagcugcucgaguacguccugaacuucaacgacaaguacgugggggcccugaagaacggcgagcggauccgccaggccuucaucgacugggagacgguggacaucgagaagcucugcuucuccuucaucgggccccgcaacagcaagaacgccggccuguucgagcugaccucccaggggagcgcguccgacuucgaguuccucggcgucaagaucccgcgguaccgcgacuacacccccagcucccugcugaacgccacccucauccaccagagcaucacgggccuguacgagacccggaucgaccugagcaagcucggggaggacuga

SEQ ID NO: 2099 - RNA, 4182 nt, Artificial Sequence
  Cas9 variant
augaagcgcgugaccgaggacuacauccugggccucgacaucgggaccaacagcugcggcugggccgucacggacaagaagaacaaccugcugaagcuccgggggaagaccgccaucggcucccaccuguucgaggaggggcacaccgcggccgaccgccggggcuuccgcaccacgcggcgccggcugaagcgccggaaguggcgccuccggcugcuggaggagaucuucgccgagcccauggccaagguggacccgggcuucuucgugcgccuccaccagagcugggucagcccccuggacaagagccggaagaaguaccacgccaucguguuccccaccgcgaaggaggacaaggccuucuaccagaaguaccccaccaucuaccaccuccgcgacgcccucaugacccaggaccggcaguucgaccugcgcgagaucuuccuggccauccaccacaucgugaaguuccgggggaacuuccuccaggacacgccggucaaggacuucgaggcguccaagaucgaggugggccccauccugagcaagaucaacggggccuucgccgagaagaucguggaggaccaggaccccaucgagcugaacgucgccaacgccgcggagaucgaggccgugauccgcggcaaggacgccgacaagacccucuacaagauggacaaggugaagaagaucgccaagcugcugaccgacuccaccgccaaggaggagaagaacgucgcgaagcagaucgccaacgccgugaugggguacaagacgcaguucgagaccauccucggcaaggagaucgacaagagcgacaaggcccagugggaguucaagcugaccgacggcgacgccgacgacaagcuggaggcgcuccugcccgaccuggacgagaacgaccagaccaucaucgccgagaucaagaagcuguucuccgccaucacgcugagcaccaucguggacgagaacaagucccugagccaguccauggucgccaaguacaacaagcaccaccaggacuacaagcuccugaaggccuacaucgacacccugcaggaccggagcaucgcgaagaagcuccugcuggccuacgaccucuacgugaacaaccgccacgggcggcugcuggaggccaagaccgaguucaagcaggacggcacgcucaccaaggaggacuucuacaagaccgugaaggacaaccuggacgacuccgagcuggcccgcaagaucgcgcagaagaucgccgccgacaacuucaugccgaagcagcgcaccaacagcaacggggucauccccuuccagcuccaccagaucgagcuggacaagaucaucgccaaccaguccaaguacuaccccuuccuggccgcggagaaccccguggaggaccaccggaagcaggccccguacaagcucgacgagcuggugcgcuuccggguccccuacuacgugggccccaugaucacgcccgacgagcaggagaagaccagcggcaaguccuucgccuggauggugcgcaaggaggacgggcagaucaccccguggaacuucgagcagaaggucgaccggcaggagagcgccaacaaguucaucaagcgcaugaccaucaaggacacguaccugcucggcgaggacgugcugcccgccaacagccugcuguaccagcgguucgagguccucaacgagcugaacaacauccgcaucaacgggucccggaucagcaucgaccugaagcagcagaucuucaacgaccucuucgaggagaagaagaccgugaccgagaagucccugaccagcuaccugaagcagaaccuccaccuccccacgguggagaucaagggccuggcggaccccaccaaguucaacuccagccuggccuccuacuaccaccucaagagccugcacgucuucgacaaggagcuggccgacccgcaguaccagaaggacuucgagaagaucaucgaguacuccagcaucuucgaggacaagaagaucuaccaggacaagcugcacgccgaguucaaguggcugacccccgagcaguucaaggccaucuccaccuggcgccuccagggguggggccggcugagcugccgccugcucguggagcugcacgacacgaacggccagaacaucauggagcagcugugggacucccagaagaacuucaugcagaucgugaccgagcccgacuucaaggacgcgaucgccaaggagaaccagaacgucacccaggugaacgggguggaggagauccucgccgacgccuacaccagccccgcgaacaagaaggccauccggcaggucgugaagguggucgccgacguggugaaggccgccggcgggaagaagccggcgcaguucgccaucgaguucacccgcgaccccgacaagaacccccagcugucccacauccggggcacgaagcugcucaaggccuaccaggagaccgccggggagcuggucgaccagaagcugaccgacagccucaaggaggccaugaccucccgcaagcugcugaaggacaaguacuuccucuacuucaugcagacgggccgggacgcguacaccggcaagaagaucaacaucgacgaggugaccaccaacuaccagaucgaccacauccugccccagagcuucaucaaggacgacuccuucgacaaccgcgugcugacggccaccccgcucaacgccgagaaguccgacgacguccccuacaagcgguucgccaacaacuacgugagcgaccugaagaugaccgugggggagauguggaagcacuggcagaaggccggcaucaucaacaagcacaagcuggggaaccuccugcuggaccccgaccgccucaacaaguuccagaaguccggcuucaucaaccgccagcuggucgagaccagccagaucgugaagcugguguccgucauccuccagaacaaguacccggacgcggagaucaucacggugaaggccggggacaacagcgcccugcggcagcgccugaaccucuacaagucccgggacgugaacgacuaccaccacgccaucgacgcguaccugagcaucaucugcggcaacuuccuguaccaggucuaccccaaguaccgccccuacuucguguacggcaaguacaagaaguucucccaggaccccgaccuccagaaggaccugaucaagcacuucaagggguucaccuucauguggccgcugcuccagaaggacaacagcgagcggaaggcccccgaggagaucaaggagaacaacuccgagcgcaucguguucuacaagcaccccgacaucuucgacaagcugcggaaggccuacaacuacaaguacaugcuggucagccgcgagaccaccacggaguccagcuccauguucaagaugaccaucuucccccggggcgagcgcgaccggaagaagacccgcaagcucaucccgaaggggaacggccuggaccccaagaucuacggcggguacagcggcaacaccgacgccuacauggugaucgugaagaucgacaaggccaaggaguccaucuacaaggucaucggggugcccaugcgggcgcugacgcgccucaaccaggccaagaagcagggcaacuaccaggaggagcugcaccaggugcuggagccccagaucaugcucgacaagaacgggaagccgaagcggggcgucaagggcuuccgcgugaucaaggaccacgugcccuucaagcaggucgugcuggacggggacaagaaguucaugcuguacagcgcccaguacaagaccaacgccaagcagcucgcccugucccaggagaccaugcggaucgugaccgacaaccugaagaagggcgaggaccaggacaagcuccuggucaaggcguacgacgagauccugcagaagguggacugcuaccucagccuguucgacacgagcaacuuccgcaacgggcugcaccucggccggaacaaguucaucgaccuggaggugaacgacaagaagaucacccuguccaacauccucaacgggcugcacgacaacaugguccugggcaaccucaagaacaucggcaucgggacgccccugggccagaugcaggagaaguccgggaucacccugagccccgaggccgugcucaucuuccagagcccgaccggccuguucgagaagcgcgugaagaucgccgaccuguga

SEQ ID NO: 2100 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaucgacgagggcuucuuccagcggaugaaggagagccccuucuacgccgaggacaagaccauccugcaggagaacgcccucuucaacgacaaggacuucacggacaagaccuaccacaaggcguacccgaccaucaaccaccugaucaaggccuggaucgagaacaaggucaagcccgacccccgccugcucuaccuggccugccacaacaucaucaagaagcggggccacuuccuguucgagggggacuucgacuccgagaaccaguucgacaccagcauccaggcccucuucgaguaccugcgcgaggacauggagguggacaucgacgcggacucccagaaggugaaggagauccugaaggacagcucccucaagaacagcgagaagcagucccggcugaacaagauccugggccucaagcccagcgacaagcagaagaaggccaucacgaaccugaucuccgggaacaagaucaacuucgccgaccuguacgacaacccggaccucaaggacgccgagaagaacagcaucuccuucagcaaggacgacuucgacgcgcuguccgacgaccuggccagcauccucggcgacuccuucgagcugcugcucaaggccaaggccgucuacaacugcagcgugcuguccaaggugaucggggacgagcaguaccugagcuucgccaaggucaagaucuacgagaagcacaagaccgaccucaccaagcugaaggcggugaucaagaagcacuuccccaacaacuacaagaagguguucggcuacaaccaggacaacgagagcaagaacaacuacuccggcuacgucggggugugcaagaccaagaacaagaagcuggugaucaacaacagcgucaaccaggaggacuucuacaaguuccucaagcccauccuguccgccaagagcgagaucaaggaggugaacgacauccuggccgagaucgagacgggcaacuuccuccccaagcagaucuccaagagcaacgccgagaucccguaccagcugcgcaagauggagcuggagaagauccucuccaacgccgagaagcacuucagcuuccugaagcagaaggacgagaaggggcugucccacagcgagaagaucaucaugcuccugaccuucaagauccccuacuacaucggccccaucaacgacaaccacaagaaguccuuccccgaccggugcuggguggucaagaaggagaaguccccgagcggcaagaccacccccuggaacuucuucgaccacaucgacaaggagaagacggcggaggaguucaucaccagccgcaccaacuucugcaccuaccugaucggggaguccgugcuccccaagaacagccugcuguacuccgaguacacggugcugaacgagaucaacaaccuccagaucaucaucgacggcaagaacaucugcgacaccaagcugaagcagaagaucuacgaggaccuguucaagaaguacaagaagaucacccagaagcagaucagcaccuucaucaagcacgaggggaucugcaacaagacggacgaggucaucauccucggcaucgacaaggagugcaccuccagccucaagagcuacaucgagcugaagaacaucuucgggaagcaggucgacgagaucuccaccaagaacaugcucgaggagaucauccggugggccaccaucuacgacgagggcgagggcaagacgauccugaagaccaagaucaaggccgaguacgggaaguacugcagcgacgagcagaucaagaagauccugaaccucaaguucuccggcugggggcgccugagccggaaguuccuggagaccgugaccuccgagaugcccggcuucagcgagccggugaacaucaucacggccaugcgcgagacccagaacaaccucauggagcugcuguccagcgaguucaaguucaccgagaacaucaagaagaucaacuccggguucgaggacgccgagaagcaguucagcuacgacggccucgugaagccccuguuccugucccccagcgucaagaagaugcucuggcagacccugaagcuggugaaggagaucucccacaucacgcaggcgcccccgaagaagaucuucaucgagauggccaagggcgccgagcucgagcccgcccgcaccaagacccggcugaagauccugcaggaccucuacagcuccugcaagaacgacgcggacgccuucagcuccgagauccaguaccugagcgggaagaucgagaacgaggacaaccugcgccuccggagcgacaagcuguaccuguacuacacccagcucggcaagugcauguacugcgggaagcccaucgagaucggccacguguucgacaccuccaacuacgacaucgaccacaucuacccccagagcaagaucaaggacgacuccaucagcaaccgcguccuggugugcuccagcugcaacaagaacaaggaggacaaguacccgcugaaguccgagauccagagcaagcagcggggguucuggaacuuccuccagcgcaacaacuucaucucccuggagaagcugaaccggcucacgcgcaccacccccaucagcgacgacgagaccgccaaguucaucgcccggcagcugguggagacgcgccaggccaccaaggucgcggccaaggugcuggagaagauguuccccgagaccaagaucguguacuccaaggccgagaccgucagcauguuccggaacaaguucgacaucaucaagugccgcgagaucaacgacuuccaccacgcccacgacgccuaccucaacaucguggugggcaacgucuacaacacgaaguucaccaacaaccccuggaacuucaucaaggagaagcgggacaacccgaagaucgcggacaccuacaacuacuacaagguguucgacuacgacgugaagcgcaacaacaucaccgccugggagaagggcaagacgaucaucaccgucaaggacaugcugaagcggaacacccccaucuacacccgccaggccgccugcaagaagggcgggcuguucgaccagacgaucaugaagaaggggcucggccagcacccccugaagaaggagggcccguucuccaacaucagcaaguacgggggcuacaacaagguguccgccgcguacuacacccugaucgaguacgaggagaaggggaacaagauccggagccucgagaccaucccccuguaccuggugaaggacauccagaaggaccaggacguccucaaguccuaccugaccgaccugcucggcaagaaggaguucaagauccuggugcccaagaucaagaucaacagccugcucaagaucaacggguuccccugccacaucacgggcaagaccaacgacuccuuccugcugcgcccggccgugcaguucugcugcagcaacgacgagguccucuacuucaagaagaucauccgguucagcgagauccgcucccagcgcgagaagaucggcaagaccaucagccccuacgaggaccuguccuuccggagcuacaucaaggagaaccugugcaagaagaccaagaacgacgagaucggggagaaggaguucuacgaccuccugcagaagaagaaccuggagaucuacgacaugcuccugacgaagcacaaggacaccaucuacaagaagcgccccaacuccgccaccaucgacauccuggugaagggcaaggagaaguucaagagccucaucaucgagaaccaguucgaggugauccuggagauccugaagcuguucuccgccacccggaacgucagcgagcugcagcacaucgggggcuccaaguacagcgggguggcgaagaucggcaacaagaucuccagccuggacaacugcauccucaucuaccaguccaucacgggcaucuucgagaagcgcaucgaccugcugaagguguga

SEQ ID NO: 2101 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaucgacgagggcuucuuccagcggaugaaggagagccccuucuacgccgaggacaagaccauccugcaggagaacacccucuucaacgacaaggacuucacggacaagaccuaccacaaggcguacccgaccaucaaccaccugaucaaggccuggaucgagaacaaggucaagcccgacccccgccugcucuaccuggccugccacaacaucaucaagaagcggggccacuuccuguucgagggggacuucgacuccgagaaccaguucgacacgagcauccaggcccucuucgaguaccugcgcgaggacauggagguggacaucgacgcggacucccagaaggugaaggagauccugaaggacagcucccucaagaacagcgagaagcagucccggcugaacaagauccugggccucaagcccagcgacaagcagaagaaggccaucaccaaccugaucuccgggaacaagaucaacuucgccgaccuguacgacaacccggaccucaaggacgccgagaagaacagcaucuccuucagcaaggacgacuucgacgcccuguccgacgaccuggcgagcauccucggcgacuccuucgagcugcugcucaaggccaaggccgucuacaacugcagcgugcuguccaaggugaucggggacgagcaguaccugagcuucgccaaggucaagaucuacgagaagcacaagaccgaccucaccaagcugaagaacgugaucaagaagcacuuccccaaggacuacaagaagguguucggcuacaacaagaacgagaagaacaacaacaacuacagcggcuacgucggggugugcaagacgaaguccaagaagcugaucaucaacaacagcgugaaccaggaggacuucuacaaguuccucaagaccauccuguccgccaagagcgagaucaaggaggucaacgacauccugaccgagaucgagaccggcacguuccuccccaagcagaucuccaagagcaacgcggagauccccuaccagcugcgcaagauggagcuggagaagauccucuccaacgccgagaagcacuucagcuuccugaagcagaaggacgagaaggggcugucccacagcgagaagaucaucaugcuccugaccuucaagaucccguacuacaucggccccaucaacgacaaccacaagaaguccuuccccgaccggugcugggugaucaagaaggagaagucccccagcggcaagaccaccccguggaacuucuucgaccacaucgacaaggacaagacggccgaggccuucaucaccagccgcaccaacuucugcaccuaccuggugggggaguccguccuccccaagagcucccugcuguacagcgaguacacggugcugaacgagaucaacaaccuccagaucaucaucgacggcaagaacaucugcgacaucaagcugaagcagaagaucuacgaggagcuguucaagaaguacaagaagaucacccagaagcagaucuccaccuucaucaagcacgaggggaucugcaacaagaccgacgaggugaucauccucggcaucgacaaggagugcacgagcagccugaaguccuacaucgagcugaagaacaucuucgggaagcaggucgacgagaucagcaccaagaacaugcucgaggagaucauccggugggccaccaucuacgacgagggcgagggcaagaccauccugaagacgaagaucaaggcggaguacgggaaguacugcuccgacgagcagaucaagaagauccugaaccucaaguucagcggcugggggcgccugucccggaaguuccuggagaccgugaccagcgagaugcccggcuucuccgagcccgugaacaucaucaccgccaugcgcgagacgcagaacaaccucauggagcugcugagcuccgaguucaaguucaccgagaacaucaagaagaucaacagcggguucgaggacgccgagaagcaguucuccuacaacggccucgucaagccgcuguuccugagccccuccgugaagaagaugcucuggcagacccugaagcuggucaaggagaucagccacaucacccaggccccgcccaagaagaucuucaucgagauggccaagggcgcggagcucgagcccgcccgcaccaagacgcggcugaagauccugcaggaccucuacaacaacugcaagaacgacgccgacgccuucuccagcgagaucaaggaccuguccgggaagaucgagaacgaggacaaccugcgccuccggagcgacaagcuguaccuguacuacacccagcucggcaagugcauguacugcgggaagcccaucgagaucggccacguguucgacaccagcaacuacgacaucgaccacaucuacccccaguccaagaucaaggacgacagcaucuccaaccgcgugcuggucugcagcuccugcaacaagaacaaggaggacaaguacccccucaagagcgagauccaguccaagcagcggggguucuggaacuuccuccagcgcaacaacuucaucagccuggagaagcugaaccggcucacccgcacgaccccgaucuccgacgacgagaccgcgaaguucaucgcccggcagcugguggagacccgccaggccacgaagguggccgccaagguccuggagaagauguuccccgagaccaagaucguguacagcaaggcggagaccguguccauguuccggaacaaguucgacaucaucaagugccgcgagaucaacgacuuccaccacgcccacgacgccuaccucaacaucgucgugggcaacguguacaacaccaaguucacgaacaaccccuggaacuucaucaaggagaagcgggacaaccccaagaucgccgacaccuacaacuacuacaaggucuucgacuacgacgugaagcgcaacaacaucaccgccugggagaagggcaagaccaucaucacggugaaggacaugcugaagcggaacaccccgaucuacacccgccaggcggccugcaagaagggcgggcuguucgaccagaccaucaugaagaaggggcucggccagcacccccugaagaaggagggcgccuucagcaacaucuccaaguacgggggcuacaacaaggucagcgccgccuacuacacgcugaucgaguacgaggagaaggggaacaagauccggucccucgagaccaucccccuguaccuggugaaggacauccagaaggaccaggacgugcucaagagcuaccugaccgaccugcucggcaagaaggagaucaagauccuggucccgaagaucaagaucaacucccugcucaagaucaacggguuccccugccacaucaccggcaagacgggcgacagcuucgugcugcgccccgcggugcaguucugcugcuccaacgacgagguccuguacuucaagaagaucauccgguucaacgagauccgcagccagcgcgagaagauggggaagaccaucagccccuacgaggaccucuccuuccggagcuacaucaaggagaaccugugcaagaagaccaaggccgacgagaucggcgagaaggaguucuacgaccugcuccagaagaagaaccuggagaucuacgacaugcugcucaccaagcacaaggacacgaucuacaacaagcgcccgaacuccaccacccuggggaugcugaccaagggccgguacgaguucaucaaccucaagcccaaggaccagaucaucgugaugcuggagauccugaagcuguucugcacgacccgcgaggccaucgaccuggggcugaucaagggcaagcccgccgcgggcguggccacccucgggaagaagaucagcaaccccgacaacugcauccugaucuaccaguccaucaccggcaucuucgagaagcggaucgaccugcucaaggucuga

SEQ ID NO: 2102 - RNA, 4188 nt, Artificial Sequence
  Cas9 variant
augggcgacaccgugaagaacuaccacaucgggcuggacaucggcaccagcuccgucggguucgccgcccgcgacgacgacaacaaccucauccgggugaagggcaagaacgugaucgggacccgccuguucagcgagggccagaccgcgcaggagcggcgcauggcccgggccucccgccggcgcuacaaccggcgcaaguggcggcugcgccuccuggacgagaucuuccacgacgagaucauccacaaggacgccgaguucuucaaccggcugaagcagagcucccucagccccaaggacgagcgcaagcaguacuucggcucccugcuguucccggaggucggggacagcgaguacuaccacgacggcaaccagaccaucuaccaccuccggcaccgccugaugacccaggacgagaaggccgacauccgggagaucuaccuggcgcuccgccacaucaucaaguaccgggggaacuuccuggacgacacgcccguguccagcuucgaggccuccgaccugaagcucgccagcuucgugcccacccugaacgaccuguucgagaccaucgacgucaacuacgaguucuccauggacaacaucaacgagaucgaggacauccuccugaacaacaagcugcgcaacagcgacaaguccaagcagcuccccgaccugcugaccgagccgaucgugaacaucgacgacaagagccucgagaagcaguucaacaaggagcggacggacaucuccaaggagaucgccaagagcguggucggcuccaagaugaacgugaacaagcugcugagcuucgagagcuccgggggcuacaagaucgcguucagcuucuccgacgccagcuccgaggacaagaugauggagcucagcgacgugcuggacgacucccgcaugaacauccugaacauccucaaggucaucuacagccgcgugcggcugaaccagaucauccccuccggcauggggcugagcgaguccaugguggccgccuacgaccuccacaagcagcagcugaaggaccugaagaagcuccugaacguccugcccuucaacgagcgcuacgccgugaagaucgcguacgccgccuacaucggcaacaucgacaagcagaaguucaccaagagcgaggugaagaccaucgacaagcucaaggagaaguccgccaucaugaacguccuggacuucaagagcgggcacaucaccaacgaggagcuguccaacgugaucaagguggucaucguggacaaguaccucaacgacgagaacuucgaguaccacagcaucguggagaagaucaaccaggacaucuccaacggcagcuaccugcugaagcagcggaacaaccagaacggcaacaucccccaccagcuccaccagauggagcuggaccagaucaucgagaaccaguccaaguacuacccguuccugggggagcucaaccccaacagcaaccgcaaccacaucgccaaguacaagaucagcgagcuggucgcguuccgggugcccuacuacgucggcccccugaucacgccggaggagcaggagaagaccuccggggccagcuucgccuggaugaagcgcaaggaggacggcgccaucacccccuggaacuucgaggagaagguggacaaggaggagaccgccucccgguucaucaagcgccugacggugaaggacaccuaccuccugaacgaggacguccugcccgacaacagccuccuguacgagaaguucaaggugcugaacgagcucaacguggucaaggcgaacaacaagcggcugaccguggaggagaagcagggggccuucgacaaccuguucaagaagaugaagaccgugacggccaagaagcucaagaacuaccuggucuccaaccacaaccacaucaacagcguggagaucaccggccuguccgacguggacaaguucaacaacagccucuccaccuacaucgacuucaagaagaucuucgacgacaagaucgacaaccccgaccugcuggacgacuucgaggacaucaucgaguggagcaccgucuucgaggaccgcaagaucuucgaggagaaggugcggaaggacaucuccuggaucagcgaguccgagaucaaggccguggucagcaagcgcuacuccggcugggggcggcucagcaagaagcugcugaacggcaucacgaacaacgaggggcgcaacaucaucgacgagcucugggaggaguccgagaccuucauggaggccgugagcaagccggaggugaaggagcagaucgacggcaucaacagcgacuucaucaagaacaccgacaucgaguccguccuggcggacgccuacaccagcccccagaacaagaaggccauccgggagacgcacaagcuggugaaggacauccagaaggccaugggcgggcaggcgcccgccuccaucagcaucgaguucacccgcaacccccaggacaagggccagcucacccggucccgccacagcgaggugucccggaaguacaaggagaucagcaaggaggucuccaagacccugaacgacgagcucaagagcaagaagaacuccauggacguggacaaguacuaccuguacuucaugcagauggggaucgaccuguacgacggcagcuccaucgacaucgacgaccugaacaacuaccagaucgaccacaucaucccgcagagcuucuacaaggacgacuccuucgacaaccgcgugcucacgcacuacagcaacaaccagaagaaggggaacaacacgccccugaacggccugaacaucgacgacaagacccgcgccaucuggaaccaccuccgggaccuggggcugaucaccaagaagaaguacaacggccucacccugaagggcauggaccagcuguccaaguacaccaagcacggguucauccgccggcagcucgucgagaccagccaggugaucaagcugguggccaacauccuguccgacgaguucagcaccgacgacaccaagaucaucgaggucaaggccaagaugaacagccagauccgccagguguucaaccucuacaaggugcgggagcugaacgacuaccaccacgcggucgacgccuaccugacgaccuucaucggcggguaccucuacaaccgcuaccccaaccugcggaacauguucguguacggcgacuucaagaaguucuccgccgacguggacaaccugaagaccuucaacuuccuccacgacaucaccaaccccagcgacaaguucgaggaccgcaucuucgacgagaaguccggcgagcugauccuggaccggaagcacgccaucgagacgaucaagaagaucuaccaguacaaguacaugcucaucacccgcgaggucagcaccaagaacgggcagcuguccgaccagaccguguacagcgccaagcggaucaacaacgugaaggcgccgauccccgucaagaaggacuccaaccccgagcuguacggcuuccgcacggggaacguggaccaccacauggugaucgucaaguaccccaagaaggacagcuacgacuacaagguggugggcaucccgcuccgguucguccagaagcugaaggagaccaaggacaacaaggacuacgagaaccugcucaaccagaucgugcagaugaagcugaaccgcaagaagcaggacuucaucguggucguggacaacgugauguacgggcagcugauccaggacggcggcgagaaguacacccucggguccagcaccuacaaguacaacgccaagcagcuggucaucaacauggacaagacgcggauccuggaggacaaccgcuaccucaacucccuggacgagggcgaggugagcgagaagcuggugaacaucuacaacgacaucaugaaggucgugaacucccgguucgaccucuucgacaucaacaaguuccgcgagaagcugaacgacgggcugaacaaguucaagaacaucagcaacgagcagaaggaggagacccuccugaagauccuguccggccuccacugcgggagcgccaacguccccaucaaggagcugggccugaccacgccccucggcaagcugcagcugccguccgggaucgugcucagcgaggaggccguggucaucuaccagucccccagcggccuguucgagaacaaggugcggcugaaggaccucuga

SEQ ID NO: 2103 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaccgacgagggcuucuuccagcggaugaaggagagccccuucuacgccgaggacaagacgauccugcaggagaacacccucuucaacgacaaggacuucgcggacaagaccuaccacaaggccuacccgaccaucaaccaccugaucaaggccuggaucgagaacaaggucaagcccgacccccgccugcucuaccuggccugccacaacaucaucaagaagcggggccacuuccuguucgagggggacuucgacuccgagaaccaguucgacacgagcauccaggcccucuucgaguaccugcgcgaggacauggagguggacaucgacgcggacucccagaaggugaaggagauccugaaggacagcucccucaagaacagcgagaagcagucccggcugaacaagauccugggccucaagcccagcgacaagcagaagaaggccaucaccaaccugaucuccgggaacaagaucaacuucgccgaccuguacgacaacccggaccucaaggacgccgagaagaacagcaucuccuucagcaaggacgacuucgacgcgcuguccgacgaccuggccagcauccucggcgacuccuucgagcugcugcucaaggccaaggccgucuacaacugcagcgugcuguccaaggugaucggggacgagcaguaccugagcuucgccaaggucaagaucuacgagaagcacaagaccgaccucaccaagcugaagaacgugaucaagaagcacuuccccaaggacuacaagaagguguucggcuacaacaagaacgagaagaacaacaacaacuacagcggcuacgucggggugugcaagacgaaguccaagaagcugaucaucaacaacagcgugaaccaggaggacuucuacaaguuccucaagaccauccuguccgccaagagcgagaucaaggaggucaacgacauccugaccgagaucgagaccggcacguuccuccccaagcagaucuccaagagcaacgcggagauccccuaccagcugcgcaagauggagcuggagaagauccucuccaacgccgagaagcacuucagcuuccugaagcagaaggacgagaaggggcugucccacagcgagaagaucaucaugcuccugaccuucaagaucccguacuacaucggccccaucaacgacaaccacaagaaguucuuccccgaccggugcuggguggugaagaaggagaagucccccagcggcaagaccaccccguggaacuucuucgaccacaucgacaaggagaagacggccgaggccuucaucaccucccgcaccaacuucugcaccuaccuggucggggagagcgugcuccccaaguccagccugcuguacuccgaguacacggugcugaacgagaucaacaaccuccagaucaucaucgacggcaagaacaucugcgacaucaagcugaagcagaagaucuacgaggaccuguucaagaaguacaagaagaucacccagaagcagaucagcaccuucaucaagcacgaggggaucugcaacaagaccgacgaggucaucauccucggcaucgacaaggagugcacguccagccucaagagcuacaucgagcugaagaacaucuucgggaagcaggucgacgagaucuccaccaagaacaugcucgaggagaucauccggugggcgaccaucuacgacgagggcgagggcaagaccauccugaagacgaagaucaaggccgaguacgggaaguacugcagcgacgagcagaucaagaagauccugaaccucaaguucuccggcugggggcgccugagccggaaguuccuggagaccgugaccuccgagaugcccggcuucagcgagcccgugaacaucaucaccgccaugcgcgagacgcagaacaaccucauggagcugcuguccagcgaguucaccuucaccgagaacaucaagaagaucaacuccggguucgaggacgccgagaagcaguucagcuacgacggccucgugaagccgcuguuccugucccccagcgucaagaagaugcucuggcagacccugaagcuggugaaggagaucucccacaucacccaggccccgcccaagaagaucuucaucgagauggcgaagggcgccgagcucgagcccgcccgcacgaagacccggcugaagauccugcaggaccucuacaacaacugcaagaacgacgccgacgcguucagcuccgagaucaaggaccugagcgggaagaucgagaacgaggacaaccugcgccuccgguccgacaagcuguaccuguacuacacccagcucggcaagugcauguacugcgggaagcccaucgagaucggccacguguucgacaccagcaacuacgacaucgaccacaucuacccccagagcaagaucaaggacgacuccaucagcaaccgcguccuggugugcuccagcugcaacaagaacaaggaggacaaguacccccugaaguccgagauccagagcaagcagcggggguucuggaacuuccuccagcgcaacaacuucaucucccuggagaagcugaaccggcucacgcgcgccaccccgaucagcgacgacgagaccgccaaguucaucgcccggcagcugguggagacccgccaggccacgaaggucgcggccaaggugcuggagaagauguuccccgagaccaagaucguguacuccaaggccgagaccgucagcauguuccggaacaaguucgacaucgugaagugccgcgagaucaacgacuuccaccacgcccacgacgccuaccucaacaucguggucggcaacguguacaacaccaaguucacgaacaaccccuggaacuucaucaaggagaagcgggacaaccccaagaucgcggacaccuacaacuacuacaagguguucgacuacgacgucaagcgcaacaacaucaccgccugggagaagggcaagaccaucaucacggugaaggacaugcugaagcggaacaccccgaucuacacccgccaggccgccugcaagaagggggagcuguucaaccagaccaucaugaagaagggccucgggcagcacccccugaagaaggagggccccuucuccaacaucagcaaguacggcggguacaacaagguguccgccgcguacuacacgcugaucgaguacgaggagaagggcaacaagauccggagccucgagaccaucccgcuguaccuggucaaggacauccagaaggaccaggacgugcucaaguccuaccugaccgaccugcucgggaagaaggaguucaagauccuggugcccaagaucaagaucaacagccugcucaagaucaacggcuuccccugccacaucaccgggaagacgaacgacuccuuccugcugcgccccgccguccaguucugcugcagcaacaacgaggugcucuacuucaagaagaucauccgguucuccgagauccgcagccagcgcgagaagaucggcaagaccaucagcccguacgaggaccuguccuuccggagcuacaucaaggagaaccuguggaagaagaccaagaacgacgagaucggcgagaaggaguucuacgaccuccugcagaagaagaaccuggagaucuacgacaugcuccugaccaagcacaaggacacgaucuacaagaagcgccccaacuccgccaccaucgacauccuggugaaggggaaggagaaguucaagagccucaucaucgagaaccaguucgaggucauccuggagauccugaagcuguucuccgccacccggaacgugagcgaccugcagcacaucggcggguccaaguacagcggcguggcgaagaucgggaacaagaucuccagccuggacaacugcauccucaucuaccaguccaucaccggcaucuucgagaagcgcaucgaccugcugaaggucuga

SEQ ID NO: 2104 - RNA, 4188 nt, Artificial Sequence
  Cas9 variant
augaacgccaaccgcgagauggccuacuacaucggcaucgacauggggaccggcagcguggggauggcgaucaccgacgagaacuacaaccugcucaaggucaagggccaggacuacugguucgugcgggaguucgagacggccaacacccagaucaagcgccggaugcaccgcaucuccaagcggcgccugcggcgccaccaggugcgggucgcccugauccgcagcuacuucgccgaggagauccucaagaacgacccccuguucuucauccggcaggacaacuccaucuacuaccuggaggacaaggacagcgugcucaagaccaaggacugccuguucgccgacuacaacuaccacgacaagaacuacuacaaggacuacccgaccaucuuccaccuccgccaggcguucaucaaggacacggugaaggacgacgagaaccacacccgguacgcccgccuccuguaccuggccaucaucaacauguucgagcaccgggggcacuuccuccugaacuccgucagcgaggacaucaacaaggagauggugaaggacgccggcgagggcuucacccuguaccuccaggagcgcaucaaggagaucaagcccguguccuacagcgacauccuggacguccugguggagaagaacaucucccggagcgagaagaaggagcgcaucguggagcuguucgggaucaagaaguccugcaagaacggcauggagaucaucaagugccugugcgggcuggaggcgaacgucgccaucauguucaaccucgacgacaucgagaacaagcugaccaucguggugagcaaggacgacuacgaggacaagcuggccgagguccagccccucguggacgaggaguccuucgagcugcugagccggaucaagcagcucuacgacuacucccagcugcagagcauccugaagggcuacaaggagaaggaggacggggaggacaaguaccucuccgacgugcgcgucgagcuguacgagaagcacaaggccgaccugaagcuccugaagaagguguacaagcgggaccuggacaagaagggcaagaucugcgagggcaagaacauccagcgcagcuccaaguacaacuucauguuccgcagcgggaaggacggcacguacagcgccuacaccaacucccucaacagcuucugcuccaagaccaucgagaacaaguaccggcgcaacaugaagaaccgggaccgcgcgagccuguacgacaccaucaagaaggaccuguccgggaucgagaacgacgacgugaagaagauccuccgggacaucgagacggagaaguuccugcccaagcagaucaccggcgagaacggcgucaucccgaaccagauccacgccaaggagcugaaggccauccucaagaacgccgagaagcaccuccccuuccugaccgagaaggacgacagcgggcugaccguguccgagcgcaucaucagccuguuccgguacugcauccccuacuacaucggccccguggggaaggacucccgcacgggcugggccagcaucaaggaggaggggcagaucuucccguggaacaucgagcagaagaucgacgucgacaagaccuccgaggaguucaucacccggcugaucaagaccugcacguaccucagcaacgagaaggugguccccaagcagucccugguguacgagcgcuacugcgugcugaacgagaucaacaacaucaagauccggggcaagcgcaucgacccccagcugaagcaggagaucuucaaggagcucuacaucggcagcaagugcgggaagaaggucacccggaagaaccugugccaguaccuggugaacaagggcgcgaucgaggaggacuccgagaucagcgggaucgacaaggaccucaacaccuacauguccagcuacggcaagauguaccagaucuucggggacaagaucaagcgcgacgacaucaaggagguggccgaggagaucaucuacuacggcaccaucuacggcggggccaaggagauguucaagaagaagaucgagcaguacgucuccgaggacauccuggacgaggcccagaugaaccggauccugggcuucaaguucaaggacugggcccgccucagcaagaaguuccuguaccuggagggguacgacaagggcaaccagaaccagcucacgacccugaugcaggcgcugugggacuacaaccucaacaccauggagcugaugaacagccccauguucaccuucaaggagacgcuggagaagcagaagaacaagauggagaaggugcucugcgacuucgaguacgaggaccuggacgaguacuacuucuccgccccggugaagcggauggucuggcagaccaucgccugccugaaggagguggugcagaucauggggcacaaccccaagcgcaucuucaucgagaugccccgggccgacgaggagaagggcgagcagggccgcaaggccagccgcaagaaccggcuccugucccuguacgaggagaucgaggacgagcgccccuggaagaaggagaucgagaacgcggccgagagcgggcggcucaacuccaagcgcauguaccuguacuaccugcagaugggcaaggacgccuacaccggggaggacaucgacaucgaggaccucuucgacaacagcaaguacgacaucgaccacaucuacccgcggucccugaccgacgacaacagccuggagaacaaccucguccugguguccgccacgaucaaccaggacgugaagaagaacgacuaccccauccccuacgacaagauccgcggcaacagcaagguccgggagcuguggcgcuuccuccacgagaagaaguucaugaacgacgagaaguacaaccggcugauguccgacgugccccugacccaggagcagcucgcgggcuacaucgcccgccagcugguggagaccgcccaggggaccaagggcaucgccgacaucaucaagagcgucaucccggacgccgacaucaucuacuccaaggcgaagaacgugagcgacuuccggaagcgcuacgggaugcugaagucccggcucacgaacgacuuccaccacgccaaggacgccuaccugaacguggucgugggcaacguguacuucaccaaguucacccagaacccccgcaaguacaucaaggacgagaacgacaucgagaacaagaaguacaacuacaaccugagcaagauguacgacaaggacgucauccggaacgggaagguggccuggaucgcccagaacggcaagaaggcgggcaccauccagaccaucaagaaggugauggaccgcaacacgcccaucaucacccggcaggccuucgagcagcgcggggagcucuacgaccugcagcccaucuccaagcacaaggccaagaaggagaacuacgucccgaucaaggccaccaacgagaagaugaaggacgugaccaaguacggcggguucacgagccugaaccccgccuacuucguguucgucgaguacggcagcgcgaagaagcggcagcgcugcuucgccguggugcacuccuacugggccagcuccaucaagaacaacgaggaccucgucacccaccugaaggaccggggguacgagaaccccaucgugaucgccgacaagaucaagaagaacagccugaucaaguacaacggcuacuuccucuacaucgugggcauggacgcgcgcaagcaggucgaguucuccaacgccaccagcaugugccugaacaacaacuucauccaguacauccagaagaucgagaaggccaacacccugaucgccgaggccaagaagcgccggcccuacaucgacgaguccaucacggcggagcgcaacaucgcccucuacaacgagcugaagaagaagcaccuggacagcaucuucaagaaccacccgaaggggaucggcuccgugcucgagagcggggagggcgccuucgugcagcugucccuggagcagcagaucgggauccucuacagcaucauccaguucuccagcuucaagaagggcaccuucucccugacccugaucggcgggcccaaggaggucggccggauccgcaucagcgggaacaugcccaaggcccgggagcucaagcugauccacuacuccaucaccggcauguacaagaaggagaucaaccugcucgacuga

SEQ ID NO: 2105 - RNA, 4188 nt, Artificial Sequence
  Cas9 variant
auggagacccaggccagcaaccagcugaucuccagccaccucaagggcuaccccaucaaggacuacuucguggggcuggacaucggcaccuccagcgucgggugggccgugacgaacaaggcguacgagcugcucaaguuccgcucccacaagauguggggcagccggcuguucgacgagggggaguccgccguggcccgccggggcuuccgcagcaugcggcgccggcuggagcgccggaagcuccgccugaagcugcucgaggagcuguucgccgacgccauggcgcaggucgacccgaccuucuucaugcggcugcgcgaguccaaguaccacuacgaggacaagaccaccggccacagcuccaagcacauccucuucaucgacaagaacuacacggaccaggacuacuacaaggaguaccccaccaucuaccaccuccggguggcccugaugaaguccgggaccgacgacauccgcaagcuguuccuggccgugcaccacauccugaaguaccggggcaacuuccucuacgagggggccaccuucgacagcaacgcgagcacgcuggacgacguccugaagcaggcccucgagaacaucaccuucaacugcuucgacuccagcgccgccaucggcuccaucgggcagauccugauggagcugggcaagaccaagagcgacaaggccaaggcgaucgagcgccucguggacaccuacaucaucacggacgagguggacaccuccggcaagacccagaaggagcaggucaaggaggacaagaagcggcucaagagcuucgccaaccuggugcuggggcugagcgccucccugaccgaccucuucggcagcguggaggaccuggacgaggaccugaagaagcuccagaucaucggggacacguacgacgagcgccgggacgaccuggccaaggucuggggcgacgagauccacaucaucgacgacugcaaguccguguacgacgccaucauccugaugagcaucaaggagcccggccucaccaucuccgagagcaaggugaaggcguucaagaagcacaaggacgaccuggccauccugaagucccuccucaagagcgaccgcuccaucuacaacaccauguucaaggucgacgagaaggggcugcacaacuacgugcacuacaucaagcagggccggaccgaggagacgagcugcaaccgcgaggacuucuacaaguacaccaagaagguggucgaggggcugcccgacuccaaggacaaggaguacauccugagcgagaucgagcugcagacccuccugccgcugcagcgcaucaaggacaacggcgugauccccuaccagcuccaccuggaggagcugaaggugauccuggccaagugcgggcccaaguuccccuuccucaacgaggucgccgacggcuucuccguggccgagaagcugaucaagaugcuggaguuccggaucccguacuacgugggcccccucaacacccaccacaacgucgacaacgggggcuucgcgugggccgugcgcaaggccagcgggcgggucacgcccuggaacuucgacgacaagaucgaccgcgagaaguccgccgccgcguucaucaagaaccugaccaacaagugcaccuaccugcucggcgaggacgugcugcccaagagcucccugcucuacagcgaguucaugcugcugaacgagcucaacaacgugcggaucgacgggaagccgcuggagaaggccgucaaggagcaccugaucgaggccguguucaagcaggaccacaagaagaugaccaagaaccgcaucgagcaguuccucaaggacaacaacuacauccccgagaagcacaagcccgagaucacgggccuggacggcgagaucaagaacgaccuggccuccuaccgggacauggugcgcauccucgggaacaacuucgaccugagcauggcggaggagaucaucaccgacaucaccaucuucggcgagagcaagaagaugcugcgggagacccuccgcaacaaguucuccagccggcuggacgacgaggccaucaagaagcuguccaagcuccgcuaccgggacugggggcgccugagccggaagcugcucaacgucaucgagggcugcgacaaggccggggacggcacgcccgagaccaucaucauccugaugcgcaacuucuccuacaaccugauggagcuccugggcgacaaguucagcuucauggagcggauccaggagaucaacgccaagcugaucgaggggcagaucgugaacccgcacgacaucaucgacgaccucgcccugucccccgcggugaagcgcgccgucuggcaggcccugcggaucguggacgagaucgugcacaucaagaagacccuccccgcccgcaucuucgucgaggugacccgcagcaacaaggccgagaagaagaagaaggacucccggcagaagcgccugagcgaccuguacgcggccaucaagaaggacgacgcccuccuguccggccugacgaacgaggaguucgggggccucaagagcggccuggccaaguacgacgacgccgcgcugcgguccaagaagcucuaccuguacuacacccagauggggcgcugcgccuacaccggcgaggugaucgaccugagccagcucaacaccgacaacuacgacaucgaccacaucuacccccggucccugaccaaggacgacagcuucgacaaccugguccucugcaagcgcacggccaacgcccagaaguccgacaccuacccgaucagcaaggagauccagaaggcgcagaaggccuucuggaucuuccugaagcagcaggggcugaucagcgagcggaaguacgagcgccucacccggaucacgccccugaccgccgacgaccuguccggcuucaucgcccgccagcucguggagaccaaccagagcgugaaggccgcgaccacccugcugcggcgccucuaccccggggucgacgugguguucgucaaggccgagaacgugacggacuuccggcacgacaacgacuucaucaaggugcgcucccugaaccaccaccaccacgccaaggacgccuaccugaacaucgucgugggcaacguguaccacgagcgguucacccgcaacuuccgggccuucuucaagaagaacggcgcgaaccgcaccuacaaccucgccaagauguucaacuacgacgucaagugcaccaacgccaaggacgggaaggccugggccgugaagacgagcauggacaccgugaagaagaugauggacuccaacgacguccgggugaccaagcgcguguacgagcagaagggccagcugagcgacaucaaccugaccaaggcguccaaggucaaggccgacaucuaccuccccaucaaggccaacgacccgaucaugagccagaacaugaaguacgggggcuacuccgacaucaagaacgccuacuacacgaucaucgaguacagcgacaagaagaacaacuccaucaaggcguucauccccauccccaucuucaucgccaccaagacccugaccaagcaggcccugcucgaguacaucaagacggugcugcccaaggccaacaaccugcggaucaucuacaagaagguguacaacgaccagcuccugaagaucgacggguucaacuacuaccugggcggccgcagcaacgaccgcuucugcaucgacaacgccauccagcucaucgucccgcuggagauccaguucuacaucaagcugguggagaaguucaccgcgaucaucuccgagaacaagaacaucgcccucaaggccagcuccgucaagagccggaaccccaucaacaaccagguggagaacaucacccuggaguacacccagaagcuguucgacuaccucguguccaaguucaacgagcugaucuaccugaagaugcgcgggaacaagcucacggacgugaacaacaucggccggaagcaguucaucaagcugagccuggaggagcgcugcaaggcccucgccgagcugcugaacaucuucaccaacaugaacaagaagcucucccugagcaccaucaacgucagcgcgucccggaagguggugaacuucaagaucagcucccuggacgaguucaagaucgucaacgagagcaucaccgggcucuacucccacgagaucacgaucguguga

SEQ ID NO: 2106 - RNA, 4188 nt, Artificial Sequence
  Cas9 variant
augaaccugcgcaacaccaccgacgaguacaacaucggccucgacauggggacgaacagcgugggcugggccgucaccgacaaggugggggccaucgcgcacuucaagggcaugcccacccuggggucccggcuguucgacgccgcccagaccgccgccgaggcgcgcgcccaccggggccagcgccggcgcuacgugcggcgccgguggcgccucgaccugcugcagagccucuuccaggacgagaucgacaaggucgacuccgaguucuucauccggcugcgccagagccggcugcacguggaggaccgcgaggacggccacgccgacuacaaguggccgaucuucaacgacuccgacuucacggagguggacuacuacaagcgguuccccaccaucuaccaccuccgcaaguggcugaucgagaccgaccagaaggccgacauccggcugaucuaccucgcgguccacaacaucgugaagcaccgcgggaacuuccugcgggagaacaacaagaaccugagcucccgcaacgccgaccccgccgaggccgugggccaccuccggcuggcccugaacaacuggugccucgagcgcggguacgagugcgcguggaaguccggcgggaacgacaacgccauccugaacguccugaucgacggcgagaagcgccggagcgaccaggugcgcgagaucgccaagcucaccggcaucgacugcggggacgccaagcagagccggcagugcaacgaggccaucgcgaaggccaucgugggccugaaggccgagaugaagaacaucuucggggaguuccccgccgagaagacgcugaucuaccucuccagcgacgacgacgucgagguggugcgcgacgccugcccggacgacuccgucgagcuguuccaggcgcugugcgagcucuacgccgccuacauccugcagggccugcucagcuacgcccccggccagaccaucuccgugaacauggugaagaaguacgaccgguacggggaggaccugcaccuccugaaggagcugacccgcaccuacgccagcaagcgguacgacgcguucuuccgcggcgagacguacgagggguccagcgacuacgucguggacaaggcccagggcuacacccgguacaaccuggggaccacccagcucuccuacgacgacuuccagaaggccgugaaggagcuguucaagggcacggacgcccugcaggacgagcgcuaccagggcaugauggucgcguucggggagcagcgguuccuccgccggcugaagaccagcgacaacggcagcaucuacuaccagcugcaccucgaggagcugcacgccauccuggagaaccaggggaagcacuaccccuuccuccuggccgaggaggacaagaucgagucccuggugagcuuccgcauccccuacuacgugggcccgcucacccgggagaacgccgccgucgggcacgacggcaaggagcgcuucgcgugguccagccggcgcgacggcauggagcacgccgugaucacccccuggaacugggaggagaucaucgaccgggacaaguccgccgaggacuucaucauccgcaugacgggggacugcaccuaccugcagggcgagcccguccugcccaagugcagccugcucuacgaggaguucugcgcccugaacgagcugaacggggcccacuggaccaucgacgaggacgacgagcgccgguucgacgcggcccagcgcgagcggaucaugugcgaccucuuccgcuccacccggaaggugacguacaagaaggugagcgacuggcuggagcgcgaggacuccuucgucggcgcccgggugcacgggggccagggcgagcacggguucgagagccagcugggcuccuacaucuucuucugcaaggacguguucaagaccgacagccucgacgaggccgacuacccgaugaucgagcagaucauccugugguccacccuguucgaggaccgcgacauccuccggcgcaagaucgaggaggccuacggggaccggcugaccacggagcagaucaaggucaucugcaagaagcgcuucgcgggcuggggccggcugagcaagaagcuccugaccgggaucaagguggacaccgacaccggccgcaaguccaucaucgacgugcugcgggaggggaaccccaacgacggccagcgcagccggacgauggucuucauggaggugcuccgcgacgaggggcugggcuuccagaaggccguggacgacuucaaccgggacuacuucuccgagcacaacaacggccugauggacgucaacgaccuccccgggagccccgccauccgccgguccaucaaccaggccgugcgcaucguggacgagaucgucagcaucgcgaagaaggagccggccaacaucuucaucgaggugacccgcgaggaggacgacccccggaagaagggcaagcgcaccaagcggcgcuacgacgccaucaagagcgcccuggagguguucaagaaggacgacccccagcuguggaaggagcucaccaagaaggacuccaacaacauggacgagcggcugagccuguacuucaugcagcgcgggaagugcauguacuccggccggcccaucaagaucgaggagcuccacacggggaaguacgaggucgaccacaucaucccgcgcagcuacaucaaggacgacucccuggagaacaaggugcugguguaccgggaggagaaccagcacaagaccgacacccuccugaucgacagcuccauccgccggaagaugggcaaguacuggcgcaugcugcacaacgccaagcucaucggcgacaagaaguuccggaaccuguuccgcgaccacaucgacgacaagaccaugaagggguucgucgcgcggcagaucguggagaccagccagauggugaagcugguccagacgcuccuggaggcccgcuaccccggcgcccggaucgugcccgugaaggccaacaucucccacgaccugcgcgacgccgcggggcucgucaagugccgggaggccaacgacuuccaccacgcccacgacgccuuccuggccugccgcgugggccuguucauccagaagcgccaccccagcguguacgacaacccgaucgggcucgcgcacaucaugcgggacuacgcccgcgcccaggcccgggaguacaagaagucccacuaccuggcgcacaccaagggcuucaucgucaacagcuuccuguccagcggcuucgacaaggagaccggggagguguucaaggacgacugggacgccgaggccgagguggagggcauccgccggguccucaacuaccgccagugcuucaucucccggaugcccguggaggccaccgggacguucugggaccagaccaucuacagccccaagugcggcaagaagcugacccugccccucaagcgcgggcuggacccggaccgguacggcuccuacagccgcgagcaguucgccuacuucuucaucuacgaggcgcgggaccugaagcacgagcgccacauccuccaguucgcccaggugcccguccggguggccgcccacaucgccaaggaccccagccagcuggaguccuacgcggugaagcuggccggccaggccaaccucgccuucguccgcaucgugcggcgccggauccugaagaagcagcugcucgagcugaacggggaccgccugaucaucaccggcgugcgggagguccgcaacgccacggaguucgcguucagccucgacgaggagacccugaucgagcggugcgugcagaucgccaagguggggucccugaucggcgucgugaacgacgaggacgaggagcagcucagcgccgaccugaacgagcuguucuccagccucgugaagcgcggcccgaagcugugcaaccgccuguacgcccagcucaagcuggacaaguaccuguccaaguucgacgagcucacccugaccgacaaggccaaggucgugcugcagcucaucgcgaucacgaacgggagcaucaacauggccgaccuguccgcccugggcagcuccaaguacgccgggugcaugcaggucagcuacuucaagcagcucaacgcgcccaucggcgaggugaacaucaucgaccaguccgugaccgggauguucgagcggcgcacccacaucggccuguga

SEQ ID NO: 2107 - RNA, 4188 nt, Artificial Sequence
  Cas9 variant
augaaggagaucaaggacuacaucaucgggcuggacaucgggaccaacagcugcggcuacguggucaccgacaagcagaacaacauccucaagcugaaggggaagacggccaucggcgcccgccuguucaaggaggggcaggcggccgccgaccggcgcuccuuccggaccacccgccggcgccucgcccggcgccacuggcggcugggccugcucgaggagaucuucgaccccgagauggagaagaucgacccgaacuucuuccgccggcugaaggagagcgacuacucccccaaggacagccgcaagcaguucaacgccaucguguucaaguccaucaaggcggacaagcgguucuacaagaaguaccccaccaucuaccaccuccgcaacgcccucaugcacgacaaccagaagcacgaccugcgggagaucuucauggccgugcaccacaucgucaaguaccgcggcaacuuccugcgggaggacagcgugaacgccuucaaggcggccaaguucucccuccgcggggaggacggcaucgggcccguggacaagcugaacgaccugcucaaggagaucuacagcgaguacuccccggagcuggccacgaacaaccugagcaagaucgaggacaucaucaaggacaagaaccucuacaagcaggacaagcugaagcaggucgccacccugcucaucaaggaggccgacuccaaggacaaggcgaagcugaacaaggacaucgccaagcaggucgccaacagcuucaugggcuacauguuccggcuggacacccucuucucccugaccgacguggacgugaaggacuacaagcugaaguucagcgacgccaacaucgacgagucccucgacgaccugacgagccugcucaccgacgcccagaucgaguucgugcuggagcugcaguccaucuacaacaccaucgugcucaacgagaucguccccgacgggaugagccuguccgagagcaugaucaagaaguacgacgaccacaaggaggaccugaagaucuucaaggaguacaucgacagccucuccgaccagaagaaggcgaagaagcugcugagcgccuacaaccucuacgugaacuaccgcaaguccgaccugguggaggccaagaaccuguucaagaacaagaaggucggcgacaagaacuucgccgacgugaucagcaacuucgagguguucggcaaguucgucuccgacaaccucgacgacagcgagcuggccaacaagaucaaggcgcggcuggaccucggggaguuccugcccaagcagcgcaccaaccagaacggcgugauccccuaccagcugcaccagguggagcucacgcagauccuggagaagcaggggaaguacuacccguuccugaucacccccaaccccgucgagucccaccgcaacaacgcccccuacgagaucagcgagcugguguccuuccgggugccguacuacgucggcccccucaucgacaaccagagcaucaaggacaagcagaacaagaacaaguucgccuggauggugcgccagaagcagggccagaucacccccuggaaccuggaggagauggucgacaccacggaguccgccaaccaguucaucaagcggaugacccgcaaggacaccuaccugcucgccgaggacgugcugcccaagagcucccugguguaccagaaguucaugauccucgacgagcugaaccggaucaagaucgacgggaagaagcugaccagcgagcucaagcacgacaucuucgagaagcuguucaagaagcagaaguccaucaaccuggacaaccucaagaacuaccugcuggucgagggcaacaucccggggcucaucgagggccugagcgacgggaucaacuucaacaacuccuucagcacguacaucgacuaccgcaacaucuucggcgacgagaucgacaaccccaacaagcaggcggacuucgagaagaugaucgagugguccaccguguucgaggaccggaagaucuucaagcgcaagcugaaggagaucaccuggcucaccagcgagcagaucaagcaggucagcuccaagcgguacagcggcugggggcgccuguccaagaagcugcucacgcagaucaccgacgagaacggcgugaacauccugcagcggcuguggaacgagcccgagacccucaccgaggugcuggccaaccccgugaucaagcgcaagaucgucgaggccaacagcuccuucacgaaggccaaggacaugaaggacauccugguggaggcguacaccagcccgcagaacaagaaggccauccgccaggugaugcgggucguggacgacaucaucgccgccgcccacgggaagaagcccucccagaucgcgaucgaguucgcccgggaggaccaggacaacccccagaugaccaagagccgcaaggcccagcucgaccagaucuacgccaagaucuccgacgaguuccuggacgacgccgugaagaacgagcugaagaacaugaaggacaacaagccccucgcgaaggacaaggucuuccuguacuucaagcagaugggccgggacgccuacagcggggagaagcugucccucgacaaccugcaggacuacgacaucgaccacaucuacccgcagagcuucaucaaggacgacuccuucgacaaccgcgugcuggugcagcgggccuacaacaacggcaagagcgacaacguccccgugcuccuguucggcaacaagaucgccgccgggcugggcaucaccauccgccagauguggaagaaguggcucgagcuggggcugaucuccaagcgcaaguucaacaaccucaucacggaccccgagaagaucagccggaacauggcguccggcuucgugaaccgccagcuggucgagaccagccaggugaucaagcugguggccaacauccuccaggccaagcugcccgacaccgagaucaucgaggucaaggccagcuacaacuccauccugcggaaggaguucaaccucuacaagagccgcgaggugaacgacuaccaccacgcgaucgacgccuaccugaccacgaucguggggaacuaccuguaccaggucuacccgaagcuccggcccuacuucguguacggccaguucaagaaguucggcaaggccgagaaccaggaggacgaccccgugaagaagaucaagaaguucaacuucaucuaccagcugaucugggggaaggacgacgccaucugcaucucccacaccaaccagcaggucuucagcaagaaggacaucaucgacaagcugaccaccgccuacaacuucaaguacaugaacaucucccacgcgguguacacccgcaacaacaacauguucaagcagacgcuguucccgaucaucgagcggaccaccgccaagaccaagagccugauccccaagaagcuggaccgccccacggacaucuacggcggguacuccaacaacaacgacgccuaccucgcccuggugaaggucgacaagaagcggggcagcgaguaccgcguggugggcauccccaugcgggccgcggccaugcugaaggccuccaagaacuacgacgaggaccuccgcaaggucaucgagccgauggugauguucgacaagaacgggaaggccaagcggggcaucgagggguuccgcgugcuggucggcaagaugcccuucaagcaggccgugcuggacgggaacaagaaguucaugcucaccggcaccguggacacccccaaccugaagcagcugguccucagccagcagaacaugaaguacauccuggacuacaucgaggacguggacugccggaagcacaaguucggcgacaaggugcagaaccccgacaagugccugcucgaggucuucgacgagaucaucgagaucguggacaaguacuucgagcuguucgacucccgcgacuuccgggagaagcugcgcaacagccggaacaaguucaucaagcucgaggcguccaagaaggccgacacgauccuggccauccugaaggggcuccaggccaagagcacccgcgcgaccaucaaggagcugaacaucuccgacuucggccggaucaucaccagcuccaucagcccggaggcccagcugaucuaccagucccccacgggccucuucgagcgccgcgugaaggucaaggaccuguga

SEQ ID NO: 2108 - RNA, 4188 nt, Artificial Sequence
  Cas9 variant
augagcaagaaguaccagaacaccaaguacuacgugggccuggacaucgggaccuccagcgucggcugggccgugacggacgccaacuacgagcuccugaaggugaacgggcacaagaccuggggcucccgccuguucaccgaggcggagaccgcccucgagcggcgcacgcaccgggccacccgccggcgccugcagcggcgcaagcagcggcuggaccuccuggacgagcuguucgccgaggagcucgccaaggucgacccccaguuccugcugcgccucaaggagagccaguaccacauggaggacaaguccaccgacgacaaguacgugcuguucaacgaccagaaccggaccgacggggaguucuucacggaguacccgaccaucuaccaccuccgcagcgagcucaugcagggcaagaaggaggacauccgggcgguguaccuggcccugcaccacaucgucaaguaccgcggccacuuccuccugcccggggacaacuacgacaugcagggcaaccuguccgagcucaucaagcggcuguucaaguucaucgaggagacccuguucaucgaggaccucgggcugaccgacgagauccagagcaagaucgaggagauccugcucacgaagaccaagacccgccuggaccggcagaaggagaucgugaagcuguucaacaccaagcaccagaagcucgacgacaagcagaagaagcugcuggaggccaucuucaagcucugccugggccugaaggggaacauggugaacaucuucggcgacaagggcgaguacgggaucgacuucacggacgucgaggacaagaagaagaagguggaguucuccgccgacuacgacaacaacaucaacgacuacguggacuucuucggcgaguacuucgagcuccuggagaucaccaagaagaucaacgacaccgucaucuucagcgagauccugguggacgggaagggcuucuccgagagcaaggugaucuccuacgagaagcaccagcaggaccuccgcaagcugaagacccugcucaagagccuggacaagacgcugggcuacaaguacggggagggccucuaccagaagauccugcuggacgacgucaaguccaacuacgugaacuacagcgggaacucccagaagcucaagaagugcaccaaggacgaguucuacggcuucaucaagagcaagcugaacuccgugaccaagaaggagaaggucagcgaggcgcagcagaaggagaucgcccagauccuggccgacauggaguucggggacuaccugccccuccagcggaccacggacaacggcgugauccccaaccagcugcacaagaaggagcugaucgagaucaucgagcagcagaccaaguaccacgacuucuucaacgacguggacgagaacggccucaccaucaaggacaagaucaucagccugaugaccuuccgcaucccguacuacgucgggccccugaacgacuaccacaagguggccgacggcacggggcacgccuggaucgagaagaagaaggacggcaagaucuaccccuggaacuucgacgagaugguggacaccgaggcgaccgccgagaaguucaucaagaaccucaccaacaagugcacguaccugaagggggaggacguccugcccaaggaguccaagcucuacagcgaguucaugcugcugaacgagcucaacaacaucaagaucgacaaccagaagcuggacccgaagcugaagaugaagaugguguccgagcuguucaugaagaagaacgagaagaucaccaagaagaagaucgucgacuaccugcggagcaucggccaggccaacggcaacgagaugguguccgggaucgaccgcgagaucaagagcgaccugaagaccauccacaagauccagcacuacuaccaggacgccucccucgagauggccgagaacaucauccgcuggaacaccaucuucaacgacagcacguccgacauccugaaggacaagaucaccaaggcguacggcgacgugcugacccccgggcagaucaagggccucagcaaccuggccugcaaggacugggggaagcuguccgagaaguuccucaccggcauccggugcgacgucggcgaguucaagaacaucagcaucauccaggccaugcgcgacaccaacaacaaccugauggagcugcucuccaacaaguacgaguucauggacaagauccaggaguacaacaaggaguacuacggggacuucacguucaaggccgagcccagcaucauggacgaccuguacgugggccccgggccgaagcgggccaucuggcaggcggugcgcaucgucgaggagaucaagcggaucaugggccacgaccccgagaagaucuuccuggagaccacccgcaccaaccgggcccccaaggugaagaacacgaagcgcuacgacgcccucgagaagaaguacgaguccgugaaggagcacgaguacgccgaggucaagaaggaguucgagaucgagaagaacgacagccugaacaucaagaagcuguuccucuacuucacccagcugggccacugcauguacuccgacgagaagauccccuacaacgagcuguucaccaaccgguacgacaucgaccacaucuacccgcgcagcaagacccgggacaacuccauggacaaccucgugcuggugaaggccgagugcaaccgcgacaagaaggacaacuaccccaucaagcugaagacgaacauccagcagaagugccagguccggugggcguaccuccgcgacaagaagcugaucaccgaggagaaguacaaccggcuggugcgcaagacgccccucaccgaggacgagcugagccaguucaucgcccggcagcugguguucaccagccaguccgucaaggccaccgccgagguguucaagcgccucuacgaggacagcaagaucugcuacgugaaggcggagaacgucuccgacuuccgguacgggagcacccgcaagauguccaaggacgaccagccccagccguucaucaagaaccgcgacgugaacgacuuccaccacgccaaggacgccuaccugaacaucguggucggcaacguguacgacgugaaguucacccagaaccccacgcgguucaucaaggccaacaaggacuacagccugaacuacaucuuccgcuaccccgucaacaagaagggggagaacgugugggaccccgagcaguccaugaagaucguggagaagacccucaagagcaacgacguccgggugaccaagcuggugaagccgaucaccucccccaucagcaacgagacgcugcacaaggcccucaagugcaagcccggcuccuaccugccccgcaagagcuccaaggggaccccgcuggcggacgucaccaaguacggcggcuacgagaagaucaagaacgccuacuacagcaucuacaaguacaccuacaugaagaagaaggagugcauggaggaguuccuccuggugcccauccccauccaccuggugaacaacgacgaggagcucccgaaguacaucaacgacaagaucgccgagcgggccaagaagaagaagcuggagacggucgagugcaucgugaaggagcuguaccaggggacccucgugcgcaucaacggcuacgacuaccggaucgccggguccagcggcaagcaguucgagcugcacaacgggaucaaccugaucgucgagcccuggguggagaaggugcucaaggagaccgacaaguucguccgcaaguccaacagcaagcuggacaagaagcagcagaaggagaacaccacggagacccugaucgagaagcagcucaacgacguguucgaguaccugugccggaagcugaaccagggcaucuucaagaacaacaagcacacccuccccgcgaagcugcugggcgacagcauccagaagcgcuucgaggacgccuccaucgaggacgaguucgaggugaucaaggagcucaucagcgccaucgccaagaacccccagaacuucaagaccauccagaagguccuggacaucuccgggagcuccaucccgcgguucaaccugaagcucacgaagaacaacguggacgaguucaucaucaagaacgagagcgugaccggccuguucacccacgagaaggucaucuuccgcaaguga

SEQ ID NO: 2109 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaucgacgagggcuucuuccagcggaugaaggagagcccccuguacgccgaggacaagaccauccuccaggagaacacgcuguucaacgacaaggacuucaccgacaagaccuaccacaaggcguacccgaccaucaaccaccugaucaaggccuggaucgagaacaaggucaagcccgacccccgccuccuguaccuggccugccacaacaucaucaagaagcggggccacuuccucuucgagggggacuucgacuccgagaaccaguucgacacgagcauccaggcccuguucgaguaccugcgcgaggacauggagcucgacaucgacgcggacucccagaaggugaaggagauccugaaggacagcucccugaagaacagcgagaagcagucccggcucaacaagaugcugggccugaagcccagcgacaagcagaagaaggccaucaccaaccucaucuccgggaacaagaucaacuucgccgaccuguacgacaacccggaccugaaggacgccgagaagaacagcaucuccuucagcaaggacgacuucgacgcccucuccgacgaccuggcgagcauccugggcgacuccuucgagcuccugcugaaggccaaggccguguacaacugcagcguccucuccaaggugaucggggacgagcaguaccugagcuucgccaaggugaagaucuacgagaagcacaagaccgaccugaccaagcucaagaacgucaucaagaagcacuuccccaaggacuacaagaagguguucggcuacaacaagaacgagaagaacaacaacaacuacagcgccuacgugggcgucugcaagaucacgcacaagaagcuggugaucaagaacuccgcgagccaggaggacuucuacaaguuccugaagaccauccucuccgccaagagcgagaucaaggaggugaacgacauccugaccgagaucgagaccgggacguuccugcccaagcagaucuccaagagcaacgccgagauccccuaccagcuccgcaagauggagcuggagaagauccuguccaacgccgagaagcacuucagcuuccucaagcagaaggacgagaagggccugucccacagcgagaagaucaucaugcugcucaccuucaagaucccguacuacaucgggcccaucaacgacaaccacaagaaguccuuccccgaccggugcugggucgugaagaaggagaagucccccagcggcaagaccaccccguggaacuucuucgaccacaucgacaaggagaagacggccgaggaguucaucaccagccgcaccaacuucugcaccuaccugaucggcgaguccgugcugcccaagagcucccugcucuacagcgaguacacgguccugaacgagaucaacaaccugcagaucaucaucgacgggaagaacaucugcgacaucaagcucaagcagaagaucuacgaggagcuguucaagaaguacaagaagaucacccagaagcagaucuccaccuucaucaagcacgagggcaucugcaacaagaccgacgaggugaucauccuggggaucgacaaggagugcacgagcagccucaaguccuacaucgagcugaagaacaucuucggcaagcaggucgacgagaucagcaccaagaacaugcuggaggagaucauccggugggcgaccaucuacgacgagggggagggcaagaccauccucaagacgaagaucaaggccgaguacggcaaguacugcuccgacgagcagaucaagaagauccugaaccugaaguucagcggguggggccgccucucccggaaguuccuggagaccgugaccagcgagaugcccggguucuccgagcccgugaacaucaucaccgccaugcgcgagacgcagaacaaccugauggagcuccugagcuccgaguucaaguucaccgagaacaucaagaagaucaacagcggcuucgaggacgccgagaagcaguucuccuacaacgggcuggugaagccccucuuccugagccccuccgucaagaagaugcuguggcagacccucaagcuggugaaggagaucagccacaucacccaggccccgcccaagaagaucuucaucgagauggcgaagggcgccgagcuggagccggcccgcaccaagacgcggcucaagauccugcaggaccuguacuccagcugcaagaacgacgccgacgcguucuccagcgagauccaguaccucagcggcaagaucgagaacgaggacaaccugcgccugcgguccgacaagcucuaccuguacuacacccagcuggggaagugcauguacugcggcaagcccaucgagaucgggcacgucuucgacaccagcaacuacgacaucgaccacaucuacccccaguccaagaucaaggacgacagcaucuccaaccgcgugcucgugugcagcuccugcaacaagaacaaggaggacaaguacccccugaaggccgagauccagagcaagcagcggggcuucuggaacuuccugcagcgcaacaacuucaucucccucgagaagcugaaccggcugacccgcacgagcccgaucuccgacgacgagaccgccaaguucaucgcccggcagcucgucgagacccgccaggccaccaagguggcggccaaggugcuggagaagauguuccccgagacgaagaucgucuacagcaaggccgagaccguguccauguuccggaacaaguucgacaucaucaagugccgcgagaucaacgacuuccaccacgcccacgacgccuaccugaacaucguggucgggaacguguacaacaccaaguucaccaacaaccccuggaacuucaucaaggagaagcgggacaaccccaagaucgcggacacguacaacuacuacaagguguucgacuacgacgucaagcgcaacaacaucaccgccugggagaagggcaagaccaucaucaccgugaaggacaugcucaagcggaacacgccgaucuacacccgccaggccgccugcaagaagggcgagcuguucaaccagaccaucaugaagaaggggcugggccagcacccccucaagaaggaggggccccugagcaacaucuccaaguacggcggcuacaacaaggugagcgccgcguacuacacccugaucgaguacgaggagaagggguccaagauccggagccucgagacgaucccgcuguaccuggucaaggacauccagaagaacaaggacggccucaaguccuaccugaccgaccagaucgggaagaaggagaucaagauccugauccccaagaucaagaucaacagccuccugaagaucaacggcuuccccugccacaucaccgggaagaugggcgaggccuucgugcugcgccccgccgugcaguucugcugcagcaacgacgaggcccucuacuucaagaagaucauccgguucaacgagauccgcaagcagcgcgagaagaugggcaagaccaucuccccguacgaggaccugagcuuccgguccuacaucaaggacaaccugugcaagaagacgaaggcggacgagaucgaggagaaggaguucuacgaccuccugcagaagaagaaccuggagaucuacgacaugcuccugaccaagcacaaggacaccaucuacaagaagcgccccaacagcgccaccaucgacauccuggucaaggggaaggagaaguucaagucccucaucaucgagaaccaguucgaggugauccuggagauccugaagcuguucagcgccacgcggaacguguccgaccuccagcacaucggcgggagcaagaacgccggcaacgcccgcgucgggaacaagaucuccagccuggacaacugcauccucaucuaccaguccaucaccggcaucuucgagaagcggaucgaccugcugaagaucuga

SEQ ID NO: 2110 - RNA, 4188 nt, Artificial Sequence
  Cas9 variant
augagcuucaagaagauccugggccucgacgugggggucgccuccaucggcugggccguggugcgcgagaacgaggagaaccccaacuucaacaccaucaccaagcuggggguccggguggugccgaucacgagcgacgagaagcugaacuucgagaagggcaaguccaucaccagcaacgcggagcgcacccucgcccgguccagccgccggaaccugcagcgcuuccggcugcgccggaagaaccucaucgccauccugcugcagaaccagaucaucacccccacgacgccccucaccgagaaggggaaguucaccaccuucgagacccugaagauccgcgccaaggccaccaaggagaagaucgagcuggaggagcucgcgcggguccugcugcacaucaacaagaagcgcggcuacaaguccagccggaaggugaagaacuccgaggacggcaaggccaucgacgggauggaggccgccaagauccucuacgagaacaagcugacccccggccaguacacguaccagcugcucgagaaggggagcaacaagaucccggacuucuacugcuccgaccugcagaucgagugggaggugaucuggaacuuccagaagcaguucuaccccaaccugcucaccgaggacuucaagaaggagcugaagggcaucgggcagcgcgcgaccgccgcccuguuccucaagaaguacggcaucuacaccgcccugaacaagggcaagcgggaggagaagaagcugcaggccuacaaguggcgcagcaaguccgucagcgagaagauccccguggaggagcucgcguacgugaucgccgagaucaacucccacaucacgaacagcuccggguaccugggcaccaucagcgaccgguccaaggagcuguacuucaaccagcagaccaucggggagaaccucuacgcccaggucgccaagaacacccacgccaagcugaagaaccagguguuccugcgccaggacuacagcgcggaguucgagcagaucugggagacgcaggccaaguuccacccccagcucaccccggagcugaagaagaagauccgggacagcaucaucuucuaccagcgcaagcugcggucccagaagcgccucaucagcaucugcgaguucgagaaccgcgagaucgagaucaucaagaacggcaagaagaagaagaagaagaucggccugaaggccgcccccaaguccagcccccuguuccaggaguucaagaucuggcagguccucaacaacaucgugaucaagcaggaggggaaggaccggcugcugaccugggaggagaaggagcuccuguucaccgagcugaacaucaagggcaacaucuccgggcagaaggcccucgcgcugcugaagcucagccccaaggacacgaagaucaacgugaccauccuggagggcaaccacacccaggagcagcuguaccgcguguaccugcggauccucgggauggagggcuacgacgucuucgaccugcugaagaucccggagaaccaggacgagaucaagcccgccgacuccaagaucagcgccgccgagaucaaggagaccgugaaguccguguucaagacgugcagcaucucccccagcauccucgacuucgacccccugcugccgaaccccgaguucgagaaccaguccagcuaccagcucuggcaccuccuguacuccuacgagggcgacagcucccccagcgggaacgagaagcugcuggagcugcucaagaacaaguucggcuucaagaaggagcacgcccugcugcucgcguccaucagcuacaccuacaucuacgggaaccugagcuccaaggccaugcgcaagaucuaccccuacagcaaggagaacaccuacuccgaggccugcaugcuggccggcuaccggcacagcaagaacgcgcucccgcgcgaggagcuggucaaguaccagcugaaggaccggcucgagauccugcccaagaacucccugcgcaaccccgugguggagaagguccucaaccagcugaucaaccuggugaacagccucauggacgaguacggggccuucgacgagauccggcuggagauggcccgcgagcugaagaagaacgccaaggagcgggagaagugguccaagaacaucgccgacgcgaccagccgcaaccagaagcacgccgagauccucaagaaggacuucaagaucuccaaccccagcaagaacgaccugauccgguaccgccuguaccucgagcugaaggccaacggcuacaacgaccuguacacgaacaccuacaucgacaucaacuaccucuucacccaccgguacgacaucgaccacaucaucccgcaguccaagguccuggacgacagcuucuccaacaaggugcuggugccccgccaggccaaccucgagaaguccaaccugaccgccuucgacuacaucagccaccagggcaaggagaaggaggagcacuaccugaacgucaucacggagcucuacaagcgggggagcaucuccgagaccaaguacaagaaccugcagaagaagggcaacgagaucggggagggcuucaucaaccgcgaccugaagaacacccaguacaucgugcggaaggcgcgcgagauccucagccugaucacccccaacguggucaccacgaccggggagaucaccgccaagcugcgcaaggacuggaaccucaucaacagcaugaaggagcugaacauggacaaguuccggaacgcccgccugaccgagcucguggagaacucccggggcgagaagaaggagaucaucaucgacuggaacaagcgcaacgaccagcggcaccacgccaucgacgcccugguggucgcguucacgacccgcaaccacgugcaguaccugaacuacaugaacgcccgggaggacgagagccacaagcagcacucccacauccucagcaucgagaagaagaucaaguacgacaaguuccacgagaacggcucccgccagagccgguucaucuaccccaccuccaacuuccgcgaggaggccaagaagaagcugaaggagauccuggugagcuacaagaccaagaacaaggucgugacggugaacaucaacaagccgaagaagaagggcggguacucccccaagcacgagcucacgccccgggggccgcugcacaaggagaccaucuacggcaugauccgcauccugcacaccaaggagaucaaggucagcuccaagcucaacuucgagaccguggugcggauccagaacccccgcuaccggaacgcccugcuggagcgccucaaggacaacuucaacgaccccaagaaggcguucagcggcaccaacucccugaccaagaaccccgucuuccugaccgccaacagcacggagaccgugccggagaaggugaccauccagugguucgagaaggucuacaccauccggaagcccaucaaccccacgaacuucaagaacgagaagaacaucgagaaggugcucgaccccaccauccgcacccugcugaagaagcggcuccaggaguacaacgggaacgccaaggaggccuucuccgaccuggagaagaacccgaucuggcugaaccaggagaagggcaucugcaucaagaccgugacgaucaccgggaucagcaacgucgagucccuccacaccaagaaggaccacuucggcaaggagcugcuggacaucaacgggaaccccauccccguggacuucgugagcaccggcaacaaccaccacgucgccaucuacgaggacuccgagggcaaccuccaggagaagguggugagcuucuacgaggcggucgagcgcgugaaccaggggcugcccgugaucgacacgcuguacaaccucgaccugggcuggaaguuccuguucaccaugaagcagaacgagauguuccucuucccggccgacgacuucgaccccaacgacaucgacaucuacgacgagaagaaccugauccugaucagcaagcaccucuuccggguccagaagcuguccagcaaggacuacugcuuccgccaccaccuggagaccuccaucaacuucaacgaccccgcccucaaggggaucaccuggcgccgggagagccccaacggccugcgcaaccuggugaaggugcggcucaaccaccuggggaagaucguccacaucggcgaguga

SEQ ID NO: 2111 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccacaaggaccucuggggcaugcgcugcuucgagaccgcggagaccgccgagaagcggcgccuguuccgcggggcccggcggcgcaucgagcggcgccggaagcgcaucaagcugcuccaggagcuguucucccaggagaucgccaagaucgacgaggacuucuuccagcggauggaggagagccccuucuacgccgaggacaagaccauccugcaggagaacacgcuguucaacgaccgcgacuucaccgacaagaccuaccacaaggcguacccgaccaucaaccaccugaucaaggccuggaucgagaacaaggugaagcccgacccccggcugcucuaccuggccugccacaacaucaucaagaagcgcggccacuuccuguucgagggcgacuucgacuccgagaaccaguucgacacgagcguccaggcccucuucgaguaccugcgggaggacauggagcuggacaucgacgcggacuccaagaagaucaaggagauccucaaggacagcgcccugaagaacuccgacaagcagaaccgccugaacaagcuccuggggcucaagagcuccgacaagcagaagaaggcccucaccaaccugaucagcggcaacaaggccaacuucgccgaccuguacgacaaccccgaccucaaggacgcggagaagaacuccaucagcuucuccaaggacgacuucgacgcccugagcgacgagcuggccuccgugcucggggacagcuucgagcugcugcuccgggccaaggccguguacaacugcuccguccugagcaaggugaucggcgacgagcaguaccuguccuucgcgaaggugaagaucuacgagaagcacaagaacgaccucaccaagcugaaggaggucgugaagaaguacuucccgaucgaguaccgcaacaucuucggguacaagcagagcgagaacaacaacugcaacuacagccgguacgugggcgucugcaaguccggcagcaagaagaaggugaucaacaagaccgccucccaggaggacuucuacaaguuccugaaggacauccuccugaagcgcagcgacgugcccgaggccaacgggauccugacggagaucgagaccggcaccuuccuccccaagcagaucuccaagaacaacgccgagauccccuaccagcugcggaagaucgagcuggagaagauccucaccaacgccgagaaguucuucagcuuccugaagcagaaggacgagaacgggcugucccacagcgagaagaucaucaugcuccugacguucaagaucccguacuacaucggccccaucaacaccucccacaagcaguacuuccccgaccgcagcugggucaucaagaaggagaacgcgccccaggagaagaucaccccguggaacuucuucgaccacaucgacaaggagaagaccgccgaggccuucaucacgucccgcaccaacuucugcaccuaccugaucggcgagagcgugcugcccaagaacucccuccuguacagcgaguacaccgugcugaacgagaucaacaaccuccagaucaucaucgacgggaagaacaucugcgacgucaagcugaagcagaagaucuacgaggagcuguucaagaaguacaagaaggugacgcagaagcagaucuccaccuucaucaagcacgagggcaucugcaacaagaccgacgaggugaucauccucgggaucgacaaggagugcaccagcucccucaagagcuacaucgagcugaagaacaucuucggcaagcaggucgacgagaucuccacgaagaacaugcucgaggacaucauccggugggccaccaucuacgacgagggggagggcaagaccauccugaagaccaagaucaaggccgaguacgagaaguacuacagcgacgagcagaucaagaagauccugaaccucaagcugagcggcugggggcgccugucccggaaguuccucgagagcaucacguccgagauccccggcuucaucgagcccgugaacaucaucaccgcgaugcgcgagacccagaacaaccugauggagcugcucagcuccaaguucaaguucaacgagaacaucaagaagaucaacagcggguucgaggacaccgacaagcgguucuccuacaacagccuggugaagccgcuguuccucucccccagcgucaagaagaugcuguggcagacgcugaagcucgugaaggagaucucccacaucacccaggccccgcccaagaagaucuucaucgagauggccaagggcgccgagcuggagcccgcgcgcaccaagacccggcugaagauccuccaggaccuguacaacagcugcaagaacgacgccgacgccuucuccagcgagauccaguaccugcucgggaagaucgagaacgaggacaaccugcgccugcgguccgacaagcucuaccuguacuacacccagcugggcaagugcauguacugcggcaagcccaucgagaucgggcacgucuucgacacgagcaaguacgacaucgaccacaucuacccccaguccaagaucaaggacgacagcaucaacaaccgcgugcucgugugcagcuccugcaacaagaacaaggaggacaaguacccccugaagccggagauccagcugaagcagaagaaguucuggaacuuccuccagcggaacaacuucaucagcaucgagaaguucaaccgccugacccggaccacccccaucuccgacgacgagacggccaaguucaucgcccgccagcuggucgagacccggcaggcgaccaagguggccgccaaggugcucgagaagaucuuccccgagaccaacaucgucuacagcaaggccgagacgguguccauguuccgcaacaaguucgacaucaucaagugccgggagaucaacgacuuccaccacgcccacgacgcguaccugaacaucguggucggcaacguguacaacaccaaguucaccaacaaccccuggaacuucaucaaggagaagcgcgacaacccgaagaucggggacaccuacaacuacuacaagguguucgacuacgacgucaagcggaacaacaucacggccugggagaaggagaagaccaucaucaccgugaagaccaugcugaagcgcaacacgcccaucuacacccgccaggccgccugcaagaagggcgagcuguucaaccagaccaucaugaagaaggggcugggccagcacccccugaagaaggagugcccguucagcaacaucuccaaguacggcggguacaacaaggugagcgccgcguacuacaccuucaucgaguacgaggagaagggcaacaagauccggucccucgagacgaucccccuguaccuggagaaggacauccagaagucccaggacgggcucaagggcuaccugaccgaccagcugggcaagaaggagaucaagauccucguccccaagaucaagaucaacagccugcugaagaucaacggguuccccugccacaucaccggcaagaccggggccagcuucgugcuccgcccggccgugcaguucugcugcuccaacgacgagguccuguacuucaagaagaucauccgguucaacgagauccgcagccagcgggagaagaugggcaagacgaucucccccuacgaggaccugagcuuccgcuccuacaucaaggagaaccucugcaagaagaccaagaacgacgagaucggggagaaggaguucuacggcuuccugcagaagaagaaccuggagaucuacgacaugcuccugaucaagcacaaggacaccaucuacagcaagcggcccaacuccaccacgcuggacaugcucaucaagggccgcuacgaguucaucaaccugaagcccgaggaccagauccgggugaugcuggagauccucaagcuguucugcaccacccgcgaggugaucgaccuggggcucaucaagggcaagagcgaggccggggucaccacgcugggcaagaagaucagcaaccuggacuccugcauccucaucuaccagagcaucaccgggaucuucgagaagcggaucgaccugcugaagaucuga

SEQ ID NO: 2112 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaccgacgagggcuucuuccagcggaugaaggagagccccuucuacgccgaggacaagacgauccugcaggagaacgcccucuucaacgaccgcgacuucaccgacaagaccuaccacaaggccuacccgaccaucaaccaccugaucaaggccuggaucgagaacaaggucaagcccgacccccggcugcucuaccuggccugccacaacaucaucaagaagcgcggccacuuccuguucgagggggacuucgacuccgagaaccaguucgacacgagcauccaggcccucuucgaguaccugcgggaggacauggagguggacaucgacgcggacucccagaaggugaaggagauccugaaggacagcucccucaagaacagcgagaagcagucccgccugaacaagaugcugggccucaagcccagcgacaagcagaagaaggccaucaccaaccugaucuccgggaacaagaucaacuucgccgaccuguacgacaacccggaccucaaggacgccgagaagaacagcaucuccuucagcaaggacgacuucgacgcgcuguccgacgaccuggccagcauccucggcgacuccuucgagcugcugcucaaggccaaggccgucuacaacugcagcgugcuguccaaggugaucggggacgagcaguaccugagcuucgccaaggucaagaucuacgagaagcacaagaccgaccucaccaagcugaagaacgugaucaagaagcacuuccccaacgacuacaagaagguguucggcuacaacaagaacgagaagaacaacaacaacuacagcgcguacgucggcgugugcaagacgaaguccaagaagcuggugaucaacaacaccgucaaccaggaggacuucuacaaguuccucaagcccauccugcuggccaagagcgagaucaaggaggugaacgacauccucaccgagaucgagaccgggacguuccugcccaagcagaucuccaagagcaacgccgagaucccguaccagcugcggaagauggagcucgagaagauccuguccaacgccgagaagcacuucagcuuccugaagcagaaggacgagaagggccucucccacagcgagaagaucaucaugcugcugaccuucaagauccccuacuacaucgggcccaucaacgacaaccacaagaaguccuuccccgaccgcugcugggugaucaagaaggagaaguccccgagcggcaagaccacccccuggaacuucuucgaccacaucgacaaggacaagacggccgaggcguucaucaccagccggaccaacuucugcaccuaccucgucggcgaguccgugcugcccaagaacagccugcuguacuccgaguacacggugcucaacgagaucaacaaccugcagaucaucaucgacgggaagaacaucugcgacaucaagcugaagcagaagaucuacgaggagcuguucaagaaguacaagaagaucacccagaagcagaucagcaccuucaucaagcacgagggcaucugcaacaagaccgacgaggucaucauccucgggaucgacaaggagugcacguccagccugaaguccuacaucgagcucaagaacaucuucggcaagcaggucgacgagaucagcaccaagaacaugcuggaggagaucauccgcugggccaccaucuacgacgagggggagggcaagaccauccugaagacgaagaucaaggccgaguacggcaaguacugcagcgacgagcagaucaagaagauccucaaccugaaguucuccggguggggccggcugagccgcaaguuccucgagaccgugaccuccgagaugcccggguucagcgagccggugaacaucaucaccgccaugcgcgagacgcagaacaaccugauggagcugcucuccagcgaguucaaguucaccgagaacaucaagaagaucaacuccggcuucgaggacguggagaagcaguucagcuacgacucccuggucaagccccuguuccucagccccuccgugaagaagaugcuguggcagacccugaagcucgugaaggagaucagccacaucacccaggcgcccccgaagaagaucuucaucgagauggcgaagggggccgagcuggaccccguccggaccaagacgcgccugaagauccuccaggaccuguacaacaacugcaagaacgacgccgacgccuucuccagcgagaucaaggaccuguccggcaagaucgagaacgaggacaaccuccggcugcgcagcgacaagcuguaccucuacuacacccagcugggcaagugcauguacugcgggaagcccaucgagaucggccacguguucgacaccuccaacuacgacaucgaccacaucuacccccagagcaagaucaaggacgacagcaucuccaaccgggugcuggucugcagcuccugcaacaagaacaaggaggacaaguacccgcucaaggcggagauccagagcaagcagcgcggguucuggaacuuccugcagcggaacaacuucaucucccuggagaagcucaaccgccugacccggacgagccccaucuccgacgacgagaccgccaaguucaucgcccgccagcugguggagacccggcaggccaccaagguggccgcgaagguccucgagaagauguuccccgagacgaagaucguguacagcaaggccgagaccguguccauguuccgcaacaaguucgacaucaucaagugccgggagaucaacgacuuccaccacgcccacgacgccuaccugaacaucgucgugggcaacguguacaacaccaaguucaccaacaaccccuggaacuucaucaaggagaagcgcgacaacccgaagaucgccgacacguacaacuacuacaaggucuucgacuacgacgugaagcggaacaacaucaccgcgugggagaaggggaagaccaucaucaccgugaaggacaugcugaagcgcaacacgcccaucuacacccggcaggccgccugcaagaagggcgagcuguucaaccagaccaucaugaagaagggccucgggcagcacccccugaagaaggagggcccgcucagcaacaucuccaaguacgggggcuacaacaaggucagcgccgccuacuacacccugaucgaguacgaggagaagggcuccaagauccgcagccuggagacgaucccccucuaccuggugaaggacauccagaagaacaaggacgggcugaaguccuaccucaccgaccagaucggcaagaaggagaucaagauccugauccccaagaucaagaucaacagccugcucaagaucaacggguuccccugccacaucaccggcaagaugggggaggcguucgugcugcggccggccguccaguucugcugcuccaacgacgaggcccuguacuucaagaagaucauccgcuucaacgagauccgcaagcagcgggagaagaugggcaagaccaucagccccuacgaggaccucuccuuccgcagcuacaucaaggacaaccugugcaagaagacgaaggccgacgagaucgaggagaaggaguucuacgaccugcuccagaagaagaaccuggagaucuacgacaugcugcucaccaagcacaaggacaccaucuacaagaagcggcccaacagcgcgaccaucgacauccuggugaagggcaaggagaaguucaagucccugaucaucgagaaccaguucgaggugauccucgagauccugaagcuguucagcgccacgcgcaacgucuccgaccuccagcacaucgggggcagcaagaacgccgggaacgcccgggugggcaacaagaucuccagccuggacaacugcauccugaucuaccaguccaucaccgggaucuucgagaagcgcaucgaccuccugaagaucuga

SEQ ID NO: 2113 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaucgacgagggcuucuuccagcggaugaaggagagccccuucuacgccgaggacaagaccauccugcaggagaacgcccucuucaacgacaaggacuucacggacaagaccuaccacaaggcguacccgaccaucaaccaccugaucaaggccuggaucgagaacaaggucaagcccgacccccgccugcucuaccuggccugccacaacaucaucaagaagcggggccacuuccuguucgagggggacuucgacuccgagaaccaguucgacaccagcauccaggcccucuucgaguaccugcgcgaggacauggagguggacaucgacgcggacucccagaaggugaaggagauccugaaggacagcucccucaagaacagcgagaagcagucccggcugaacaagauccugggccucaagcccagcgacaagcagaagaaggccaucacgaaccugaucuccgggaacaagaucaacuucgccgaccuguacgacaacccggaccucaaggacgccgagaagaacagcaucuccuucagcaaggacgacuucgacgcgcuguccgacgaccuggccagcauccucggcgacuccuucgagcugcugcucaaggccaaggccgucuacaacugcagcgugcuguccaaggugaucggggacgagcaguaccugagcuucgccaaggucaagaucuacgagaagcacaagaccgaccucaccaagcugaaggcggugaucaagaagcacuuccccaacaacuacaagaagguguucggcuacaaccaggacaacgagagcaagaacaacuacuccggcuacgucggggugugcaagaccaagaacaagaagcuggugaucaacaacagcgucaaccaggaggacuucuacaaguuccucaagcccauccuguccgccaagagcgagaucaaggaggugaacgacauccuggccgagaucgagacgggcaacuuccuccccaagcagaucuccaagagcaacgccgagaucccguaccagcugcgcaagauggagcuggagaagauccucuccaacgccgagaagcacuucagcuuccugaagcagaaggacgagaaggggcugucccacagcgagaagaucaucaugcuccugaccuucaagauccccuacuacaucggccccaucaacgacaaccacaagaaguccuuccccgaccggugcuggguggucaagaaggagaaguccccgagcggcaagaccacccccuggaacuucuucgaccacaucgacaaggagaagacggcggaggaguucaucaccagccgcaccaacuucugcaccuaccugaucggggaguccgugcuccccaagaacagccugcuguacuccgaguacacggugcugaacgagaucaacaaccuccagaucaucaucgacggcaagaacaucugcgacaccaagcugaagcagaagaucuacgaggaccuguucaagaaguacaagaagaucacccagaagcagaucagcaccuucaucaagcacgaggggaucugcaacaagacggacgaggucaucauccucggcaucgacaaggagugcaccuccagccucaagagcuacaucgagcugaagaacaucuucgggaagcaggucgacgagaucuccaccaagaacaugcucgaggagaucauccggugggccaccaucuacgacgagggcgagggcaagacgauccugaagaccaagaucaaggccgaguacgggaaguacugcagcgacgagcagaucaagaagauccugaaccucaaguucuccggcugggggcgccugagccggaaguuccuggagaccgugaccuccgagaugcccggcuucagcgagccggugaacaucaucacggccaugcgcgagacccagaacaaccucauggagcugcuguccagcgaguucaaguucaccgagaacaucaagaagaucaacuccggguucgaggacgccgagaagcaguucagcuacgacggccucgugaagccccuguuccugucccccagcgucaagaagaugcucuggcagacccugaagcuggugaaggagaucucccacaucacgcaggcgcccccgaagaagaucuucaucgagauggccaagggcgccgagcucgagcccgcccgcaccaagacccggcugaagauccugcaggaccucuacagcuccugcaagaacgacgcggacgccuucagcuccgagauccaguaccugagcgggaagaucgagaacgaggacaaccugcgccuccggagcgacaagcuguaccuguacuacacccagcucggcaagugcauguacugcgggaagcccaucgagaucggccacguguucgacaccuccaacuacgacaucgaccacaucuacccccagagcaagaucaaggacgacuccaucagcaaccgcguccuggugugcuccagcugcaacaagaacaaggaggacaaguacccgcugaaguccgagauccagagcaagcagcggggguucuggaacuuccuccagcgcaacaacuucaucucccuggagaagcugaaccggcucacgcgcaccacccccaucagcgacgacgagaccgccaaguucaucgcccggcagcugguggagacgcgccaggccaccaaggucgcggccaaggugcuggagaagauguuccccgagaccaagaucguguacuccaaggccgagaccgucagcauguuccggaacaaguucgacaucaucaagugccgcgagaucaacgacuuccaccacgcccacgacgccuaccucaacaucguggugggcaacgucuacaacacgaaguucaccaacaaccccuggaacuucaucaaggagaagcgggacaacccgaagaucgcggacaccuacaacuacuacaagguguucgacuacgacgugaagcgcaacaacaucaccgccugggagaagggcaagacgaucaucaccgucaaggacaugcugaagcggaacacccccaucuacacccgccaggccgccugcaagaagggggagcuguucaaccagacgaucaugaagaagggccucgggcagcacccccugaagaaggagggcccguucuccaacaucagcaaguacggcggguacaacaagguguccgccgcguacuacacccugaucgaguacgaggagaaggugaacaagauccggagccucgagaccaucccccuguaccuggucaaggacauccagaaggaccaggacgugcucaaguccuaccugaccgaccugcucggcaagaaggagaucaagauccuggugcccaagaucaagaucaacagccugcucaagaucaacggguuccccugccacaucacgggcaagaccggggacuccuucguccugcgcccggccgugcaguucugcugcagcaacgacgaggugcuguacuucaagaagaucauccgguucaacgagauccgcagccagcgcgagaagaugggcaagaccaucucccccuacgaggaccucagcuuccgguccuacaucaaggagaaccugugcaagaagaccaaggccgacgagaucggcgagaaggaguucuacgaccugcuccagaagaagaaccuggagaucuacgacaugcugcucacgaagcacaaggacaccaucuacaacaagcgccccaacagcaccacccuggggaugcugacgaagggccgguacgaguucaucaaccucaagcccaaggaccagaucaucgucaugcuggagauccugaagcuguucugcaccacccgcgaggccaucgaccuggggcugaucaagggcaagccggcggccgggguggccacccucggcaagaagaucuccaaccuggacaacugcauccugaucuaccagagcaucacgggcaucuucgagaagcggaucgaccuccugaagguguga

SEQ ID NO: 2114 - RNA, 4188 nt, Artificial Sequence
  Cas9 variant
augaagaaggagaucaaggacuacuuccugggccucgacguggggaccggcagcgucgggugggccgugaccgacacggacuacaagcugcugaaggccaaccgcaaggaccucuggggcaugcggugcuucgagaccgcggagaccgccgaggugcgccggcugcaccgcggggcccggcgccggaucgagcgccggaagaagcgcaucaagcugcuccaggagcuguucucccaggagaucgccaagaucgacgagggcuucuuccagcggaugaaggagagcccccuguacgccgaggacaagaccauccuccaggagaacacgcuguucaacgacaaggacuucaccgacaagaccuaccacaaggcguacccgaccaucaaccaccugaucaaggccuggaucgagaacaaggucaagcccgacccccgccuccuguaccuggccugccacaacaucaucaagaagcggggccacuuccucuucgagggggacuucgacuccgagaaccaguucgacacgagcauccaggcccuguucgaguaccugcgcgaggacauggagguggacaucgacgcggacucccagaaggugaaggagauccucaaggacagcucccugaagaacagcgagaagcagucccggcugaacaagaugcucggccugaagcccagcgacaagcagaagaaggccaucaccaaccugaucuccgggaacaagaucaacuucgccgaccucuacgacaacccggaccugaaggacgccgagaagaacagcaucuccuucagcaaggacgacuucgacgcccuguccgacgaccucgcgagcauccugggcgacuccuucgagcugcuccugaaggccaaggccgucuacaacugcagcgugcuguccaaggugaucggggacgagcaguaccucagcuucgccaaggucaagaucuacgagaagcacaagaccgaccugaccaagcugaagaacgugaucaagaagcacuuccccaaggacuacaagaagguguucggcuacaacaagaacgagaagaacaacaacaacuacagcggcuacgucggggugugcaagacgaaguccaagaagcucaucaucaacaacagcgugaaccaggaggacuucuacaaguuccugaagaccauccuguccgccaagagcgagaucaaggaggucaacgacauccucaccgagaucgagaccggcacguuccugcccaagcagaucuccaagagcaacgcggagauccccuaccagcugcgcaagauggagcucgagaagauccuguccaacgccgagaagcacuucagcuuccugaagcagaaggacgagaaggggcucucccacagcgagaagaucaucaugcugcugaccuucaagaucccguacuacaucggccccaucaacgacaaccacaagaaguccuuccccgaccggugcuggguggugaagaaggagaagucccccagcggcaagaccaccccguggaacuucuucgaccacaucgacaaggagaagacggccgaggaguucaucaccagccgcaccaacuucugcaccuaccucaucggggaguccguccugcccaagaacagccugcuguacuccgaguacacggugcucaacgagaucaacaaccugcagaucaucaucgacggcaagaacaucugcgacaccaagcugaagcagaagaucuacgaggagcuguucaagaaguacaagaagaucacccagaagcagaucagcaccuucaucaagcacgaggggaucugcaacaagacggacgaggugaucauccugggcaucgacaaggagugcaccuccagccucaagagcuacaucgagcucaagaacaucuucgggaagcaggucgacgagaucuccaccaagaacaugcuggaggagaucauccggugggccaccaucuacgacgagggcgagggcaagacgauccugaagaccaagaucaaggccgaguacgggaaguacugcagcgacgagcagaucaagaagauccucaaccugaaguucuccggcugggggcgccugagccggaaguuccucgagaccgugaccuccgagaugcccggcuucagcgagcccgugaacaucaucacggcgaugcgcgagacccagaacaaccugauggagcugcucuccagcgaguucaaguucaccgagaacaucaagaagaucaacuccggguucgaggacgucgagaagcaguucagcuacgacggccuggugaagccgcuguuccucucccccagcgucaagaagaugcuguggcagacccugaagcucgugaaggagaucucccacaucacccaggccccgcccaagaagaucuucaucgagauggccaagggcgccgagcuggaccccgugcgcacgaagacccggcugaagauccuccaggaccuguacaacaacugcaagaacgacgccgacgcguucagcuccgagaucaaggaccugagcgggaagaucgagaacgaggacaaccuccgccugcgguccgacaagcuguaccucuacuacacccagcugggcaagugcauguacugcgggaagcccaucgagaucggccacgucuucgacaccagcaacuacgacaucgaccacaucuacccccagagcaagaucaaggacgacuccaucagcaaccgcgugcuggugugcuccagcugcaacaagaacaaggaggacaaguacccccucaaggccgagauccaguccaagcagcggggguucuggaacuuccugcagcgcaacaacuucaucagccuggagaaguucaaccggcucacgcgcgccaccccgaucuccgacgacgagaccgccaaguucaucgcgcggcagcuggucgagacccgccaggccacgaagguggccgcccgggugcuggagaagauguuccccgagaccaagaucgucuacagcaaggccgagaccguguccauguuccgcaacaaguucgacaucgugaagugccgggagaucaacgacuuccaccacgcgcacgacgccuaccucaacaucgucgugggcaacguguacaacaccaaguucacgaacaaccuguggaacuucaucaaggagaagcgcgacaaccccaagaucgccgacaccuacaacuacuacaaggucuucgacuacgacgugaagcggaacaacaucaccgccugggagaagggcaagaccaucaucacggugaaggacaugcugaagcgcaacacccccaucuacacccggcaggccgcgugcaagaagggcggccucuucgaccagaccaucaugaagaaggggcuggggcagcacccgcugaagaaggagggccccuucagcaacaucuccaaguacgggggcuacaacaaggucagcgccgccuacuacacgcucaucgaguacgaggagaaggggaacaagauccgcucccuggagaccaucccccuguaccucgugaaggacauccagaaggaccaggacgugcucaagagcuaccugaccgaccugcugggcaagaaggaguucaagauccuggucccgaagaucaagaucaacucccuccugaagaucaacggguuccccugccacaucaccggcaagacgaacgacagcuuccugcuccggcccgccgugcaguucugcugcuccaacgacgaggugcuguacuucaagaagaucauccgcuucagcgagauccgcucccagcgggagaagaucggcaagaccaucagccccuacgaggaccugagcuuccgcuccuacaucaaggagaaccucugcaagaagaccaagaacgacgagaucggggagaaggaguucuacgaccugcugcagaagaagaaccucgagaucuacgacaugcugcugaccaagcacaaggacacgaucuacaagaagcggccgaacagcgccaccaucgacauccucgucaagggcaaggagaaguucaagucccugaucaucgagaaccaguucgaggugauccuggagauccucaagcuguucagcgcgacccgcaacguguccgaccugcagcacaucgggggcagcaaguacuccggggucgccaagaucggcaacaagaucagcucccucgacaacugcauccugaucuaccagagcaucaccggcaucuucgagaagcggaucgaccugcucaagguguga

SEQ ID NO: 2115 - RNA, 4191 nt, Artificial Sequence
  Cas9 variant
auggacagcuccaagcagggccugcgccgguaccaccucgggcuggacaucggcaccaacagcaucggguggaccgccaucgacgaccacuucucccugcuccgcgugaagggcaagaacgccaucgggguccggacguucaaggagggcgagaccgcggccgaccgccggggcuuccgcaccgcccggcgccggcugagccgccggcgcuggcggcugcaguuccucgacgaguucuucgcccccuaccuggccgagguggacccgaacuuccuggcgcgccucaagcaguccgacaucagcgccaaggaccccgccaagaaccaggaguacauggggaagcugcuguuccccgaccaggaggccgcguccgacggcaacggguaccccacccucauccagaugcggaaggccaugccggccgagaaggccgccgacuuccccguguucaacaucuaccagcugcgcuacgcgcugaugaacgagaagcggaaguucgaccuccgcgagaucuaccuggccguccaccacaucgugaaguaccggggcaacuuccugaacaacacgagcguggacaaguucaaggccgaccagaucgacuucaacaaguccuucgagacccucaacgaccuguuccgccagguccagcccaucgcccccuuccagaucgaccugaccaagguggacgagcucgggaagcugcugcucgacaccaagcagaagaagcuggaccggcagaaggccguggcgaagcugcucccgcugaucgaggacggcacggacaaggagaucgucaaggcccaccagcagaccgcccgcgagaucagcaagcugauccucggcuacaaggccaagguggggcugauccugcagaacaaccucgaccagacccuggacauguccaccgagaacagcgacgaccagcugaugcagaucgccgaggagcucgacgacuaccagauggagcugaucaaccagcugucccuccuguacagccagaucaugcugaacgagaucgugcccaacggcgagacggucuccgcgagcaugcucaaccgcuacuacaagcaccggugccagcugaaggagcugaaggacuacggggccgcccaggacaagaagacccgcgagcagcucgaccaccuguacgccgaguacaucggccagauccccaaggacuccaaguucgacuucaccaaggaccugaagaagcucauggacaagagcgaccugggccagaagaucaaggacgagaucgaggccggggacuaccugcccaagcagcggaccuccgcgaacggcgugaucccgcaccagaugcaccagcaggagcuggaccagaucaucgagaaccagaaggaguacuaccccuggcucgccgagcccaaccccguggagaagaacaucaagaacgccaaguacaagcuggaccagcuggucagcuuccgcgugccguacuacguggggcccaugaucacgcucgccgaccagcagaagaccagcaaggcguccuucgccugggccguccggaagaaggccggcaagaucacccccuggaacuucuacgacaugaucgaccgcgagaaguccgccaacaacuucaucaagcggaugaccaacaaggacacguaccugcugagcgaggacgugcuccccgcgagcucccugcuguaccagaaguucaccgugcucaacgagcugaacaacauccgcgucaacgggcggaagcugcagccggcccucaagcaggccaucuacaccgaccuguuccagaagcgcaagaccgugaaccugaagacgcucaccaacuuccuggccauccacgagcccacccugaccaagcccaagaucgagggccucagcaacggccgguccuucaacagcucccuggggacguacaucgacaugagcaagauccugggcgacucccucgacgaccugaacuaccgcgacgacaucgagaagaucaucgaguggagcaccguguucgaggacuccgagaucuacggggucaagcugcaggagauccaguggcucaccaacgagcagcgggagaagcuggugcgcaagcgguaccagggcugggggcgccugagcaagaagcuccugaccggcaucacggacgagaacggccagcggaucaucgaccugaugugggacaccuccaagaacuucaugcagaucguccaccagcccguguucgaggagcagaucgccgagcucaaccagcagcugcugcaggacgcggacaaggccccgcucgagguggucgacgacauccuggccgacgccuacaccagcccccagaacaagaaggccauccgccagguggugaaggucguggcggacguggucaaggccguggggaacgcccccgccuccaucagcaucgaguucgcgcggaacgaggaccgcaacaaggagcugaagaacucccgccggcacagcaucgagaagcucuaccacgagaccgccgagaagcuggugaagcagacgaaccugcucgaggagcugggcaacgucaaggaccugaacgaccgcuacuaccucuacuucacccaggccgggcgggacauguacgacggcacccccaucaacaucgacgagaucagcacccacuacgagaucgaccacauccugccgcaguccuuccugaaggacaacagccucgacaaccgcgugcuggugaagaaguccgagaacgccgccaagagcgaccggguccccgcgaagcuguacggggccaagaugcgcgccuucuggaagcagcucaaggagucccagcugaucagcaaccggaaguaccugaaccucaccacggaccccgagcaggucgacaaguaccagaugcagggcuucgugcaccgccagcugguggagacccggcagaucaucaagcuggccgccaacaucuucggcucccucuacccggacagcgcggugaucgagacccgcgccgagcugaccaagcagcugcgggagaaguucucccucuacaaggugcgcgacgucaacgacuaccaccacgccguggacgccuaccugacggccuucgcggggcacuaccuguaccagcgguaccccaagcuccgccccauguucguguacggcgacuacgccaagaucuacgccgacgaccugaagcggcugcgcagcgucaaccucuuccacgaccuggagaaggaccaguacaacuccgggaccgccgugaaccccgagaccaaggagaagaucguggacgucgacuggcugagcgacuacguguccaagauccagcacuucaaguacaugcucaucagcaaggcgguguacacccagcacggccagcuguacggcgccacgauccugccggucgcccagguggacaagaucuccgcccccaucgggaucaaggacgacaagcccguggacaucuacggcgccuacaccaacgaggucgcggccuacauggccaucgugcgggugaacgggaagaagcccaaguacaaggucgugagcgugccgguccgcaugcuccagcggcugaagauggccgagcagaagggccacgaccaguacaugcagacccugcacgacgugcuccugcgcaacuucaccucccugaagaagaaccggaagacggggcucaaggaggccguggucaaggacuucgacgugcuggugcccugcguccgcuacaaccagcuggugaucgacggcgacaccaaguucacccucggcagcgcgaccuaccagcacaacgccaagcagcuggugcugugcaaccacagccucgagacgcuggccaacaacuucgaguacguccgcaagcaccccgacgaggccgacgagcggaugaucaugcuguacgacgacauccucgaccaggugaaccacuacuucacccuguacgacaagaacaaguuccgcgagaagcugaacgccgggcgggacaaguaccucaagcugcccaccuucucccaguucgagaacaacaagaagaccgcgaucggcaagagcgaggccaucaucaacauccugcgcgggcuccacgccaacgccgccaucacgaaccugaagugccugggcguguccaccccguucgggcagcuccagagccccuccggcaucgagcugagcgagaacgcgaagcuggucuaccagucccccaccggccuguucagccgggaggugcuccugaaggaccuguga

SEQ ID NO: 2116 - RNA, 4191 nt, Artificial Sequence
  Cas9 variant
auggccaaccugcgcaacuacaagggcgacuacaacaucgggcucgacaugggcaccgggagcgugggcugggccgucaccgacuccgaggggaagcugcugcacuucaagaagcagcccacguggggcagccgccucuucgacuccgcggagaccgccgccagcgcccggaucccgcggggccagcgccggcgcuacgugcggcgccgguggcgccuggaccugcuccagcagcuguuccaggacgagguguccaaggccgaccccgaguucuucauccggcugcgccagagccggcuccugaaggaggaccgcgaggaggggcaccgggacuacaaccacccccuguucaacgacuccgacuucaccgagaccgacuacuacaaccgcuuccccacgaucuaccaccuccggaaguggcugauggagaccgacgagaaggcggacauccgccuggucuaccucgccgcccacaacaucgugaagcaccggggcaacuuccugcgccaggagaacaccagccuguccgccaagaacgcgcggccgcucgacgcccugcgcgaguuccgcagcgcccugguggacuggugcgccgagcucggguacgagugcaaccccgacgaguccggcgagaucagcaacgagauccuguccguccuggaggaggagcacguggccaacagcgacaagaagaagcggaucuccagccucaucgggguggcgaugaacgagggcgccaaggaguccaaggccugcaacgacgcccuggccggcgcgauggucgggcugaaggccgaguucaagaacguguucggcgagaucagcgccgagcagaccuccaucuaccucagcaacgacgaggccguggacgcccugcgcgaggggauccccgacgagggccuggagcuguucggcaagcucugcagcgucuacuccgcguacgugcugcaggggcuccugagcuacgcccccggccagacgaucuccgugaacauggucgccaaguacgagaaguacgggaacgaccugaagacccucaaggcccuggugugcgaguacgcccgggcggaguacgacagcuucuuccgcggcgaguucuaccgggaccaggacgggcacgagcugaacaucuacaacgccuccaaggcccagggcuacacccgcuacaaccucggcaccagcaagauguccuacgaggacuucgagaaggccgugaagaagcuguucgcggggacggccgccgaggaggacggccgguaccugcagaugaugaaggaguucggggagcagcgcuuccuccggcgccugaagaccagcgacaacggcuccaucuacuaccagcugcaccucgaggagcugaccgccauccugagcaaccaggggaagcacuacccguuccucgucgaggacgccgagaagaucaagucccuggugagcuuccggauccccuacuacgugggcccccugaccgaccgcaacgcgcggaaggacaagcacggcaagaaccgcuucgccugguccgagcgcaagagcgggauggaggacgccgucaucacgcccuggaacugggacgaggugaucgaccggggcaaguccgccgaggccuucaucacccggaugaccgggaugugcaccuaccugcagggcgaggacgugcucccgaagugcagccugcuguacgaggaguucugcguccucaacgagcugaacgggucccgcuggggcauggacggcgacaaggagcaccgguucgacgcggccgaccgcgaggccaucaucgaggagcuguucaagaagaagaagacggugaaguacaaggacgucgccaacuggcucgagcgcgaggccgggcggaugaacgugcacgugaugggcgggcagggcgagaccggcuacgagagcaagcuguccagcuacuacuucuuccgccgggacaucuucgacgucgaggagcuggaccgcgcggacuaccccaugaucgagcagaucauccucuggaacacccuguucgaggaccggcgcauccugaaggagaagcucgaggacgccuacgggcccaagggcaacgggcggcuggacgacgaccagaucaagaagaucugccgcaagcgguucaccggcugggggcgccugagcaagaaguuccucacgggcaucaagguggacaccgacugcggcccccgguccaucauggacgugcugcgcgagggggacccgaacgccggcuuccgggggaagaccauggucaugauggaggugcugcgcgacgagaaccucggcuuccagcagaagguggacgaguucaacaagaacuacuucgggcagaagggcaaggcccuggaggucaacgagcugcccggcagccccgcgauccggcgcucccucaaccaggccauccggaucguggacgagaucgccaagaucgccgggaaggaccccgagagcaucuucaucgaggugacccgcgacgacgagcuggacaagcggggcaagcgcacgaagcggcgcuacgacgcccugaaggaggcgcucaccgucuucaagaaggaggacccggagaucugggccgagcugcaggccaccucccccagcgaccuggacgagcgccucacccuguacuucaugcagcgggggaagugccuguacuccggcgagcccaucgacaucaacaagcucagcuccggggaguacgagguggaccacaucaucccccgcagcuacaucaaggacgacucccuggagaacaaggcccuggugugccggaaguacaaccagagcaagacggacgccaugcuccuggacccguccauccgccggaagaugcgcagcuacugggacaugcugcucgacgcgaagcugaucggccccaagaagcaccggaaccugcuccgcgaccacaucgacgagaaggccaugaagggcuucgucgcccggcagcugguggagaccucccagagcgugaagcuggccgggucccuccugagcguccgcuaccccaacgccaacaucgugcccgugaaggcgagcaugucccacgaccugcgggaggccgccggcuucgucaagugccgcgaggccaacgacuuccaccacgcgcacgacgccuaccucgccugccggauggggcuguucauccagaugcgccacccgaagguguacgagaaccccaucgccaugacccgggugaugcagaaguacgcccagcagcagagcaaggaguucaaccgcaaccaccggguccccggcaccuccggguucaucgugaacagcuucauguccagcggcuucgacaaggagacgggcgagaucuucaaggacaccuggaacgcggagaccgagaucgaggggauccgcaaggcccugaacuaccggcagugcuacaucucccgcaugccgauggaggacaccggcgccuucuggaacgccaccguguacagcccccgcgaccccaagauggggcccaagcucgcccugccgcugaagaagggccucgaccccaagaaguacggcggguucuccagccagcaguucgcguacuucuucgucuacgaggcccgggacaagaaggacaagcaggucuuccgcuucgccgaggugcccguguggcuggccucccagaucgagagcgacaagaucgcccuggagcgguacgcgacgggccucgccgaggccgagaagcugaaguucgugcgcaucgagcgggccaagauccugaagaagcagcucaucgagaucgacggggaccgcuucauccugaccggcaagaaggagaugcggaacgggcgcgagcuggcccucucccagaaggagacccugaaccugaucguggcgggcgacgagaacgccagccucgacgaccggggcaacgccuccgacgccgucuucgacgcgaucgugcgccagggggacgagaucggccugcggcuguacaagcagcucaagaucgccgagaucgccgagcgcuaccggagcgugggggccgacgccaaggucggcgcggugaugucccugcugagcuccaucaacgccagcagcaacauggugaaccucuccauggucgggggcagcaaguacgccggcaaccugcagcccaacuacuccaaccugcucagcgacccggagaccaacuucgugaucaucgaccaguccgugacggggauguucgagcgccggacccgcaucggccuguga

SEQ ID NO: 2117 - RNA, 4191 nt, Artificial Sequence
  Cas9 variant
augaccaagcccuacagcaucggccuggacaucgggaccaacuccgugggcugggccgucaucacggacgacuacaaggugccggccaagaagaugaaggugcucgggaacaccaaccgcgacuacaucaagaagaaccugcugggcgcgcuccuguucgacgggggcgagaccgccgagggccggcgccugaagcggaccgcccgccggcgcuacacgcggcgcaagaaccggcuccgcuaccugcaggagaucuucgccgaggagaugaugcaggucgacgagagcuucuuccagcggcuggacgacuccuuccucguggaggaggacaagcaggggagcaaguaccccaucuucggcacccugaaggaggagaaggaguaccacaagaaguucaagaccaucuaccaccuccgcgaggagcucgccaacuccaaggagaaggcggaccugcggcugguguaccucgcccuggcccacaugaucaaguuccgcgggcacuuccuguacgagggcgaccucaaggccgagaacaccgacguccaggcgcuguucaaggacuucguggaggaguacgacaagacgaucgaggagagccaccuguccgagaucaccguggacgcccucagcauccugaccgagaaggucuccaagagcucccggcuggagaaccucaucgcccacuaccccaccgagaagaagaacacgcuguucgggaaccugaucgcccucagccugggccugcaggccaacuucaagaccaacuuccagcucuccgaggacgcgaagcugcaguucagcaaggacaccuacgaggaggaccuggagggccuccugggggaggugggcgacgaguacgccgaccuguucguguccgccaagaaccucuacgacgccauccugcugagcgggauccucaccgucgacgacaacuccacgaaggcgccccugagcgccuccauggugaagcgcuacaaggagcacaaggaggagcuggccgccuucaagcgguucaucaaggagaagcucccgaagaaguacgaggagaucuucaaggacgacaccaagaacggcuacgccggcuacgugggggccgacaagaagcugcgcaagcggagcggcaagcuggcgaccgaggaggaguucuacaaguacgucaaggggauccucaacaagguggagggcgccgacuacuuccuggacaagaucgaccgcgaggacuuccugcggaagcagcgcaccuucgacaacgggagcaucccccaccagauccaccuccaggagaugcacgccauccugcgccggcagggcgagcacuaccccuuccugaaggagaaccaggacaagaucgagaagauccugacguuccgcauccccuacuacgugggcccgcucgcccggaaggggucccgcuucgccugggcggaguacaaggccgacgagaagaucacccccuggaacuucgacgacauccuggacaaggagaaguccgccgagaaguucaucacccggaugacccugaacgaccucuaccugcccgaggagaagguccugcccaagcacagcccgcucuacgagacguucaccguguacaacgagcugaccaaggugaaguacgucaacgagcagggcgaggccaaguucuucgacaccaacaugaagcaggagaucuucgaccacguguucaaggagaaccgcaaggugacgaaggacaagcugcucaacuaccugaacaaggaguucgaggaguuccggaucgucaaccugaccgggcucgacaaggagaacaaggcguucaacgccagccugggcaccuaccacgaccugcgcaagauccucgacaaguccuuccuggacgacaaggugaacgagaagaucaucgaggacaucauccagacccugacgcuguucgaggaccgggagaugauccgccagcggcugcagaaguacagcgacaucuucaccacccagcagcugaaggagcucgagcgccggcacuacaccggguggggccgccuguccuacaagcugaucaacggcauccggaacaaggagaacaagaagacgauccucgacuaccugaucgacgacggguacgccaaccgcaacuucaugcagcugaucaacgacgacgcccucagcuucaaggaggagaucgcccgggcgcagaucaucggcgacgucgacgacaucgccaacguggugcacgaccugcccgggucccccgccaucaagaagggcauccugcagagcgucaagaucguggacgagcucgugaaggucauggggcacaaccccaccaacaucaucaucgagauggcccgcgagaaccagaccaccgacaagggccggcgcaacucccagcagcgccugaagcugcuccaggacagccugaagaaccuggacaacccggugaacaucaagaacguggagaaccagcagcuccagaacgaccggcuguuccuguacuacauccagaacggcaaggacauguacaccggggagacgcucgacaucaacaaccugucccaguacgacaucgaccacaucaucccccaggccuucaucaaggacaacagccuggacaaccgcguccucacccgguccgacaagaaccgcggcaagagcgacgacgugcccuccaucgaggugguccacgagaugaaguccuucuggagcaagcugcugagcgugaagcucaucacccagcggaaguucgacaaccugaccaaggcggagcgcgggggccugacggagaacgacaaggccggcuucaucaagcggcagcucguggagacccgccagaucaccaagcacgucgcccaggugcuggacgcccgguucaacgccaagcacgacgagaacaagaaggugauccgcgacgucaagaucaucacccucaagagcaaccucgugucccaguuccggaaggacuucaaguucuacaaggugcgcgagaucaacgacuaccaccacgcgcacgacgccuaccugaacgccgucaucgggacggcccugcucaagaaguaccccaagcuggcgagcgaguucguguacggcgaguucaagaaguacgacgugcggaaguucaucgccaaguccgacaaggagaucgggaaggccaccgccaaguacuucuucuacagcaaccugaugaacuucuucaagaaggaggucaaguucgccgacggcaccgugguggagcgcccggacaucgagaccuccgaggacggggagaucgcguggaacaagcagacggacuucaagaucguccggaaggugcucagcuacccccaggugaacaucgucaagaagaccgaggugcagacccacggccuggaccgcggcaagccccgggggcuguucaacgccaaccccuccccgaagcccaagcccgacagcuccgagaaccucgugggcaucaagcgcaaccuggaccccaagaaguacgggggcuacgccgggaucagcaacuccuacgccguccuggugaaggccaucaucgagaagggcgugaagaagaaggagaccaugguccucgaguuccagggcaucagcauccuggaccggaucacguucgagaaggacaagcgcgcguuccugcucgggaagggcuacaaggacaucaagaagaucaucgagcugccgaaguacucccuguucgagcucaaggacgggagccggcgcaugcuggccuccauccugagcaccaacaacaagcgcggcgagauccacaaggggaacgagcuguucgugccccagaaguucaccacccugcuguaccacgccaagcggaucaacaaccccaucaacaaggaccacaucgaguacgugaagaagcaccgcgacgacuucaaggagcuccugaacuacguccuggaguucaacgagaaguacgugggcgccacgaagaacggcgagcggcucaaggaggccguggcggacuucgacuccaagagcaacgaggagaucugcaccagcuuccugggggccgucaacuccaagaacgccggccuguucgagcucaccagccugggguccgccagcgacuucgaguuccugggcgugaagaucccgcgcuaccgggacuacacccccuccagccuccugaaggacuccauccugauccaccagagcaucacggggcucuacgagacccgcaucgaccuguccaagcugggcgaggacuga

SEQ ID NO: 2118 - RNA, 4191 nt, Artificial Sequence
  Cas9 variant
augaagcgcgugaacgaggacuacauccugggccucgacaucgggaccaacagcugcggcugggccgucaccgacaagaagaacaaccugcugaagcuccgggggaagacggccaucggcucccaccuguucgaggaggggcacaccgcggccgaccgccggggcuuccgcaccacccggcgccggcugaagcgccggaaguggcgccuccggcugcuggaggagaucuucgccgagcccauggccaagguggacccgggcuucuucgugcgccuccaccagagcugggucagcccccuggacaaggaccggaagaaguacaacgccaucguguuccccacggcgaaggaggaccaggccuucuacaagcacuacgccaccaucuaccaccuccgcgacgagcucaugacccaggaccggcaguucgaccugcgcgagaucuuccuggccauccaccacaucgugaaguaccgggggaacuuccuccaggacacccccgucaaggacuucgaggcgagcaagaucgaggugggcccgauccugucccacaucaacaacgccuucgccgagaagaucguggaggaccaggaccccaucgagcugaacgucgccaacgccgcggacaucgaggacgugauccgcgggaaggacgccgagaagacgguguacaagcucgacaaggucaagaagaucgccaagcugcugaccgacagcaccgccaaggaggagaagaacguggccaagcagaucgcgaacgccaucaugggcuacaagacccaguucgagacgauccucgacaaggagaucgacaaguccgacaaggcccagugggaguucaagcugagcgacgccgacgccgacgacaagcuggacgcgcuccugcccgaccuggacgagaccgaccagaccguggucgccgagaucgagaagcuguucuccgccaucacccugagcacgaucguggacgagaacaagucccugagccaguccaugguggagaaguacaagaagcacaagaaggacuacaagaagcucaagaaguacaucaacacccugcaggaccagaccaaggccaagaagcugcuccuggccuacgaccuguacgucaacaaccggcacgggcgccuccuggaggcgaagaagaccuucgaggacaagaagaagaagaaggcccugacgaaggacgaguucuacaagaucgugaaggacaaccucgacgacagcgaccuggcccacgagauccagcaggagaucgccgcggacaacuucaugcccaagcagcggaccaacuccaacggcgugaucccguuccagcugcaccagaucgagcucgacaagaucaucgccaaccagggcaaguacuaccccuuccuggccgccgagaaccccgucgaggaccaccgcaagcaggcccccuacaagcuggacgagcucgugcgcuuccgggugccguacuacgucgggcccaugaucaccgcggacgagcaggagaagaccagcggcaaguccuucgccuggauggugcgcaaggaggacgggcagaucacgcccuggaacuucgagcagaaggucgaccggcaggagagcgccaacaaguucaucaagcgcaugaccaucaaggacaccuaccugcuguccgaggacgugcuccccgccaacagccugcuguaccagcgguucgaggugcugaacgagcucaacaacauccgcaucaacggcagccggaucuccgucgaccugaagcagcagaucuucaacgaccuguucgaggagaagaagaccgugacggagaagucccucaccuccuaccugaagcagaaccugcaccucccgaccguggagaucaagggccuggccgaccccaccaaguucaacagcucccuggcgagcuacuaccaccucaagucccugcacgucuucgacaaggagcuggccgacccccaguaccagaaggacuucgagaagaucaucgaguacagcuccaucuucgaggacaagaagaucuuccaggacaagcuccacgccgaguucaaguggcugacgcccgagcaguucaaggccaucagcaccuggcgccugcagggguggggccggcucucccgcaagcugcugguggagcuccacgacaccaacgggcagaacaucauggagcagcugugggacagccagaagaacuucaugcagaucgugaccgagccggacuucaaggacgccaucgcgaaggagaaccagaacgucacgcgggccaacggcguggaggagauccuggccgacgccuacaccucccccgcgaacaagaaggccauccgccagguggucaaggugguggccgacgucgugaaggccgccgggggcaagaagcccgcgcaguucgccaucgaguucacccgggaccccgacaagaacccgcagcucagccacauccgcggcaccaagcugcugaaggccuaccaggagaccgccggggagcucguggaccagaagcugacggacucccugaaggaggccaugaccagccggaagcuccugaaggacaaguacuuccuguacuucaugcaggcgggccgcgacgccuacaccgggcagaagaucaacaucgacgaggucuccaccaacuaccagaucgaccacauccucccccagagcuucaucaaggacgacuccuucgacaaccgggugcugacggccacgccccugaacgccgagaaguccgacgacgugcccuacaagcgcuucgccaacaacuacgucagcgacaugaagaugaccgugggcgagauguggaagcacuggcagaaggcggggaucaucaacaagcacaagcucggcaaccugcugcucgacccggaccggcugaacaaguuccagaaguccggcuucaucaaccgccagcugguggagaccagccagaucaucaagcucgucagcgugauccugcagaacaaguaccccgacgccgagaucaucaccgugaaggccggggacaacagcgcccugcgccagcggcucaaccuguacaagucccgcgacgucaacgacuaccaccacgcgaucgacgccuaccugagcaucaucugcggcaacuuccucuaccagguguaccccaaguaccggccguacuucguguacgggaaguacaagaaguucucccaggaccccgaccugcagaaggaggucaucaagcacuucaagggcuucaccuucauguggccccugcuccagaaggacaacagcgagcgcaaggcccccgagaagaucaaggagaacaacuccgaccggaucguguucuacaagcacccggacaucuucgacaagcugcgcaaggccuacaacuacaaguacaugcuggugagccgggagaccaccacggagaacuccggccucuucgacgucaccaucuacccccgcggggagcgggaccuggccaagacccgcaagcugauccccaagagcaacggccucgaccccaagaucuacgggggcuacuccgggaacaccgacgcguacauggugaucgugaagaucgacaagggcaaggagagcaucuacaaggucaucggcgugccgaugcgggcccuggccucccugaaccgcgccaagaagcaggggaacuacaaggaggagcuccaccaggugcuggagccccagaucauguucgacaagaacggcaagcccaagcggagcgucaagggguuccgcaucaucaaggaccacgugcccuucaagcaggucgugcuggacggcgacaagaaguucaugcucaacuccagcacguacgagaucaacgccaagcagcugacccugaccccggagaccaugcggaucgugacggacaaccucaagaagggggaggaccaggaccagcugcuggugaaggcguacgacgagauccuccagaaggucgaccaguaccugccccuguucgacgugaacaaguuccgcaacagccuccaccugggccgggccaaguuccuggaccucgccgugaacgacaagaagaucacccugaccaacauccugaacggccuccacgacaaccuggucacccccgaccugaagaacaucgggaucaagacgccccucggcaagcuccaggugccguccgggaucgugcugagcuccgaggccauccugaucuuccagagccccaccggccuguucgagaagcgcguccggaucgccgaccuguga

SEQ ID NO: 2119 - RNA, 4194 nt, Artificial Sequence
  Cas9 variant
augaaggacuacaacaucggccuggacaucgggaccagcuccaucggcuucgccgccaucgacgacgacaacaaccucauccgcgugaaggggaagaacgucaucggcagccggcuguucgcggaggggaagaccgccgccgagcgccggggcuuccgcacggcccggcgccgguacaaccgccggaaguggcgccugaagcuccuggacgagaucuucuacgaggagaucauccacaucgaccccgaguucuucaaccggcugaagcaguccagcaucuccccgaaggacgagagcaagaaguacuucggcucccuccuguuccccgacaagaccgacagcgccuacuaccacgacgggaaccagaccaucuaccaccuccgcaaccggcucgugcaccagaaggagaaggcggacauccgcgagaucuaccuggcccugcggcacaucgugaaguaccgcggcaacuuccucgacuccacccccgucagcuccuucgaggccgacaaccugaagcuggacgagcucgugcccgugaucaacgacauguacgagaacaucgacaucgacuucagcaucaacgucgacaacaucuccgagaucgagaaggugcugcuggacaaccaccucaagagcgccgacaagcaggaccggcugaaggagcugcucuacgacaacccggaguaccccgacgacaaggugaagcagaaggagaucuccaaguuccgcaaggaccuggacaaggagaucaucaaggucaucgugggguacaaguucaacgcguacaagaucgugaacuacauccccgacgacggcagcaaguucuccuucagcuucuccgacgagagcagcgacgacaagcuggacgaccucuccgagguccuggacgacagccagauggagauccugaacacgcucaaggugaucuacucccgggugcgccugaaccagaucauccccaacgggaugggccugagcgaguccauggucgccaaguacaaccggcaccacgagcagcucgaggaccugaaggagcugcucgacgugcugccgaacgacgagaagcgcagcaucgaguacgccuacaccgccuacaucggcaacguggacaagcagaaguacaacaacaaccuggucgccucccucaaggaccugcccaucaagggggacaucaacaagaagauccaggcgguguucgaguacgccaagggccacaucagcucccaggaccuguacgacgugaucaagaccaucaucaucgacaaguaccucgaggacgagagcuucgaguaccacgaccuggucgagcgcaucuccaacgacaucgacaacaaggacuaccugcucaagcagcggagcucccagaacgggaacaucccccaccaggugcaccagauggagauggacaagaucaucgccaaccagagccaguacuaccccuuccugggcgugcugaacccgaacgagucccgccggcacaucgccaaguacaagaucagcgagcucgucuccuuccgcgugcccuacuacgucggcccccugaucacccccgaggagcaggagaagacgagcgggaagcacuucgccuggaugaagcggaaggaggcgggcaagaucaccccguggaacuucgaggagaagguggacaaggaggccaccgccgccaaguucaucaagcgccugaccgugaaggacacguaccuccugaacgaggacguccugcccgacaacucccugcucuaccagcaguucaaggugcugaacgagcugaacaucgugaaggucaacaacaagcggcucacccugagcgagaagcaggggguguacaacgaccuguucaagaacaccaagagcaucaccgugaagcgccucaagaacuaccugaucuccaacuacaagcaccuggagaacaucgagaucacgggccucagcgacggggacaaguucaacaacucccugggcaccuacaacgacuucaagaagaucuucggcgcccggaucgacgacgucaacuacagcgcggacuucgagaacaucaucgagugguccaccguguucgaggaccgcagcauccugaaggagaagcucgagaaggacaucgacuggaucacccccgaggagaucaaggccguggucgccaagcgguacuccggguggggccgccugagcgccaagcugcucacggagcugcuggacgacgacgggcagcggaucaucgacauccucuggaacgacuccaucaccuucauggaggccgugagcaagcccgagaucaaggcgcagauccagaacaucaaccgcgacuucaucaaggccaccgacaucgagaccgugcuggacgaggccuacacguccccgcagaacaagaaggccauccgggaggucuacaagcuggugaaggacauccagaaggcgaugggcgggaaggcccccagcuccaucagcaucgaguucacccgcucccccgaggacaacggcagcgugaccaagacccgguacaacaacaugcagaacaaguacaaggagcucggcaaggagcuguccgacgaccugagcgcccagcucaaggaguacaaggggcgcauggaccaggacaaguucuaccuguacuucaugcagaugggcaaggaccuguacgacgggagcacgaucaaccucgacgaccugaacuccuaccagaucgaccacaucgucccccagagcuucuacaaggacgacuccaucgacaaccgggugcugacccacuacaccaacaaccagaagaagggcaaccacaccccgcucaacgggcugaacaucgacgcccagacgcagaaccuguggaagcaccucaacaagcugggccugaucagcaagaagaagcuccagaaccugugcuucaaggacaucaaccagcuguccaaguacaccaagcacggcuucgugcgccgccagcucgucgagaccagccaggugaucaagcugguggccaacauccuguccgacgaguucgcgaacgacgggaccaagaucaucgaggucaaggccaagaugaacagccucaugcgggacacguucaaccuguacaaggugcgccagcugaacgacuaccaccacgccguggacgccuaccucaccaccuucgucggcaaguaccuguacaagcgguaccccaagcugcgcuccauguucguguacggggacuucaagaaguucagcgccgaggacgaccucaaggacaucaagaccuucaacuuccugcacgacaucaccaaccccaaggaguccaacaaggagaagaucuacgacgagaaguccggcgagcugauccucgaccggaagcacgcgaucgagacgaucaagaagaucuaccaguacaaguucaugcugaucgugcgcgaggucagcaccaagagcggccagcuguucaagcagaccaucuacuccgccaagaagaccaacgggcucaagagcgccauccccgugaaguccaaccuggagccgagcaucuacggcuaccgguccgggaacguggaccaccacauggucaucgugaagaucaagaagggcacgaaguacagcuucaaggugaucgggaucagcgcccgcgccauccaggagcuggagaucgcgaagaagaucggcaacuaccgggacaagcucuacgaggucguguccgaccgccugagccaguccaugaaguccguggagagcuuccggaucauccuggacaacaucauguacggccagcucaucgucgacgggaacgacaaguucacccugggcagcgccgacuaccgcaagaacucccggcagcuggugcucugcaccaacagccugaagauccugaaggacgaggacuacaugaaccgccucuccgacauccagcggagcaagcugauggugcaggucuacgacgagaucaucaagaucaugaagaacaaguacucccuguucaucagcaacaccgagaagcuccuggagaagcgcgacaucuucugcgggcuguccuucgacgagcagaagaucgugaucuggaagaucaucaucgaccuccacaacggccccuucacgaagauccaggagcuggggaucaacaacaagaugggcaccuuccagaccaagcacggcaucauccugaccgagaacgccaucgugaucuaccagagccccuccgggcuguucgagcggaagguccgccugaaggaccuguga

SEQ ID NO: 2120 - RNA, 4194 nt, Artificial Sequence
  Cas9 variant
augaagaaggugcugggccucgaccuggggaccaacagcaucggcugggcccuggucaacgaggccaccaaggaggagaagaaggaggggaaguccagcgagaucaucaagcucggcgugcgcgugaacccccugacggucgacgagaagaccaacuucgagaaggggcggccgcuguccaccaacgcggaccgcacccucaagcggagcgcccgccggaaccugcagcgcuacaagcugcggcgccggaaccucaucgagauccugaucaagaacggcuucaucacgaaggacacgccccugaccgagaccggcaaggacacgacccaccagacccucaagcugcgcgccaaguccgccaaggagaagguggaccugaaggacuucgccaagauccuccugaccaucaacaagaagcggggguacaagagcucccgcaaggugaacagcgacgaggacggccuggcgaucgacgggauggccgucgccaagcaccucuacgagcagaaccugacgcccggccaguacgugcugaaccuccugcagaagaacaagaaguacgugcccgacuucuaccgguccgaccugcaggaggaguucaagaacaucuggaacaaccagaagaccuacuacuucgacauccucaccgacacccuguucgaggagcugaaggacaagaacaagagccagacgugggccaucugcaagaagccguucgacaucgcggggaucaagcagaucggcaaggccuccgacaagcgccucgagcgguacaaguggcgcaccgagggccugacccagaagcugaaccucgaguaccuggccaucgcccugcaggagaucaacaacgacaucaacaagagcuccggguaccucggcgccaucagcgaccgguccaaggagcuguucuucaacaaggagaccgucggggagaaccuguaccgccagcucgugaagacgccccacaccagccugcggaaccagguguucuaccgccaggacuaccuggacgaguucgagaccaucugggagacccaggcgaaguucuacccccagcucacgcacacccugaaggaggagauccgggacgucaucaucuucuaccagcgcaagcugaagucccagaagucccucaucagcuucugccaguucgagagcugggagcagaccuacaucgagaaggagaccggcaagagcaagacgcgcaccgugggccggaaggugauccccaaguccagcccgcuguuccaggaguucaagaucuggcagaaccugaacucccucgaguuccgcaacagcgacgagggggagaucaucgaguucaucaagcuggacgaggacauccggcagaccgucuucgaggagcugaaccuccgcggcaaccugaagcccaacgacgugcugaagauccuggggaacuacaucucccucggcaaggugagccaguggaagugcaacuucgaggagaucgaggggaaccggaccaacgccgcccuguacaacgucuaccagaucaucgccgagaacgagggcuacggcuucgacugggccaagaagacggcguccgagaucaacaaggagcugaagaacaucuucccccagcucgggaucgacgccagcauccuggacuucgacuucacccaggccaacuucgacaagcagaccuccuaccagcuguggcaccuccuguacagcgccgaggaggacuucaagaucuccgaggaggacaaggugcuguacggcaacagcuccgugagccucaagaagaagcugcaccagaaguacggguucaagcccgaguacaccaagcugcucacgaacaucucccugcagccggacuacggcaaccugagcgccaaggcgaucugcaacauccuccccuaccugaaggagaacaacgucuacuccgaggccugcgaccugaccggguacaaccacagcaacuuccucaccgccgaggagcaggccaagcgcccccugaagcccauccuggagcuccugaagaagaacucccugcggaacccggugguggagaagauccucaaccagauggucaacguggucaaccaggugaucgagaccuacggcaagcccgacgagauccgcaucgagcugacccgggagcugaagaaguccgccaaggagcgcgcgaacaugaccaagagcaucgccgacgccacccggcgcaacgacgacuaccggaagaccaucaucaaggaguucggcauccccaaccccaccaagagcgacgugguccgcuaccggcucuggcaggagcuggccagccgcggguacaaggacaucuucacggacaccgagaucaagccgcaggagcuguucuccaacaagaucgacaucgagcacaucauccccaaggcgcuccuguucgacgacagcuucuccaacaagacccuggccuucaagaaggacaaccucaagaaggccaaccggaccgccuacgacuucaucgccaacgacuacgcgcccaaccuggagaacuacaucgagcgcguggagagccugcacaaggaccggaagaucacgcgcgccaagcgcaacaagcuccugaugcugcaguccaagcuccccgacggcuucaucgagcgggaccugcgcaacagccaguacaucaccaaggaggccaagaagaugcuguacgaggugugccggaccgucguguccaccagcggguccaucacggacaagcuccgcgaggacugggaccugaucaacgugaugaaggagcugaacuucccgaaguacaaggcccucggccugaccgagaagaucgagcgguacgacaucggggccgagaagaugaaggaggucgagaucaucgaggacuggaacaagcgcaacgaccaccggcaccacgcgaucgacgcccugaccguggccuucagcacccacucccacauccaguaccucaaccaccugaacgcccgccgggacgagggccacaagaagcacgccgcgaucaucgccaucgagagcacgaucaccgagaaggagggcaacaagaagcgccgguucaucgcgccccugcccaacuuccgccuccaggccaaggagcacaucgaguccauccuggugagcuucaagaacaagaacaaggucgugaccaacaacaucaacaagaccaagcggaucaagaaggacaaguucaacacgaaggugcagcugacgccccgcgggcagcuccacaaggagaccaucuacggcaagaucaagcagccgcuggagaagcacaucaagcugaacaaguccuucacccucgagcaggccaagcugaucaucgacaagcggcagcgcgagaagguccugaaccaccucgagaaguacgcccacaacagcgacaucgccuucaacagcaagacccugaagaagaacccccugcucaucuccgacgagccccugaaggaggugcugugcuucgaggagguguucaccauccggaaggacaucagcuacgacaacuucaagaacgagaagcagcucgacaaggucaucgacgagaaggugaagcaggcccugaaggagcgcaucaaccaguacaacggggacuuccgggaggccuucuccgacaucgagcgcaacccgaucuggcugaacaaggcgaagggcaucugcgugaagcgggccaccaucaagggcgucagcaacgccgagccccuccacaccgccaagaaccaccugggggaggaggugcugacggagaacaaggagcagauccccguggacuacgucuccaccggcaacaaccaccacguggccaucuacgaggacgaggacgggaaccuccaggagaagguggucagcuucuacgaggcggugauccgcgugaacgagggccugcccaucaucgacaaggaguacaacaagucccugggguggaccuucaaguucaccaugaagcagaacgagauguucgucuucccgagcgaggacuucaaccccacggagaucgaccuccuggaccagaagaacgccucccugaucagccccaaccucuuccgcgugcagaaguucaccaucaaggacuacuucuuccggcaccaccuggagaccaccguggagaacaacaacacgcugaagaacaccaccuggcgccgggagggccucuccggcaucuacgggaucaucaagauccgccugaaccaccugggcgagaucguccaggugggggaguacuga

SEQ ID NO: 2121 - RNA, 4194 nt, Artificial Sequence
  Cas9 variant
augaacgagaacaaggagugguuccugggccucgacaucgggaccgccagcgugggcugggccgcgaccgacacgaacuacaaccugcugaagcucaaggggaagaaguccuggggcguccgccuguucgacgaggcccagaccgccaaggagcggcgcgacugccggagcaagcgccggcgccuggcccggcgcaaguggcggcucgggcugcuggaggagcuguucgccgaggagaucaacaagaucgaccccaacuucuucaugcgccuccgggaguccaaguacaaggugagcgacaagaccggcaacgugccguccauccuguucaacgagaagaacuacaccgacaaggaguacuaccgcaacuacaagacgaucuaccaccuccgggcggaccugauccacaagaacaaccccgacauccgcgagcuguuccucgccauccaccacauccugaaguaccggggccacuuccuguucgccgggcagcaguucaagggcagcgagaucaaggacaacauccgcgagcuccugcaguacaacucccugaacaucaagaucgacaucaccgacgagcucaucaacaacaucgccgagauccugcugaagaagaagaacagcaccgacaagaucaucgaguucaagaagcuguucgcggacgagaagcagcucaucgaggcccugcggcucgcccuggggaacaagacccagcuggccaagcuguucgacaucgaggccuacaaggagcucgacaucuccaucaagacgaucagcuucaaggagaagaucuacgaggacguccgcuccaacuacgaggagauccugggcgaguacaucaucgugcucgacaccgcgaagcugaucuacgacgccaucauccugagcaagaucaagaucaagaacaugaccaucuccgagagcaagguggucuccuacgagaagcacgggaaggaccucaagcagcugaagcaccugaucaaggaggacugcaagcucagcaagaaggagaagcggcagcuguucgagaacaucuucgugaaggaggacgagaagggcgccaacuacgugaacuacaucggcaagaacaacgccggguccagcaaguccagcugcagcuacgaggacuucaagaaguuccugaccaaggagcucaagugcugcgaggaguccaagcugaagcaggacauccuggccgagcucgagcuggagacguuccugccccgccagcggaccaaggacaacagcgucauccucuaccagauccacaaggaggagcuggagaagauccugaacaacgcggugcaguaccaccccuuccugaacaacaccgacgaguacggcaucuccaucaaggagaagaucauccagcuccuggaguuccgcaucccguacuacguggggccccugaacaccagccacaaggucggcgacggcggguucuccuggagcgugcgcaacaagggcuacgagcacaucgccgugacgcccuggaacuucaacaaggucaucaacaaggaggaguccgccaagaacuucaucgagaaccucaccaaccagugcaccuaccugcuguacgaggacgugcuccccaagcacagccugcuguacuccgaguucgcccuccugaacgagcugaacagcaucaacuacgggggcaagcggcucaccguggagcaccgcaaccugaucaucgagcgguucuucaagcaguccgccccgaaggcgacggggaaggagcugaagaaguuccucaugagcgagggcgucaucgacggcaaggacgagcuguccggguucgacgugagcaucaagaacgaccugaaguccuaccgcgacuucaagaagauccucggcgacaaguucgacagcgagaagguggagaagaugauccgguggaucacccuguucggggaguccaagcagcugcucgucgacaagaucaccaaggaguacggcgacaucuacagccuggaggagaucaagaagaucuccgggcugaccuacaaggacuggggccgccucagcgagaagcugcugacggagaucgugagcucccagcucuacgacgagagcaccggcgagugcuucaacaucaucaacgccaugcggaacaacacccugcuguucauggagcuccuggggaccaacuacgacuacuucgagaagaucaacaucuacaaccgccggcugcgcaaggagaucacggagaucacgccccacauccucgacgaccuguacgugucccccgccgucaagcggagcaucuggcaggucgugcgcaucguggaggagcugaagaagaucaucggcuccgagcccaagcggaucuucguggagaccacccgcagcaacaaggagaagaagggggacgacggccggaaggacucccgcaagaaggcccuccuggagcuguacaagaagaucaagaccagcgacaucgucgagcucgagaaggcccuggggcacaccguggacuucgacaagaagaagcaggaccugaccgacaucgacaacaacaagcucaaggcgcggaagcuguaccuguacuacacccagcucggccgcugccuguacacgggcaaggccaucgaccugaacaaccuccuguccagcaacuccgaguacgacguggaccacaucuacccgcagagcaagaccaaggacggguccuggaacaaccugguccucgugaacaagaccgagaacagcaagaaguccaacggccugaucagcgaguccauccagcggaagaacaagcacuucuggcgcuuccugaaggccaagaaccucaucagcgaggagaaguacaagcgccugacccggaccgaggacuucacggacgacgagcugagcggguucaucgcccgccagcucaucgagaccucccagagcgugaaggcggucucccagauccugcagaaccugaaccccaccaccgagaucugcuucagcaaggccgagaacgugcacgacuuccggcaggaguucggcaagaucaaggugggcaagcgccggaaccucacggaggagcagcagaaggaggccaaggaggggcagcugaucaagguccgcgaccugaacgaccuccaccacgccaaggacgccuaccugaacaucguggugggcaacgucuaccacaucaaguucacccggaaccccaagaacuucauccgcaagaacuccaagaaccgggaguacacccugaacacccucuucuacagcgacaagaucgagcgcaacggggagguggcgugggagaagggcaagacggagaagaucguguccagcgucaugugcaacaaccugaucaacgugacccggcgcaccuccgagcagaagggggcccuguacgacgccaccaucuacaaggccaacgccgcgaaggagggcagcuacuaccccgugaagacgaagaacaagaaccucaaggacgucacccgguacggcggguucaccuccaucaagaucgccuacuacagcaucuucaaguacgacauccgcaacaaggacaaggugaaggagaacaucaagaucaucccgauccccaucuacaucucccagaacaucaagaccgaccuggaccugaucaacuucgccgagaagcagaucaagcucaagaagggcgagaacaucgagaaccugcagcugaucuacaagaagcucaacaucggggcccuggugaagaucgacuacuaccccuacuacgucggcgggaagacgaacgacaacuucuacaucgacggcgccguccaggugcugcucagcuccgacaucgagcgguaccugaaggagguggugaaguucgugaacuuccagcgcgagaacaaggaggcgaaggucagcaaggagcacaucuccagcgaggagaacaucgagcuguacaacacccuccugugcaagaugaccgccaagaucuucacccacacgaagaacaacaaguacaacgaccuggcccaggacaaggccaagaacaccuucaagaaccucucccuggaggagcagugcaaggugcugcucgagauccugaaccugcucaccaacaagaagaccacguucgaccugagccugaucaacgagaaggcgagccgggugaagugcggcuucaaccuccugaaccagaagcaguucuccaucaucgagcagagcgucaccgggcuguacgagaaggagaucaagaucaucgaggacuga

SEQ ID NO: 2122 - RNA, 4197 nt, Artificial Sequence
  Cas9 variant
auggagacccaggccagcaaccagcugaucuccagccaccucaagggcuaccccaucaaggacuacuucguggggcuggacaucggcaccuccagcgucgggugggccgugacgaacaaggcguacgagcugcucaaguuccgcucccacaagauguggggcagccggcuguucgacgagggggaguccgccguggcccgccggggcuuccgcagcaugcggcgccggcuggagcgccggaagcuccgccugaagcugcucgaggagcuguucgccgacgccauggcgcaggucgacccgaccuucuucaugcggcugcgcgaguccaaguaccacuacgaggacaagaccaccggccacagcuccaagcacauccucuucaucgacaagaacuacaacgaccaggacuacuucaaggaguaccccacgguguaccaccuccggagcgagcugaugaaguccgggaccgacgacauccgcaagcuguuccuggccgugcaccacauccugaaguaccggggcaacuuccucuacgagggggccaccuucgacagcaacgccuccacccuggacgacgucaucaagcaggcgcuggagaacaucacguucaacugcuucgacugcaacagcgccaucuccagcaucggccagauccucauggaggccgggaagaccaaguccgacaaggccaaggccaucgagcaccugguggacaccuacaucgcgaccgacacgguggacaccagcagcaagacccagaaggaccaggucaaggaggacaagaagcgccugaaggccuucgccaaccucgugcugggccugaacgccucccucaucgaccuguucggcagcguggaggagcuggaggaggaccucaagaagcugcagaucaccggggacacguacgacgacaagcgggacgagcuggccaaggcgugguccgacgagaucuacaucaucgacgacugcaagagcgucuacgacgccaucauccuccuguccaucaaggagcccggccugaccaucagcgaguccaaggugaaggccuucaacaagcacaaggacgaccucgccauccucaagagccugcugaaguccgaccgcagcaucuacaacaccauguucaagguggacgagaaggggcugcacaacuacguccacuacaucaagcagggccggaccgaggagacguccugcaaccgcgaggacuucuacaaguacaccaagaagaucguggagggccugagcgacuccaaggacaaggaguacauccucagccagaucgagcugcagauccugcucccccugcagcggaucaaggacaacggggugaucccguaccagcugcaccucgaggagcugaaggccauccuggcgaagugcggccccaaguuccccuuccugaacgaggucgccgacggguucuccguggccgagaagcucaucaagaugcuggaguuccgcauccccuacuacgugggcccgcugaacacccaccacaacgucgacaacgggggcuucgccugggccgugcgcaaggcgagcggccgggugacccccuggaacuucgacgacaagaucgaccgcgagaaguccgccgccgccuucaucaagaaccucacgaacaagugcaccuaccugcugggggaggacguccuccccaagagcucccugcuguacagcgaguucaugcuccugaacgagcugaacaacgugcggaucgacggcaagccccucgagaaggucgugaaggagcaccugaucgaggcgguguucaagcaggaccacaagaagaugaccaagaaccgcaucgagcaguuccugaaggacaacggguacaucagcgagacccacaagcacgagaucacgggccucgacggggagaucaagaacgaccuggccuccuaccgggacaugguccgcauccugggcgacggcuucgaccggagcauggccgaggagaucaucaccgacaucaccaucuucggggaguccaagaagaugcuccgcgagacccugcggaagaaguucgccagcugccuggacgacgaggccaucaagaagcucacgaagcugcgcuaccgggacuggggccgccugucccagaagcuccugaacgggaucgagggcugcgacaaggcgggggacggcaccccggagaccaucaucauccugaugcggaacuucagcuacaaccucauggagcugcugggcgacaaguucuccuucauggagcgcauccaggagaucaacgccaagcucaccgaggggcagaucgugaacccccacgacaucaucgacgaccuggcccugagccccgccgugaagcgggccgucuggcaggcgcuccgcaucguggacgagguggcccacaucaagaaggcccugcccgcccggaucuucgucgaggugacgcgcuccaacaagaacgagaagaagaagaaggacagccggcagaagcgccuguccgaccucuacgccgcgaucaagaaggacgacgugcugcugaacggccucaacaacgagaucuucggggagcucaagagcucccuggccaaguacgacgacgccgcccugcgcagcaagaagcuguaccuguacuacacccagaugggccggugcgcguacaccggcgagaucaucgagcucucccugcugaacaccgacaacuacgacaucgaccacaucuacccgcgcagccucaccaaggacgacuccuucgacaaccugguccugugcaagcggacggccaacgcccagaaguccgacgccuaccccaucagcgaggagauccagaagacccagaagcccuucuggaccuuccucaagcagcaggggcugaucagcgagcgcaaguacgagcggcugacccgcaucacgccccucaccgccgacgaccugagcggcuucaucgcgcggcagcugguggagaccaaccaguccgugaaggccgccaccacgcuccugcgccggcuguacccgggggucgacgugguguucgucaaggccgagaacgugaccgacuuccgccacgacaacaacuucaucaaggugcggagccucaaccaccaccaccacgccaaggacgcguaccugaacaucgucgugggcaacguguaccacgagcgcuucacccggaacuuccgcgccuucuucaagaagaacggggccaaccggaccuacaaccuggccaagauguucaacuacgacgucaacugcacgaacgccaaggacggcaaggcgugggacgugaagaccuccauggacaccgugaagaagaugauggacagcaacgacguccgcgugaccaagcggcuccuggagcagacgggcgcccuggccgacgccaccaucuacaaggcgaccguggccgggaaggccaaggacggcgccuacaucgggaugaagaccaaguccagcgucuucgccgacguguccaaguacggcgggaugacgaagaucaagaacgcguacagcaucaucgugcaguacaccggcaagaagggcgaggucaucaaggagaucgugccccuccccaucuaccugaccaaccgcaacaccacggaccaggaccugaucaacuacguggccuccaucaucccccaggccaaggacaucagcaucaucuacgggaagcucugcaucaaccagcuggucaaggugaacggcuucuacuacuaccucgggggcaagaccaacuccaaguucugcaucgacaacgccauccaggugaucgucagcaacgaguggaucccguaccugaaggugcuggagaaguucaacaacaugcggaaggacaacaaggaccugaaggccaacguggucuccacccgcgcgcucgacaacaagcacaccaucgaggugcggaucguggaggagaagaacaucgaguucuucgacuaccuggucagcaagcugaagaugcccaucuaccagaagaugaaggggaacaaggccgccgagcucuccgagaagggcuacggccuguucaagaagaugagccuggaggagcaguccauccaccucaucgagcugcugaaccuccugacgaaccagaagaccaccuucgaggugaagccccuggggaucaccgccagccgcagcacggugggcuccaagaucagcaaccaggacgaguucaaggucaucaacgaguccaucaccgggcucuacagcaacgaggugaccaucguguga

SEQ ID NO: 2123 - RNA, 4197 nt, Artificial Sequence
  Cas9 variant
auggagaaguccuacagcaucggccuggacaucgggaccaacagcgugggcugguccgucaucaccgacgacuacaaggugcccgccaagaagaugcgcgugcucgggaacacggacaagaaguacaucaagaagaaccugcugggcgcccuccuguucgacagcggggagaccgcggaggccacccggcugaagcgcaccgcccggcgccgguacacgcgccggaagaaccgccuccgguaccugcaggagaucuucgccaaggagauggccaaggucgacgaguccuucuuccagcgccuggacgagagcuuccucaccgacgacgacaagaccuucgacucccacccgaucuucggcaacaaggcggaggaggacgccuaccaccagaaguuccccaccaucuaccaccuccggaagcaccuggccgacagccaggagaaggccgaccuccgccugaucuaccuggcgcucgcccacaugaucaaguuccggggccacuuccuguacgacaacuucaacgacgacaacuucgacuggcgcaacaucgacauccagaagcgguacgaggaguucaucgagacguacgacuccacccugggggagagcuaccucgccgacaucuccguggacgccgccagcauccuggaggagaagguguccaagaccgagcgccuggagaaccuccugaaguacuaccccaccgagaagaagacgaccuucuucggcaaccugaucaagcucauccuggggcagcaggcgaaguucaaggccaucuucaaccuggaggacgagaucagccuccaguucgccacccccaccuacgacgaggaccuggaggagcugcucggcaagaucgacaacggggacuccuacagcgagcuguucgucgccgcccagaaccuguacaacacgauccuccuggcguccuuccugaagaccgacaacaagagcgccaaggccccgcucuccaccagcaugaucgagcgguacgagaaccacaagaaggaccuggccaagcugaaggacuucgugaagaagaacugccccgaccaguaccacgacaucuuccgcgacaagagcaagaacggcuacgccggcuacaucgacaacggggugucccagaacgacuucuacaccuucaucggcaagugccucgaggagagccugaagaaggacaagggggcgcaguacuuccuggacaagaucgaccgggacgacuuccuccgcaagcagcggacguucgacaacggcgccuuccccuaccagauccaccuccaggagaugcacgccauccugcgccgccagggcgacuacuaccccuuccucaaggagaaccaggacaagaucgagaagauccugaccuuccggaucccguacuacgucgggccccuggcccgcaaggacucccgguucgccugggcgaacuaccgcagcgacgaggccaucacccccuggaacuucgacgaggugguggacaaggagaaguccgccgagaaguucaucacccggaugacgcucaacgaccuguaccugcccgaggagaagguccugccgaagcacagccucaucuacgagaccuucaccguguacaacgagcugaccaacaucaaguacgugaacgaccagggcaacgccauccacuucgacuccgagcugaaggagaagaucuucaaccagcuguucaaggagaaccgcaaggucagcaagaagacgcugaucgacuuccugaacaacuccgaggggaucuacaccgacaagcucgugggcaucgacgaggaggugaaguaccugaacgcgagccuggggaccuaccacgaccucaagaagauccuggaguccuucauggacgacgagaucaacgagaagaucaucgaggacaucauccagacccugacgcuguucgaggacaucgagaugaagcggcagcgccugcagaaguacgacgacaucuucacccccaagcagcugaaggagcucgcccggcgcaacuacaccggcuggggccggcugagcuacaagcugaucaacgggauccgcaacaaggagaacaacaagaccauccucgacuaccugaagaacggcaaccggaacuucaugcagcugaucaacgacgaccgccucuccuucaagcagaucaucaucgacgcccggaagaucgagaagcuggacaacaucgagagcgucguguacaaccugcccgggucccccgccaucaagaagggcauccuccagagcaucaagaucguggacgagcuggucaaggugauggggcacaacccggacaacaucgugaucgagauggcccgcgagaaccagacgaccaaccagggcaagaaccggucccagcagcgccugaagcggcuccaggacagcauguccaacuucaaggacagcagcaucucccugaaggacgucgacaacagcgaccugcagaacgaccgccucuuccuguacuacauccagaacggcaaggacauguacaccggggaggagcuggacaucgaccaccucuccgacuacgacaucgaccacaucaucccccagagcuucaucaaggacaacuccaucgacaaccgcgugcugaccagcuccgcgaagaaccggggcaagagcgacgacguccccgggcgcgacguggugcugaagaugaagcccuucuggaagaagcucuacgacgucaagcugaucuccaagcggaaguucgacaaccugaccaagagcgagcacggcgggcucacggaguccgacaaggccggcuucaucaagcgccagcugguggagacccggcagaucaccaaguacguggcccagauccuggacggccgcuucaacaccaagcgggacgacaacaacaaggucauccgcgacgugaaggugaucacgcucaagagcucccuggucagccaguuccggaaggacuucggguucuacaaggugcgcgagaucaacgacuaccaccacgcccacgacgccuaccugaacgcgguggucggcaccgccauccucaagaaguacccgaagcuggcccccgaguucguguacggggaguacaagaagugcgacgugcggaagcugaucgccaaguccggcgacaagagcgagaucggcaaggccaccgcgaaguacuucuucuacuccaaccucaugaacuucuucaagcgcgucauccgguacagcaacgggaugaucguggugcgccccgucaucgaguacagcaaggacaccggcgagaucgccugggacaaggagaaggacuucaagacggugugcaaggugcuguccugcccccaggucaacaucgugaagaagguggagaagcagagccacgggcuggaccggggcaagccgaagggguucuacaacgccaaccccucccccaagcccaagaagggcagcaaggucaaccucgugccgaucaaggccaaccugaaccccaagaacuacggcggguacgcgggcaucuccaacagcuacgccgugcuggucgacgccaccaucgagaagggggccaagaagaagcucacccgcauccaggaguuccagggcaucuccaucaucgaccgggagaaguacgagaagaacaagguggaguuccugaaggggcugggcuacaaggagaucuacagcaucaucacccuccccaaguacucccuguucgagcuggccgacggcagccgccggaugcucgcguccauccugagcacgaacaacaagcgcggggagauccacaagggcaacgagcuggugcucccggccaaguacaucccccugcuguaccacgccaaccggauccacaacaccuucgagaccgggcaccgcgaguacgucgagaagcacaucgccgaguucaaggagaucgccgagaucauccucgaguucaacaacaaguacgugaacgcgaagaagaacuccagcaucaucgagaaggcccuggaguccuucgacagcuucucccuggacgagaucugcgacagcuucgugggcaagcucaagaagaacaacaccaagaagaacuccgggcuguucgagcuggucagccucggcagcgccuccgacuucgaguuccuggagacgaaggugccccgcuaccgggacuacacccccagcucccugcucaacgccacccugauccaccagagcaucaccggccuguacgagacgcgcaucgaccucuccaagcugggggaggaguga

SEQ ID NO: 2124 - RNA, 4197 nt, Artificial Sequence
  Cas9 variant
auggagacccaggccagcaaccagcugaucuccagccaccucaagggcuaccccaucaaggacuacuucguggggcuggacaucggcaccuccagcgucgggugggccgugacgaacaaggcguacgagcugcucaaguuccgcucccacaagauguggggcagccggcuguucgacgagggggaguccgccguggcccgccggggcuuccgcagcaugcggcgccggcuggagcgccggaagcuccgccugaagcugcucgaggagcuguucgccgacgccauggcgcaggucgacccgaccuucuucaugcggcugcgcgaguccaaguaccacuacgaggacaagaccaccggccacagcuccaagcacauccucuucaucgacaagaacuacacggaccaggacuacuacaaggccuaccccaccaucuaccaccuccgggccgagcugaugaaggacgggaccuacgacauccgcaagcuguuccuggccgugcaccacauccugaaguaccggggcaacuuccucuacgagggggcgagcuucgacuccaacgccagcacccuggacgacgugcugaagcaggcccucgagaacaucacguucaacugcuucgacuccagcgccgccaucggcuccaucgggcagauccugauggagaccggcaagaccaagagcgacaaggcgaagaccaucgagcgccuggucgacacguacaucaucaccgacgaggugaacgccuccggcaagacccagaaggaccaggugaaggaggacaagaagcggcucaaggccuucgccaaccugguccuggggcucaacgccagccugaucgaccuguucggcagcguggaggagcucgaggaggaccugaagaagcugcagaucaccggggacacguacgacgacaagcgcgacgagcucgcgaaggccugguccgacgagaucuacaucaucgacgacugcaagagcguguacgacgccaucauccugcuguccaucaaggagcccggccucaccaucagcgaguccaaggucaaggccuucaacaagcacaaggacgaccuggccauccucaagagccugcugaaguccgaccggagcaucuacaacgcgauguucaagguggacgagaagggccugcacaacuacgugcacuacaucaagcaggggcgcaccgaggagaccuccugcaaccgggaggacuucuacaaguacacgaagaaggucguggagggccuccccgacagcaaggacaaggaguacauccuguccgagaucgagcugcagacccuccugccgcugcagcgcaucaaggacaacggggugauccccuaccagcuccaccuggaggagcugaaggucauccuggccaagugcggccccaaguuccccuuccucaacgagguggccgacggguucagcguggccgagaagcugaucaagaugcuggaguuccgcaucccguacuacgucggcccccucaacaccucccacaacguggacaacggcggguucgccugggcggugcggaaggccagcggccgcgucacccccuggaacuucgacgacaagaucgaccgggagaaguccgccgccgcguucaucaagaaccugacgaacaagugcaccuaccugcucggggaggacgugcugcccaagagcucccugcucuacagcgaguucaugcugcugaacgagcucaacaacguccgcaucgacggcaagccgcuggagaccaaggugaaggcccaccugaucaaggccguguucaagcaggaccacaagaagaugaccaagaaccggaucgagcaguuccucaaggacaacaacuacauccccgagaagcacaagcccgagaucacggggcuggacggcgagaucaagaacgaccuggccuccuaccgcgacaugguccggauccucggcaacaacuucgaccugagcauggccgaggagaucaucaccgacaucaccaucuucggggagagcaagaagaugcugcgcgagacccuccggaagaaguucgcguccugccuggacgacgaggccaucaagaagcugagcaagcuccgcuaccgggacuggggccgccuguccaagaagcugcucaacgggaucgacggcugcgacaaggccggggacggcacgagcgugaccaucaucgaggccaugcgggacuucuccuacaaccugauggagcugcucggcgaccgcuuccuguucauggagcggauccaggagaucaacgacaagcugaccgaggggcagaucgugaacccccacgacaucaucgacgaccucgcccugagcccggcggucaagcgcgccguguggcaggcccugcggaucguggacgagaucguccacaucaagaaggcccuccccgcccgcaucuucguggaggugacccgguccaacaaggcggagaagaagaagaaggacagccgccagaagcgccuguccgaccuguacgccgccaucaagaaggacgacgcccuccugagcggccugacgaacgaggaguucgggggccucaaguccgagcuggcgaaguacgacgacgccgcccugcggagcaagaagcucuaccuguacuacacccagaugggccgcugcgccuacaccggggaggucaucgaccugucccagcucaacaccgacaacuacgacaucgaccacaucuacccccggagccugaccaaggacgacuccuucgacaaccuggugcucugcaagcgcacggccaacgcgcagaaguccgacaccuaccccaucagcaaggagauccagaaggcccagaaggccuucuggaucuuccugaagcagcagggccugaucagcgagcggaaguacgagcgccucacccggaucaccccgcugacggccgacgaccugagcggguucaucgcccgccagcucguggagaccaaccaguccgucaaggcggccaccacccugcugcggcgccucuaccccgacaucgacgugguguucgucaaggccgagaacgugacggacuuccggcacgacaacaacuucaucaaggugcgcagccugaaccaccaccaccacgccaaggacgccuaccugaacaucgucgugggcaacguguaccacgagaaguucacccggaacuuccgcgcguucuucaagaagaacggggccaaccggaccuacaaccucgccaagauguucaacuacgacgucaagugcaccaacgccaaggacggcaaggcgugggacgugaagacguccauggacaccgugaacaagaugaugaccagcaacgacguccgcgugaccaagcggcugcuggagcaguccggcgcccucgccgacgccacgguguacaaggccaccgucgcggccaaggccaaggacggggccuacaucggcaugaagaccaagagcuccguguucgccgacgugaccaaguacgggggcaugacgaagaucaagaacgcguacagcaucaucguccaguacaucgggaagaagggcgagguggugaaggagaucgucccccugcccaucuaccugaccaaccgcaacaucaccgaccaggaccucaucgacuacguggccuccaucaccccgcaggccaaggacaucagcaucaucuaccggaagcugugcaucaaccagcuggugaaggucaacggcuucuacuacuaccucgggggcaagacgaacuccaacaucuacaucgacaacgccguggagguggucgugcccgccaacaucgcgguguacaucaagguccuggagaaguucgcccugcuccacaaggacaacaacaacaucaaggccagcaccgugaccacccgcaucuacaacgagggguccacgaacaucgugagcaucaccgacaaggacggccugaucgucuacgacuaccugauguccaagcuccggacgccccuguacaugaagaugaaggggaacaagguggacgagcugagcaccgugggccgcuccaaguucaugaacaugacccucgaggagcagagcaucuaccugcuggagguccucaaccugcugaccaacuccaagaccaccuucgacgugaaggcccucggcaucacggccagccgcagcaccaucggggucaagauccacacccuggacgaguucaagaucaucaaccaguccaucaccggccuguacagcaacgagaucaccaucguguga

SEQ ID NO: 2125 - RNA, 4197 nt, Artificial Sequence
  Cas9 variant
auggagacccagaccagcaaccagcugaucacgucccaccucaaggacuaccccaagcaggacuacuucgugggccuggacaucgggaccaacagcgucggcugggccgugaccaacaccuccuacgagcugcucaaguuccacagccacaagaugugggggucccgccuguucgaggagggcgagagcgccgugacgcggcgcggguuccgguccaugcgccggcgccuggagcggcgcaagcuccggcugaagcugcucgaggagcuguucgcggacgccauggcccaggucgacagcaccuucuucauccgccugcacgaguccaaguaccacuacgaggacaagaccaccggccacagcuccaagcacauccucuucaucgacgaggacuacacggaccaggacuacuucaccgaguacccgaccaucuaccaccuccggaaggaccugauggagaacggcaccgacgacauccgcaagcuguuccuggccgugcaccacauccugaaguaccgggggaacuuccucuacgagggcgccacguucaacagcaacgcguucaccuucgaggacgugcugaagcaggcccuggucaacaucaccuucaacugcuucgacaccaacuccgccaucagcuccaucagcaacauccucauggaguccgggaagaccaagagcgacaaggccaaggcgaucgagcgccugguggacaccuacaccguguucgacgaggucaacacccccgacaagccccagaaggagcaggucaaggaggacaagaagacgcugaaggccuucgccaaccucgugcugggccuguccgccaaccucaucgaccuguucgggagcguggaggacaucgacgacgaccugaagaagcuccagaucgugggcgacaccuacgacgagaagcgggacgagcuggccaagguguggggcgacgagauccacaucaucgacgacugcaagagcgucuacgacgcgaucauccugauguccaucaaggagcccgggcucaccaucagccaguccaaggugaaggccuucgacaagcacaaggaggaccuggugauccucaagagccuccugaagcuggaccgcaacgucuacaacgagauguucaaguccgacaagaagggccuccacaacuacgugcacuacaucaagcaggggcggaccgaggagacgagcugcucccgcgaggacuucuacaaguacaccaagaagaucguggagggccuggccgacagcaaggacaaggaguacauccugaacgagaucgagcuccagacccugcugccgcuccagcggaucaaggacaacggcgucauccccuaccagcugcaccuggaggagcucaaggugauccuggacaagugcgggcccaaguuccccuuccugcacaccguguccgacggcuucagcgucacggagaagcugaucaagaugcucgaguuccgcaucccguacuacguggggccccugaacacccaccacaacaucgacaacggcggguucuccugggccguccggaagcaggccggccgcgugacccccuggaacuucgaggagaagaucgaccgcgagaaguccgcggccgccuucaucaagaaccugaccaacaagugcacguaccucuucggcgaggacgugcugcccaagagcagccugcucuacuccgaguucaugcugcugaacgagcucaacaacguccggaucgacgggaaggcccuggcccagggcgugaagcagcaccugaucgacagcaucuucaagcaggaccacaagaagaugaccaagaaccgcaucgagcuguuccugaaggacaacaacuacaucaccaagaagcacaagccggagaucaccgggcuggacggcgagaucaagaacgaccucacguccuaccgggacauggugcgcauccuggggaacaacuucgacgucagcauggcggaggacaucaucaccgacaucaccaucuucggcgaguccaagaagaugcugcggcagacccuccgcaacaaguucggcagccagcugaacgacgagaccaucaagaagcugagcaagcuccgguaccgcgacugggggcggcuguccaagaagcugcucaagggcaucgacgggugcgacaaggccggcaacggggcccccaagacgaucaucgagcugaugcgcaacgacagcuacaaccugauggagauccucggcgacaaguucuccuucauggagugcaucgaggaggagaacgccaagcuggcccagggccagguggugaacccccacgacaucaucgacgagcuggcgcucagccccgccgucaagcgggccguguggcaggcccugcgcaucguggacgaggucgcgcacaucaagaaggcccugccgucccggaucuucguggagguggcccgcaccaacaagagcgagaagaagaagaaggacucccggcagaagcgccucagcgaccuguacuccgccaucaagaaggacgacguccugcagagcgggcuccaggacaaggaguucggcgcccugaaguccgggcuggcgaacuacgacgacgccgcccuccggagcaagaagcuguaccuguacuacacccagaugggccgcugcgccuacaccggcaacaucaucgaccucaaccagcugaacacggacaacuacgacaucgaccacaucuacccccggucccugaccaaggacgacagcuucgacaaccucgugcugugcgagcgcaccgccaacgcgaagaaguccgacaucuaccccaucgacaaccgcauccagaccaagcagaagcccuucugggccuuccugaagcaccaggggcucaucagcgagcggaaguacgagcgccugacgcggaucgccccgcugaccgccgacgaccucuccggcuucaucgcccgccagcugguggagaccaaccagagcgucaaggcgaccacgacccugcuccggcgccuguaccccgacaucgacgugguguucgucaaggccgagaacgugagcgacuuccggcacaacaacaacuucaucaaggugcgcucccugaaccaccaccaccacgccaaggacgccuaccucaacaucgucguggggaacguguaccacgagaaguucacccggaacuuccgccuguucuucaagaagaacggcgcgaaccggaccuacaaccuggccaagauguucaacuacgacgucaucugcacgaacgcccaggacgggaaggccugggacgugaagaccagcaugaacaccgugaagaagaugauggccuccaacgacguccgcgugacccggcgccuccuggagcagagcggcgcgcuggccgacgccacgaucuacaaggccuccguggccgcgaaggccaaggacggcgccuacaucgggaugaagaccaaguacagcgucuucgccgacgugaccaaguacggcgggaugaccaagaucaagaacgccuacuccaucaucgugcaguacacgggcaagaagggggaggagaucaaggagaucgucccccuccccaucuaccugaucaaccggaacgcgaccgacaucgagcugaucgacuacgucaagagcgugaucccgaaggccaaggacaucuccaucaaguaccgcaagcucugcaucaaccagcuggugaaggugaacggcuucuacuacuaccugggcgggaagaccaacgacaagaucuacaucgacaacgccaucgagcucguggucccccacgacaucgccaccuacaucaagcugcuggacaaguacgaccuccugcggaaggagaacaagacgcugaaggcgagcuccaucaccaccagcaucuacaacaucaacaccuccacgguggugagccucuccaacaaggucggcaucgacguguucgacuacuucaugagcaagcugcgcacgccccuguacaugaagaugaaggggaacaagguggacgagcucuccagcaccggccgguccaaguucaucaagaugacccuggaggagcagagcaucuaccugcucgagguccugaaccugcucacgaacagcaagaccaccuucgacgugaagccccuggggaucaccggcucccgcagcaccaucggcgugaagauccacaaccuggacgaguucaagaucaucaacgaguccaucacggggcucuacagcaacgaggucaccaucguguga

SEQ ID NO: 2126 - RNA, 4200 nt, Artificial Sequence
  Cas9 variant
augaagaccauccugggccucgaccuggggaccacgagcaucggcugggcccuggugaaggaggccgagcccuucuccgacgagaaguccgagaucguccgccucggggugcgggugaucccgcugaccgucgacgagcgcaccagcuucgagaacggcaagagcaucaccacgaacgcgcugcggacccagaagcgcgggaugcggcgcaaccuccagcgguacaagcugcgccggcaggcccugaucgaggagcucaaguccaccggcuggaucggcaacgacuucaucuucagcgagaccgggcccggcuccacguuccgcacccugcggcugcgcgccaagagcgccuccgaggaggugacccucggggaccuggcccggauccugcuccagaucaacaagaagcgcggcuacaagagcucccggaagauggugagcuccgacgacgggcaggcgaucgacggcauggccgucgccaaggagauguacgacaagggccugacccccggggaguacguguaccagcgcaugcuggagggcaaguacgccauccccgaguucuacaagagcgaccuccaggaggaguucgaccggaucugggcgcugcagaaguccuuccacaucgagcugacggacgagcucuaccgcaagcugagcgaccggaacaagucccagaccugggccaucugccgcgacgagcuggggauccagggccucaagagcuccuucaucggcaaggagcggcugaaggaggccuaccgcuaccgccaccuggccgccacccaggaggugaacauggagguccugaccugcgcgcuccaggagaucaacgggcagaaggccagccugagcggccuccuguccaagaucagcgaccgguccaaggagcuguaccucaacaaccugacgguggggcagaugcugcucaagcgcaucgaggacaacccgaacaacagccugaagaacaucguguucuaccggcaggacuaccuggacgaguucgagcgcaucuggaccguccaguccaaguaccacaccgagcucacccacgagcugaagaagcggcugcgcgacaucaucaucuucuaccagcggccccucaagagccagaagggccugaucucccugugcgagcucgagacgaaggacaucgagguggccaucgacggggugaagaagaugaagaacaucggcccccgcgucugcccccggagcuccccgcuguuccaggaguucaagaucuggcagaccaucaacaacaucuucgugaacggcgccgcccuggacgacgaggacaagagcgugaucgcgaaggagcucauguucaaggacaagcugaaggacuccgaccugcugaagcuccuguucaagaccaccaaggggcagagcgucaacuucaaggagguggacggcaaccgcacgauggccacccugaugaaggccugcuucaagaucgccgagaaccucggguacgacgacaucggccuguccaagcugagcuccgaggaccagauggugcggaucgaggggaucuucaaggagcagggcuucaagaccggcuuccuccacuucgacagcucccuggccagccccgaguucgagaaccaggacuccuaccgccuguggcaccuccuguacagcuacgagggggacaagagcgcguccggcaacgagagccuggucaagugcaucauggaccucugcuccauggacgaggggagcgccaagauccuggccuccugcaccuuccugcccgacuacggcagccucuccgccaaggccaugcggaagauccugcccuacaugaaggacgggcuggaguacacggcggccugcgccauggccggcuaccgccacagcaagcggucccucaccaaggaggagcuggacaccaaggaguacagcgaccgccugucccuccugccgaagaacagccugcggaaccccgugguggagaagauccucaaccagaugaucaacgucgugaacuccgucaucgacguguacggcaagcccgacgagauccgcaucgagauggcgcgggagcugaagaaguccgccaaggagcgcgaggaggcccagcgcgacaucgccagcagcaccgccgagucccagaaggugaucgagauccugaagggggagcccuucuuccuccaguucccgacgcggaacgacaucauccgcuaccggcuguaccaggagcuggcgcagaacggcuucaagacccucuacagcaacaccuacauccccaaggacaagcuguucagcaaggaguucgacaucgagcacaucaucccccaggcccugaucuucaacgacuccuucgccaacaagacccucgagagccgccagugcaaccuggagaaggggaaggagacggccauggacuacgucaaguccaaguacgacgagaccggcgugcagaccuacugcgaccgggugaacggccugaucgggaagggcaucagcaagaccaaggccaaguggcuccugauggaggggaaggacauccccgaggacuucaucaaccgcgagcugcgggacucccaguacaucgcgaagaaggcccgcgagauccucgagagccuggucaaguucguggugccgaccacgggcuccgucaccgcccggcugcgcgaggacuggcagcucgugaacgugaugcaggagcugaacugggagaaguacgcccggcuggggcucaccggcguccgcgaggacaaggacggccggcgcauccccuucauccaggacuggaccaagcggaacgaccaccgccaccacgccauggacgcgcugacgaucgccuucacccggcgccaguucauccaguaccugaaccaccucaacagcaagaucgacgugguguccugggacaagaaggaccuggaccugcgggacuacgaccucgaggacaucaaguucgggaaccugagcgccggcgaccgcuacgggaucgucaaggcccugcaggacaaguuccucuacaaggacggcaacgacaaguaccgguucgugccgcccaucccccuggacgaguuccgccgccaggcgaaggagcagcuguccgacauccucaucagcuucaaggccaagaacaaggugugcacccggaacgucaacgugaccaagaacaagggcggggccaaccgcaaggcccagcugacgccccggggcccccugcacaacgagaccaucuacggguccagccucgaguacgugaccaaggagaacgagaagaucggcuccagcuucgacaccgagcgcaucacgaccgucugcaagaagaaguuccgggacgcccuggcgcgccggcuggaggaguucgggggcgaccccaagaaggccuucaccgggaagaacuccccggagaagaaccccaucuggguggacgagcaccacagcgagcagguccccgccaaggugcgcaccgugacgaugggccagcgguucaccggccgcaagccgaucgacgccacccucaagaucgagaaggugaucgacaagcggauccgcgagauccugcaggcccggcuggacgaguucgacgggaaggcggccaaggccuucuccaaccucgacgagaaccccaucuggcugaacaaggagaagggcaucgccaucaagcgcgucaccgugagcgggcccgccaaccccgugccgguccgguucaagcgcgacaaggacggcaagcccaucaucgacgacgcggggaagacgaucggcgccgacuucgugacccccggcaacaaccaccacaucgccaucuuccgggacagcuccgggaagcugcaggagcaccccgugagcuuccucgaggccaccaucgcgaagucccacggccuggacgucaucgaccgcaacuacaacaaggacgaggggugggaguuccuguucacccucaagcagaacgaguacuucguguucccgaacagcgagacgggcuucaacccccuggacuacgaccugaccgacccccggaacuacgccgagaucucccccaaccucuaccgcgugcagagcaucuccaccaacgacuacuucuuccgccaccaccuggagaccacgagcgagaagaacaacucccuguacggcaucaccuggaagcggauccgcaacgccagcgcccucgaggggcuggucaaggugcggaucgacaaccugggccgcaucguggccgucggggaguacgacuga

SEQ ID NO: 2127 - RNA, 4200 nt, Artificial Sequence
  Cas9 variant
auggagacccaggccaccgcccagcugaucagcggccaccucaagggguaccccaucuacgacuacuucgugggccuggacaucgggacgaacuccgucggcugggcggugaccaaccgcaucuacgagcugcucaaguuccggagccacaagaugugggggucccgccuguucgaggagggccagaccgccgugguccggcgcggcuuccggagcauccgccggcgccuggagcggcgccggcuccgccugaagcugcucgaggcccuguucgccgacgccauggcgcggguggacuccaccuucuucauccgccugcgggagagcaaguaccacuacgaggacaagacgaccgggcacaaguccaagcacauccucuucaucgacgacaacuacaccgaccaggacuacuucgccgaguacccgaccaucuaccaccuccgcgccgaccugauggagaacggcacgagcgacauccggaagcuguuccuggccgugcaccacauccugaaguaccgcgggaacuuccucuacgagggcgcgaccuucgacuccaacagcucccuggacaccguccugaagcgggcccucgagcagaucgaguuccacaucuucaacgccaccagcgaggacgcccugcacuccauccuggacaucgugaagcuccaggacaagaccaagagcgacaaggccaaggcgaucgagucccugguggacacguacaucaccgacaaggucgagagcuccugcaccgacaaggagaagaaggaccugcucaaggccgacaagaagcgccugcgggccuucgccaaccugauccucgggcugaacgccaaccugacggaccucuucggcaccaucgaggagaucgaggaggacuucgugaagcugcagaucaccggcgacaccuacgaggagaagcgcgacgacuacgcgaagguguggggcgacacgauccgcaucaucgacgacugcaagagcgucuacgacuccaucauccugaugagcaucaaggagcccgggcucaccaucagccaguccaaggugaaggccuucaacaagcacaaggaggaccuggccauccugaagcggcuccucaagagcgacaaguacaucuacaagaacauguucaaggccgacgagaaggggcuggccaacuacgugcacuacaucaagcagggccgcaagaacgagaccggcugcuccugcgaggacuucuacaaguacaccaagaaggucguggagagccugcccgacuccagcgacaaggcguacauccugaacgagaucgagcugcagaagcuccugccccugcagcggaucaaggacaacggggugaucccguaccagcuccaccuggaggagcugaaggccauccuggagaagugcaaggacacguuccccuuccucaacaccgucuccgacggcuucaccguggccgagaagcugaucaagaugcuggaguuccgcauccccuacuacguggggccccucaacccgagccacuccaucgacaagggcggguucgccugggucgagcggaaggagcccggccaggugacccccuggaacuucgaggacaagaucgaccgcgagaaguccgccgaggcguucaucaagaaccugacgaacaagugcaccuaccugaucggcgaggacgugcuccccaagagcagccugcuguacuccgaguucaugcuccugaacgagcugaacaaccuccggaucgacgggaagccgcuggagcaggccgucaagaugcaccugaucgacgccguguucaagaaggagcacaagaagcagaccaagaaccgcaucaucgaguuccucaaggacaacaacuacauccugggcaagcacaagcccgaggucgacgggcuggacgagagcaucaagggcgaccucgccuccuaccgggacaugaagcgcauccugggggacgacuucgacgugagcauggcggaguccaucaucaccagcaucacgaucuucggcgaguccaagaacaugcugcgggagacccuccgcaagaaguucggcagcauccugagcgaggaccagauccggucccuggccaagcuccgcuaccgggacugggggcgccugagcaagaaguuccugaucggcaucgacgggugcgugaagggcgaggacgggacccccggcaccaucaucgacaugaugcggaacacgucccacaaccucauggagcugcugggcgacaccuucagcuucauggacgucaucaucgaggagaacgacaagcucaccaagggccaggugguggacccccacgagaucaucgaggagcuggggcuguccccggccgucaagcgcgccguguggcaggcccuccggaucguggacgaggucauccacaucaagaaggcgcugcccagccgcaucuucguggagguggcccgcaccaacaaggacgagaagaagaagaaggacucccggaagaagcgccugcaggagcucuacaagagcauccagaaggagucccccgaguggcugagcgucacccgggacgaguccgacaagcugaucagcaaccucgaccgcgccgacgacuccagccugcgguccaagaagcuguaccucuacuacacgcagauggggcgcugcauguacagcggccgggugaucgaccuggaccagcugaacaccgacaaguacgacaucgaccacaucuacccccgcucccucaccaaggacgacagcuucgacaaccuggugcugugcgagcggcaggagaacgccaagaaguccgacaacuacccgaucgaccccgacauccagaacgcccgcaagcccuucuggaccuuccucaaggaccagaaccugaucagcagccggaaguacgagcgccugacgcggguccucccccuggaggcggacgaccugaccggcuucaucgcccgccagcucguggagaccaaccaguccgugaaggccgucaccacgcugcugcggcgccucuacccggggguggacguggucuucgugaaggccgagaacgugaccgacuuccggcacgacaacgacuucaucaagguccgcagccugaaccaccaccaccacgccaaggacgcguaccugaacaucguggugggcaacgucuaccacgagaaguucacccggaacuuccgcaaguuccucaagaagaacggggccaagcggaccuacaaccuggcccgcauguucgacuucgacgugauguccacgaacgccaaggacggcaaggcgugggacaucaagaccagcaugaacaucgugaagaagaugauggccuccaacgacguccgcgugaccaagcggcugauggagcagaagggggcccucagcgacgccaccguguacaaggccuccgucgcgggcaaggccaagggcggggccuacaucggcaugaagacgaaggacagcguguucuccgacgugagcaaguacgggggccgcaccuccaucaagaacgccuacagcaucgucguggaguacaccgggaagaagaacgagaucaucaaggagaucgugccccugcccgucuaccugaucaaccggaacaagaccgaccaggagcucauccacuacaucguguccaucaucccccaggccaagaacgugagcaucaucuacaagaagcugugcaucaaccagcuggucaaggugaacggcuucuacuacuaccucggcgggaagacgaacaacuacuucuggaucgacuccgcgauccagguggucaucgccgacgaguggaucccguaccugaaggugcuggagaaguucgacgugaugcgcaagcagaacaaggagcucaaggucggcaccgugagcaccuccauccagaaccaggggaagaagguggucaucaagauccuggaggagcggaacguggaguucuucagcuaccuggucggcaagcuccacagcuccaucuacagcaagaugaaggggaacaaggccggcgagcuggccaccaagucccuggagaucuucgugaacaugagccucgagaaccagugcaucuaccugauggagcugcucaaccugcugacgaacaagaaggcccccgacgugaagccccucggcaucaccgcgucccgcgggaccaucggcagcaaggucuccaaccaggacgaguucaagaucaucaacgagagcaucaccgggcuguacuccaacgaggugacgaucguguga

SEQ ID NO: 2128 - RNA, 4200 nt, Artificial Sequence
  Cas9 variant
augaaccugcgcaacaccaccgacgaguacaacaucggccucgacauggggacgaacagcgugggcugggccgucaccgacaaggccggggcgaucgcccacuucaagggcaagcccacccuggggucccggcuguucgacgccgcccagaccgccgcgggcgcccgcauccaccggagccagcgccggcgcuacgugcggcgccgguggcgccucgaccugcugcagucccucuuccaggacgaggugagcaaggucgacuccgaguucuucugccggcugcgccagagccggcuguacgugggcgaccgcgagaaggggcacgccgacuacacguggccgaucuucaacgacuccgacuucaacgagguggacuacuacaagcgguuccccaccaucuaccaccuccgcaaguggcugauggagaccgacgagaaggccgacauccggcugaucuaccucgcgacccacaacaucgucaagcaccgcggcaacuuccugcgggagaacaacaagagccuguccagccgcgacgccaaccccgcccaggccgugaagucccuccggcuggcccugaacgacuggugcagcgagcgcgacuacgagugcgcguggaagggggaggaggacgacggcgccaucgacgaggccauccucaacgugcuggccgacggggagaagggccgcuccgaccaggccaaggagaucgcgaagcugacgggcgucgacugcggggacgccaagcagagcaagcagugcaacgaggccaucgccaaggccaucgugggccucaagguggagaugaagaacaucuucggggaguuccccgcggagaagaccuccuacaucuaccugagcuccgacgaggacgucgaggccgugcgggagagcugcccggacgacuccggcgagcuguuccaggcccucugcaagcuguacagcgccuacauccugcaggagcuccugagcuacgccgaccccuccggccagaccaucagcgcgaacaugguggccaaguacaagcaguacgggcgcgaccugcggcuccugaaggagcugacccgcacguacgcgccccagaaguacgaccucuucuuccggggcgagaccuacgccggguccagcgacuacgucguggacgaggcccgcggcuacacccgguacaaccuggggaccacgaaggccaacuacgacgacuuccagaaguccgugaaggagcuguucaagggcaccgacgcccuccaggacgagcgcuaccaggagaugauggucgccuucggcgagcagaaguuccugcggcgccugaagaccagcgacaacggguccaucuacuaccagcuccaccuggaggagcugcacaccauccucgagaaccagggcaagcacuaccccuuccugcugagcgaggaggacaagaucgagucccucgugagcuuccggaucccguacuacguggggccccugacgcgcaagaacgccgcgaucggccacgacgggaaggagcgguucgccugguccagccgcaaggacggcauggagcacgccgucaucacccccuggaacugggaggagaucaucgaccgggacaaguccgccgaggacuucaucaugcgcaugaccggcgacugcaccuaccugcagggggagcccgugcucccgaagugcagccugcuguacgaggaguucugcgcccugaacgaguucaacggcgcgcacuggacgguggacggggacgacgagcggcgcuucgacgccgcccagcgggagcgcaucaugugcgaccucuuccgccggacccgcuccgucaccuacaacaaggugagcgacuggcuggagcggaaguacaacuucaccggcgcccgcguccgcgggggccagggcgagcacggguucgaguccaagcugggcagcuacaucuucuucugcaaggacguguucaagacggacgggcucgacgaggccgacuacaccaugaucgagcagaucauccugugguccacccuguucgaggaccgggacauccucaagcggaagaucgaggaggcguacggcggcgaccgccugaccagcgagcagaucaaggugaucugcaagaagcgguucacgggguggggccgccugagcaagcggcuccugaccgacaucaaggucaacaccgacaccgggcgcaaguccaucauggacgugcugcgggagggcaaccccaacaacgggcagcgcagccggacgaugguguucauggagguccuccgcgacgaggaccugggcuuccagaaggccaucgacggccugaaccgggacuacuuccgcgagcacaacaacgggcucauggacgugaacgaccugcccggcucccccgccauccggcgcagcaucaaccaggccgugcggaucgucgacgagaucgcguccaucgcccgcaaggagccgaccaacaucuucaucgaggugacccgcgaggaggacgacccccggaagaaggggaagcgcaccaagcggcgcuacgacgccaucaagagcgcccuggagaaguucaagaaggacgaccccucccucuggaaggagcugugcgagaaggcccccggcgacauggacgagcggcugagccucuacuucaugcagcgcgggaagugcauguacuccggccggccgaucaagaucgaggagcugcacaccggcaaguacgagguggaccacaucaucccccgcagcuacaucaaggacgacuccuucgagaacaagguccugguguaccgggaggagaaccagcacaagacggacgcgcuccugaucgacagcuccauccgccagaagaugggcggguacuggcggaugcugcacgacgccaagcucgugggggacaagaaguuccgcaaccuguuccggaaccacaucgacgacaaggccaugaagggcuucgucgcccgccagaucguggagaccagccagauggugaagcugguccagacccucuucgaggcccgguaccccaacacccgcaucgugcccgugaaggcggggaucucccacgaccugcgggaggccgccggccuggucaagugccgcgaggccaacgacuuccaccacgcccacgacgcguuccucgccugccggaucggccuguucauccagaagcgccacccgagcguguacgacaaccccaucgggcuggcccgcaucaugcgggacuacgcccgcaugcaggcgcgggaguacaagaagucccacugccucgcccacacgcagggcuucaucgugaacagcuuccugagcuccggguucgacgaggagaccggcgagaucuucaaggacgacugggacgccaaggccgaggucgaggggauccgccgggugcugaacugccgccagugcuucaucagccggaugcccguggagggcgacacccgcuacggcgggcgguacuggggcgagaccaucuacucccccaaggggaagcacaagcacgagaucccgcucaagcagggccuggaccccaaccuguacggcggguacagcgaccuccuguacuccuacuuccugaucuacgaggccagcgacgucuccagcggcgagcgcgugcuccgguucaucgggauccccacguccaucgcggcccgcauggccaaccagaagcggcuggaggaguacgugagccgccuggcccuccaggagaaccuggagcacguccggauggugcgcaagaucaugaagaagcagcugaucgagguggacaacugccggcuccuggucaccgccgcggacgccgugaccaacgccaccgagcuggccuucucccucgacgagaugaagaucaucagcacgugcgccaagugcaucaacggcgcggacccguccgccaucgacaagaucgggaacgcccaggacagcuucuucgacaaccugaagcgccggggcuccgaccgcugcgcccuccuguucagccagcugaagcuggacaagcucucccagaacuucuacaugaucagcuccgacgacaagagcaagauccugaucagcauccuggaccggauccgcgccaaguccaacagcguggaccucucccuggucggcggggcgaagcacgccgcccagaugaaguucgacuucaacgccaagcugaacaaccccgcgagcuccuucgugcucaucgaccagagcgugaccggcauguucgagcgccggacccgcaucgggcuguga

SEQ ID NO: 2129 - RNA, 4203 nt, Artificial Sequence
  Cas9 variant
augaaccugcgcaacgccaccggcgacuacagcaucgggcucgaccugggcaccaacuccguggggugggccgucacggacagcaacggcuccauggcgcacuucaaggggaagcccacccugggcagccggcuguucgacgccgccgagaccgccgccggcgcgcgccagcaccgggggcagcgccggcgcuacgugcggcgccgguggcgccuggaccugcuccagggccuguuccaggacgaggugaacaaggucgacuccgaguucuucauccggcugcgccagagccggcuccacguggaggaccgcgccgaggggcacgccggcuaccgguggccgcuguucaacgacaccgacuucacggagaaggacuacuacaagcgcuuccccaccaucuaccaccuccggaaguggcucauggagaccgacgagaaggccgacauccgccugaucuaccuggcggcccacaacaucgugaagcaccgggggaacuuccuccgcgaggacaacaagaaccuguccagccacaacgccaaccccgccgaggccguccggucccugcgccaggcgcucgacgacuggugcgccgagcgcggcuacgugugcgccuggaccagcguggacgaccuggccgaggccgacucccacauccuggacauccucacgaacagcaaggagcggcgcgcggaccaggccaaggagcuggccaagcuguucggcgucgacugcggggacaccaagcaguccaagagcugcaacuccgcccucgccaaggcgguggugggccugaagaccgagcugaaggacgucuucggggaguucugcgccgagaagaccgccauccaccucagcuccgacgacgacguggaggccauccgggacgccauccccgacgacagcggcgagcuguuccaggugcugugcgcggucuacuccgccuacgugcuccaggagcugcugagcuacgccccgggccagacgaucagcgccaacaugguggcgaaguacgaccaguacgggaaggaccucaagcugcugaagaaccucgcccgcaccuacgucucccgggagaacuacgacgccuucuuccgcggccagaccuacgaggacagcaacgacuacaacguggacaaggcccagggguacacccgguacaaccugggcacgaccaaggccuccuacgacgacuucaagaaguccguggagaagcuguucaaggggacccaggcggagcaggacaagcgcuaccagggcaugaugaagcgguucgccgaggagaaguuccuccgccggcugaagaccuccgacaacggcagcaucuacuaccagcugcaccucgaggagcugcgcgccauccugaagaaccaggggaagcaccaccccuuccuccuggaggaggagaagaagaucgagucccuggucagcuuccggauccccuacuacgugggcccccucuccagcaagaacgccucccuggaccacaaggggaagcagcgcuucgccuggagcgagcggcgcccgggcaugaaggacacggugaucacccccuggaacugggaccagaucaucgacugcgaccaguccgcggagaaguucauccugcggaugaccggggacugcaccuaccugcagggcgagcccguccuccccaagugcagccugcuguacgaggaguacugcgugcucaacgagcugaacggcgcccgcuggacgaucgacggggacgacuggcggcgcuucgacgucgcccagcgcgagggcauccugcacgaccucuuccggaagacccgcuccguggccuacaacaagguggccgacuggcuggagcgggaggagaacugggcgaacgcccacguccgcgggggccagggggagaacagcuucgaguccaagcugggcagcuacaucuucuucugcaaggacguguucaagaccgccgcccucgacgaggcggacuacccgaugaucgagcagaucauccuguggaacacccuguucgaggaccgggccauccucaagcgcaagaucgagcaggccuacggcgagcaccacgggggcaagcugacggacgagcagaucaaggugaucugcaagaagcgguucaccggguggggccgccugucccggaagcuccugaccggcaucaaggucgacgccgacaccgggcgcgugagcaucauggacgugcugcgggagggcaaccccaacgaggggcagcgcagccggacgaugguccucauggaggugcugcgcgacgaggaccugggcuuccagaagaagaucgacgacuucaacaaggccuacuucgcggggcagggcgagggccucauguccgugaacgaccugcccgggagccccgccauccggcgcuccaucaaccaggccauccggaucgucgacgagaucgccagcaucgccggcaaggcgccguccaacguguucaucgaggugacccgcgaggaggacgacccccggaagaaggggcgccggaccaaccgccgcuacgaggacaucaagaacgcccuggagaacuucaagaccgaggaccaggagcucuggagcgagcugcugggcaaggcccccaacgaccucgacgagcggcugucccuguacuucaugcagcgcgggaagugcauguacagcggccggcccaucaagcucgaggagcugcacacgggcaaguacgaggucgaccacaucaucccgcgcuccuacaucaaggacgacagcuucgagaacaaggugcuggugugccgggaggagaaccagcgcaagaccaacgagaugcucaucgaccccgccauccggcgccggaugggggacuacuggcgcaugcugcacaaggccaagcugaucggcgacaagaaguucaacaaccucuucaugcgggaccgcaucgacgacaagacccugaagggguucgucgcgcggcagcugguggagaccucccagagcgugaagcucguccagacccugcuggaggugcgcuaccccaacacgaagaucgugcccgucaaggccaacaucucccacgaccuccgggaggccgccgaccuggugaagugccgcgaggcgaacgacuuccaccacgcccacgacgccuaccuggccugccgggugggccucuucauccagaagcgccacccgagcgucuacgccaaccccaucgggcugucccgggugaugcgcgacuacgcgcgcaagcaggccggcgaguucaacaagacccacagcauggcccacaccaagggcuucaucgugaacuccuucaugaccagcgaguucgacaaggagacgggggagaucuucugggacgccgaggccgcggucgaggacauccggcgcgugcugaacuaccggcagugcuucaucagccgcaugcccguggaggacaccggcgccuucugggaccagaccaucuacagcccccggagcaacaagcgccucgagcugccgcugaaggacgaccucgaccccaacaaguacggguccuacagccgggagcaguucgccuacuucuucaucuacgaggcccgcgacgccaagaaguccaagaccguccugcgguucgcccaggugcccgugcgcgucacgagcgcgaucgcccgggacuccagcaagcuggacgaguacgccuccggccucgccgugcaggaggggcuggaguucaccaagaucauccgccggcgcauccugaagaagcagcuccuggagcugaacggcgaccggcucgugaucaccggcgcgaaggagguccgcaacgccaccgaguucgccuucacgcuggaggagaccgcccugguggcgaugugcagcgagaucgcccgggagggggugccguccgagaucgccagcgacguccaguccaucagcucccagcucagcgaccuguuccuggcccucaucgagcgcggccugaccaucggggugcggcugcacggccagcucaagcugggccaguaccugcgccaguucgaggacgccgcgcuccgggacaaggccaaggugaucaucgggaucaucuccaucaccaacggcgccacgaacacccuggaccugagcucccucaacgggagcaagaacgucggccaggugcgcaucacccacaacaagcugcugaacgacaagagcaccuccuacgugcucaucgaccagagcgucacggggauguucgagcgccggacccgcaucggccuguga

SEQ ID NO: 2130 - RNA, 4203 nt, Artificial Sequence
  Cas9 variant
augaagaccaucaccgaggacuacauccugggccucgacaucgggacgaacagcugcggcugggccgugauggacaagaagaaccgccugcugcggcuccgcgggaagcgggccaucggcucccaccuguucgaggaggggcacagcgcggccgaccgccgguccuuccgcaccacccggcgccggcugaagcgccggaaguggcgccuccggcugcuggaggaguucuucgccgagcccauggccaaggucgacccggccuucuucgugcgccuccaccagagcuggguguccccgcuggacaaggaccggaagaaguaccacgcgaucgucuuccccaccgccaaggaggaccacgaguucuaccacgacuaccccacgaucuaccaccuccgcgacgcccucaugcgggaggaccgccaguucgaccugcgggagaucuuccuggccauccaccacaucgugaaguaccgcggcaacuuccuccaggacaccccggugaacagcuucgucgcguccaagaucgacguggccagcuuccugaccaacgugaaccaggccuacgccgacaaguacggcgaggagcagaacuucaucgagcugaacgagaacaacgccgcggccaucgaggccgucauccgggggaaggacaaggacaagaccacgaagcagcucgacaaggccaagaagaucaccaagcugcugcaguccagcaccaacaaguacgagaagaacgugacccgccagaucgccaacgcgaucaucggcuacaagacgcaguucgagaccauccucgggaaggacaucgacaagaacgacaaggccgacugggaguucaagcuguccgacggcgacgccgacgacaagcuggagaaccuccugcccgaguucgacgacaacgaccaguacaucguggccgagaucaagaagcuguucgggagcaucgcccucucccagaucgucuacgagaacaugacccugagccaguccaugaagugcaaguacaaggaccacggcgaggacuacgaccugcucaagcaguacaucgcgacccugagcgaccacucccaggugcgcaagcugcuccuggccuacgaccuguacgugaacaaccggcacggccgccuccuggaggccaagaaggaguucaagcaggacaaggcccugacgcaggacgaguucuacaagaucgucaaggagaaccucgacgacagccagcuggcccagaagauccugcagaagaucgacgaggggaaguucaugcccaagcagcgggugaacaagaacggcuacauccccuaccagcuccaccagaucgagcuggaccagaucaucgcgaaccaguccaaguacuacccguuccuggccgaggagaaccccgugaaggagcaccgcaagcaggcccccuacaagcucgacgagcugguccgguuccgcgugcccuacuacguggggccgcugaucagccccgacgacaagcggaaggacgagcagcagaacaagaaccacgagauguucaaguucgccuggaugaagcgcaaggacgacaacggcgcgaucacccccuggaacuucgcccagaaggucgaccgggagaccagcgccaaccgcuucaucaagcggaugaccgugaaggacacguaccucaucggcgaggacgugcugcccgcccgcucccugcuguaccagaaguucgagguccucaacgagcugaacaacauccgggugaacgggaagcgccuggagccgaaguucaagcagaaggucuucaacgagcuguucaagcagaagaacaaggugaccaagaaggccuucaaggaguucauccugcagaacaccggcaugaagaccgcggagaucgacgggcuggccgaccccacgaaguucaacagcucccucagcuccuacuaccaccucaagagcaccaagguguucgacaagcagcuggacgacccccaguaccaggccgacuucgagaagaucaucgaguacuccagcaucuucgaggacgccgagaucuaccaggagaagcuccacaaggagaucaaguggcugacccccgcccaguucaaggcgaucgccaacuggcggcugcagggcugggggcgccucucccggaagcugcuggucgagcucaagggcaagggcggggagaacaucaucuaccagcuguggaccacgcagaagaacuucaugcagaucgugaacgagccggagcugaagaaggccaucgugaaggagaaccaccaggccaccgaggagaagggcaucgagaagauccucgacgacagcuucaccucccccgccaacaagaaggcgauccgccaggucaucaaggugguggacgacgucgugaaggccgccgggggcaagaagcccgcccaguucgcgaucgaguucacccgggagcccaaguggaacccgcaccugagcaacauccgcgggacgaagcugcuccagguguacgaggacaccgccaagaagcuggucgaccagucccugaccgacagccuccgcgagaacaugaccaaccggaaccugcugaaggacgaguacuuccucuacuucauccagggcggccgcgacgccuacacggggaagaagaucgacaucgacgacauccccaagaaguaccagaucgaccacauccugccccaguccuucaucaccgacgacagccuggacaaccgggugcucaccgagaucgagaucaaccagaagaagggcaagaaguacgccucccaccuguucgcccccaagccggcguucgggcugaaccagagcaucuccgagauguggaagaccuggcagaaggccggccucaucagccagcgcaagcugaacaaccugcuguucgaccccgaccuggugaaggacaagcagaagaagggguucaucaaccggcagcuggucgagaccagccagaucaucaagcucguguccaucauccugcaggacaaguuccccgacacggagaucaucaccgugaaggccggcuacaacaccgcccugcgcaaggagcucaagcuguacaagagccgggaggccaacgacuaccaccacgcgaucgacgccuaccugaccgccaucugcgacaacuuccucuaccaggucuacccgaacuuccgccccuucuucguguacggccaguucaagaaguucucccaggacacggacaagcagaagaaggccgugaaguacuacgggcugaagaacuuccugcucccccugcuggacgacagcaccggcgacgaggucauggugaaccacaccaagcacguggucuuccacaagcagcgggacaucuucaaccgccucauccaggccuacaacuacaaguacaugcuggugucccgggagaccacgaccgagaacagcaacauguucaacaugaccaucuacccccgcggggagcgggaccgcaagaagacccggaagcugaucccgaagggcaaggaccucgaccccgcgaucuacggcggguacuccggcaacacggacgccuacauggugaucgucaagaucgagaagaccaaggagacccuguacaaggugguggggguccccaugcgcgcccuggccagccucaagaaggcgcagaaggagggcaacuacgaccaggagcugaacaaggugcuggagccccucaucauguucaacaagaacgggaaguccaaggccggcaucaagggcuucaccguggucaaggaccacgugcacuucaagcaggucgugaucgacggggacagcaaguucaugcuguacuccgcccaguaccgggccaacgccaagcagcugacgcucagccaggagaccaugaagguggugaccgacaacaccgacgacauggaccagaagaacgcggacaaggaccagcugcugcucaacgccuacgacgagauccuggagaaggucgaccaguaccugccccucuucgacaucaacggcuuccgccaggggcugcacgacggccgggccaaguucgccgcccugaagacguccgagaagaaguacacccucaagaacgugcugaacgggcugcacgacaaccucgugacccccaaccugaagaacaucggcaucaagacccccuucggccugaugcagagcuccagcgggaucacgcucucccccaacgcgaagcuggucuuccagagcccgaccggccuguucgagaagcgcgugaagcucaccaaccuguga

SEQ ID NO: 2131 - RNA, 4203 nt, Artificial Sequence
  Cas9 variant
augggcaagcagaaguucaacgacuacuaccugggguucgacaucggcaccaacagcgccgggugggccgugaccgaccuccaguacaagcugcugcgcuucaacaagaaggacauguggggcucccgccucuucgacgaggcgcagacgagcaaggagcggcgggucuaccgcaacucccggcgccggcuggaccgccggaagaagcgccugaagcuccuggaggagcuguuccucgacgagaucagcaagaucgacaacaccuucuucaagcggcugaaggaguccaaccuguacaacgaggacaagagcaucaaguucaacuacccccucuucaacgacaaggacuacaccgacaucgacuucuacaacgaguacaagaccaucuaccaccuccgcaaggaccugaucuucgaggacaagaaguucgacauccggcucguguucaucgcccugcaccacauccugaaguaccgcgggcacuucaucuucgagggccaguccuucgaggagaucaagagcuucgacuccaucuucacgcagcucagcuccuacuuccuggagaacuucgacuucaacaucgacgugagcaucaaggagaagcuggaggagaucauccucuccgacaacaccaagagcaucaagaagaccgaguucaagaagaucuucuccgacaacaagguccugagcgugcugaacauggccaucggcuccaaggugagccucaaggacgucuucaacaacgaggagcugaaggagcagaagaucuccuucagcgagaucgacuacgagaacgagaagcgggacgaguucuaccagcugcucggggaggacaucuuccugaucgaccuggccaagaagaucuacgacuucauggugcucaagaagauccugaagaacaccgacagcuucuccgccagcaagguggcgcuguacugcgagcacaagaaggaccucgacgaccugaaguacaucuucaagaaguaccugacgaaggaggacuacuucaaguucuuccgcuccaacgucgagaagaucaacuacccgagcuacaucggccucaacaagaucaaguccaagaagaucaucaaggagaacaagugcagcaucuccgacaucaacaaggagcugaagaacaaguaccugaaggacaucaagcucgaggccaaggacaaggagcuguucaaccggaucuucaacaagcuggacgaguucaaguuccucgagaagcucaagagcuccgagaacagcaccgugcccuaccaggugcacgagaucgagcugaagaagauccucgacaaccagcgcaaguacuaccccuuccugaacgagaagaucgacgggaaguccgucuacgagaagaucauccagcuguucgaguucaagauccccuacuacaucggcccgcucaacaccgaccccaacgugaaggggaagaacaccugggugguccggaaggacgagaacaacaagacgcccaucacccccuggaacuucgagcagaagguggacaugcagaaguccgccgaggaguucaucaagcgcaugaccaaccggugcaccuaccugaaggccgaggacgugaucgcgaagaacagccugcuguacgaggaguucauccuccugaacgagcugaacaaggucacgguggacaacgagauccuccacccgacccugaagaccgagaucaucaacgagcuguucaagaccacggugaaggucaccaagaagaaguucaucgaguuccucaagaagaagcaggccgugaacgacguggagagcaucaccggcaucggcgucgaguucaacugcaagcugcagggguacaacaccuuccgcaagauccugggcaagaagaucgagaacgugaacgucaagaacuucguggagaagugcaucgagcucaagugccuguacggguccgacaagaagcuguucgagaacgccaucggcaagaucuaccgcgaguacaacaucacggacgaggaguucaacaagaucaaccggcucaacuucaacaagugggcccgccugagcaagaaguuccugaccgagaucuccuucgagaagaccgacggcaccaagcgguucgagagcgugaucgaggcccuccgcuccacgaacuacaaccugauggagcugcucagcgacaaguucaaccugcagagcaagaucgacgagaucaacggggaggacgacuucuccaacaucgacaucaaggaguacgucgacaagcuguacgugagccccuccgugaagcggagcaucauccagaccuacaagaucgcgauggagaucaagaagaucaccaagaaggaccccaagaagaucuucaucgagauggccaaggacaagggcgagaaggggaagaccacggagaagcgcaaggacaagaucaagaagcucuacaagaacaucaaggacacccuguccgacuacugcaacaaccugcaggaccucacccugcaggucgagaaguacgacgacaaccggcugcgccagaagaagcuguuccuguacuucaugcagaugggcaagagcauguacaccgggcggugcaucgaccuggaggaccucuucaacaacaacguguacgacaucgaccacaucuacccccaguccaaggugaaggacgacagcuucgacaacaucguccugguggagaaggaggagaaccaccgcaaguccaacgagcugcucaaggaggagauccagagccggaugaacaacuacuggaucuuccugcgcgagaacaaguucaucuccaaggagaaguacaaccggcugacgcgcaagaaggacuucaccgacgaggagcucggcgacuucguggcccggcagcuggucaccacccgccagagcaccaaggagaucgccaaguucuucgagaagaucuucgagaagacgaccgugguguacuccaaggccagccuggucuccgaguuccgggagaaguacgacaucaucaaggugcgcgaggugaacgacgcgcaccacgcccaggacgccuaccucaacaucgucgugggcaacguguucaacaccaaguucaccaagaacuacuggaaguucacgaaggacaucaagcggcagaacgaggagaacccgaacgagaagaagggguacaaccugcgcaagaucuacgagagcgacgucuucugcaacgacuccguggccuggguguacagcaaggagaaccccaaguacaacaccaucaacaccgucaaggacaugguguaccgcaagaccgccaacaucacgcggaugcugguggagggcaaggggcagcuguucaaccugaccaucaaggacaagacccagcugaagaagaacgucggcaacaucguggcgaacacccccaucagccucaagaaccgcaagcugcaccugaacuccguggagaucgccaagaaguacggguacuucgacagccucaacaacgccuacuucguccuguucaaguacgaggagaagggcaaggagaagaucggcuucgacuccaucacgaucgccuacaaggagcggcugaagaagaaccucgacaucgagaaguuccuggagaacaagggguacaagaacagcaagcugauccgcaagaucuucaagaaccagaaggugcucaucaacggcuaccccuaccugcugaaguccuucaacaagcagagccagaucaaguucaacaacuucaagauccucuaccugaacgagaacaaccugaaguucgccaaggacgcgaucaaguucgagaagaacaacgccaacguggaccucaagaagcagaaguacaucgucuccuuccugaagaagaagaagcagaacgagaucaacgagaccuacgaggagugcaucgaccggcugaacgacgaguucgacacccucuuccugaagcugugcgacauccagaaguccagcaucuacaccaacuacaagcuccaggacuucagcuccaacaagaaguccaucgagaucaaggacaaguucgacaucuucaagagccuggaccuguacaagaaguccaagcucaucaaggaguuccugaacuacuacaaguacgagaagaacgaccuggacuucagccucaucgacaucgacaagaaggccaacugcauccagaagcacuucacggaggaccuggugaaggacuucgugaucgucgacgagagcgugaccgggcuguucgugaagaaggagcgccucaaguga

SEQ ID NO: 2132 - RNA, 4203 nt, Artificial Sequence
  Cas9 variant
augaagaccaucaccgaggacuacauccugggccucgacaucgggacgaacagcugcggcugggccgugauggacaagaagaaccgccugcugcggcuccgcgggaagcgggccaucggcucccaccuguucgaggaggggcacagcgcggccgaccgccgguccuuccgcaccacccggcgccggcugaagcgccggaaguggcgccuccggcugcuggaggagaucuucgccgagcccauggccaaggucgacccggccuucuucgugcgccuccaccagagcugggugagcccccuggacaaggaccggaagaaguaccacgcgaucgucuuccccaccgccaaggaggaccacgaguucuaccacgacuaccccacgaucuaccaccuccgcgacgcccucaugcgggaggaccgccaguucgaccugcgggagaucuuccuggccauccaccacaucgugaaguaccgcggcaacuuccuccaggacaccccggugaacagcuucgucgcguccaagaucgacguggccagcuuccugaccaacgugaaccaggccuacgccgacaaguacggcgaggagcagaacuucaucgagcugaacgagaacaacgccgcggccaucgaggccgucauccgggggaaggacaaggacaagaccacgaagcagcucgacaaggccaagaagaucaccaagcugcugcaguccagcaccaacaaguacgagaagaacgugacccgccagaucgccaacgcgaucaucggcuacaagacgcaguucgagaccauccucgggaaggacaucgacaagaacgacaaggccgacugggaguucaagcuguccgacggcgacgccgacgacaagcuggagaaccuccugcccgaguucgacgacaacgaccaguacaucguggccgagaucaagaagcuguucgggagcaucgcccucucccagaucgucuacgagaacaugacccugagccaguccaugaagugcaaguacaaggaccacggcgacgacuaccaccuccucaagcaguacaucgcgacccugagcgaccacggccaggugcgcaagcugcuccuggccuacgaccuguacgugaacaaccggcacgggcgccuccuggaggccaagaaggaguucaagcaggacaaggcccugacgcaggacgaguucuacaagaucguccgggagaaccucgacaacucccagcuggcccagaagauccugcagaagaucgaggaggagaaguucaugcccaagcagcgcgugaacaagaacggcuucauccccuaccagcuccaccagaucgagcuggaccagaucaucgcgaaccagagcaaguacuacccguuccuggccgaggagaaccccgugaaggagcaccggaagcaggcccccuacaagcucgacgagcugguccgcuuccgggugcccuacuacguggggccgcugaucucccccgacgacaagcgcaaggacaagcagcagaacaagaaccacgagauguucaaguucgccuggaugaagcggaaggacaacaacggcgcgaucacccccuggaacuucgcccagaaggucgaccgcgagaccagcgccaaccgguucaucaagcgcaugaccgugaaggacacguaccucaucggcgaggacgugcugcccgcccggagccugcuguaccagaaguucgagguccucaacgagcugaacaacauccgcgugaacgggaagcggcuggagccgaaguucaagcagaaggucuucaacgagcuguucaagcagaagaacaaggugaccaagaaggccuucaaggaguucauccugcagaacaccggcaugaagaccgcggagaucgacgggcuggccgaccccacgaaguucaacuccagccucuccagcuacuaccaccugaaguccaccaagguguucgacaagcagcuggacgaccccgaguaccaggccgacuucgagaagaucaucgaguacagcuccaucuucgaggacgccgagaucuaccaggagaagcuccacaaggagaucaaguggcugauccccgcccaguucaaggcgaucgccaacuggcgccugcagggcugggggcggcucagccgcaagcugcuggucgagcucaagggcaagggcggggagaacaucaucuaccagcuguggaccacccagaagaacuucaugcagaucgugaacgagccggagcugaagaaggccaucgugaaggagaaccaccaggccacggaggagaagggcaucgagaagauccucgacgacuccuucaccagccccgccaacaagaaggcgauccggcaggucaucaaggugguggacgacgucgugaaggccgccgggggcaagaagcccgcccaguucgcgaucgaguucacccgcgagcccaaguggaacccgcagcugucccacauccgcgggaccaagcugcuccagguguacgaggacacggccaagaagcuggucgaccagagccugaccgacucccucaaggagaacaugaccaaccggaaccugcugaaggacgaguacuuccucuacuucauccagugcggccgcgacgccuacaccggcaagaagaucgacaucgccgacauccacaagaaguaccagaucgaccacauccugccccagagcuucaucacggacgacucccuggacaaccgggugcucaccgagaucgagaucaaccagaagaagcacaagaaguacgccagccaccuguucgcgaccaagcccgccuucgggcugaaccaguccaucagcgagauguggaagaccuggcagaaggccggccucaucucccagcgcaagcugaacaaccugcuguucgaccccgaccuggugaaggacaagcagaagaagggguucaucaaccggcagcuggucgagaccagccagaucaucaagcucgugagcaucauccugcaggacaaguucccggacacggagaucaucaccgugaaggccggcuacaacaccgcccugcgcaaggagcucaagcuguacaagucccgggaggcgaacgacuaccaccacgccaucgacgccuaccugaccgccaucaacgacaacuuccucuaccaggucuaccccaacuuccgccccuucuucguguacgggcaguucaagaaguucagccaggacacggacaagcagaaggaggccaucaaguacuacggccugaagaacuuccuggagccgcuccuggacgacuccaccggcgacgaggugauggucaaccacaccaagcacgugguguuccacaagcagcgggacaucuucaaccgccugauccaggcguacaacuacaaguacaugcucgucagccgggagaccacgaccgagaacuccaacauguucaacaugaccaucuacccccgcggggagcgggaccgcaagaagacccggaagcugauccccaagggcaaggaccuggaccccgccaucuacgggggcuacagcggcaacacggacgccuacauggugaucgugaagaucgagaagaccaaggagacccucuacaaggucgugggggugccgaugcgcgcccuggcgucccugaagaaggcccagaaggagggcaacuacgaccaggagcucaacaagguccuggagccccugaucauguucaacaagaacgggaaguccaaggccggcaucaagggguucaccguggugaaggaccacguccacuucaagcaggucgugaucgacggcgacuccaaguucaugcucuacagcgcccaguaccgggccaacgcgaagcagcugacgcugucccaggagaccaugaagguggugaccgacaacaccgacgacauggaccagaagaacgccgacaaggaccagcuccugcugaacgccuacgacgagauccucgagaagguggaccaguaccugccccuguucgacaucaacggcuuccgccaggggcuccacgacggccgggccaaguucgccgcgcugaagacgagcgagaagaaguacacccugaagaacauccucaacgggcugcacgacaaccuggucacccccaaccucaagaacaucggcaucaagaccccguucgggcugaugcaguccagcuccggcaucacgcugagccccaacgccaagcucguguuccagucccccaccggccuguucgagaagcgcgugaagcugaccaaccucuga

SEQ ID NO: 2133 - RNA, 4203 nt, Artificial Sequence
  Cas9 variant
augaagaccauccugggccucgaccuggggaccaacagcaucggcugggcccuggugaaggagacggagaacuccaacgagaaguccgagaucaucaagcucgggguccgcgugaacccccugaccguggacgagaagaccaacuucgaggccggccggccgcugagcaccaacgcggaccgcacggccaagcggagcgcccgccggaaccuccagcgcuacaagcugcggcgcaagaaccugaucgaccuccugaucaagcaccggcugaucgacaaggacacgccccucaccgagaucgggaagaacaccacccaccagacccuggagcugcgcgccaaggccgcgcgggagcgcaucgagcucgaggaccuggcccgggucuuccuggccaucaacaagaagcgcggcuaccgguccagccgcaaggugaacaacgaggaggagggccagguggucgacgggauggccguggcgaagaagcucuacgacgagaaccugacccccggccaguacgccuacgagcugcucuccaaggggaagaaguacgugcccgacuucuaccggagcgaccugcaggccgaguucgacuccaucugggaguaccagaagcaguucuacgccgacauccuggacgacgagcucuacaacgcccugaagggccaggggcagcagaacagccgcaagcgguuccuggcgaucaagggcgucuacaccgccgagaacaagggcaagcgcgacgaggugaagcuccagcacuacaaguggcgguccgaggccaucacgcagaagcugagcaucgaggagguggccuacguccugguggagaucaacaacgaccucaacaaguccagcggguaccugggcgccaucuccgaccgcagcaaggagcuguacuucaacaaggagaccgugggggagaaccucuggaagcagauccagaagaacccgcacaccucccugaagaaccaggucuucuaccgccaggacuaccuggacgaguucgagcagaucugggagacccaggcgcaguuccacccccagcucacgcuggcccugaaggagcagauccgggacguggugaucuucuaccagcgcaagcucaagagccagaagggccugcuguccuucugccaguucgagagcugggagaucgagcggaaggacgagaacggcaacgucauccucaacaagaccacccagcugcccaagcgccagaccguggggcggcgcguggcccccaagagcuccccgcuguuccaggaguucaagaucuggcagaacaucaacaaccucgagaucgccaagaucagcgacggcaacuccaagaacaagaaggagacggaggcccugagcgacgacgagcggaagcuccuguucgaggagcugaaccugcgcgggaaccugucccagaaggagguccuccagauccugggccugaaggacaaggaguacaagaccaacuuccccgaggggcucgagggcaaccggaccaacgcggcccuguucaacaucuaccagcagaucgccgagaacgagggcuacggggacuggaccaagaaguccgcccaggagaucaaggaggagcugaaggccguguucccccagaucggcauccaggcggacauccucgacuucaacgccgagcuggacgggaaggaguucgagaaccaggccagcuaccagcuguggcaccuccuguacagcgccgaggaggacgacaagaucaacgaggaggaccagaucaucuacggcaacuccgcggugagccugaagaagaagcucugcgagaaguucggguucacgcccgaguacgccaaguggaucgccaacgucucccugcaggacgacuacggcaaccugagcaccaaggccaugcgcaagaucaucccguaccucaucgacggcaacgacuacuccgaggccugcgcgcuggccggguacaaccacagcaacucccugaccaaggaggagaacgacaaccgggagcgccucaacaagcuggagcugcuccccaagaacagccugcggaaccccguggucgagaagauccugaaccagauggugaacguggucaaccaggugaucgagaccuacggcaagcccgacgaggugcgcaucgagcucgcccgggagcugaagaaguccgccgaggagcgcgccgagaugacgaaggggaucaacgaggcgacccggcgcaacgaggacaucaagaagcugaucaccaagaacuucggcaucccgaaccccaccaagaacgacgucgugcgguaccgccucugggaggagcuggcgccccuggccuacaaggacguguucacggggcgccagaucaagaaggaggaccucuucagcuccaagaucgacaucgagcacaucauccccaaggcccugcuguucgacgacagcuucagcaacaagacccucgccuuccgggagaccaaccugaagaaggccgaccgcaccgccuacggcuucaucgaguccgacuacaacgccacgcuggacgacuacauccagcgggucgagacccucuacaacaacgccaagggcaccaucagcaaggggaagcgcaacaagcugcugauggcgcagaagaaccucccggacggcuucaucgagcgggaccugcgcaacucccaguacaucgccaagaaggccaagagcaugaucgagaagguguucaacgacgugaacgucaccuccgggagcaucaccgaccggcugcgcgaggacugggaccucaucaacgugaugaaggagcugaacuuccccaaguacaaggcccugggccucacggagaucgaggagcgguacgacaucggccaggagaagaccaagaagguggaggucaucaccgacuggaccaagcgcaacgaccaccggcaccacgccauggacgcgcugacgguggccuucaccaccaagucccacgugcaguaccugaacaaccucaacaccauccacagccugaagggggacgaggucgaccuggagcucuccaagcuguacggccugaagaacacgaucaccgagguggugaacaagaagcgcaaguucaucccgcccaugcccaacuuccgggaggaggccaagaagcacaucgagaccauccucgucagcaucaagaacaagaacaagguguacaccaagaacaucaacaagacgaagaaggaguccggguaccacaccaaggagcagcugacgccccgcggccagcugcacaaggagaccguguacggcaagagcaagcggcccaugaacaagcccaccaagaucaacaagaacuucucccucgagcaggcccagcugaucaucaacguccaggagaaggagcuggugcuccgccaccuggcccaguucgacaacaacccggcgguggccuucgacaccaagacccugaagaagaugccccuccugaagaacggggagccccugaaggagguccucugcuucgaggagaucuucaccauccggaaggacaucacgccggaccugaagaucgagaaggugguggacgagaagaucaaggccauccuggagcagcgcaagaaggacuucggcgggaacgccaaggaggccuucagcgaccucgacaagaaccccaucuggcugaacaaggagaagggcaucugcaucaagcgggucaccaucaccgggguguccaacgcggaggcccugcaccaccagaaggaccaccucggccgcgagauccuggacgacaacgggaaccccauccccgccgacuucgugagcaccggcaacaaccaccacgucgccaucuacgaggacgagaagggcaagcugcaggagaagguggugucccucuacgaggcggucgcccgggccaaccaggggcugccggugguggacaagggccugaacgaggaccucggguggaaguuccuguucacgaugaagcagaacgagauguucgucuuccccaacgacgacuucgacgugaacgacaucgaccugcucgacgagaacaacgccaagaucaucagccagcaccuguuccgcgugcagaagcuggccaccaagaacuacauguuccgccaccaccucgagaccaacguccaggaggugaaggagcugaacgacaucgcguacaagagcauccgguccaccgagccccugaagaacaucaagaaggugcgcaucaaccacaucggcaagaucguccaggugggggaguacuga

SEQ ID NO: 2134 - RNA, 4209 nt, Artificial Sequence
  Cas9 variant
auggccaagaaggacuacaccaucggccuggacaucgggaccaacagcgugggcugggccaucaucgacgacaaccucaagcugcugaagcgcaacaugacgaucaaggggaacaccgacaagaaguccgucaagcgggaccucuggggcagccugcuguacuccgggaacagcgacaagaccaccuccgcggccgacgcccgcagcaagcggggccuccgccggcgccugcggcgccggaaguaccgccuggaccggcucaagcagaucuucuccgagaucaucaacgacaaggcccccaacuucuucgacaagcugaacgagagcuuccugaacccgaaggacaagaaguacggcaaguaccagaucuucgacacggagaaggaggagaaggacuacuaccgccgguaccccaccaucuaccaccuccgcaaggaccugaucgaguccagcaagaagcaggacauccggcugguguaccucgcccuggcgcacauccugaagucccgcgggaacuuccucuucgagggcaacaucgacgaccugaagaacgacuucgccgggaucuacgaggagguggucgagcugugcaugaccaucaacgccgaggacguggaccucgaguucgaggagguggacaagcagagccugaacuccaucaucaagaacgaggacaucagcgagaucgagcagggccuggagaacuucgccgacgagcacgucaucuucaaggagcagaacaagaagaagaacgaccucuucuccaacugcugcaagaucaucugcgggcacaccgugaaggcgaacaaguucgccagcgagcuggacuccgagcuguucaucagcuucaaguccgacgacuacguggacgucaucgacgugauccagagcggcaacgagaacaucgccaaccuccugcuggccugccggaaggccuacgacuacaucauguucaaccgccucguggaccugaacaucgacagccccgcgaagcuguccagcaacauggucucccucuacaaccagcacgagaaggaccugaaggccuacaagaagcugaucaaggaguucaacaaguucaagcggagcaacggcugcaaggaccucgagaugaucauccugacggccgacgacaucgacuccuuccgcaagaagguggacaagaaggaggggaagcugaacggcaucaacaagaagaucacccacgagcaggcccucaagaagcagcugaaggacaugaagaagauccuggaggacaagaacaccgaggccgaggacaagcagaucaacgacauccucaagaugaucaccagcaucgaggagcgggugaacaaguccugcuuccugaagaaccugcgcagcacggacaacgcguccauccccaaccagauccagcgccaggagauggaggccauccucgacaagcaggccaaguucuacccguuccugaacgagcacaaggacgagcugcuccagcugcugagcuuccggauccccuacuacgucgggccccuggugaacaagaaguacucccgcuucgccuggcucgugcggaaggagggccagguccagaagaucacccccaccaacuucgacggcgugguggacaagcacaagaccgccgagaaguucauggagcgccugaucgggaaggacgucuaccugccgaacgagcgggugcuccccaaggcgagccugcuguaccaggaguacugcaucuucaacgagcucacgaagguggccuacaucgacuccaccggcaagaagaacaacuucagcuccgaggagaagcugaacaucuucgagaagcuguucaagaccaagcgcgaggucaccaagacggaccucugcaagugccugaacaacgugugcaagcugaaggagaaggucaaggagaccgagaucaucgggaucaaggccaaguucaacgccaaguacagcaccuaccacgaccucaagaagaucaacggcauggagcagcugaucgccgacgaggaggggaagccccugugcgaggacaucaucuccauccucaccaucuucgaggacaaggacauccggcuggugcgccugaaggagcuccugugccagaacaaggaccugaucaacaaguucagccucuccgcggagaagcuggccaaggugcugagcacgaagcacuacaagggcuucggcaacgucagcgccaagcucaucaacgggauccgggacaagaacugcaagaccauccuggacuaccugaucgaggacgacaaggaggccuacuacggccgcaacaaccccaaccggaaccucaugcagcuggugaacgacucccgccuggcguucaaggggcagaucgaccgggagcagaacacccaccucgaggaccugagccuggacgaguuccucgacgaccuguacguguccccgagcauccgccggggcauccgccugaccauccggcucgucgacgagcugguggagaucaugggguaccugcccaagaacaucgugaucgagaugccccgcgaggacggcgagaagggcaagaucgccgacacgcgguacuccaagcucgagaagaugcugaagaaggacgccgcccuggaggaccucuaccgcguccugaagaccuacgagaagaacaagaaggcccuggcgaacgacgcccucuaccuguacuuccugcagaacgggcgcgacauguacaccggcaaggagaucaaccucagcgagcugcacuccuacgacaucgaccacaucauccccaagagcuucaaguacgacgacucccuggacaacaaggugcucaccgccaagaagaugaacauggacaagcggacgggggcccuggaccacaacaucaucgagaaccagugcggcuucuggcgcgugcugcuccagcaggacaagaucagccuggagaaguacaccaaccugaugaagaccgaguucaccgaggccgacaaggcgggguucaucaugcggcagcucgucgagacgcgccagaucaccaaguucguggcccgguaccuggacaacaaguucaacggccugaucuccgacccgaacgacaaggugaacauccuccugccccgcgccagccugugccaccaguuccgggagaccuucggcuucuacaagguccgcgagcucaacgacaugcaccacgcccacgacgccuaccugaacgcggugaucgccaacacccugaacaagaacgccuaccucuccgaccugcugaaguacggggccuacagcaaguacaagaagaacggcuucaacaacuccaacgggaucauggacuacuucggcaacacccaguucaacugccucuucguggucgagcggacgcuggacaagugccgcgugaacaucgugaagcaccccgagaccgcgagcggcgaguucuacaacgagaccauccagaagaacaaggucaacgggggcuccagcacccggagccugaaguccagcgugaaggugcuccagaacacggagcaguacgggggcuucaccaacgucaacaacgccuacuucauccuguucgacuacaaggccaaguccaagcugaagcgcaagcucaucggggugcccaucguggaccggcagaaguucgagcaggacccggucaccuaccuggaggccaagggcuucgacgagcccaagcuggugcagaagcuccugaaguacacccugcucgaguacgaggacggcaagcgccgguaccugacgggggugaccggcaagcgcugcgagcugguccgggccaaccagcuccugcugccccgcaacaugauggcgcuccugcaccaccuccaggaguggcagaagcacgacuucgggaucaaggagaugaccaaggugaucaagaacaccaacaacaucgaggccaaguucgacaagcuguucgagcacaugaugaaguucaucgacaaguacagcgagcccccgaagaucguguccagcaagaucuccgaggaguaccacaagcugcgggagagccugugccaggacgacaacaagaucaagaucuacgccgagaucggcaaggcccuccugucccugcugcaccucgucgacagcaaguccgccugcguguucaaguucagcgggcuggagaucaaccgcauccgguaccaguccaucaacgagaagaaggagcccgugaucaucuuccagagccuguccggccuccgcgagagccgcuacaaguacaaccaguga

SEQ ID NO: 2135 - RNA, 4209 nt, Artificial Sequence
  Cas9 variant
augaagcugcgcaacgccaaggacuacagcaucggccucgacguggggaccggcuccaccgggugggccgucacgacccuggacggcgaccuguucaccuucaaccaccggcccacccucgggagccgccuguucgaguccgcgagcacggcccaggagacccgggaggcccgcggcgcccggcgccggcugaagcgccggcgcuggcggaucucccuccugcaggagcaguucgccgcggagauggagagcugcgacuccaacuucuucauccgccugaaccagagccggcucuggcaggaggaccgcaccgagcagggcaagggguaccuguucggcgggaagccgauccugugcggcgcccagaucuucgccaacgagcaggaguacuaccagcaguuccccaccaucuuccaccuccggaaguuccugguggagugcuccgagcaggucgaccugcgccucaucuaccuggcccugcacaacaucgugaaguaccgggggaacuuccucuaccaggacaacaagacgcugaacgugcgcaacuucaaccuggacagccagaucgcggacuuccucgaccagcugcagcuguggugcgagaacaacgaccucugcuuccacgagaucgacggcaccaccacccuggccucccagcugaacacgugcuuccaccagcagagcaaccagcagaagaaggacacccucaagaccuucuucgcgaccugcaucgagaacgacaagaucgccggcgagcugacgaaggcccugcucggguacaagaccgacuucaagaucaucuucaacaucgagggcgagaaggacgaguacaaggccaagugcaacgaggaggagaagauccugaagcugcaggagaccaucgacgacgccaaccaggugcuccugcaguccauccugaaccucuacagcgggaucaucgucgagaagauccugaacaacaccgccgugaagaacgaguccgcccagugcacgcugagcgccuaccacugcuacuccuacgcgcucuacagcaagcagcugcggacccugaagaagcucgugcgcaaguacaacccccagcgguacaacgagugcuucaaccuguccgccgaggaccccaaggccaagaagcagcugugcaccuacgcccgcuacaacgcccagcacagcaccgacuacgacgaguucaagaaguacaucaaggaccucuucgagaacacggacgcggucaacgacgccgccuaccagcagaugaagcaggacuucgacgaggagaaguuccugcgccggcagaagaccagcgacaacggcguguacccguaccaguuccaccuggaggagaugcagcucaucaucgagaaccaggcccagcacuaccccuuccugaccaagaucaagcccaagcuggagucccuggugaccuuccgcauccccuacuacgucggcccgcucacgcagaaggggauccagcggaacggccgcaaguucgccuggagcaagcggaacaaggacgcggagaaccagcgcaucuaccccuggaacugggacuccaucaucgacaagagcgccuccgccgaggccuucauccugcggaugaccgggaagugcaccuaccuguacggcgaggacgugcuccccaaggagagccugcuguaccaggaguucugcgugcucaacgagcugaacggggcgcgcuggaacugcgacggcgagcggcgcaugccccuguccaacaaggacugcaaggccaucuaccggcagcuguuccugaagaagcagaaggucagcuacgccgacguguccaacuaccugaaggcccagggccacaucaacaacagcguggccgggggccagggggagcacggcuucgaguccacccucagcucccaccacuucuuccgcaagcuguucaacgucgacgcggccaacgaccugacggcccagcagaucgagaccgccgagcagcucauccugugggggaccaucuucgaggacaaggagaucuucgagcagaagaucaaggagcgguucggcgacauguucagcaaggacgagaucaagaccaucgcccgccggaaguucuccggcugggggaagugcagcaagcagcugcucuccggccugacgguggagaccccgcgcgggcgggagagcaucaucgacgugcugcgcaacggccaccccgagaacgggcggacccucgucuucaugcaggucaucaccgacaagaagcuggaguucgacaagaagaucgaggaguacaacaacgagcaccuggcgaagaccaacgaguccgugcucgacacggccaucaugagccccgccaucaagcgcggcgugaaccaggcccugcacaucgugggcgagauccgccggaucaccaagcacgacccgaccugcaucuacaucgagaccacgcgcgacgagaaggacgggaagcacaacacccggaccagcucccgcuacagcucccugaagaagaaccucgagacccucaagagcaucgacaaggccaacgcgcccgccaucaagcacucccuggagcuccuggagacguacaagaagcagaacaucgacgacaagcuguuccucuacuucacccagaacggcaagugcauguacagcgggaagucccuggacaucaacaaccugagcuccuaccagaucgaccacgucaucccccagagcuacaucaccgacaacuccuucgacaaccgggugcucguguacgccagcgagaaccagcgcaaguccgacagccugcugcucuccagcgucauccaggccaagcaggagcccuucuggaccucccuggagaaggcgggccugaucagcgagaagaagcacaacaaccucaagcgcaagagccuguccgacgcccagaucaagggcuucaucaaccggcagcugguggagacgagccagaucgugaagguccuccgggacgagcugucccgcauccugcccgacaccaagaucaucccggugaaggccagccucucccacgacgugcggaucgccugcaaccuguacaagagccgcaccgccaacuccuuccaccacgcgcacgacgcccugcucgccagcaccauggggcgguucguccagacgcgcuuccccgacauguacgagaaccccgugcgguacgugaagauccugcgcgccuacaucgcccaguccaagcugcagcacagcgcgcagacccggaacuucgacucccgcagcuucauggcccacuccuucuucugcgacuacagcaacgagaacggcgacaccaucuggaacuccgccagcgagaucgagcggcuccgccgggcccuguccuacaagaaccuguaccucacccgccgccccuucaucgacgccgggcaguucugggaccagacgaucuacagcccgcacgacaagaagaagacccccgacucccugaucccccugaagaagaaccucgacacccagaaguacggcggguacagcggcaaggacuacgcgcacuucuucaucuacagcguccugaacaagcagggcgacguggaguaccgguucgacggggugccccuguacaucgccgccaacaucaaccgcgacgaccggggcgcccucgcgcaguacgccaagcagcuggucgagcacgagaacgugccgaacgccaagcgcaagaccaaggaccugguguuccagcggaucgagcgcgccugcguccccaaguaccagcucaucugcaucucccagugcagcggggacuccgaccggagcguguccgacuacuacuacaucacgggcaagaaggaggugcgcaacgcccugcagcuggcguuccccaugcaccucuacggggccaucaacgccaucgaggacaagaaggagcuggacgacagcgcccuggaggagcucgucguguacauccugcggaacgccccgcgcaucgcgcccgacguguuccggcgccugaaccucaccgagaagcuggccgacugccuggacauccccgaccggaucgagcuccagaacuccaucuacggccuguucaaccugaucaacgccgagagcaacgucgugaaccuccagaucuucggcggggccaagaccgccggcgugaagcugaucaaccugaacucccuccugaacgaccccgcgaccacggucaccuucaucgaccagagcgugaccgggauguucgagcgcaaggagaccaucggcaucuccuga

SEQ ID NO: 2136 - RNA, 4209 nt, Artificial Sequence
  Cas9 variant
augggcaagcaggaguucaacgacuacuaccugggguucgacaucggcaccaacagcguggggugggccgucaccgaccagcaguacaagcuccugcgcuucaacaagaaggacauguggggcucccggcuguucgaggaggccaagacggcgaaggagcgccggguguaccgcaacagccggcgccggcucgaccgccggaagcgccggcugaagcugcucgaggagcuguuccuggacgagauccucaagguggacuccaccuucuucaagcgccuggaggagagcaaccuguacaacgaggacaaguccaucaaguucaacuacccccucuucaacgacaaggacuacaccgacaucgacuucuacaaggaguacaagaccaucuaccaccuccggaaggcccuggucuucgaggaccgcaaguucgacauccggcuccuguucaucgcccugcaccacauccucaaguaccgcgggcacuucaucuucgagggccagagcuucgaggacaucaaguccuucgacuacaucuucacggagauccaggacuggauccuggagaacuucgagaucaacaucgacaucaaccugaaggagaagcucgaggagaucauccugagcaacaacaccaaguccaucaagaagaucgaguucaagaagaucuucagcgacaaccggauccuggccauccucaacaugggcguggggugcaagguggaccugaaggacgucuucaacaacgaggagcugaaggaccagaagaucuccuucaccgagaucgacuacgagaacgagaagcgcgacgaguucuaccagcuccugggcgaggggaucuucaucguggaccuggccaagaagaucuacgacuucauggugcucaagaagauccugaagaacagcgacuacuucuccgagagcaaggucgcgcuguacgaggagcacaaggaggaccucaaccggcugaaguacaucuucaagaaguaccugaaguccagcgacuacuacaaguucuuccgcuccaacagcgagaagaccaacuacccguccuacaucggccucaacaagaucaagacgaagcggcugaucgagaacaacaagugcagcaucagcgacaucaacaaggagcugaagaacaaguaccucaaggacauccagguggaggccgaggacgaggagcuguucaaccgcauccugcacaagaucaacgagaacaaguuccucgagaagcugaaguccagcgagaacuccaccgugcccuaccagguccacgagaucgagcugaagaagauccucgacaaccagcgcaaguaccacagcuuccugaacgagaaguccgacgggaugacccugugcgagaagaucaucaagcuguucgaguuccggauccccuacuacgugggcccccugaacaccaacccgaacaugaacaagaagaacaagaacacguggguggucaagaaggaggagaacagcaaguccagcaucacccccuggaacuucgagaagaagguggacgagcagaaguccgccgaggaguucaucaagcgcaugaccaaccggugcaccuaccugcgcggcgaggacgugauccccaagaacagccugcucuacgaggaguucguccugcugaacgagcucaacaaggugacgguggacaacgagcugcugcaccccacccucaagaacgagaucaucgacgagcuguucaagaccaccgucaaggugacgaagaagaagaucaccgaguuccugaagaagaagcaggccaucuccgacguggagagcaucaccgggaucgacgucgaguucaacggcaagcuccagggguacaacaccuuccggaagauccugggcgagaagaucgagaaccugaacaucaagaaguucguggagcgcugcaucgagcucaagugccuguacggcuccgacaagaagcuguucaagaacgcggucgggaagcucuacaaggaguacaacgugacggacgaggaguucaccaagaucaacaagcugaacuucaacaaguggggccggcugagcaaggaguuccucaccgggauccgcuucgagaagaccgacggcacggagcgguucgaguccgugaucgccgcccugcgcagcaccaacuacaaccugauggagcuccuguccgacaaguucaaccugcagagcaagaucgacgagaucaacggggaggacgacuucuccaacaucgacaucaaggaguacgucaacgagcucuacgugagcccgagcgugaagcgguccaucauccagaccuacaagaucgccauggagaucaagaagaucaccggcaagaaccccaagaaggucuucaucgagauggccaagggcgggggcgagaaggggaagcgcacggagcggcgcaaggacaagaucaaggagcuguacaagaacaugaaggacagccuguccgacuacugcaacaaccuccaggaccugagcucccagguggagaaguacgacgacaaccggcugcgccagaagaagcuguuccuguacuucaugcagaugggcaagagcauguacaccgggaacgacaucgaccuguccgagcuguucaacaacaacaucuacgacaucgaccacaucuacccccagagcaaggugaaggacgacuccuucgacaacaucguccugguggagaagcaggagaaccacagcaaguccaacgagcugcucaagcccgagauccagagcaagaugaacaacuacuggaucuuccugcgggagaacaaguucaucuccaaggagaaguacaaccgccugacccggaagaagaacuucaccgacgaggagcucggcgacuucguggcgcgccagcuggucacgacccgccagagcaccaaggagguggccaagcuguucgagaagaucuucgacggcaccgagguggucuacuccaaggccagccucguguccgacuuccgggagcgcuucgacaucaucaaggugcgggaggucaacgacgcccaccacgcccaggacgcguaccugaacaucgugguggggaacgucuucaacaccaaguucacgaagaacuacuggaaguucaucaaggagaacaaccgcaagaacgaggagaacccgaacaagaaggagggcuacaacuucaagaacaucuacgagagcgacguguuccggaacgaggacguggccugggucuucagcaaggagaacaaggagaucaacaccaucaagaccgugaacaagaugguguaccgcaagaccgucaacaucacggagaugcugguggaggggaagggccagcuguucaaccucaccaucaaggaccggacccagcugaagaagaagguggggaacaucgucgccaacauccccaagucccucaagaaccgcaacaccaagcucaagagcgacgagcuggccaagaaguacggcuacuucgacucccucaacaacagcuacuucgugcuguucaaguacguggagaaggagaaggagaagaucggcuucgacgggaucacgaucgucgacaaggagaagcugaagaagaacuccgacaucgagcgguuccucgagaacaagggcaacaagaacgccaagcugauccgcaagaucuucaagaaccagaaggugcugaucgacggguaccccuaccuccucaagagcugcaacaaggacaaggcgauccgguucgacaacuucaagucccuguaccucgacgagaacgaccugaaguucacccgcgacgccaucaaguucgagaagaacaacgccgacaucgaccugaagaagcagaaguacaucaucagcuuccucaagaagaagaagcagaacgagaucaacgagaccuacgaggagugcaucgagcggcugaacaacgaguucgacacccuguuccucaaccugugcgacauccagaagucccccaucuacaagaacuacaagcugccggacuucaucagcaagaagaacguggucgaggugaaggacaaguucgagguguucaagaaccucgagcuguacaacaaguccaagcugaucaagaacuuccucaacuacuucaaguacgacaacaacaagcuggaccugaucgccaucggcaucgacagcaaggccaacugcauccagaagcacuucacggaggaccucaucaaggacuucgucaucguggacgaguccgugaccggccuguucgcgaagaaggagcgccuggaguga

SEQ ID NO: 2137 - RNA, 4209 nt, Artificial Sequence
  Cas9 variant
augaccuaccgcaacuaccacaucggccuggacaucgggaccagcuccgugggcuucgccgugcgguacgacaacggggagcucgugcacaagaagggcagcaaccuggugggggcccgccuguucaaggagggcgagacggcggaggagcggcgccucaaccggggcgcccgccggcgcuacaaccggcgcaaguggcggcugaaccugcucaaccagaucuucaagccccugaucgaggucaacgacccgaccuucuucaagcgccuggagcaguccaaccucgugaacuacgacaagagcgaguccuucagccugcugaacaaccaguccgacgacaagcuccaccagcaguuccccaccaucuaccaccuccgggacuaccugaugaaguccaccgagaaggccgacauccgccucaucuaccuggccgugcaccacaucgucaaguaccgggggaacuuccuggacgccagccccguggacagcuucgaggcguccaaccucaagguggacgagauccugacgcagaucaaccugcuccuggacaaccugaccgacgaccuccgccugaacacccaguacgucaccgacaucgagcagacgcugcucagcaacaccgaguccaacaaggacaaggagaaggugauccagaagcugcugcuccacaaggaggccaucaagaucgacaaggaccggaccgcccagaucgccaagcuggugcugggcuacaaggcggacaucgccaagcuguucgggaucaccgagaagcugcagacgcccaagcuggagcucagcgccgccaacuccgacgacgcccugauggagcugagcgcggagcucaacgaggaccagaucggcauccugcugcagcucaagacccuguacucccgcguccggcugaaccagaucaucccgagcgggaccucccucagcaagagcaugaucgagaaguacgagcugcaccacacccagcugaaguccuucaaggagaacauccuccugaagcugcgccggaacacggccgugcgccgcaaccuggagcucgccuacgcccuguacgugggcaacgcccagaccaagcaggaggucuucgagcccaagaaggcgcgguucaccagcgacgacuucgccucccugaaggccaacgccaagagcgccuccagcgugaaggaggcgcccaagaacaccaagacgaagcucaccaccgacgacuucuacaacauccugaccgagcuguucgccacguucgaguccgagcucagcgccgacgaggacaugaucaaggagguggagcagaucaagaaggccaucaccggcgacaacuaccugcccaagcagcgcaccgaccagaacgggaacaucccgcaccagcugcaccagaucgagcuccggcagauccugcagaaccagcugccccacuaccccgagauggacaagaucaacgagcagaagcccaucgagaagcucgucaccuuccgcgugccguacuacaucggcccccugaucacgcccgaggaccagcagaaguccagcgccgcgaacuucgccuggaugaagcggaaggagcagggggccaucacccccuggaacuucgacgacaagguggaccgcaugcaguccgccaccaacuucaucaagcggaugaccgucaaggacacguaccugaucaacgaggacgugcucccggaccgcagccugcuguaccagcgguucaaggugcucaacgagcugaaccuggucaaggugaacaaccagcuccuguccaucggcgagaagcaggcgaucuaccacgaccuguucgagaagcagaagaccgucagcaccaagaagcuccaguccuaccugcagagcgagcagggcuacggggacaacaucgagaucuccggccugagcaaccccgacaaguucaacaacgggcucaccacguacaucgacuucaagaacaucuucggcgaccugguggaggacaccaccaagcagaaggaguucgagcagaucaucgagugguccaccguguucgaggaccgcgccaucuucaaggccaagcugcaggaggucaacuggcucaccgaggagcagaucaaggcccugguggccaagcgguacagcggguggggccgccugagcuaccggcuccuggcggagcuggugaacgacaacggcgagcgcaucaucgacauccucuggaacaacaagggguccaaccugaugagcaucgucucccaggacgaguuccagcagcagaucgcccggaucaacagccacgaggugcaggagcugggcauggaguccgugcucgccaacgccuacacgagcccccagaacaagaaggccauccgccaggucaugaaggugguggacgacauccagcuggcgaugaacgggcaggcccccaccuccaucagcaucgaguucacccggaagccggaggagaacuccgagaucagcaagucccgcuacgagaccaucacgagcaucuaccagucccugagcaaggacaucgagaaggaggucaaggacaaccucaacaagaacaaguccagccugaagaagaaccuguccgacaaguacuaccucuacuucacccagcugggccgggacaucuacaccaaccagcccauccccuucaacgagauccccuacuacgacaucgaccacaucgugccgcgcagcguggagaugaacgacagccugaacaaccgcguccucguggccaaguccaucaaccagaucaagaagaacaacgcccccaucgacagcucccugaagaucaccagcgagacgcggcagcuguggaagaagcuccuggacuccgggcugaucaccaagcagaaguacuacaagcucagcuccagcaucaagaacaccgugucccccuacgucaagcagggcuucaucaaccgccagcugguggagaccagccaggugaucaagcuggucgccaacauccucggcacgaaguaccagaacgacgacaccgagaucaucgaggugaaggcgcaccugaacuccgagauccggaagaccuucgaguucuacaagcugcgcgagcucaacgacuaccaccacggguucgacgccuaccugaccacgcuggugggcggguaccucuacaaccgguaccccaagcugcgcagcuacuucgucuacggcgaccacaagcggcuggacaaggcccagcucuccgagcugaagaacuucaacuuccugcacgggcucaccaaccccaagagcggcuccgacggccugaucaccgccagcgggucccagcaggucgugcuggaccgcaacgagaccaucaagcggcucaacaagaucuaccgcuacaaguacaugcugaucagccgggagguguucacgaagcagggccaguucuacaacgagaccaucuacccggcgaagcccaacaccgccaagaugaucccgcugaaggacaacaagcccuccgagguguacgggggcuacagcagcuccaacgugagcaagaucgcccucaucaaggagaagaacaccgacaacuaccaguucaucggcauccccauccgcuccaucgccaagcugaagcaggccaaggcgaacagcaagacggucuaccagaccgagcugaaccgggugaucaaguccgugcucgccagccagaagaccaagaagcagaaggaguucgaggucauccuggacaacgugaaguacaaccagguggucguggaccagggggagaaguacuaccugggcucccccuacuacaagaagaacgccaagcagcucgugaucagcccggaguccgucaagauccuggccgacaaggccaccgcggaccugcccgagcaggaggcccacaacaagcucaugacgguguaccaggagaucguggacguccugaacaagcacuucgcccuguacgacaucaacaacgugcgcaagaagcucaacgacgggcugaucaaguucagccagcugcccaacuacgacgagaccuccaagaaccgguucgacaucagcaaguccaucaagaccaaguacgccgugaucaugcgcauccucagcggcaucaagaaccagaccuccgagguccccgagcuggggcucaagagcccgcugaacaagaugcagacgaagggcggcaucaagaucucccccgaggccaagaucuacuacagcucccccaccgggaucuucagccacuucaagcaggucaagaaccuguga

SEQ ID NO: 2138 - RNA, 4209 nt, Artificial Sequence
  Cas9 variant
auggagcgcauccugggccucgaccugggggugagcuccaucggcugggcccuggucgaggaggacgugaagaaccccgagaacaacaagaucaucaagcucggggugcgggucaacccgcugaccaucgacgagaagaccaacuucgagaagggcaagagcaucacgaccaacgccgggcgcaccuccgcgcggagcgcccgccggaaccugcagcgcuucaagcuccggcgcaagaagcugcuggagauccucauccacuacaagaucaucaagaacgacgccgugcuggccgagaccggcaagaacacgaccuuccagacccaguaccugcgggccaaggcggcccgcgagaagaucgagcucgacgagcuggcccgggugcugcuccugaucaacaagaagcgcggcuacaaguccagccggaagguccagaacgacgacgacgggaaggccaucgacggccuguccguggcgaaggagcucuacgagaagaacuacacccccgggcaguacgccuacgaccugcugaagcgcggcaagaagcagauccccgacuucuaccggagcgaccuccagaacgagcuggaccgcaucugggaguuccagaagcaguaccaccccgacauccugacggacgaguucaagaaggagcucgaggggaagggccagcgggccaccgccgccaucuuccugaaccgcuacaagaucuacaccgcggacaacaagggcacccgggaggagaagaagauccaggccuaccaguggcgcguggaggcccugucccagccgcucgacgucaaggagguggccuacgugaucgccgagaucaacaacaaccugaacaacagcuccggguaccugggcgcgaucagcgaccgguccaagaagcucuacuucaacgggcagacgaucggcgaguaccuguucgaggagcugagcgccaacccccacacccgccucaagaaccaggucuucuaccgccaggacuaccaggacgaguucgagaagaucuggaagauccagaccaaguuccaccccgagcugaccaaggagcugaaggagcagguccgggacaucgugaucuucuaccagcgcaagcucaagucccagaagggccugaucagcuucugcgaguucgagucccgggagaucgagaucgaggagaacgggaagcgcaagcggaagaaggugggccugaagguggcccccaagagcuccccgcuguuccaggaguucaagaucuggcagguccucaacaacaucgagaucaagaacgaggacgagcgccgguaccuggagcccgaggagaaggagcuccuguucaacgagcugaacugcaaggggaaccucacgagccagaagugccuggagcugcucggcuucaagagcaaggacgccaagcugaacuucaaggugguggaggggaaccgcaccaacgagaagcuguacgacgccuuccugaagauccucgagcugcagggcuacaacguguucgagcugcucaagaucaaggaggacaaggacgaggcgaagcuguccgagcugaaggccagcgccgacgagaucaagggcaugaucaaggagaucuucaacgccaaccucaucaacaccuccauccuggacuucaacgccgagcuggaggggaaggacuucgagaaccaggcgagcuaccaguucuggcaccucauguacuccuacgagggcgacaacagccccuccgggaacgagaagcuguacgagcugcucgagaagaaguucggcuucaagaaggagcacagcaagauccuguccaccaucgucuucagccaggaguacgggucccugagcacgaaggccaugcggcgcaucuaccccuacaucaaggacaacaaguacuccgaggccugccuccuggccggcuacaaccacagcaagcacucccugaccaaggaggagcucgagaaccggaagcugaaggagcagcuggaggugcucccgaagaacagccugcgcaaccccguggucgagaagauccugaaccagaugaucaaccucgugaacgcgaccaucuccgaguacggcaagcuggacgggguccggaucgagcuggcccgcgagcucaagaaguccgcccaggagcgggaggacauggccaagagcaucaacgaggccacccugcugcaccagaaguacgcgacgauccucaagcaggaguucggcguggugaaccccagccgcaacgacaucauccgguacaagcuguacauggagcugaccgucaacggguacaaggaccucuacaccaacaccaagaucgagaaggagaaccuguucacggacaaguacgacaucgaccacaucaucccccagagccgcuucuucgacgacuccuucagcaacaaggugcuggugccgcggcaguccaaccucgacaagggcaaccugaccgccuacgacuucaugagcaacaagggguccgagcgcgaggagcacuuccugaacgucaucaaggagcuccuggacaagggcagcaucuccaaggccaaguacgagaagcugaagaagaagggccucgagaucggggacggcuucaucgagcgcgaccugcgggacacccaguacaucgccaagaaggccaaggagauccuguucgagaucaccaacagcguggugacgaccuccgggcgcaucaccgacaagcuccggaaggacugggaccuggucaacaucaugaaggagcugaaccucgacaacuaccgccggcugggccugaccgagaucgugcgcaacagcaagggcgaggagaaggagcucauccccgacuggacgaagcggaacgaccaccgccaccacgcgauggacgcccugaccguggccuucaccacccggaaccacauccaguaccugaacuaccucaacgcccgcaaggacgagaagcacaaggagcaccagaacaucuacgccaucgagaacaucaucaccgaggucaucgagaagaagaacggguccaagacgcggcgcuucaaggcgcccaugaacagcuuccggcacgaggccaagcagcaccugaaggagauccuggugucccacaagaccaagaacaagguggucaccagcaacaucaacaagaccaagaagaagggcgggauccacaagaagacggagcucacgccccgcggccagcugcacaaggagaccguguacggguccaagaaguuccugcagagccgggaggagaagguguccgccaaguucgacuacgagaccauccucauggucgugaacccgauccaccgcaacgcccugcugaaccggcucaaggaguacggcaacgaccccaagaaggcguucagcggcaagaacgccaucaacaagaaccccguguaccuggacgacagcaagaccgacauccuguccgagaaggucacccucagcugguacgagaccggguacaccauccgcaaguccgugacgcccgacaacuucaaggacuacaagaaccuggagaagaucaccgaccugggcaucaagaagauccucaaggagcggcuggaccaguucaaggggaacgccaaggaggccuucagcaaccuggacaaggacccgaucuggcucaacgaggagaagggcaucgccaucaagaccgugaccaucacgggggucuccaacgcggagagccugcacuucaagaaggaccaccugggcaaggagauccucgacgagaacggcaacaagauccccggggacuucguguccaccggcaacaaccaccaccuggccaucuaccuggacgaggaggagaagcucgacgacaagauggugaccuucuacgaggccguccugcgcgugaaccaggggcugcccgugaucgacaaggacuacaacaaggagaagggcuacaaguuccucaugacccugaagcagaacgagauguucgucuuccccaacgaggacuucgacccgaacgagaucgaccugcucgacgagcggaaccuggagcgcaucagcaagcaccuguuccgcgugcagaagaucuccaaggugggguacggcaacagcuucguccgggacuucguguuccgccaccaccucgagacgaccguggaggagcggaaggagcugcgcaacaucaccuacauccagcugaagucccucgagggccugcggaacaucaucaagguccgccugaaccaccucgggaagaucgugcagaucggcgaguacuga

SEQ ID NO: 2139 - RNA, 4215 nt, Artificial Sequence
  Cas9 variant
augaccaagaacauccugggccucgaccugggggugagcuccaucggcugggcccugguccaggaggacagcaagaaccccgagaacaaccgcaucgugaagcucggggugcgggucaacccgcugaccguggacgagcagaucaacuucgagaagggcaagcccaucacgaccaacgccucccgcacccuggcgcggagcgcccgccggaaccuccagcgcuucaaguuccggcgcgccaaccugaucgacgugcugaagaagugcaacauccucaagcagggggaccugcugaccgagaucggcaagaacuccacguuccagacccaggagcuccgggccaagagcgccaaggagaaggucgagcuguccgacuucgugcgcgugcugcuccugaugaacaagaagcggggcuaccgcagcucccggaaggcgaagaacgaggacgaggggcagaucaucgacggcaugagcgucgccaagaagcuguacgaggagaaccucacccccggggaguacuccuaccagcugcugaucgagaacaagaagcagcuccccgacuucuaccgcagcgaccugcaguccgaguucgaccggguguggaaguuccagaagcaguucaacccggagauccugaccgacgaccucuacaaggagcugcagggcaagaacaagaacgccacgugggccgugcugaaggagcccuucagccucgucgggaucaagcagaucggcaccauccaggagaagaaggcggagaaguacuucuggcgcuccgaggccgugaagcggcagcuggacuucgagagccuggccguggucuuccaggagaucaacuccaaccucaacaacagcuccggcuaccugggggccaucagcgaccgcagcaaggagcuguacuucaacaaccagaccgugggcgaguaccucuuccagcagcugaaggagaacucccacaccaagcugaagaaccagguguucuaccggcaggacuaccucgacgaguucgagaagaucugggagacgcagagcaaguacuacaaggagcugaccaaggagcugaaggaggagauccgcgacaucaucaucuucuaccagcggaagcucaagucccagaaggggcugaucagcaucugcgaguucgagaaccgcgagaucgagaucaccgagaacggcaagaucaagaagaagaccgucggccugaagguggcccccaaguccagcccccucuuccaggaguucaagaucuggcagguccugaacaaccugguguuccaguccaucgagagcaaggagcuguucccgcuggaccuggacaucaaggaguccaucuucaacgaggugaacaucaaggggaaccucagcgcgaagaacgugcuggaccugaugggcuacuccgggaaggaguggaagacgaacuucaagaacaucgagggcaaccgcaccaacgagaaccuguacaccgccuuccucaagaucaucgccagcgaggggaucgaguuccccaaggaguucaagcuguccaucgacgacgacaucaaggucagcaagaucgacaucuccagcgagaagaucaaggaguucaucaaggagaacuuccugaagcucggcaucaacaccuccauccuggacuucaaccccgagcuggacggcaaggacuucgagaagcaggagagcuaccagcucuggcaccuccuguacuccuacgagggggacgacagcgccagcggcaacgugaagcucuacgagcugcuggagaagaaguucggguucaagaaggagcacuccaagauccucgccgacgucggcuucagccccgacuacgggucccugagcuccaaggcgaugcggaagaucuacccguacaucaaggagaacaaguacagcgacgccugccaccuggccggcuacaaccacuccaagaacagcuucacgaaggaccagcucgccaaccgcauccugaaggagcagcuggagauccuccccaagaacgcccugcggaaccccgugguggagaagauccugaaccagaugaucaaccucgucaacgaggugaucaaggcguacggcaagcccgacgagauccgcaucgagcuggcccgggagcugaagaagaacgccgaggagcgcgccaacaugaccuccgacaucagcaaggccacccuccugcaccagaaguacgcggaggugcugcagaaggaguucgggaucaaggccccgucccggaacgacaucauccgcuacaagcucuaccuggagcuggagaagaaccucuucaaggaccuguacaccgacguccagaucaagcgggaggagcuguucacggacaaguacgacaucgaccacaucaucccccagagccgcuucuucgacgacuccuucagcaacaaggugcucgugccccggggcgccaaccugaagaaggggaacuucaccgcccuggacuacauggagaucgagggcaaggagaagcucgagaaguuccugaacaucaucaaggagcuguucgacaagggggcgaucuccaaggccaaguucgagaagcuccagaagaagggcagcgagaucggcgagggguucaucgagcgcgaccugcgggacacccaguacaucgccaagaaggccaaggagauccuguucggcaucaccaacuccgucaucagcacgagcgggcgcaucaccgacaagcuccgggaggacuggaaccuggugaacaccaugaaggagcugaaccucgagaaguaccgcaagcugggccugaccgagcucaucgugaacuccaagggcgaggagaaggagcggaucaucgacuggacgaagcgcaacgaccaccggcaccacgccauggacgcgcugaccgucgccuucaccacccacaaccacauccaguaccugaacuaccucaacgcccgcaaggacgagaagcacaaggagcaccagaacaucuucgccaucgagaacacgaucaccgagaucguggagaagaagaacgggagcaaggagcgccgguucaagcugcccaucaagaacuuccgcaccgaggccaagaagcagcuggaggaggugcucaucucccacaaggcgaagaacaaggucgugaccaagaacaucaacaagaucaagaagaagggcagcaucaucgccaagaccgagcugacgccgcgggggcagcugcacaaggagaccaucuacggcuccagcaaguuccucaagaccaaggaggagaagaucuccgggaaguucgaccuggagaugauccagaaggugcagaacgagaaguaccgcaacgcccugcucaagcggcugcaggaguucggcggcgacagcaagaaggccuucaccgggaagaacgucaucuccaagaaccccaucuuccugaacgccgagaagacggagcagcuccccgagaccgugacccuggcgugguacgagaccggcuacacgauccgcaagguggucaaccccgacaacuucaaggacuucaagaacaucgagaaggugaucgacaagggggugcgggacauccugaccgagcgccucaaggaguucaacggcaacagcaaggaggccuucuccaaccuggagaagaacccgaucuggcugaacaagagcaaggggaucuccaucaagaccgucaccaucacgggcaucaacaacgccgaggcccuccacuacaagaaggaccaccugggcaaggagauccuggacgagaacgggcagcggaucgcgguggacuucgugagcaccggcaacaaccaccacgucgccaucuacgaggacgacaacgggaaccuccaggagaaggugguguccuucuacgaggccgucgagcgcgugaaccagaaccugcccaucaucaacaaggaguacaacuucgagcugggcuggaaguuccucuucaccaugaagcagaacgagauguuccuguuccccagcgacgacuucgaccccaaggagguggaccuguucgacgacaaguaccucucccugaucagcaagaaccuguuccggguccaguccaucagcaucgugcaguacgggaacagcgugauccgcgacuucaaguuccggcaccaccucgagaccuccgucagcgacgagaagaagcugcagggcgugacguaccagcagaucaagucccugcagccgcucaaggacaucaucaagauccgccugaacaaccugggcaagaucgugcagaucggggaguacuga

SEQ ID NO: 2140 - RNA, 4215 nt, Artificial Sequence
  Cas9 variant
augaagggcaacaucgagaagaagaagcaggaguucaacgacuacuaccugggguucgacaucggcaccaacagcguggggugggccgucuccgaccucagcuacaaccugcugcgcuucaacaagaaggacauguggggcgcccgccucuucgacgaggcgaagaccgccaaggaccggcgggugaagcgcaacucccggcgccggcuggagcgccggagcaagcgccugaaguaccucgaggagaucuucgagacggagaucugcaagaucgacaagaacuucuuccggcgccuggaggaguccacccugcacaacgaggacaagaccuucgacuuccgguuccccaucuucaacgacgagaacuacaccgacaaggaguacuacaaggacuucccgacgguguaccaccuccgcaacgagcugaucaagaacgagaacaagaaguucgacauccggcugaucuaccucgccauccacaacauccugaaguaccgcgggcacuucaucuucgagggccaggacuucgacagcgucaccgacuucaaggagguguucuccgagcugagcgccuaccucuccgagaaccuggaggagaaccuggacaucaaccucugcgacaacaucaaggacaucaucugcagcaaggagaacaagaccuccaagggcaagagcuucgugucccugaucgacagcaaggucauccaguccgugcugcggugcugcaucggguaccgcgugaaguucaaggacaucuucaucaacuacgaggagaaggagaagaacgagggcaucaaccucagcgagaucgaguacgacgagaagcgggacgagaucgcccugucccugggggagaacauccuccugaucgacaucugcaagaaggucuacgacuucaugauccugaacaacauccucaagggcaacaaguacaucagcgaguccaaggugaaccuguacgacgagcacaagugcgaccugugcaaccucaaguacaucuucaagaaguaccugcccaagaaggacuacuucgaguucuuccgcaacgagaacaaggagaagaacuacgugagcuacaucagcuccagccugaacaacgggaagaagaagaacacgugcacccaggaggaccucaacaaggagaucaaggaguacaucgcgaagaucaaggaguacgaggagaacgacgccguccuggagaagaucaaccugaagcucaacgagaacaagcugcugcccaagcucaagaccaacgacaacggcgugauccccuaccagauccacaagaucgagcuggagaagauccugcagaaccaguccaaguacuacgacuuccuccuggagaagaucgacggcaucaccaacaucgagcggaucgagaagcuguucaccuuccgcaucccguacuacaucgggacgcucaagggcaaguucagcugggccaagcugaaggagaacaagaagaucacccccuggaacuucgagaagaucguggacauggaggaguccgccaaggcguucaucgagcgcaugagcaaccggugcuccuaccugaagaccgagaacguccuccccaagaacagccugcuguacuccgaguacgagcugcucaacgagcugaacaaggugaagaucaagaacgaguucaucaacgugguccugaagaacgagaucaucgacgagcuguucaagaccacgagcaaggugaccaagaagaaguucguggacuaccugaagaccaagcagaucuucgucgagaaggaggacaucuccgggcuggacaacgaguucaagagcaagcucgacuccuacaucaaguucaagaaggugaucggcgacaagaucgacacccugcgcggcuacaacuucguggagaagugcaucgaguucaagugcuucuacggggacgacaagaagcuguucaagaacgccaucaacaacacggaguucaaggacuacgucagcgacgacgagcucaagaagaucaacaagaugaaguucaacaaguggggccggcuguccaagcgccugcucaccgagaucugcuucgagaacgugaucgagagcgaguccuucgagaacaucaucgucgcccugcggagcaccaacuacaacuucauggaguucaccuccaagaaguucaaccugagcgagaagguggccgaggagaaccaggagaacacgcucgagaaguucaacaucaacgaguacguggacgagcuguacgucagccccuccgugaagcgcagcaucauccagaccuacaagaucgccauggagaucaagaagaucaccgggaagaacccgaagaagaucuucaucgagauggcgcggggcgggggcgagaagggcaagaagaccgagaagcgcaaggagcggaucaagacgcuguacgccaacaugaaggacuccaacgaggaguuccucaacaaccuggacaaccugaagcucagcguggacaacuacgacgacaaccgccugcgggagaagaagcuguuccucuacuucaugcagcuggggaaguccauguacaccggcaagaacaucgaccugaacgagcuccuguucgccaacaccuacgacaucgaccacaucaucccccagagcaagcugaaggacgacuccuucgacaacaucguccucguggagaagaccaucaacaaggacaaggacaaccgcgacuaccuggacgagagcauccggcugcgcaugaacaaguucuggaacuuccuccgggagaagggguucaucacgaucgagaaguacaaccgccugcggcgcaacaccuacuucuccgacgacgagcugagcggcuucaucucccggcagcucgugaccacccgccagagcacgcuggaggucaagaagcuguucgaguucaucuuccagaacaccgacguggugugcuccaaggccaaccucgucagcgacuuccgcgagaaguacgggaucaucaaggugcgggaccugaacgacgcccaccacgcgcaggacgccuaccugaacaucguggucggcaacguguucgacaccaaguucaccaagaacuacuggaaguucaucgaggaccgccggaagguggacaacauccgcgagaccuacaacuucaagaagaucuucgacuacgacgucucccggggcgagaacguggccuggcucaaggacuacagcaucaacacgaucuccgagaugaucaacaagaagaccgccaacaucacccagaugaucaccgaggggaagggccagcuguucgaccugacgauccucaagaaguccaagaucgacaagaagcugaccgugauccccaacacccccaagauccucaagagcagccucaaggacagcugcaagaucgccgagaaguacggguacuucuccacccugaugccggcguacuucgucguguucaaguacaucgacaagaacaaggagguguucggcuucgaccgcaucuucaucuucgaccgggagaagaucaacagcaacgaggacaucgagaaguaccuggaggacaagggguacaacucccccaaguucauccgcaaggucaaccucaagcagaagauccugcugaacggcuaccccuaccggaucgugggcuucacggacaacaagcucgagaucaagaacagcaagcaguucuacuccgacggggagcaccugaaguacaucaagcaccugagcgccuucuacaacaacaacaacaacgugaagaacggcgaguaccgcaucaacuuccucaagaagaccuccgagaacgaccggaacgagaccaccgacgaggccaaggagcgccugaacaucgaguucaucaagcuguacgaguacuucugcgagcggcucaacagcaagaucuacgccaacuacuacaacuccaagaaguacgacgagcugaucgaggucuucgacugcuucaagaaccugaaccuccuggacaaggccaagcugcuccuggaguuccugaagaucuucaagaaggacacguacgggaacuucaagcuccuggagaagcccgagcuggacaagaacggcaagcagaagcucgacaagaacggcaaccugagcuucgaggggcuguccauggcguucggcaagcucaacgggaagaaguucaagcagcugguggagaaggacauccaguucguggacgagagcgucaccggccuguucgagaagaaggaggggcucgagaaguggcaggacggcgagcaguga

SEQ ID NO: 2141 - RNA, 4215 nt, Artificial Sequence
  Cas9 variant
auggccaagaagauccugggccucgaccugggggugagcuccaucggcugggccaucgucgaggaggacgcggagaacgugaugaacaacaagaucgugaagcuggggguccgcgugaacccccucaccguggacgagcagaucaacuucgagaagggcaagccgaucaccacgaacgccgggcggacccugguccgcggcgcccggcgcaaccugcagcgguucaagcuccgccggcugcaccugaucgacauccuccagaagcgcaacauccugaagcaggccgaccugcucgccgagagcggccggaacuccaccuuccagacccaggagauccgcgccaagagcgcgaagcagaagguggagcuguccgagcuggcccgggugcuccugcugaucaacaagaagcgcggguacaagagcucccggaaggccaagaacgaggacgagggccagaucgucgacgggaugagcguggcgaagaagcucuacgaggagaacacgacccccggcgaguacuccuacgagcugcucaagagcgggaagaagcagcucuccgacuucuaccgcagcgaccugcaggccgaguucgaccggguguggaacuuccagaagcaguucuaccccgagaucuucuccgacaaccuguacaaggagcuccagggcaagaacaagaacgccaccuggaagauccuggagauccccuucagccuggucggcaucaagcaggucgggaccacgcaggagaagaagaucgagaaguacuucuggcgcuccgaggccgugaagaagcagcucgacuucgagagccuggccgugguguuccaggagaucaacuccaaccugaacaacagcuccggcuaccucggggcgaucagcgaccggagcaaggagcuguacuucaacaaccagaccgugggcgaguaccugcacugccagcucaaggagaacccgcacaccaagcugaagaaccaggucuucuaccgccaggacuaccuggacgaguucgagaagaucugggagauccaguccaaguaccacaccgugcucacgaaggagcugaaggaggagauccgggacgugaucaucuucuaccagcgcaagcucaagagccagaagggccugaucuccaucugcgaguucgagaaccgggagaucgagaucaccgagaacgggaagaucaagaagaaggaggucggccugaagguggcccccaagagcucccugcuguuccaggaguucaagaucuggcagguccugaacaaccugcaguuccagaacaucgagagcaaggagaucuucccccucgaccuggacugcaaggaguccaucuucaacgaggugaacaucaaggggcgcaucagcgccaaggccgugcuggacguccucggcuacuccgggaaggaguggaagaccaacuucaaggacaucgagggcaacaacagcaacgagaaccuguacaacgccuaccugaagaucaucgcgaacgagggcaucgaguuccccaaggaguucaagugcaaccuggacgacgacaucaacguguccaagaucaucugcagcgccgggaagaucaucgaguucgugcgcgagaaguucuccgagcucggcaucaacaccagcauccuggacuucaacuccgagcuggaggggacgaacuucgagaagcagaaguccuaccagcucuggcaccuccuguacagcuacgacggcgacgacagcccguccgggaaccagaagcuguacgagcugcuggagaagaaguucggcuucaagaaggagcacagcaucauccucgccgacaucggcuucccccaggaguacgggagccuguccaccaaggccaugcggaagaucaucccccaccugaagaccggccuccccuucgccaagaaguccgacaacgacaccauccugagcgcgacggccauggccggguacaaccacagcaagucccugaccaccgaggagcucaccaagcgcguccugaaggagcaccuggagauccucccgaagaacagccugcggaaccccgugguggagaagauccugaaccagaugaucaacgucgugaacgaggugaucaaggaguacggcaagcccgacgagauccgcaucgagcucgcccgggagcugaagaagaacgccgaggagcgcgcgaacaugacguccgagaucgggaaggccaccauccagcaccagaaguacagcgagauccugcagaaggaguucggcaucaagucccccagccggaacgacaucauccgcuacaagcucuaccuggagcuguccaacaacggcuucaaggaccucuacaccgacauccagaucaagcgggaggagcuguucaccgacaaguacgacaucgaccacaucaucccgcagagccgcuucuucgacgacuccuucagcaacaagguccuggugccccgcggggccaaccucaagaagggcaaccugacggccuucgacuaccuggaguccgaggggaaggacacccucgagaaguucaucaacaccaucaccgaguucuacgacaagggcaucaucacgaaggcgaaguacgagaagcugcagaagaagggcaccgagaucggggacggcuucaucgagcgggaccugcgggacacccaguacaucgccaagaaggccaaggagauccucuucgggaucaccaacagcguggucuccacgagcggccgcaucaccgacaagcugcgggaggacuggaaccuggugaacaccaugaaggagaugaaccucgagaaguaccgcaagcgggggcugaccgagaccgugaucaacagcaagggcgaggagaaggagaagaucaucgacugguccaagcgcaacgaccaccggcaccacgccauggacgcccugacggucgcguucaccacccacaaccacauccaguaccucaacuaccugaacgcccgcaagaacgaggaccacaagcagcacaaggugaucagcaacaucgagaaccugaucaccaagguguucgagaagaagaacggcuccaagcagcgccgguuccucgagcccauccacaacuuccgcaucgacgccaagaagcaccuggaggagauccugaucagccacaaggccaagaacaaggucgugacgaagaacaucaacaagaucaagaagaagggguccaucaucgccaagaucgagcucacgccccggggccagcugcacaaggagaccaucuacgggagcuccaaguaccugaagaccaaggacgagaagcucagcggcaaguucgaccuggagaccaucaacaaggugcagaacgagcgcuacaagaacgcgcugcucgagcggcugaaggucuucggguacgacuccaagaaggccuucaccggcaagaacauccuggccaagaacccgaucuuccucaacaucgagaagaccgagcagcugcccgaggugcugacccucgccugguacgagacgaucuacaccauccgcaagagcaucaacuccgacaacuucaaggacuacaagaacaucgacaaggugaccgacaagaagguccacaacauccugaccgaccggcugcgcgaguucaacggcaacagcaaggaggccuucuccgaccucgagaagaaccccaucuggcugaacaagcccaaggggaucgcgaucaagacggugaccaucaccggcgugaacaacgucgaggcccugcacuacaagaaggaccacuucgggaaggaguuccucgacgagaagggccacaagaucccgguggacuucgugagcaccgggaacaaccaccacgucgccaucuacgaggacacggccggcaaccugcaggagcgggugcuguccuucuacgaggcgguggagcgcgucaaccagggccucagcgugaucgacaaggaguacaacuccagccugggguggaaguuccuguucaccaugaagcagaacgagauguuccucuuccacuccgaggacuucaacccccaggagaucgaccuguacgacgagaagaaccugcggcucaucagcaagaaccuguuccgcgugcagaaguucaccgucaaggacuacuucuuccggcaccaccuggagaccaacguggaggacaacagcaagcucaagggcgacacguggaagcgcgaggggcugaacggcauccgggggauccugaaggugcgccucaaccaccugggcaagaucguccaggugggcgaguacuga

SEQ ID NO: 2142 - RNA, 4215 nt, Artificial Sequence
  Cas9 variant
augagcaagaagauccugggccucgaccuggggaccaccuccaucggcugggccuucgugcgcgaggccgaggacuuccaggaggagagcuccaucgagcggaucgggguccgcgugaacccccugacgaccgacgagcagaucaacuucgagaagggcaagccgaucagcgugaacgcggaccggacccucaagcgcggggcccggcgcaaccugcagcgguacaagcagcgccggaccaaccugauccagcuccugaagcaguacaagaucaucaacgagaacacgauccuggccgaggacgacaagaacaccacccacuccaccuacgcccuccgcgccaaggcggucagcgagaagaucuccaaggaggccuucgcccgggugcugcugaugaucaacaagaagcgcggcuacaagagcucccggaaggccaagaacgaggacgagggccaggcgaucgacgggaugagcguggccaagcgccucuacgaggaggacaucacgcccggccagcugugccugcagcuccugaaggaggggaagaagaagcugcccgacuucuaccucuccgaccugcaggccgagcuggagaagaucuggaacuuccagaagaaguucuaccccgagauccucaccgacgaguucaagaaggagaucgagggcaaggggcagcgggccaccagcgccuccuucugggcgaaguacaaguucaacaccgccgagaacaagggcagccgcgacgagaagaagaugcaggccugggaguggcgguccaaggccaucaacacgcagcugacccgcgaggaggucgccuacgugaucaccgagaucaacaacaacaucaacaacagcuccggcuaccugggggcgaucagcgaccgguccaaggagcucuacuucaacaaggagaccgugggcgaguaccuguuccgccagcugcgguacagcccgcacacgcgcgucaagaaccagguguucuaccgccaggacuaccucgacgaguucgagaccaucugggagaaccagagccgguaccacaacgagcugaccaacgagcugaaguccgagauccgcgacguggucaucuucuaccagcggaagcucaagagccagaaggggcugaucuccuucugcgaguucgagagcaagcagaucgagauccagaaggacggcaagaucgugaagaagaucaucggccugaaggugucccccaagagcagcccccucuuccaggaguucaagaucuggcagauccugcagaaccuggaguucaccaacaaggagacgaaggagaagaagguccccgacuucgaggccaagaaccuccuguucgaggagcugaacaucaaggggaaccucaagggcgagaaggccaucgagauccugggguacaagccgaaggaguggcuggugaacuacaaggagcucgacggcaaccgcaccaaccaggugcuguacgagggguaccugaagauccucgaggucgagggcuacgacaucaaggaccugcugaagaucaaguccaacaaggacgaggugaaccucuccgagcugagcaagcccguguccgagaucaaggaccugaucaagagcaucuucgagucccugaacaucaacaccgccauccucgacuucaaccccgagcuggagggcaaggacuucgagcggcaggccagcuaccagcuguggcaccuccuguacuccuacgagggggacaacagcaacaccggcaacgacgagcuguaccgccuccuguaccagaaguucggguucggcaaggagcacgcgcagauccuggccaaccucuccuucagccaggacuacgggucccugagcgccaaggccaugcggaagaucuaccccuucaucaaggagaacagcuacuccgaggccugcagccuggcgggcuacaaccacuccagcuccaucacgaaggaggagaacgacaagcgcgagcucaaggagaagcuggagcugcucccgaagaacagccugcggaaccccgucguggagaagauccugaaccagauggugaacgucaucaacgccaucaucgccgaccccuccaugggccgccccgacgagauccggaucgagcucgcccgcgagcugaagaagaacgcggccgagcgggccgagaugaccauccacaucaacaaggccaagagcgagcacgacaacuaccgcaagauccugaccaccgaguucgggaucccgaaccccacgcggaacgacaucauccgcuacaagcucuacgaggagcugaaggugaacggcuacaagacccuguacuccaacaccuacaucccccgggagaagcuguucagcaaggaguucgacgucgagcacaucauccccaaggcccuccuguucgacgacuccuucagcaacaagaccaucugcgcgcgccaggagaaccucgacaaggggaacaagacggccuucgacuucauccaguccuucuacggcaaggagaaguucgaggaguaccugcagcggaucgagagccuggccaagaucaaggagggggacaccuucgugaucuccaaggccaaguacaagaagcuccugcugccggagaucgagaucggcgagggcuucaucgagcgcgaccuccgcaacagccaguacaucgccaagaaggcgaaguccaugcugcuggacaucugcaagaccgugguccccaccacggggagcaucaccgaccggcuccgcgaggacuggggccugaucaacaucaugcaggagcugaacuucgagaaguacaagaagcucgggcugaucgagaugguggagaagaaggacggcagcuucaaggagcggaucaccgacuggaccaagcgcaacgaccaccggcaccacgccauggacgcccugaccguggccuucacgaagcacaaccacauccaguaccucaacuaccugaacgcccgcaagaacgagaaccacaagaugcacggcaacgucaucgcgaucgagcagaaggagaccgagcugcucguggacuccguggggaagcggaagcgcaaguucaagcugcccaucagcaacuuccgggaggucgccaagaugcaccuggagaacauccucguguccuacaaggccaagaacaagguggccaccaagaacaagaaccgcuucaagaccaagaacggcgagaaggucaagaucgagcugacgccccgggggcagcugcacaaggagaccguguacggcaagaugaagaaguacgagaccaaggaggagaucaucgggagcaaguucgacgaggcgaccauccucaagguggccaaccuggagcagcgcaacgcccugcuccagcggcugaaggagaacaacaacgacccgaagaaggccuucuccggcaagaacagccugaaguccaacccccucuacuacggcgucgacagcaagcccauccccgagcgcaucaagaucguguggcuggaggacgacuacacgauccggaaggagaucaccccggaccugaagaucgacaaggugaucgacaucgggauccgccggauccucgagaaccgccuggccgaguucaacggcaacgcgaaggaggccuucuccaaccuggagaagaaccccaucuggcucaacgaggggaagcggaucgccaucaagcgcgucaccaucagcggcgugaagaacgccgagacccugcacuacaagaaggaccaccuggggcacgagaugcucgacaagcagggcaagcggauccccguggacuucgucuccacgggcaacaaccaccacguggccaucuacaaggacgacaagagcgaccugcaggagaagguggucuccuucuacgaggcgguggagcgcaucaaccaggagcugccgaucaucgacaagagcuucaaccacgaccucggguggcaguuccuguucaccaugaagcagaacgaguacuucguguucccccgcgacggcuucgaccccuacgagaucgaccugcucaaccccgacaacuacaagaucaucuccccgaaccuguuccggguccagaagaucgccaccaagaacuacguguucaaccaccaccuggagaccaaggccguggacggggagcuccugaagacgaagaaggaccugagcgacaucaccuaccgcuucauccagacccccgucaaccucaagaacaucaucaaggugcggaucaaccacaucggccagaucgugaagaucggggaguacuga

SEQ ID NO: 2143 - RNA, 4218 nt, Artificial Sequence
  Cas9 variant
augaagaccauccugggccucgaccuggggaccaacagcaucggcugggcccuggugaaggaggccgagaacuccaacgagaaguccgagaucaucaagcucggggugcgcgugaacccccugacgguggacgagaagaccaacuucgaggcgggccggccgcugagcaccaacgccgaccgcaccgccaagcggagcgcccgccggaaccuccagcgcuacaagcugcggcgcaagaaccugaucgaccuccugaucaagaaccagcugaucgacaaggacacgccccucaccgagaucgggaagaacaccacccaccagacgcuggagcugcgggccaaggcggcccgcgagcggaucgagcucgaggaccuggcccgcgucuuccuggccaucaacaagaagcggggcuaccgcuccagccggaaggugaacaacgaggaggagggccaggcgguggacgggauggccgucgccaagaagcucuacgacgagaaccugacccccggccaguacgccuacgagcugcucuccaaggggaagaaguacgugcccgacuucuaccgcagcgaccugcaggccgaguucaacgcgaucugggaguaccagaagcaguucuacgccgacauccuggacgacgagcucuacaacgcccugaagggccaggggcagcagaacucccggaagcgcuuccuggccaucaagggcguguacaccgccgagaacaagggcaagcgggacgacgucaagcuccgccacuacaaguggcggagcgaggcgaucuccaagaagaucaacaucgaggagguggccuacgugcuggucgagaucaacaacgaccugaacaagagcuccggguaccucggcgccaucagcgaccgcuccaaggagcuguacuucaacaaggagaccgugggggagaaccuguggaagcagauccagaagaacccgcacacgagccucaagaaccagguguucuaccgccaggacuaccuggacgaguucgagcagaucugggagacccaggcccaguuccacccccagcugacccucgcccugaaggagcagauccgggacgucaucaucuucuaccagcgcaagcugaagucccagaagggccuccugagcuucugccaguucgaguccugggagaucgagcggaaggacgagaacggcaacgugauccugaacaagaccacgcagcuccccaagcgccagaccguggggcggcgcgucgcgcccaagagcagcccgcuguuccaggaguucaagaucuggcagaacaucaacaaccuggaggugaccaagaucuccgagggcgccagcaagaacaagaaggagaccgagacgcucuccgacgacgagcggaagcugcuguucgaggagcucaaccugcgcgggaaccugagccagaaggaggugcugcagauccucggccugaaggacaaggaguacaagaccaacuucuccgaggggcuggagggcaaccggaccaacgccgcccucuucaacaucuaccagcagaucgccgagaacgagggcuacggguucgacuggagcaagaaguccgcgcaggagaucaaggaggagcugaaggccgucuucccccagaucggcauccaggccgacauccuggacuucaacgccaaccucgacgggaaggaguucgagaaccaggcgagcuaccagcuguggcaccuccuguacuccgccgaggaggacgacaagaucaacgaggaggaccagaucaucuacggcaacagcgccgugucccugaagaagaagcugugcgagaaguucggguucacccccgaguacgccaaguggaucgccaacgugagccuccaggacgacuacggcaaccuguccacgaaggcgaugcgcaagaucauccccuaccugaucgacggcaacgacuacagcgaggccugcgcccucgccggguacaaccacuccaacagccugaccaaggaggagaacgacaaccgggagcugcucgacaagcuggagcugcucccgaagaacucccugcgcaaccccgucguggagaagauccugaaccagauggucaacguggugaaccaggucaucgagaccuacggcaagcccgacgaggugcggaucgagcucgcccgcgagcugaagaaguccgcggagaagcgggccgagaugaccaagagcaucaacgaggccacgcgccggaacgaggacaucaagaagcugaucaccaaggacuucgggauccccaacccgaccaagagcgacgugguccgcuaccggcucugggaggagcuggcgccccuggccuacaaggacguguucaccggcaagcagaucaagaaggaggaccucuucagcuccaagaucgacaucgagcacaucauccccaaggcccugcuguucgacgacagcuucuccaacaagacgcucguguuccgcgagaccaaccugaagaaggccgaccgcaccgccuacgacuucaucgagagcgacuacaacgccacccuggacgacuacauccagcgggucgagacgcucuacaacaacaccaaggggaccaucuccaagggcaagcgcaacaagcugcugauggcgcagaagaaccuccccgacggcuucaucgagcgggaccugcgcaacagccaguacaucgccaagaaggccaaggccaugcuguaccagguguucaaggacgugaacgucaccuccgggagcaucaccgaccggcuccgcgaggacugggaccugaucaacgugaugaaggagcugaacuucccgaaguacaaggcccucggccugacggagaucgaggagcgguacgacaucgggcaggagaagaccaagcgcguggaggucaucaccgacuggaccaagcggaacgaccaccgccaccacgcgaugaacgcccugacgguggccuucaccaccuccagccacauccaguaccucaacuaccugaacgcccggaagaacgagucccacaaggagcacaagaacaucaagggcaucgagaacaagaucacccacaagcagaaggacaagcgcaaguucaucccgcccaugcccaacuuccgggaggaggccaagaagcacaucgagacgauccuggugagcaucaagaacaagaacaaggucuacaccaagaacaucaacaagaccaagaagaaguccggccacaacaccaaggagcagcucacgccccgcgggcagcugcacaaggagaccguguacggcaagagcaagcggcccauguccaagcccaccaagaucaacaagaacuucagccuggagcaggcgcagcucaucaucaacgugcaggagaaggagcugguccugcgccaccucgcccaguucgacaacaaccccgccguggccuucgacaccaagacgcugaagaagaugccgcugcucaagaacggggagccccugaaggaggugcugugcuucgaggagaucuucaccauccggaaggacaucacccccgaccucaagaucgagaaggucguggacgagaagaucaaggccauccuggagcagcgcaagaaggacuucggcgggaacgcgaaggaggccuucuccgaccuggacaagaacccgaucuggcucaacaagaagaagggcaucugcaucaagcgggugaccaucacgggcgucagcaacgccgaggcccugcaccaccagaaggaccaccuggggcgcgagauccucgacgacaacggcaaccccauccccgcggacuucgugagcaccgggaacaaccaccaccuggccguguaccuggacuccgagggcaagcuccaggacaacaucgucagcuucuacgaggccguggugcggaccucccaggggcugcccgucguggacaagggccugaacaaggaccucggcuggaaguuccuguucagccugaagcagaacgagauguucguguucccgaacgacgacuucgacaucaacgacuucgaccuccuggacgacaagaaggccgagcugaucuccaagcaccucuaccgcguccagaagaucagcaagguguccgccgggaacagcuucgugcgcgacaucgucuuccggcaccaccuggagaccacggugaaggaggugaaggagcugaaggacaucuccuacauccagcucaagagccuggagggccugcgcaacaucaagaagguccggaucaaccacaucgggaagaucguccaggugggcgaguacuga

SEQ ID NO: 2144 - RNA, 4221 nt, Artificial Sequence
  Cas9 variant
auggagaagaagaucaucggcaucgaccugggggugaccagcaucggcugggccuacgucaucgaggacgagaacgggcacucccgcauccuccggaucggcacccgcgugaacccccugacgaccgaggagcugaagaacuucgagcaggggaagccgaucaccgagaccgccgagcggacgcucaagcgcagcaugcggcgcaaccugcagcgguacaagcagcgccggaccaaccugaucaacgugcuccugaagaacaagcugaucaccgagaccacggcgcucgccgaggacggcaagggcaccacccaccugacccacgcccugcgcgccaaggccgcguacgcccagaucccccucgaggacuucgcccggguccugcugaugcucaacaagaagcgcggguaccgguccagccgcaaggugaagacggaggccgacggccaggcgaucgacgggauggccguggccaagaagcuguacgaggagaacaucacccccggccagcugugcuacacccuccugcugcaggggaagaagacccuccccgacuucuaccgguccgaccugcaggucgagauggagaagguguggacguuccagaagcaguuccaccaggccauccugaccgacgaguuccgcaaguacaucgccggcaagggccagcgggcgaccgccgccagcuucugggggaaguacggcuucaacaccgccgaguucaaggggucccgcgaggagaagaagcucaagagcuacgaguggcggucccaggccaucacgaccccgcugagccaggaggagguggcggccgucaucaccgacaucaacuccaacaucgccaacagcuccggcuaccugggcgccaucagcgaccgcuccaaggagcuguucuucaacaagcagaccguggggcaguaccaguacaaccugcugcagcagaacccccacacgaaccucagcggccagguguucuaccggcaggacuaccuggacgaguucgagaccaucugggagacccaggccaccuuccacacgaugcugacccccucccucaaggaggagauccgcgacaucgucaucuucuaccagcgcaagcucaagagccagaagaagcugguguccaucugcgaguucgagaagcggauccucgagccccugcagggggacaagguggucggcuacaagguggcgcccaagagcagcccccuguuccaggaguucaagaucuggcaggcccucgggcgcauggagauccagcacaaggugaccaaggagcggcacuuccuggaccuggacgccaagcagcuccuguucgacgagcugaacgucaagggcgaccucaccaaggagaacgcccugacgauccugggcuucaagcccaaggagugggagugcaaccuccugaagcuggaggggaaccgcaccaaccaggcccuguacgaggcguaccucaagauccuggagcuggagggcuacgaggugaaggaccuccuggggcugaagcucgacaaggacgacaucaagcuguccgagcugcccguggacgccgccgacaucaagaagaugguccgggagaucuucgagacccucaacaucaagaccagccugcuggacuucaacgccacgcucccgggcaaguccuucgagcagcagcacgcguaccagcuguggcaccuccuguacagcuacgagggggacaacucccccagcggcaacaagaagcugcaggaccugcuccaggccaaguucggcuucaccaacgcccacgggcagauccuggccaacgugucccuggagaccgacuacggcagccucuccgccaaggcgauccgcaagaucuucacccacaucaaggagaaccacuacagcgccgccugcgcccuggccggguacaaccacuccagcuaccuguccaaggaggagaacgagcagcggauccucaaggaccgccugaccauccugcccaagaacagccuccggaaccccguggucgagaagauccugaaccagcugaucaaccuccugaacacgaucuucgacgacccguaccugggcaagcccgacgagauccgcaucgagcucgcgcgggagcugaagaagaacgugcaggagcgccagcggcugaacaccgagaucaccaagaacaacaccgagcacgagcgcaucacgaagauccucaucaaggaggacaacaucaagaaccccacccggaacgacaucauccgcuacaagcuguaccaggagcugaagcacaacggguacaagacccucuacuccaacaccuacaucccccgggaggagcuguucggcaagaacuucgacaucgagcacaucaucccgcagagcauccuguucgacgacuccuucagcaacaagacgcucugcguccgcaaggagaacaucgacaaggccgaccggaccgccauggacuucaucggccccuacuucggggaggacaaggugcaggaguacaucaaccgcguggagaugcugcaccagaucaaccugaagaaccccgaggagggcaucgggaagggcaaguacaagaagcuccugaugaaggccuccgagaucggccagggguucaucgagcgcgaccugcgggacacccaguacaucgccaagaaggcgcgccagaugcuccuggaggucacccggacggugguggccaccaccggcagcaucaccaagcgccugcgggaggacugggggcucgucaacgugaugcaggagcugaacauggacaaguaccgccagcagggccugacggagcucaucgagaagaaggacgggagcaccaaggagcggaucaccgacuggaccaagcgcaacgaccaccggcaccacgccauggacgcccugacgaucgcguucaccaagcacucccacauccaguaccugaacaaccucaacgcccgcaagagcgacgacaagaagggcaaggagaucuucggcaucgagcagaaggagaccgagaaggugaaggacgacaccgggcagacgcagcggcgcuucaagcugcccaugccggacuuccggcaggccgccaagcaccaccuggagcaccuccugaucuccuucaaggccaagaacaaggucuucaccaagaacaagaacaaguacaagaccaagaacggcgagcaggucaagcuggagcucaccccgcgcgggcagcugcacaaggagacgaucuacggccggaucaagaaguacgugacccacgaggagaaggugagcuccaaguucaacgcgcagcugauccagaccguggccaacagcaaguaccgcuacgcccuccugaagcggcuggaggagaacgggaacgaccccaagaaggccuucaccggcaagaacucccucgacaagacgccccuguucguggacgccacccagcaggagaagaucccgcccgucgugaagcuggugagcaucgagcagggcuacaccauccgcaaggacaucacccccgagaacuucaaggacgcgaaguccaucgagaagaucgucgacguggggauccggaaccuccugcaccaccgccuggagacguacaacggcaacgagaaggaggccuucuacaaccucgacaagaacccgaucugggugaacgagagcaaggggaucugcaucaagcgggucaccaucaccggcgugaccaacgccgagccccugcacuacaagcgcgaccaccacgggaagcccauccuggacaacaacggcaaccgcacccccgccgacuucguguccacgggcaacaaccaccacgccgcgaucuaccgggacgccgccgggaaccuccaggacaacgucgugagcuucuacgaggccguggcgcgcgucaaccagggccugccgaucaucgacaagucccugaacaaggagcucggguggcaguuccuguucagccugaagcagaacgagugcuucguguuccccaacgagggcuucgacccccucgagaucgaccuguacaaccccgccaacaacaagcugaucgccgccaaccucuuccgggugcagaacuucucccgccugcaguacgggaacaacaucauccgggacuacaacuuccgccacaucuacgagaccagcgucgagaaccggaaggagcugaaggacaucgccuacaagcaggucaagucccucccgaucuucgagaagaucaucaaggugcgcaucaaccacaucggccagaucgugaagaccggcgaguacuga

SEQ ID NO: 2145 - RNA, 4224 nt, Artificial Sequence
  Cas9 variant
augauccgcaacauccugggccucgaccugggggugagcuccaucggcugggccuacguccaggaggacagcaagaacuccgagaacaaccggaucaucaagcugggggugcgcgugaacccccucaccgucgacgagcagcugaacuucgagaagggcaagccgaucaccacgaacgccgggcggacccuggcgcgcagcgcccggcgcaaccuccagcgguucaagcugcgccgguccaaccugauggacgugcucaagaagaacaacauccugaaggagaccgaccugcucgccgaggugggcaagaacagcaccuuccagacgcaggagcugcgcgccaaguccgccaaggagaagaucgagcugagcgaguucgcgcggguccuccugcugaucaacaagaagcgcggcuacaaguccagccggaaggccaagaacgacgaggacgggcagaucguggacggcauggccguggccaagaagcuguucgaggagaaccugacccccggggaguacuccuaccagcugcuccagcagggcaagaagcagcugcccgacuucuaccgcagcgaccugcaggcggaguucgacaagaucugggacuuccagaagcaguucaaccccgagaucuucaccaacgagcucuacgagaagcugcaggggaagaaccggaacgccaccuggaaggagcuggaguucccguucucccucgucggcaucaagcagacgggcaccaugcaggagaagaagguggagaaguacuucuggcgcagcgaggccgugaagaagcagcuggacuucgagucccuggccgucguguuccaggagaucaacagcaaccucaacaacuccagcggguaccugggcgccaucuccgaccggagcaaggagcuguacuucuacaaccagaccgugggggaguaccucuuccagcagcugaagaccaacccccacacgaagcugaagaaccaggucuucuaccgccaggacuaccucgacgaguucgagaagaucugggagacccagagcaaguaccacaaggagcugaccaaggagcugaaggaggagauccgggacaucaccaucuucuaccagcgcaagcucaagucccagaagggccugaucagcaucugcgaguucgagaaccgggagaucgagaucacggagaacggcaagaccaagaagaagaccguggggcugaagguggcgcccaaguccagcccccucuuccaggaguucaagaucuggcagguccugaacaaccugcaguuccagaacaucgagaccaaggagguguucccgaucgaccucgacuucaagcaguccaucuucgacgaggugaacaucaagggcaagcugagcgccaaggacguccuggaccucgugggguacuccggcaaggaguggaagacgaacuucaaggagaucgaggggaacuacaccaacgagaaccuguacaccgccuuccugaagaucaucgccagcaaggagaucgaguuccccaaggaguucaagaucaccaucgacgacgagaucaagguguccaagaucaacgccagcgcggagaucaucaagcuguucguccgcgagaaguucuccgagcucggcaucgacacgagcauccuggacuucaaccccgagcuggagggcuccgacuucgagaagcaggccagcuaccagcucuggcaccuccuguacuccuacgagggggacgacagcuccagcggcaacgagaagcucuacgagcugcuggagaacaaguucggguucaagaaggagaacuccaagauccucgccgagaucggcuucagccaggacuacgggagccuguccagcaaggccaugcgcaagaucuaccccuacaucaaggagcacaaguacuccguggccugcagcuacgcgggcuacaaccacuccaagaacagccugaccaaggagcagcucgagaaccggauccugaaggagcgccuggacauccucccgaagaacucccugcggaaccccgucguggagaagauccugaaccagaugaucaaccucgugaacugccugaucgacgaguacagcgagaaggacaaggacggccagaucgucaaguacuucaaguucgacgagauccgcaucgagcuggcccgggagcucaagcugaacgccgaggagcgcgccaccaugaccuccgagaucaacaaggccacgauccagcaccagaaguacgcggaggugcugcagcgggaguucgggcucaaggcccccagccgcaacgacaucauccgguacaagcuguaccuggagcucgccaacaacggcuucaaggaccuguacaccgacgccaagaucgagcgcgagaaccuguucaccgacaaguacgacaucgaccacaucaucccccagucccgguucuucgacgacagcuucuccaacaaggugcucgucccgcgcaacgcgaaccugaagaaggggaacuucaccgccuucgacuaccuggagaucgagggcaaggagaagcucgagaaguuccugaacaucaucaaggaccuguacgacaagggggccaucacgaaggccaaguacgagaagcuccagaagaaggacuucgagaucggcgacggcuucaucgagcgggaccugcgcaacacccaguacaucgccaagaaguccaaggagauccuguucgggaucaccaacagcguggugaccacgagcggccggaucaccgacaagcuccgcgaggacuggaaccugaucaacaccaugaaggagcugaaccucgagaaguaccggaagcuggggcugaccgagaccgucaucaacuccaagggcgaggagaagcagcgcaucaucgacuggacgaagcggaacgaccaccgccaccacgcgauggacgcccucaccguggccuucaccacccacaaccacauccaguaccugaacuaccugaacgcccgcaaggacgagaagcacaaggagcaccagaacaucuucgccaucgagaaccucaucacggagaucaucgacaagaagaacggcagcaaggagcggcgcuucaaggagcccgugaagaaccugcgggcggaggcccgcaagcaccuggacgagauccucaucagccacaaggucaagaacaagguggugaccaagaacaucaacaagaucaagaagaagggguccgucaucgccaagaccgagcugacgccccggggccagcugcacaaggagaccaucuacgggagcuccaaguuccucaagaccaaggaggagaagaucagcggcaaguucgacguggagaccauccagaaggugcagaacgagcgcuaccggaacgcccugcugaagcgccuccaggaguucgggggcgacuccaagaaggccuucaccggcaagaacgucaucagcaagaaccccaucuuccugaacaacgagaagacggagcagcugccggagaccgugacccucgcgugguacgagaugggguacaccauccggaaggccgugaaccccgacaacuucaaggacuucaagaacaucgagaagacgaucgacaagggcauccgcgacauccugaccaagcggcugaaggaguucaacgggaacuccaaggaggccuucagcgaccucgacaagaaccccaucuggcugaacaaguccaagggcaucagcaucaaggccgucaccaucaccgggaucaacaacgcggaggcccugcacuacaagaaggaccaccucggcaaggacuuccuggacgagaacggcaagcgcaucgccguggacuucguguccacggggaacaaccaccacgucgccaucuacgaggacgagaacggcaaccugcaggagaagguggugagcuucuacgaggccgucgagcgggugaaccagaaccuccccaucaucgacaaggaguacaacuccgagagcggguggaaguuccuguucaccaugaagcagaacgagauguuccuguucccguccgaggacuucaaccccaaggagauggaccucuucgacgagaagaacgugaaccugaucagcaagaaccuguuccgcguccagaaguucaccaucaaggacuacuucuuccggcaccaccucgagaccaacguggaggacuccagcccccugaagggcaucacguggaagcgcgaggggcugaacggcaucgagaacauccucaaggugcggcugaaccaccugggcaagaucguccagaucggggaguacuga

SEQ ID NO: 2146 - RNA, 4227 nt, Artificial Sequence
  Cas9 variant
augaccaagaacauccugggccucgacgugggggugagcuccaucggcugggcccugaucaacgaggacaucgagaaccccaagaacaacaagaucaucaagcugggggugcgcgugaacccgcucaccgucgacgagcagaucaacuucgagaagggcaagcccaucacgaccaacgccgggcggacccuggcgcgcggcgcccggcgcaaccugcagcgguucaagcuccgccgguuccaccugaucgacauccugcagaagaacaacauccucaagcaggccgaccugcuggccgaggugggcaagaacagcaccuuccagacgcaggagauccgcgccaaguccgcgaagcagaagguggagcucagcgagcuggcccggaucuuccugcucaucaacaagaagcgcggguacaaguccagccggaaggccaagaacgaggacgagggccagaucaucgacgggauguucaucgccaagaagcuguacgacgagaagcugacccccggcgaguacuccuaccagcuccugaaggagagcaagaagcagcugcccgacuucuaccgcuccgaccuccagagcgaguucgacaagaucuggaacuuccagaagcaguucuacccggagaacuucuccgacaaccuguacaaggagcugcaggggaagaacaagaacgcgaccuggaagacccucgagauccccuucagccuggucggcaucaagcagacgggcacccugcaggagaagaagcucgagaaguacuccuggcggagcgacgccgugaagaagcagcuggacuacgagaagcuggccguggucuuccaggagaucaacuccaacaucuacaacagcuccggguaccucggcgccaucagcgaccgcuccaaggagcuguacuucaacaaccagaccgugggggaguaccuguacaaccagaucaaggagaacccccacaccaagcucaagaaccagguguucuaccggcaggacuaccuggacgaguucgagaagaucugggagacgcagagcaaguaccacaccacccugaccaaggagcucaaggaggagauccgcgacaucaucaucuucuaccagcggaagcucaagagccagaagggccugaucuccaucugcgaguucgagaaccgcgagaucgagaucaaggagaacggcaagaucaagaagaagacggucgggcugaagguggcccccaagagcuccccgcuguuccaggaguucaagaucuggcagauccugaacaaccuccaguuccagaacaucgagagcaaggagaucuuccccaucgaccuggacuucaaggaguccaucuucaacgaggugaacaucaagggccggaucagcgcgaaggccguccuggaccuccugggguacuccggcaaggaguggaaccccaacuucaaggacaucgaggggaacaacaccaacgagaaccuguacaacgccuaccucaagaucaucgccgacgaggaguucgagcugcccaaggaguucaagcugaacggcgacgacgaccuguacgugagcaagaucgccugcuccgcgagcaagaucaaggacuucgugaaggagaaguucuccgagaucggcaucaacaccagcauccucgacuucaacccggagcuggaggggaaggacuucgagaagcaggccuccuaccaguucuggcaccuccuguacagcuacgagggcgacgacucccagagcgggaacgagaagcuguacgagcugcucgagaagaaguucggcuucaagaaggagcacuccaagauccugagcaacaucggguucccccuggacuacggcaaccucuccaccaaggccaugcgcaagaucaucccccaccugaaggccggccugagcuucgccaagaaguccaaggaggacaacauccucagcgcgacggccauggccggguacaaccacagcaacuccuacaccaaggaggaccuggccaagcggguccugaaggagaagcucgagguguuccccaagaacagccugcgcaacccgguggucgagaagauccugaaccagaugaucaaccucgugaacgaggccguggaggaguacggcaccaucgacgagguccgcaucgagcuggcgcgggagcugaagaagaacgccgaggagcgcgccaacaugaccuccgagaucgggaaggccacgcuccugcaccagaaguacgcggagauccugaagaaggaguucgacauccccgugcccagccggaacgacaucauccgcuacaagcucuaccuggagcuggccaacaacggcuacaaggaccucuacaccgacguccagaucaagcgggaggagcuguucaccaacaaguacgacaucgaccacaucaucccccagucccgcuucuucgacgacagcuucuccaacaaggugcuggugccgcgcggggccaaccucaagaaggccaaccagaccgccuucgacuaccuggagaacgaggacaagcagaagcuggagaaguuccucaacaucaucaagaaccuguacgacaagggcgagaucacgaaggcgaaguacgagaagcugcagaagaagggcagcgacaucggggagggcuucaucgagcgggaccuccgggacacccaguacaucgccaagaaggccaaggagauccuguucgggaucacccacuccgucaucagcaccuccggcaagaucacggacaagcugcgcgaggacuggaaccucgugaacaccaugaaggagcugaaccuggacaaguacaagaagcucggccugaccgagacccugcucaacagcaagggggaggagaaggagcggaucaucgacugguccaagcgcaacgaccaccggcaccacgccauggacgcccugacgguggcguucaccacccacaaccacauccaguaccugaacuaccucaacgcccgcaaggacgaggaccacaagcagcacaaggucaucagcaacaucgagaaccugaucaccaagguguucgagaagaagaacggcgccaagcagcggcgcuucaucgagcccaucaacaacuuccggguggacgccaagaagcaccuggacgagauccucaucucccacaaggccaagaacaaggucgugaccaagaacaucaacaagaucaagaagaaggggagcguggucgcgaagacggagcugacgccccgcggccagcugcacaaggagaccaucuacgggagcuccaaguuccucaagaccaaggacgagaagaucagcggcaaguucgaccuggagaccaucaacaaggugcagaacgagaaguacaagaacgcccugcuccagcggcugcgcgaguucggcgaggacuccaagaaggccuucaccgggaagaacgugaucagcaagaaccccaucuaccuggacgaggagaagacccuccagaucccggaguccgucacccuggccugguacgagaugaucuacacgauccgcaagcccgugaaccccgacaacuucaaggacuacaagaacaucgacaaggugaccgacgagaagauccgggcgguccugaccgaccgccuccggaaguucaacggcaacagcaaggaggccuucuccgaccuggagaagaaccccaucuggcugaacaagagcaaggggaucgccaucaagaccgugacgaucaccggcauguccaacguggaggcccuccacuacaagaaggaccaccuggggaaggagauccuggacaagaagggcgaccgcaugccggucgacuucgugagcaccggcaacaaccaccacgccgcgaucuacgaggacgccaaggggaaccuccaggagcggguggucuccuucuacgaggccguggagcgcgugaaccagggccugagcgucgugaacaaggacuacaacgccgggcugggcuggaaguuccucuucaccaugaagcagaacgagauguuccuguuccccuccgaggacuucaaccccaaggagaucgaccuguacgacgagaagaaccucaagcugaucgccaagaaccuguuccgggugcagaaguucggggagcucagcaaguccggcuucugguuccgccaccaccuggagacgagcgucgacgugaagaaggagcugcggaacuacuccuaccucgacuucuacagcaaggacuucaugaagaccaucgugaagguccgccugaaccaccugggcaagaucguccaggugggggaguacuga

SEQ ID NO: 2147 - RNA, 4230 nt, Artificial Sequence
  Cas9 variant
augagcaucaucaacuuccagcgccggggccugauggagacccaggccuccaaccagcucaucagcucccaccugaagggguaccccaucaaggacuacuucgugggccuggacaucgggaccagcuccgucggcugggccgugacgaacaaggcguacgagcuccugaaguuccgcagccacaagaugugggggucccggcuguucgacgagggcgagagcgccguggcccgccggggcuuccgcuccaugcggcgccggcucgagcgccggaagcugcgccugaagcuccuggaggagcuguucgccgacgccauggcgcaggucgacccgaccuucuucaugcggcuccgcgagagcaaguaccacuacgaggacaagaccaccgggcacuccagcaagcacauccuguucaucgacaagaacuacacggaccaggacuacuacaaggccuaccccaccaucuaccaccuccgggccgagcugaugaaggacggcaccgacgacauccgcaagcuguuccuggccgugcaccacauccucaaguaccgggggaacuuccuguacgagggcgcgaccuucgacuccaacgccagcacgcuggacgacgugaucaagcaggcccucgagaacaucaccuucaacugcuucgacugcaacuccgccaucagcuccaucgggcagauccugauggaggccggcaagaccaagagcgacaaggcgaaggccaucgagcaccuggucgacaccuacaucgccacggacaccguggacaccuccagcaagacccagaaggaccaggugaaggaggacaagaagcgccucaaggccuucgccaaccugguccugggccucaacgcgagccugaucgaccuguucggguccguggaggagcucgaggaggaccugaagaagcugcagaucacgggcgacaccuacgacgacaagcgggacgagcucgccaaggccuggagcgacgagaucuacaucaucgacgacugcaaguccguguacgacgccaucauccugcugagcaucaaggagcccgggcucaccaucuccgagagcaaggucaaggccuucaacaagcacaaggacgaccuggcgauccugaagucccuccucaagagcgaccgcuccaucuacaacaccauguucaagguggacgagaagggccugcacaacuacgugcacuacaucaagcagggccggacggaggagaccagcugcaaccgcgaggacuucuacaaguacaccaagaaggucguggaggggcugcccgacuccaaggacaaggaguacauccugagcgagaucgagcugcagacccuccugccgcugcagcgcaucaaggacaacggcgugauccccuaccagcuccaccuggaggagcugaaggucauccuggccaagugcgggcccaaguuccccuuccucaacgagguggccgacggcuucuccguggccgagaagcugaucaagaugcuggaguuccggaucccguacuacgucgggccccucaacacgcaccacaacguggacaacggcggcuucgccugggcggugcgcaaggccagcgggcgggucacccccuggaacuucgacgacaagaucgaccgcgagaaguccgccgccgcguucaucaagaaccugaccaacaagugcaccuaccugcucggcgaggacgugcugcccaagagcucccugcucuacagcgaguucaugcugcugaacgagcucaacaacguccggaucgacgggaagccgcuggagaaggccgugaaggagcaccugaucgaggccguguucaagcaggaccacaagaagaugacgaagaaccgcaucgagcaguuccucaaggacaacaacuacauccccgagaagcacaagcccgagaucaccggccuggacggggagaucaagaacgaccuggccuccuaccgggacaugguccgcauccucggcaacaacuucgaccugagcauggccgaggagaucaucaccgacaucaccaucuucggcgagagcaagaagaugcugcgggagacgcuccgcaacaaguucuccagccggcuggacgacgaggcgaucaagaagcuguccaagcuccgcuaccgggacugggggcgccugagccggaagcugcucaacgugaucgagggcugcgacaaggccggggacggcacccccgagaccaucaucauccugaugcgcaacuucuccuacaaccugauggagcuccugggggacaaguucagcuucauggagcggauccaggagaucaacgccaagcugaucgagggccagaucgugaacccgcacgacaucaucgacgaccucgcccugucccccgccgucaagcgcgcgguguggcaggcccugcggaucguggacgagaucguccacaucaagaagacccuccccgcccgcaucuucguggaggugacgcgcagcaacaaggccgagaagaagaagaaggacucccggcagaagcgccugagcgaccuguacgccgcgaucaagaaggacgacgcccuccuguccggccugaccaacgaggaguucgggggccucaagagcgggcuggccaaguacgacgacgccgcgcugcgguccaagaagcucuaccuguacuacacccagaugggccgcugcgccuacaccggcgaggucaucgaccugagccagcucaacaccgacaacuacgacaucgaccacaucuacccccggucccugacgaaggacgacagcuucgacaaccuggugcucugcaagcgcaccgccaacgcccagaaguccgacaccuacccgaucagcaaggagauccagaaggcccagaaggcguucuggaucuuccugaagcagcaggggcugaucagcgagcggaaguacgagcgccucacccggaucacgccccugaccgccgacgaccuguccggcuucaucgcccgccagcucguggagaccaaccagagcgucaaggccgccaccacgcugcugcggcgccucuaccccgggguggacguggucuucgugaaggcggagaacgugaccgacuuccggcacgacaacgacuucaucaagguccgcucccugaaccaccaccaccacgccaaggacgccuaccugaacaucguggugggcaacgucuaccacgagcgguucacccgcaacuuccgggccuucuucaagaagaacggggccaaccgcaccuacaaccucgcgaagauguucaacuacgacgugaacugcacgaacgccaaggacggcaaggccugggacgugaagaccagcauggacaccgucaagaagaugauggccuccaacgacgugcgggugaccaagcgccugcuggagcagagcggcgcgcucgccgacgccacggucuacaaggccgccguggcggagaaggccaaggacggggccuacaucggcaugaagaccaaguccagcguguucgccgacgucuccaaguacgggggcaugaccaagaucaagaacgccuacagcaucaucgugcaguacgcggggaagaagggcgagguggucaaggagaucgugccccugccgaucuaccugaccaaccggaacacgaccgaccaggaccucaucgacuacguggccuccaucaucccccaggccaaggacaucagcaucaucuaccgcaagcugugcaucaaccagcuggucaaggugaacggcuucuacuacuaccucgggggcaagaccaacuccaaguucugcaucgacaacgccauccaggugaucgucagcaacgaguggauccccuaccugaaggugcuggagaaguucaacaacaugcgcaaggacaacaaggaccucaaggccaacgugaucuccacccgggcgcuggacaacaagcacacgaucgagguccgcaucguggaggagaagaacaucgaguucuucgacuaccuggugagcaagcucaagaugcccaucuaccagaagaugaaggggaacaaggccgccgagcuguccgagaagggcuacgggcuguucaagaagaugagccucgaggagcaguccauccaccugaucgagcugcucaaccugcugaccaaccagaagaccaccuucgaggucaagccgcucggcaucacggccagccggagcaccgugggcuccaagaucagcaaccaggacgaguucaaggugaucaacgaguccaucaccgggcuguacagcaacgaggucaccaucguguga

SEQ ID NO: 2148 - RNA, 4233 nt, Artificial Sequence
  Cas9 variant
augaccaagaacauccugggccucgaccugggggugagcuccaucggcugggcccugguccaggagaacagcaagaaccccgagaacaacaagaucgugaagcucggggugcgcgucaacccgcugaccguggacgagcagaucaacuucgagaagggcaagcccaucacgaccaacgccucccggacccuggcgcgcagcgcccggcgcaaccuccagcgguucaagcugcgccgggccaaccugaucgacgugcucaagaaggggaacauccugaagcagggcgaccugcucaccgagaucggcaagaacuccacguuccagacccaggagcugcgcgccaagagcgccaaggagaaggucgagcuguccgacuucgugcggauccuccugcugaucaacaagaagcgcggguacaagagcucccggaaggcgaagaacgaggacgagggccagaucaucgacgggauggccguggccaagaagcucuacgaggagaacaucacccccggcgaguacagcuacaagcugcugcaggaggggcgcaagcagcuccccgacuucuaccgguccgaccugcaggccgaguucgacaagaucuggaacuuccagaagcaguucaacccggagaucuucaccaacgagcuguacaagcgccuccagggcaagaaccggaacgcgacguggaaggagcuggagauccccuucuaccuggucggcaucaagcagaucgggaccaugcaggagaagaagaucgagcgcuacuucuggcggagcgaggccgugaagaagcagcucgacuucgagucccuggccguggucuuccaggagaucaacagcaaccugaacaacuccagcggcuaccucggggccaucuccgaccgcagcaaggagcuguacuucaacaaccagaccgugggcgaguaccuguacaaccagcucaagaucaacccccacaccaagcugaagaaccagguguucuaccggcaggacuaccuggacgaguucgagaagaucugggagacgcaggccaaguaccacaagaagcucaccaaggagcugaaggaggagauccgcgacaucgucaucuucuaccagcggaagcugaagucccagaagggccucaucagcuucugcgaguucgagaaccgcgagaucgagaucaccgugaacgggaagaccaagaagaagacggugggccugaaggucgugccccgcagcuccccgcuguuccaggaguucaagaucuggcagcggcucaacgaccuggaguucaagaacguggagaccaaggagaucuucccccuggagcucgagcacaaggagauccuguucgggaaccugaacaucaagggcaaccucagcuccaaggagcugaucgagcagcugggguaccccagcaaggaguggaagugcaacuucaaggagaucgacggcaacaagacccacgagaaccuguacaccgcguuccucaagaucaucgccaacgagggcaucgaguuccccaaggaguucaagcuguccaucgacgacgacaucaaggucagcaagaucgacguguccagcgagaagaucaaggaguucaucaaggagaacuuccugaagcucgggaucaacacguccauccuggacuucaacccggagcuggacggcaaggacuucgagaagcaggagagcuaccagcucuggcaccuccuguacuccuacgagggggacgacagcgccuccggcaacgagaagcuguacgagcugcuggagaagaaguucggguucaagcgcgaguacagcaagauccucgccgacgugggcuucucccaggacuacggcagccuguccagcaaggccaugcggaagaucuucaccuacaucaaggagaacaaguacuccgaggcgugccaccuggccggguacaaccacagcaagaacagccucaccaaggagcagcuggccaaccgcauccugaaggagcagcucgagauccugcccaagaacgcccugcggaaccccgucguggagaagauccucaaccagaugaucaaccuggucaacgaggugaucaaggaguacggcaagcccgacgagauccgcaucgagcuggcccgggagcucaagaagaacgcggaggagcgcgccaacaugaccuccgacaucagcaaggccacgcugcugcaccagaaguacgccgaggugcuccagaaggaguucgggaucaaggccccgucccggaacgacaucauccgcuacaagcuguaccuggagcucgcgaacaacggcuacaaggaccuguacaccaaccagaagaucgagaaggagaacaucuucaccgacaaguacgacaucgaccacaucaucccccagagccgguucuucgacgacuccuucagcaacaagguccuggugccccgcugcgccaaccaggacaaggacaacuacaccgccguggacuacaucgagaagaaguacggggagcggggcaaggaggacuuccucaaccgcauccaccuggucuucaaguccaaggaggccaucgcgggcaagagcgagucccagaucagcuccaugaacacgaaguuccugaagcuccagaagaaggggagcgagaucggcgagggguucaucgagcgggaccugcgcgacacccaguacaucgccaagaaggccaaggagauccuguucggcaucaccaacuccgugaucagcaccuccggccggaucacggacaagcuccgcgaggacuggaaccuggugaacaccaugaaggagcugaaccucgagaaguaccggaagcuggggcugaccgagcucaucgccaacagcaagggcgaggagaaggagcgcaucaucgacuggaccaagcgcaacgaccaccggcaccacgccauggacgcgcugacggucgccuucaccacccacaaccacauccaguaccugaacuaccucaacgcccgcaaggacgagaagcacaaggagcaccacaacaucuucgccaucgagaacaucaucaccgagaucguggagaagaagaacggguccaaggagcggcgcuucaagcugcccaucaagaacuuccggaccgaggccaagaagcagcuggaggaggugcucaucagccacaaggcgaagaacaaggucgugacgaagaacaucaacaagaccaagaagaagggcgggguggucagcaagaucgugcugaccccgcgcggccagcugcacaaggagaccaucuacggcuccgccaaguuccucaagacgaaggaggagaagaucagcgggaaguucgaccuggagaccaucaacaaggugcagaacgagaaguucaagaacgcccugcucgaccggcugaaggaguucaacggcgacuccaagaaggccuucaccgggaagaacguccccgccaagaaccccaucuaccugaacgagcagaagaccgagcagguccccgagagcguggugcucgcgugguacgagacgggcuacaccauccgcaaggccgugaacgccgacaacuucaaggacuacaagaaccuggagaagaucaucgacaagggggugaaggagauccugaagaaccggcucaacgccuucaacggcaacgcgaaggaggccuucuccgaccuggagaagaagccgaucuggcugaaccagagcaagggcaucgccgucaagaccgugaccaucacggggaucaacaacgccgagacccuccacuacaagaaggaccacuucggcaacgagcugcuggacgagaacgggaagaagauccccguggacuucgucuccaccggcaacaaccaccacguggccaucuacgaggacgcggacgggaaccuccaggagcgcguggucagcuucuacgaggccguggagcgggugaaccagggccuguccaucaucgacaaggaguacaaccaggaccugggcuggaaguuccucuucaccaugaagcagaacgagauguuccuguuccccagcgaggacuucaaccccaaggagacggaccuguucgacgagaagaaccucaaccugaucuccaagaacauguuccgcguccagaaguucgggagccugcucuccggcuucugguuccggcaccaccuggagaccaccguggaccugaacagcucccucaaggacaccagcuacaaggugauccaguccugcaacaaccugaagcugaucgucaaggugcgccucaaccaccuggggaagaucgugcagaucggcgaguacuga

SEQ ID NO: 2149 - RNA, 4236 nt, Artificial Sequence
  Cas9 variant
auggugaagaaggaguacuucaucggccuggacauggggaccagcuccgucggcugggccguggccgacaccaacuacaaccuccugcgcgcgaaggggaaggacauguggggcgugcggcuguuccccgaggccagcacggccgccgaccgccggucccaccgcaccgcccggcgcaacaacaagcggaaggcggcccgcgagggguuccuccgggagaucuucgaggacgagaucaacaagaucgacccgggcuucuucgagcgccugaaggagagcaaguacuaccuggaggacaagcucaccgacacccccuucguccuguucgccgacaagggcuacacggacaaggaguacuacgacgaguaccccaccguguuccaccugaucaaggagcucaucuccgagaaggggcuggagccccacgacauccggcugguguaccucgccugccugaacaucuacaagcaccgcggccacuuccugaacgacacccucagcggggacggcaucgacaacaucaacucccugugcaacgacuucaccagcuaccuggcggacuacaaccagaacuccgaggacgacgggacggagaagauggaccucgacagcaccguccuggccggcguguucgaggagacccugugcaacaagcaccucuccaacagcgccaagaagcgggaccugaucgacaagcugggcaucaccaacaagacgaaguaccucaccgagaugauggcccugaucuccgggcuggccagcuccgugagcaacauguucgcgaaggacaccuacgacgaggagcagaagaaguucaagcucuccuuccgcagcuccaaccuggacgaggacauggucaaggugcaggccaugcugaccccggaggaguacgagaugaucugcaucaugaagaagauccacgacuggagcguggucagcgugaucaugggcucccacaaguacaucagcgacgcccggguggagcucuacgagaagcacaagcaggaccuggccaagcugaaggccaucuacaaggaguaccuccccgacaaguacgacgcgauguuccgcgagaugacggacaacuccuacagcgccuacgucgggaagguguccagcaacaagaagucccagaccggcaaccacaaggugcggaugcagcgccggggcgccaagugcaagcaggaggacuucuacgaccgcaucaagaaggagaucaacagcgucccccaggaggagaagaucgacauccugcaggacauggagaccaacuccuuccugcccaagcagcucaccaacgagaacggggugaucccguaccagcugcaccuggccgagcucaagaagauccuggacaacgccagcacguaccugcccuuccucaacuccgcggacgagaccggcaucagcaacaaggacaagaucauccagcuguucgaguuccggauccccuacuacguggggccccuguucaaguccgagaagaacaagaccaacgccugggucgugcgcaaggagagcggcaagguguacccguggaacuucaacgagaagaucgacgagaagcaguccgccgagaucuucaucgagcgcaugguccggcacugcaccuaccucaacaacgagagcgcccugcccaagaacucccugaaguacgagcgcuuccgggugcucaacgagcugaacaaccugcgcaucaacggggagcggaucagccccgagcugaagcagcgcaucuacaacgagcuguucaaggucaagaagaagcggaucacgaaguccaugcucugcgaguaccuguacaagaacggcaucgccgacaaggacagcgagcucagcggcuucgacgggaccuucgcgaacgcccugcuguccuacggcaaguuccgcgagcuguucaacguggacacccucaccgacaagcaggaggccgccgcggaggacaucaucaaguggagcacgguguacggggacuccaagaaguuccugcaggagaagaucgaggagaacuacggccccgagagcgagaacccgcuccuggacaacaagcagaucaagcgggucaugggguacaaguucaccgacuggggcaaccugucccgcgaguuccucaaccuggagggcgccgacaaggacaacgacaccaccacgggggaggugaugccccugaucacccggaugugggaggagaacuacaaccucauggagcugaugagcaacaaguucuccuaccgcgacgcccuggccgagaagaccgaggagaucgagaagacccucacggacaucgaguacgaggaccuggaggaccuguacaucagcgcccccgugaagcggaugaccuggcagacccuccugauccugaaggagaucuaccagaucaugggcuacgcgcccaagaagaucuucgucgagauggcccgcgaggaggaggagaaggugaacgggaagggcgcccggaaguccagccgcaagaagcggcucgaggaccuguaccgcaacugcaaggacgccuccaaggagcugagcaccgggaucaagaacgccgacgaggcgauccuccggcgcaagaagcuguaccuguacuaccuccagaagggcaagugcauguacuccggcaagaccaucgacuucaagagccuguucacgaacaacuacgacaucgaccacaucuacccgcaguccguggucaaggacgacagccuggagaacaacauggugcucguggagcgcaacuacaacaacaagaaguccgacaccuuccccaucuucagcgacuggcagaacaagaugaagcccuucuggaccaugcugaaggagcagggguucaucaacgaggagaaguacaagcggcugacccgcacggacgagcucaccgacgacgagcuggccaacuucgucaaccggcagcugguggagacccgccaggccaccaaggugaucgccgagcuccugaagaacagcuucgacgacaucgacuccaagaucgucuacgccaaggcgggcaacgugagcgaguuccggcacaaguucuccaugaaguacgacaaggagacggagaaguccagcgugauccaccccgagcuggucaagugccgcaucaucaacgacuuccaccacgccaacgacagcuaccucaacaucgugguggggaacaucuacgacgucaaguucacccagaacccguacaacuacaucaaggaguacaagaagcagaagaacaacuccgcccugagcgagcaggagaaggagaaguaccacauggacaagaucuucaacuucgacgugaagcggaacggcgagguggccuggaucucccgcggcgacaacaagacccuggagaccguccucaaggugaugcggaagaacacgcccaucgugacccgcaugaacuucgaggagcacgggcagcuggcggaccugaccaucuacagcgccuccgacgcccucagcaagaagggcgucggguacaucaaggugaaggccuccgacgcccggcuggacgugcugaaguacggcggguacaagaaguacaagggcgcguacuucuuccucgucgagcacaccgagaagaacaagcgcgugcggacgaucgagaacaugccccuguaccugaagaacgagcucaacaccaaggagaagaucgagcuguggugcgccgacaaggagaacggccuggggcucguggaccccgacguccgccugggcaagaucaagcuguacagcaagauccggaucgacggguucgaccucuaccugaccggccgcaccgggaacaaccugcucacguccaacgccgugcagcugaagaucggcagcaacaagccguccgacaacgacaagcuguucuggcgguacuacaucaacaagcucagcaaguacaccgagaacuccgaguucgugagcauccagaacaacaucaagcuguacgaccuguucgucgagaucaacaacgccggcguguacagcaagcgccagaaccccaucggggacaagcuccuggagggccgguccaaguucaucaaccugacccucagcaagcaggucgagacccugcuggggaucauccgcaucuacucccucgagaaccagggcgccgaccugagcaacaucgggggccaggagaagaacggcacgaugaagccccacaagcggaucuccgacaagaaggaggugcugcucaucaaccagagcgugaccgggcuguacgaguccaagaucgaccugcucaagaucuga

SEQ ID NO: 2150 - RNA, 4236 nt, Artificial Sequence
  Cas9 variant
augaagaacauccugggccucgaccuggggacgaacagcaucggcugggcccugaucaagcagaacgccgaggagcgccagggguccauccucggcauggggacccgggugcugcccaugagccaggacguccugggcgacuucggcaaggggaacuccgugagccagacggcggcccgcaccggcuaccgggggauccgccggcuccgcgagcgguuccugcugcgccgggagcgccuccaccgggugcugaacauccugggcuuccucccguacuacuacgccgcccagaucgacuucgacaagcgcuucgggaaguucaaggccgagaccgagcccaagcugcccuacaacaacgagggcuucaucuucaagaacuccuucgaggagaugcugagcgacuucaagaucucccagcccgagcuccugagcggcaacaagaaggucccguacgacuggaccaucuacuaccugcggaagaaggcggugucccagaagaucgagaaggaggagcucgccuggauccugcugaacuucaaccagaagcgcggguacuaccagcuccggggcgaggacuucgacgaggagaaggacaagacguucgugacccugaacgucgacaaggugaucgacagcggggagaaggugaagggcaacauccuguucgacaucuacuucaccaacggcuggaaguacgagaagcagaccacgaagcccgaggacuggcucgggcgcuccaaggaguucaucaucaccgagagccugcugaagaacggcgagguccggcgcaccuucaaggccguggacuccgagaaggacuggaucgccaucaaggcgaagaccgagcaggagaucgagacggcccacaagaccguggggagcuacaucuacgacgccauccuccagaaccccaagcagaagaucaagggcaagcugguccggaccaucgagcgcaaguucuacaaggaggagcugcggaagauccucgagaagcagaaggacuuccaccuggagcugcagaacgaggaccucuacuccgacugcgugcgcgagcuguaccgcaacaacgacacccaccagcugagccucgccaagaaguccuucauccaccuguuccuggaggacaucaucuucuaccagcggccccucaagagccagaaguccagcgugagcaacugcacgcuggagugccgcaaguaccgggacaagaacggggccgagggcauccaguuccugaaggucaucccgaaguccaaccccuacuaccaggaguuccgcaucuggcaguggaugagcaaccucaagaucuaccggcgcgacgacgacgugaacaucaccuccgagugccugaagaccgcggaggacuacgaggaccuguucguguuccucaacauccggaaggaggucgaccagaaggccugccugcgccacuucaagcugagcgagaagacccaccgguggaacuacguggaggacaagaaguaccccugcaacgagacgggcaccaugaucuccgagcgccucaagaaggugggggacagccccgacaacaucuucacccgggagauggagcagcagaucuggcacaucaucuacuccgucaacgacaagaccgaguacgagaaggcccucaagagcuucgccaagaagaacgagcuggacaacgacuccuucuucgaggccuuccgcaaguucccgcccuucgacagcgaguacggcuccuucagcgagaaggcgaucaagaagcugcucccccugaugcggaucgggaagcacuggaacugggaggccguggacgagaagaucaagaaccgcauccagaagaucaucaucggcgaguacgacgagaacaucaaggacaacauccgggagaagacgcugucccuccagaaggagagcgacuuccaggggcugccccuguggcucgcccaguacguggucuacggccgccacuccgaggccagcguggccggcaaguggaacuccgucgacgacaucgaggaguaccugaaggaguucaagcagcacagccugcggaacccgaucguggagcaggucaucauggagaccgugcgcguggugaaggacaucuggaucaaguacgggaacggcgcggccgacuucuucgacgagauccacaucgagcucgggcgggagaugaagcugcccgccaaggagcgcaacaagaugacccagaagaucuccgagaacgagaacaccaaccugcgcaucaaggcccuccuggccgagaugaugaacgacagcgagguccagaacgugcggcccuacagccccaugcagcaggagauccugaagaucuacgaggacggcgcgcucaacuccgagaucagcguggacgacgacauccugaagaucuccaagacggcccagccgagccccuccgaccugaagaaguacaagcucuggcuggagcagaaguaccgcagccccuacaccggggacaucaucccccugaacaagcuguucaccaccgaguacgagaucgagcacaucaucccgcagucccgguacuucgacgacagcuucuccaacaaggucaucugcgagagccuggugaaccgccugaaggacaacuacaucggccucggcuucaucaagcaguuccacggguacaagaucuccgacaagacgaagguguucgaggucgaggaguacgaggacuucgugaagaagaacuacgccaacaaccggagcaagcgcuccaagcugcugcucgaggagauccccgaggagaugaucgagcggcagcugaacgacacccgcuacaucagcaaguacaucuccggcauccugagcaacaucgugcggaagaaggagaacgacgagggggucaacuccaaggacaucauccccggcaacggcaagaucaccagccagcucaagcaggacugggggcugaacgacguguggaacgaccugauccucccccgcuucgagcggaugaacgagcugaccaagagcuccuacuucacgguguggaacgagaaguaccagaaguuccugccgaccguccccguggaguucagcaagggcuucuccaagaagcgcaucgaccaccggcaccacgcccucgacgcgcuggugaucgccugcgccaccaaggaccacgucaaccugcucaacaacaagagcgccaaguccgagaugaagcgcuacgaccugaagcggaagcugaugaaguucgagaagaagaccuaccagcacagccagaccggggagcgcaucgugaaggacgugcccgucgaguuccucaagccguggaacgacuucacgguggaggccaaggagaaccuggagaagaucaucguguccuucaagcagaaccugcgggucaucaacaaggcgaccaaccacuacgagaaguggaucgagaaggacaacgugaaggugaagggccucgucgagcagcaggggcugaacugggccauccgcaagccccugcacaaggacaccgugagcggcaagguggaccuccccggcaucaagguccccaaggggaagauccugaccgccacgcggaaguccaucgacaccagcuucgaccugaagaccaucaacuccaucaccgacacgggcgugcagaagauccucaagaacuaccuggaguacaaggggaacagcuccgaggaggccuucagcuccgagggcaucgaggacaugaacaacaacaucgagaaguucaacgaggggaagcugcaccagccgaucaccaaggugcgcaucuucgagcucggcagcaaguucccccugggccagaucgggaacaagaagcacaaguacgucgagaccgccaagggcaccaaccuguucuucgcgaucuacgaggacgacaaggggaagcggacguacgagaccaucccccucaacgaggugaucgagcgccagaagcagggccuggcccccgugacccugaaguccaagaacgacuucuaccucugcccgaacgaccuggucuacguggccgccgagggggagagcgugaacaagaucgacuucaaguacgccucccaggaguucauccacaacaucuacaaggucgugagcuucagcggcucccagaucuucuucgugaagcagaacaucgcggucagcaucgugaacaaggccgaguucuccacccugaacaagauggagcgcgccguggacggcaagaugaucaaggacugcugcaucaagcucaagaucgaccggaucgggaacaucaccaagagcuga

SEQ ID NO: 2151 - RNA, 4239 nt, Artificial Sequence
  Cas9 variant
augaugaccaagaacauccugggccucgaccuggggaccaacagcaucggcugggcccugaucaagcagaacgccgaggagcgcaagggguccauccucggcauggggacgcgggugcugcccaugagccaggacgcgcugggcgacuucggcaaggggaacuccgucagccagaccgccgcccgcaccggcuaccgcggggugcggcggcuccgcgagcgguuccugcugcgccgggagcgccuccaccgggugcugaacauccugggcuuccucccggacuacuacgccgcccagaucgacuucgacaagcgcuucgggaaguucaaggcggagaccgagcccaagcugcccuacaacaacgagggcuucaucuucaagaacuccuucgaggagaugcugagcgacuucaagaucucccagcccgagcuccugagcgagaacaagaagaucccguacgacuggacgaucuacuaccugcggaagaaggccgucucccagcgcaucgagaaggaggagcucguguggauccugcugaacuucaaccagaagcggggcuacuaccagcuccgcggggaggacuucgacgaggagaaggacaagaccuucgugacccugaacgucgacaaggugaucgacagcggcgagaaggugaaggggaucguccuguucgacguguacuucaccaacggcuggaaguacgagaagcagaucacgaagcccgaggacuggcucggccgguccaaggaguucaucaucaccgagagccugcugaagaacggggaggugaagcgcaccuucaaggccgucgacuccgagaaggacuggaucgccaucaaggcgaagaccgagcaggagaucgagaucgcccacaagacggugggcagcuacaucuacgacgccauccuccagaaccccaagcagaagaucaaggggaagcugauccggaccaucgagcgcaaguucuacaaggaggagcugcggaagauccucgagaagcagaaggaguuccaccccgagcugcagaacgaggaccuguacuccgacugcgugcgcgagcucuaccgcaacaacgacgcccaccagcugagccuggccaagaaggacuucauccaccucuucgucgaggacaucaucuucuaccagcggccgcugaagucccagaaguccagcgugagcaacugcacccuggagugccgcaaguacaaggacaagaacggcgaggagcggauccaguuccucaaggugauccccaagagcaaccccuacuaccaggaguuccgcaucuggcaguggauguccaaccugaagaucuaccggcgcgacgacgacgucaacaucaccagcgaguaccugaagacgaccgaggacuaccaggaccucuucguguuccugaacacccggaaggagguggaccagaaggcgugccugaagcacuucaagcucaacgagaagacccaccgcuggaacuacgucgaggacaagcgguaccccugcaacgagacggggaccaugauccuggagcgcuucaagaaggugggcgacuccgccgacaacaucuucacccgggagauggagcagcagauguggcacaucaucuacagcgugaacgacaagaccgaguacgagaaggcccugaaguccuucgccaagaagaacgaccucgacaacgucagcuucuucgaggccuuccgcaaguucccgcccuucgacuccgaguacggcagcuucuccgagaaggcgaucaagaagcugcugccccugauccggacggggaaguacuggaacugggaggccguggacgagaagaccaagaagcgcauccagaagaugaucaccggcgagugggacgaggacaucaaggacaacauccgggagaagacccucagccugcagaaggaguccgacuuccaggggcugccccucuggcuggcccaguacgccgucuacggccgccacagcgaggccuccguggcggggaaguggaacagcgugaacgacauggaggaguaccugaaggaguucaagcagcacucccuccggaacccgaucgucgagcaggucaucacggagaccauccgcguggugaaggacaucuggaucaaguacggcaacggcgccgccgacuucuucaacgagauccacaucgagcuggggcgggagaugaagcugcccgccaaggagcgcagcaagaugacccagaagaucuccgagaacgagaacaccaaccuccgcaucaaggcccugcugguggagaugaugaacgacagcgaggugcacaacguccggcccuacucccccaugcagcaggagauccucaagaucuacgaggacggcgcgcugaacagcgagaucagcguggacgacgacauccugaagaucuccaagacggcccagccgagccccuccgaccucaagaaguacaagcuguggcuggagcagaaguaccgcagccccuacaccggggacaucaucccccucaacaagcuguucaccaccgaguacgagaucgagcacaucaucccgcagucccgguacuucgacgacagcuucuccaacaaggugaucugcgagagcuccgucaaccgccugaaggacaacuacaucggccucggguucaucaagcaguuccacggcuacaagaucagcgacaagacgaagguguucgagguggaggaguacgaggacuucgucaagaagaacuacgccuccaacuggagcaagcgguccaagcugcugcucgaggagauccccgaggagaugaucgagcgccagcugaacgacacccgguacaucagcaaguacaucuccggcauccugagcaacaucgugcgcaagaaggagaacgacgacggggugaacuccaaggacaucauccccggcaacgggaagaucaccagccagcucaagcaggacuggggccugaacgacgucuggaacgaccuggugcucccccgguucgagcgcaugaacgagcugaccaagagcaacgacuucaccguguggaacgagaaguaccagaaguuccugccgacgguccccguggaguucuccaagggcuucagcaagaagcggaucgaccaccgccaccacgcccucgacgcgcuggugaucgccugcgccacccgggaccacgucaaccugcucaacaaccaguccgcccgcagcgagaugaagcgguacgaccugaagcgcaagcugaugaaguucgagaagaaggccuaccagcacucccagaccggggagcggaucgugaaggacgugcccgucgaguuccucaagccgugggacaacuucaucguggaggcgaaggagaaccuggaccgcaucaucgugagcuucaagcagaaccugcgggucaucaacaaggccaccaaccacuacgagaaguggaucgagaagaacaacgugaaggugaaggcccucgucgagcagcagggccugaacugggccauccgcaagccccugcacaaggacacgguguccgggaagguggaccuccccggcaccaagguccccaaggggaagauccugaccgccacccgcaagagcaucgacacguccuucgacaugaagaccaucaacagcaucaccgacaccggcauccagaagauccugaagaacuaccucgaguacaagggcuccuacgaggacgcguucagcccggaggggaucgaggacaugaacaagaacaucgagaaguucaacgacggcaagcagcaccagcccaucaucaaggugcggaucuucgagcugggguccaaguucccccugggccagaucgggaacaagaagcacaaguacguggagacggccaagggcaccaaccucuucuucgccaucuacgaggacgacaagggcaagcgcaccuacgagaccaucccccugaacgaggucaucgagcggcagaagcaggggcuggccccggugacguucaagagcaagaacgacuucuaccucucccccaacgaccugguguacgucgccgcggagggcgagagcguggacaaccuggacuuccaguccgacagccaggaguacaucaacaacguguacaaggucguguccuucagcgggagccagaucuucuucgugaagcagaacgucgccguguccaucgugaacaaggccgaguucagcacccucaacaagauggagcgcgccaucgacggccggaugaucaaggagugcugcgucaagcugaagaucgaccgcaucgggaacaugaccaaguccuga

SEQ ID NO: 2152 - RNA, 4245 nt, Artificial Sequence
  Cas9 variant
augaagaagauccugggccucgaccuggggaccaacagcaucggcugggccuucguggaggaggccgagaacgaguccgagaaguccuccaucaucaagcuggggguccgcgugaacccccucaccguggacgagcagcagaacuucgagaagggcaagagcaucacgaccaacgcggaccggacccugaagcgcuccaugcggcgcaaccugcagcgguacaagcagcgccgggagaaccucaucgacauccugaugaagaacggguucaccagcgacgacacgauccuguccgagaacggcaaccgcaccaccuucgagaccuaccggcuccgcagcaaggccgucgccgagaagaucucccugcaggaguucgcccgggugcugcucaugaucaacaagaagcgcggcuacaagagcucccggaaggccaaggggacggaggacggcgagcugaucgacgggauggagguggcgaagaagcuguacaacuacaaccucaccccgggccagcugugccugcagcuccugaacgaggggaagaagcaccuccccgacuucuaccgcagcgaccugcaggccgaguucgaccggaucuucgacauccagaugaccuucuacaccgaguaccugacgcuggagcucaaggaggagcugcgcggcaagaagcgggacgccgucugggccaucugcgcgaagaucuucaaggagaagggcuucgagcugaucgggaccaagcgccagggcuccaccgccgagcagaagcacgagaacuacagcuggcgggccaaggggcucuccgagaagcuggagcuggagcagcucguggugguccugcagcagaucaacauccagcugaacagcuccagcggcuaccucggcgccaucuccgaccgcagcaaggagcuguucuucaacaagcagaccguggggcaguaccagauggccgugcuggacaagaaccccaacgcgggccuccggaacauggucuucuaccgccaggacuaccuggacgaguucaacgccaucugggagaagcaggcccuguuccaccccauccucacggacacccugaaggacgagauccgcgacgugaucaucuucuaccagcggcgccucaagagccagaaggggcugaucuccuucugcgagcuggagagccggaagaucgagguggagaucgccggccagaacaagaccaagauggucgggucccgcgugaucccgcggagcagcccccuguuccaggaguucaagaucuggcagagccucaacaacaucgagguguucggcaagggcaagaaguccaagaagcagaaggagcagacccuguucgaccagacggaggacccccuggaguucgggggccgccgggagcucuacgaggaggagaaggagcugcuggcccuggagcucagcaucaagaaggagcugaagaaggcggacauccugaagcuccuguucgacaaccccaaggagcuggaccucaacuucaacgccguccaggggaaccugacccaggccacccuguucaacguguacaagaagaucaucgagcucuccggccacgagaucgacguggagaaggacagcgccuccaagauccucaagagcaucgaggagaucuucaaggcccugaacuacaacaccgagauccugcacuucgacuccgagaagucccaggaccagcaggcgauguacaugcuguggcaccuccuguacagcuucgagggggacaacagcaacacgggcaacgagaaccugaucaacaagaucuccaagcuguacggcuucgagaaggaguacgccaagauccucgccaacgucagcuuccaggacgacuacgggucccugagcgccaaggccaucagcaagauccugccguaccucaaggagggccacaaguccgacaucgcgugcgaccuggccggguacaagcacagcgccuccagccugacccgcgaggagcucgagaacaagaccuacaaggaccggcuggagauccugcccaagaacacccuccgcaaccccgugguggagaagauccugaaccagaugaucaacgucaucaaccugaucaucgacucccgggagcucaagaaguccgccaaggagcgcgaggagcugaccaagagcaucagcgagacgaccaagcugcaccagcaguacaaggacauccucgcgaaggcccccuucaaccugaccaacacgucccggaacgacaucauccgcuacaagcuguacgaggagcucaaggacaacggcuacaagacccuguacagcaacaaguacaucuccccggccgcccuguucagcggggacuucgacaucgagcacaucaucccccagucccgccucuucgacgacagcuucuccaacaagacccuggagcugcggagcaucaacaucgagaagggcaacaagaccgccuacgacuucaucaagggcaaguacggggagacgggcgaggacaacugccucgacaaguaccugaaccggaucgagacccuguacaagaacgggauccucaagaaguccaaguacaacaagcugaagaugcaggacaaggacauccccgacggcuucaucgagcgcgacauccgggacacccaguacaucgcgaaguacgccaagacccugcucggcgaccuggugaaguucgucgugagcaccagcggguccgugacggagcgccugcgcgaggacuggcagcucgucgacgugaugaaggagcugaacugggagaaguacaugcagcugggccucaccgaggaguucaccaacgaggaggggcaccggauccgcaagaucaaggacuggaccaagcggaacgaccaccgccaccacgccauggacgcccugacgguggccuucaccaagcggcaguucauccaguaccugaacaaccucaacgcgcgccggaucagcgacgagcagggcaucuccaacagcgagaaggacgagcgcaacaacgucuccaucaccaccaacgacaugaagcugaacacgcgggacgugcuggggaucgagaagaaggagcucuaccgcgacaaccggggcaagcugcgcuucaaggcccccaugccgcugcucgaguuccgggaggaggccaagcgccaccuggagaacacccugaucagcaucaaggccaagaacaaggugaccaccaucaacaucaacacgcucaagaaggccggcggggucuacaagaagacccagcugacgccccggggccagcugcacaacgagaccaucuacgggucccagaagcaguacaucgugaaggaggagaccaucaacgcgaaguucgacguggagaagaucgccaccgucaccaaccccguguaccgcgaggcccuccugaagcggcuggagcagaacaacaacgaccccaagaaggccuucaccggcagcaacgcgcucacgaagaagccgaugugguucgacgagcagcagaccgagaaggugcccgagaaggucaagaccguguccuucgagaccaucuacacgauccgcaaggagaucagccccgaccugaagaucgagaagguggucgacgagaaggugcggcagauccugaacaaccgccucaacgaguacaacgggaacgccaagcaggccuucuccaaccuggacgagaaccccaucuggcugaacaaggagaagggcaucaccaucaagcgggugaccaucaccggcaucaacaacgcccaggcccuccacgagaagcuggacaaggacgggaagccgauccuggacggcgaggggaagaagcagcccgucgacuucgugaacacgggcaacaaccaccacguggcggucuacugcgacgccgacgggaaccuccaggagaacgugaucagcuucuacgaggccgugacccgccgcaaccugggccugcccaucaucgacaaggacuacaagaaggacgacggcuggcaguuccucuucuccaugaagcagaacgaguacuucgucuuccccaacgagagcaccggguucaacccgaacgagguggaccugcugaaccccgacaacuacucccucaucagccccaaccuguuccgggugcagaaguucaccaucaaggacuacuucuuccgccaccaccuggagacgaacgucgaguccaacagcacccucaagggcaucaccuggcugcggugcgggcugaacaacaucgacaacaucaucaaggugcgcaucaaccacaucggccagaucauccacgugggggaguacuga

SEQ ID NO: 2153 - RNA, 4248 nt, Artificial Sequence
  Cas9 variant
auggccaaguucaacaagcccuacagcaucggccuggacaucgggguguccagcgucggcuacgccgugaucaccgaggacuaccgcgugccggcguuccgguucaagguccucgggaacaccgagaaggagaagaucaagaagaaccugaucggcuccacgaccuucgugcccgcccagagcgcccaggugacccgcgucuuccgggugaaccgccggcgcaucgaccggcgcaaccaccggaucgccuaccugcgcgacaucuuccagaaggagaucgagaagguggacaagaacuucuaccggcgccucgacgaguccuuccggguccugggggacaagagcgaggaccugcagaucaagcagcccuucuucggcgacaaggagcucgagaccgccuaccacaagaaguaccccacgaucuaccaccuccgcaagcaccuggcggacgccgacaagaacuccccgguggccgacauccgggagguguacauggcccucagccacauccugaaguaccgcggccacuuccugacccucgacaagaucaaccccaacaacaucaacaugcagaacuccuggaucaacuucaucgagagcugccaggaggucuucgaccuggagguguccgaggagagcaagaccaucgcggccaucuucaaguccagcgagaaccggcaggagaaggugaagcagauccuguccuacuuccagcaggagcuccugaagaaggacaagagcaucuucaagcagcugcuccagcugcuguucgggcucaagaccaaguucaaggacugcuucgagcuggaggaggagcccgaccugaacuucuccaaggagaacuacgacgagaaccucgagaaccugcugggcacgcucgaggaggacuucagcgacgucuucgccaagcugaagauccugcgcgacaccauccuccuguccgacaugcugaccuacaccggggccacgcacgcccgguucagcgcgaccaugguggagcgcuacgaggagcaccggaaggaccuccagcgcuucaagagcuucgugaagcagaaccuguccgagcaggacuaccuggacaucuucggccgcaagacccccaacggguucgacgucgacaaggagaccaagggcuacgugggcuacaucagcaacaagauggugcucacgaacaagcagaagaccauccagcagaacuucuacgacuacaucuccgggaagaucaccggcaucgagggggccgaguacuuccugaacaagaucagcgacggcaccuuccugcggaagcuccgcacgaccgacaacggcgccaucccgaaccagauccacgccuacgagcuggagaagaucaucgagcggcaggggcgcgacuaccccuuccugcucgagaacaaggacaagcugcuguccauccucaccuucaagauccccuacuacgucggcccccuggccaaggggaacaacagccgguucgcguggaucaagcgcgccaccucccaggacauccuggacgacaacgacgaggacacgcggaacggcaagauccgcccguggaacuaccacaagcucaucaacauggacaagacccgggacgccuucaucaccaaccugaucgggaacgacaucauccugcugaacgagaaggugcuccccaagcgcagccugaucuacgaggaggugaugcugcagaacgagcucacccgggucaaguacaaggacaaguacggcaagacgcacuucuucgacuccgagcugcgccaggagaucaucaacaaccuguucaagaccaacagcaagcggguguccagcgccaugcuccugaacuaccuggagaacuacaccaaccuccaggccgucgagaucguguccggcaucgagaagggcaagagccugaacuccacccugaagacguacaacgaccucaagaccaucuucagcgaggagcugcuggacuccgagaucuaccagaaggagcucgaggagaucgugaaggucaucaccguguucgacgacaagaaguccaucaagaacuaccugaccaaguacuucgggcgccuggaguuccucaacgaggagcggaucaaccagcugagcaagcugcgcuacacgggguggggccgguacagcgcgaagcuccugcuggacauccgcgacgaggacaccggguucaaccucaugcaguuccugcggaacgacgacgagaaccgcaaccugagccagcucaucuccgacagcacccuguccuucgacagcgccaucaaguccauccagagcaaguccaccguggaggacgacgucuucgacgagaucaagaagcuggccggcagccccgccaucaagcgcggcauccucaacuccaucaagaucguggacgagcuggugcagaucaucggguacccgccccagaacaucgucaucgagauggcccgggagaacaugaccacggaggagggccagaagaaggcgaagacccgcaagaccaagcuggagagcgcccucaagaacaucgagaacuccgugcuggagaacgggaaggugccccacagcgacgagcagcugcaguccgagaagcucuaccuguacuaccugcagaacggcaaggacauguacagccucgacaagaccgggucccccacgccccuguaccgggaccgccuggaccaguacgaggucgaccacaucaucccguacagcuuccuccccaucgacuccaucgacaacaaggugcugacccaccgggagaacaaccagcgcaagcugaacaacauccccgacaaggagaccguggccaacaugaagcccuucugggagaagcucuacaacgccaagcugaucagccagaccaaguaccagcggcugacgaccagcgagcgcaccccggacggcguccucaccgaguccaugaaggcgggcuucaucgagcggcagcugguggagacgcgccagaucaucaagcacguggcccggauccuggacaaccgcuuccucgacaccaagaucaucacccucaagagccagcugaucaccaacuuccggaacacguuccacaucgccaagauccgcgagcugaacgacuaccaccacgcccacgacgccuaccuggcggucgugaucgggcagacccugcucaaggccuaccccaagcuggcccccgagcugaucuacggccaccacgcccacuucaaccggcacgaggagaacaaggccaccauccgcaagcaccucuacuccaacaucaugcgguucuucaacaaccccaacagcaagguguccaaggacaucuggaacugcaaccgcgaccugccgaucaucaaggacaucaucuacaacagccaggucaacuucgugaagcggaccaugaucaagaagggggcguucuacaagcagaacaucauccccaacgacuccagcgugacggucgacaagcgcuuccccaucaagaacaagaaguaccuggacccgaagcucuacggcggcuacuacgagcggaacuccgcccugagcguguucaucaucgggcaguccuucaacaagaacaacaagcugaagguggucaaggaguucuacgacaucaacaucaucgacuacccccucuucaacaccgaccccaugagcuucuucaacgacgacuccgagaacggcuuccugaccaagaacaaccugcagagcgugcaggccuucuacaagauccccaaguacucccucauccagaagaacgacgggacccgcaugcuguucgagagcacgaccaacuuccacaaggccacccaguucaagcugaccgaggcccagaacgagcuguucuuccacaugaagcgccugcugacgaagaccgacuucauggaccucaaguccgaggagagcaucaaggagucccaggacuucaucaugaaccacaagaacgaguucgacaacaucgugaacggccuguucggguacgcggagcggcagcugggcagcaagagccucuucacccaggcccacgaggccuacaagcugcgcaaguacccggucuucucccugaacgaggagaccauccgguacuacuacgacaacuuccuccgccuguucagccugacgaaguccggcaccagcuccggguacguggugggccucuucgaggcccccaagcugcggaacgucguguaccgcgcgaccaaggacgagagcaacgccacccugauccaccaguccaucacggggcucuacgagacccggaucgaccugagcaagcugggcgaggacuga

SEQ ID NO: 2154 - RNA, 4248 nt, Artificial Sequence
  Cas9 variant
augaaccugcgcaacguggccaaggagggcaucaacuacaacaucgggcucgaccugggcaccgggagcgucggcugggccgugaccgacgagcagggggagcuguucuccuucaagggcaagacgaccuggggcagccggaucuuccccaccgcggagaccgccgccgacacgcgccucaagcgggggcagcgccggcgcuacgcccggcgccgguggcgccuggaccugcuccagucccuguucgaggaggagaucaagaagguggacccggaguucuucacccggcugcgccagagccaccuccugaaggaggacaagaccuacgccgcgauccuguccagcaagggcgccacccggccccucuuccccgagggggaggccgaggucgaguacuacaagaaguaccccacgaucuaccaccuccgcaaggcccugauggaguccaacaaccaggaggacauccggcugaucuaccuggcguuccacaacaucgugaaggcccgcggcaacuuccugcaccaggacaccccggggcucaccgccagcaacgccaacaugggcgacgccguggagaagcugugcuccgcgcuggaggacuggugcagcucccagaacaucgagugcgccauccggaagaaccagaaguccauccaggaccucauggagggcaagaccaucgagcccagcgagagcaacgcccugaaggagacguucgacgccucccgcagcucccggaaggacaaggccagcguccuggcgggguggaucgccauccagcccggcgagcaguucgagcccaagcaggccaaggacgccuccaaggagaucgccaacgcgguguucgggcucagcgccaacaugaagaagguguucgucgagcuggaggaggaccagaagaucuaccugaacaacgacgagcaggucgaggccuucuacaccgugugcccggacgagggcguggcccucuucgaggcccugcagagcauguacuccgcguacgugcugaugggcauccucaagggggccgacggcgggagcaucuccagcugcaagguggccgccuacgagcaguacaaggaggaccugaagcugcucaagacccugguccgcgaguucgcgcccaagaaguacgacgaguucuuccggggcgacaucuucgacgccaagaagggguuccgcacccgcaacuacgaccccgccacggccaagggcuacaccaaguacaacuccgugcggggcgccagcuacgacgcguucaagaaggagguggagaagcuguucgaggggaccgccgccgaggaggacguccgcuacaccgacaugaugcagcgguucgacgagggcacguuccuccgccggcugaagaccuccgacaacgggagcauccccuaccagcugcaccucgaggagaugguggccaucaucgagaaccagaagaccuucuacccguuccuggaggagaacaaggagaaguucgagucccuggugaccuuccgcauccccuacuacgucggcccccucacgcagaagaacgcccggcccgacaaccacgggaacgcgcgcuucgccuggagccagcggaaggagggccaggagaacgcccgcguguacccguggaacugggaggaggugaucgaccggaagcaguccgccgccaaguucauggagcgccugaccgggaccugcaccuacauccuggaggagcccguccucccccgguacagccugcuguacgaggaguacugccuccugaacgagcugaacggggcgcgcuggcgggacaugggcggggacuggcaccgcuucgacuacgagacgcggauggacaucaucgaggaccuguucaagaagaagaagggcaccgugaaguacgccaccgucgccgacuggcucgugcgcgagaagcaccgguccugcgccgaggugaagggcggccagggcgagaccggguucgagagcaagcuguccagcuacgucuucuucaagggcgugcugcacguggacgagaucgacgaggcggacauccccaugaucgaggagcucaucugguggaacacgcuguucgaggaccgcuccauccugaaggagagcaucgaggacaaguacggggaccgccucaacgacgagcagaucaaggccaucugcaagaagcgguucaccggcuggggccgccuguccaagaagcugcucugcgggaucaaggcccagaccgacaacggcccgugcagcaucauggacguccugcgggaggggaaccccaacaacgacgcccgcagcgccaccaugguguucauggagaucauccgggacgacaaguucggcuucacgaagcugaucgaggaggagaacaagaagcgcaucuccagcguggacgacuucgacgucaacgaccuccccgggucccccgcggugcggcgcaccgugaaccaggccaagcggaucgucgacgagaucgugggcaucgccggcugcgccccgcagaacaucuucaucgaggugacccgcgacgaggacgggcggaacaagggccgccggaccaagcgccgguacgacgccauccaggaggcggucaaggugcugaagaaggagcagaaggaguacuucgacgccaacguggccgaccugcucaagaacaccgcccccgccgcgcuggacgacgagcgccuggcccucuacuucaugcagaacgggaagugcauguacugcggcaaggaccuggacaucaaccagcuggacaaguaccaggucgaccacauccucccccagagcuacgugaaggacgacuccuucgagaacaaggcccuggugcacagcgacgacaaccagcggaaguccaacagcaugcugcucgacgacuccaucauccgcaagaugaagcccuacugggaggcccugcggagcgcggggcugaucggcgagaagaaguucaagaaccucacgcgcguccggguguccgacaaggagcugggcggguucaucgcccgccagaugguggagaccagccaguccaugaagcugaccagccuccugcuggagcaggccuacccggagacccagguccgccccgugaaggccggcuucuccagcgaccuccggcgccggcugaagcuggugaagugccgcgagaucaacgacuaccaccacgcccacgacgcguaccucgccugcgaggucgggcaguucaucgcccugcggcacaacaagcuguacgagaaccccaucggcuacucccacgccgugaaggacuucaucgccaagcgcgcgaaguacgccagcgagcacgggaagccgauggacacguacggcaugcccggcagcuccagcuucgugaucuccagcuucaugaccuccggguucgacgaggagaccggcgagaucuucaaggacgccugggacgccagccucgccgcgguccggauccaccaggcccugaaccgcaaggacugcuacaucucccggaugcccgaggagaccagcggggccuucugggacgccacgaucuacucccccaagcagaccaagaagaagcugagccucccgcugaagaagggccuggacccccagaaguacggguccuacagccgcgagcaguucgccuacuucuucguguacgaggcgaagaagaucaagaagaaggaggagaccaaggaguacguguucgccuccguccccguccagguggccgcccucguggcggccgaccccaacgcccugaucgaguucgccaaggccgacgcggaggagcggggccugaaguucgccaagaucgugcgcgagaagguguacaaguaccagcucaucgaggucaacgacgagcgguucuucgugaccggccugcgcacggugcggaacgggcugcagaucgccuucagcgagcaggaccgcaacaucgucuccggcaucguggaggggaacagcuccaacaacaaccuccuggacaucuacgacaagaucaccaaccgguacgcccuguacgccagccgcuucggcaagcuccugaaccuguccggcuaccgggagaacuucauccaggcgagccucgaggaccaggagcgcgugguccuggcccugaucagccucuucaacgcccgcaccaacaugaucgaccuguccgccaucgggagcuccaagaccgugggcaacaugagcaugacguucgccaaggagauggcgauggccgacaaccgguucgccuucaucgaccaguccgugaccgggaugcuggagcgcaagaccuaccucuga

SEQ ID NO: 2155 - RNA, 4251 nt, Artificial Sequence
  Cas9 variant
augggcagccgcaucauccccaugucccaggacauccugggggaguucggcaaggggaacagcgugucccagaccagcgagcggaccgccuaccgcuccacgcggcgccuccgggagcgcuuccugcugcggcgcgagcggcuccaccgcguccugaacauccuggacuuccucccgacccacuacgccagccagaucgacuucaagaagcggcugggcaaguucaaggagaacaaggagcccaagaucgcguacgacaacaaguccuuccuguuccucgacagcuucaacgagaugcugaaggacuucgagcaggagcagcccaacaugcugaucaacgagaagggggagaagaagcucauccccuacgacuggacccuguacuaccugcgcaagaaggcccuccgggagaagaucuccaaggaggagcugagcuggaucauccugaacuucaaccagaagcgcggcuacuaccagcuccggggcgaggacgaggaggagaacccguccaagcugguggaguuccacagccugaccguggucgacguggugcccgacgagcccaucaaggggaagcucgagacgugguacuccaucauccuggacaacggcugggucuaccgccggagcuccaagaccgagcuguacgacuggaaggacaagaucaaggaguucaucgugaccaccgaccucaacuacgacgggacggugaagaccgacaaggagggcaacgucaagcgcagcuuccgggcccccuccgagaccgacuggacccugaucaagaagaagacggaguacgagaucgagcagagcuccaagaccaucggggaguacaucuacaacacccugcucaaguacccggagcagaagauccgcggcaagcugauccggaccaucgagcgcaaguacuacaaggaggagcugaagcagauccuccugaagcagacggaguuccacaacgagcugaaggacgacagccucuacuacgacugccugcgcgagcuguaccggaacaacgagagccaccagcuguuccuggagaagaagaacuucgcccagcuguucaucgaggacaucaucuucuaccagcgcccccuccggucccagaagucccugaucagcaacugcccccuggaguucuacaaguucaaggacagcgugggcaacgagaaggugcagcaccucaaggccauccccaaguccaacccguucuaccaggaguuccgcaucuggcaguggaucagcaaccuguccaucuacagcaagcuggacgacuccaacuucaccagccacuucuucgacuccaccgacgacugggagagccucuucgagaugcugaacgggcggaaggagaucgagcagaagcagcugcucaaguuccugcuggagaagaagggcuucaaggggaagucccugagcuccgagaucgagaaguaccgcuggaacuacgucgaggacaagaaguaccccugcaacgagacccggagccucauccagucccgccuggacaagguggcgaaccugcccgagagcuuccucacgcggcacguggagcaggagcuguggcaccugaucuacuccgucaccgacaagaucgaguucgagaaggcccucgacaccuucagcaagaaguacaagaucgacacccccacguucguggacgccuucaagaagugcccgcccuucaagagcgaguacggcuccuucagcgagaaggccaucaagaagcugcugccccucaugcgcaccggcaaguacugggaccuggacaacaucgacaaggcgaccaagcagcggaucgagaagaucaucuccggggaguacgacaaggacauccgcgaccgggugcgcgagaaggccaucaaccugcucagcgagaccgacuucaaccggcugcagcuguggcucgcccaguacaucgucuacgaccgccacuccgaggccacgagccuggacaagugggagaccaucgacgacaucgugaccuaccugcacuccuucaagcagcacagccuccggaaccccaucguggagcaggucaucaccgagacgauccgcguggugaaggacaucugguccaacuacggcaacgggagcaaggacuacuucaacgagauccacgucgagcugggccgggagaugaagcugccggccgaggagcgcaagcgcauccaggagaagaacucccagaacgaggacaccaaccuccggaucaaggcgcugcugagcgagaugcagaacgaccccaacguggagaacguccgccccuacucccccgugcagcaggagauccucaagaucuacgaggagggggugcugaacagcaacaucgagaucgccgacgacauccugaagaucuccaagaccgcccagccgagcuccagcgaccucaagcgguacaagcuguggcuggagcagaaguaccagagccccuacaccggcgagaucaucccccucaacaagcuguucacgcccgaguacgagaucgagcacaucaucccgcagucccgcuacuucgacgacagcuacaacaacaaggucaucugcgaguccgccgugaacaagcugaaggacaacagccucggcuacgaguucaucaagggguacaacggccagaucguggagugcggguucggcaagaaggucaagaucuucuccaucgacgaguacgaggacuucgugcagaagaacuacgccaacaaccggagcaaggcgucccgccugaugauggccgacauccccgagaagaugaucgagcggcagcugaacgacacccgcuacaucagcaaguacaucuccaacauccucagcaacaucgugcgguccgagagcaacgacgacggggucaacuccaagaaccugaucagcgugaacggcaagaucaccaccgugcugaagaaggacuggggcaugaacgacaucuggaacgaccucauccugccccgcuucauccggaugaaccagaucaccgacuccgacagcuucacgaccuggaacgagcgcuuccagaaguucaucccgaccguccccaucgagcuguccaagaacuucagcgccaagcggaucgaccaccgccaccacgccauggacgcccucgugaucgcgugcgccacccgggaccacgugaaccugcugaacaaccucuacgccaaguccagcgcccgcuacgaccugaaccggaagcugcgcaucuucgagaagacgaccuacaaggacaucaagaccgggcagaucaucgagcgggagauccccaaggccuuccucaagcccuggcagaacuucaccacggacgcgaaggacgccaucgagagcaucaucgucuccuacaagcagagccugcgcgugaucaacaaguccaccaacuacuaccagaaguggguggagaaggacggcaucgucaagaaggagaagaucaagcaggaggggaagaacugggccauccggaagccgcugcacaaggacaccgugagcggccucgugcagcuguccugggucaaggugcccaaggggaaggugaugaccgccacgcgcaagagccuggacuccagcuucgaccucaagaccaucgcgaccaucaccgacacgggcauccagaagauccugaucaaguaccuggaguccaagggcaacaaccccgagagcgccuucucccccgaggggaucgaggacuucaacaacaacauccaccucuacaacgacggcaagaagcaccgcccgaucaccaagguccggcuguacgagaucgggagcaaguucccccugggcgagaagggcaacaagaacgccaaguacguggaggccgccaaggggaccaaccucuucuucgcgguguacgccaacaacaagggcgagcgcuccuucgagaccaucccccugaaccuggucaucgaccggcucaagcuggggcugagcgccgugcccgagacgaacgagaagggcgacaaccuccuguuccaccuguccccgaacgaccucguguacguccccagcgaggacgagauggagaaccugaagcugaucaaccucgagcacaucuccaaggaccagcugaaccgcaucuacaagauggugagcuccaccagcaaccggugcuucuucaucaagagcgagaucgcccuguccaucgugaacaagaucgaguacagcccccucaacaagauggagaaguccaucgaggggaucaugaucaaggacgucugccugaagcuccaggugaaccgcaucggcaaccucgagcgguacuucagcuga

SEQ ID NO: 2156 - RNA, 4257 nt, Artificial Sequence
  Cas9 variant
augaaggugaagaacauccugggccucgacaucggggucaccagcaucggcuucgcccacgugaccgagaacgagaaggacaacaagucccacaucaagcagcugggggugcgcaucaacccccugacggucgacgagcagaccaacuucgagaagggccggccggccagcgugaacgcggaccgcacccucaagcgcggggcccggaagaugcugucccgguacaaggaccgccggaagaaccugaucgagauccucagcaagaccggcuucaucaacuccgagagcauccuggccgaggacggcaagaacacgacccacuccaccugggcccugcgcgccaaggcgagccgggagcgcaucgagaaggacgagcucgggcgggugcugcuggccaucaacaagaagcgcggcuacaaguccagccggaaggccaagaacgaggacgaggggcaggccaucgacggcauggcgaucgccaagcgccucuacgaggagaaccugacccccgggcagcuggucuaccagcuccugcgggagggcaagaaguacauccccgacuucuaccgcuccgaccugcaggacgagcucgacaagguguggaacuuccagaagcaguuccaccaggagauccugacggacaccuucuacaaggacauccagggcaaggggcagcgggccaccagcgccuccuucuacggcguguacggguucaacaccgccgagaacaagggcagccgcgaggagaagcggcugcaggcguacgccuggcgcuccgacgcccucacgaagcagcugacccgggaggaggucgccuucgugaucaccgagaucaacaacaaccugaacaacagcuccggcuaccucggggccaucagcgaccgcuccaaggagcuguucuucaacaagaagaccgugggccaguaccuguacgagcagcuccagcagaacccccacacgcgccugaagaaccaggucuucuaccggcaggacuaccuggacgaguucgagaccaucuggaccauccagagccgcuacuacccggagcucaccgacgaccugaagcgggagauccgcgacguggugaucuucuaccagcggaagcucaagagccagaaggggcucgucuccuucugcgagcuggagagcaaggagaucaugaucgagaagaacggcaaggcggccgugaagaagaucggguccaagguggcccccaagagcagcccccuguuccaggaguucaagaucuggcagguccuccacaacguggacaucaagaacaagaaggacaagacgaagcgcccccuggacgacuccgagaaggaguaccuguucaacgagcucaacaucaagggcaaccugaaggccgccaaggugauccagcugcucacccugaacaagaacgagaccgagcugaacuacacccagcucgagggcaaccggacgcagaaggcgcuguacgaggccuaccugaagauccucgacaccgagggguacgacgucaacaaccugcugggcaucaaguccaacaaggacgagguguuccuggacgaccucgacgugaacgcccuggagaucaagaccaugaucaagcagaucuucaacgcccugaacaucaacaccgggauccucgacuucgacgccgagcuggacggcaaggcguucgagcagcaggccagcuaccaccuguggcaccuccuguacuccuacgaggaggacgggagcaaguccggcaacgagcaccuguacaagcuccuggagaacaaguucggcuucaagccggagcacgcccgcauccuggccgggaucacgcucagcgacgacuacggcaaccuguccgcgaaggccaugcggaagaucuacccccagaucaaggagaacaacuucagcaccgccugcgagcuggucggguaccgccacuccaagaacagccucaccaaggaggagaaccaggagcggccccugaagaacaagcuggagcuccugaagaagaacucccugcgccagcccguggucgagaagauccucaaccagaugaucaaccuggugaacgagcugaucgacaagaacagcgagaaggacgagcagggcuccaucaucgaguacuuccgguucgacgagauccgcaucgagcucgcccgggagcugaagaagaacaccgacgagcgccgggaccuggacgccgcgauccgcgaggggaaccuccggaacgagaagaucuacaagcugcugcaggcccaguucggcaucaagaacccgacgcgcaacgacaucauccgcuaccggcucuacgaggagcugaagaacaacggcuacaaggaccuguacaccaacagcuacaucccccaggagaagcuguucgggaaggagaucgacaucgaccacaucaucccccagagcaagcuguucgacgacuccuucagcaacaagacccugaccuacaacacgaccaacaaggacaagggcaaccagaccggguucgacuacaucgaguccaaguacggcaucgacggcaucgaggccuacaccgcccgcaucgagaaccucuucgagagcgggaagaagaacaaggaggagggcguguccaaggccaaguaccagaagcugcugaagaaggagagcgagaucggggacggcuucaucgagcgggaccuccgcgagucccaguacaucgcgaagaaggccaaggagcugcugcuccagaucacccggagcgucguggccacguccgggagcaucaccgcccgccugcgggaggacugggaccuggugaacgucaugaaggagcucaaccugcccaaguaccgcgcccugggccucaccgagauggaggagcggaaguacggccagaagguggaggugaucaaggacuggaccaagcgcgacgaccaccggcaccacgcgauggacgcccugacgaucgccuucaccaagcacaaccacauccaguaccugaaccaccucaacgcccgcaaggacgagcagcacaaggagcacaagaucaucaacgcgaucgagaacaaggagaccauccugaucaccgacaaguccgggaaccggaagcgcgucuucaaggccccgaugcccaacuuccggcagacggccaagcaguaccuggaggaggugcucaucagccacaaggccaagaacaagguggucaccaagaacaagaacaagauccugggcaaggagaagauccaggagacccugacgccccgcgggcagcuccacgaccagaccaucuacggcuucaacugguggucccggaucacccugagcaagaaggugucccgcaacgagaucgagaagaucaucgacaacaacaccaaguucuuccugcaggaguucauccagcucaaggggagcaucgccaaggcguucuccgacgccgagcugaacaagcugauguacaagggcaagauccucaaggagaucgagguggccauccccugcuacacccagcggaucgacaucagcaaggucuucacggacagccagaaguccaacagcgccaaggagaagaacaucaagaacauccuggaccugaaggugcgcaacauccuccagaaccggcuguccgaguucaagggcgacuucaagaaggccuucagcgaccuggacaagaacccgaucugguucaacaaggagaaggggaucuccaucaagcgcgugaucaucagcggcgucaagaacguggagccccuccacuacaagaaggaccaccuggggaacgacauccuggacggcaaggagaaccgcauccccguggacuucaucuccaccgggaacaaccaccacgucgcgaucuaccaggacgagaagggcaaccuccaggagaagguggugagccuguucgacgccgucaagcuggugaacgccgacgagcccgugaucgacaagaccuacaaccagggccucggguggcaguuccuguucaccaugaagcagaacgagauguucgucuucccgaacgacaacacgggcuucgaccccaaggagaucgaccugcucgaccccuccaacaagaagcugaucagccccaaccuguuccgggugcaguccaucagcaucgugcaguacgggaacaacaucguccgcgacuucaaguuccggaaccaccucgaguccgugcugaacgacgacaaggugcugcacggcaucaccuuccagcagaucaagagccucgggccgcugcugaacaucgucaaggugcgcaucaaccaccucggcgacaucguguccgucggcgaguacuga

SEQ ID NO: 2157 - RNA, 4260 nt, Artificial Sequence
  Cas9 variant
auggccaagccccagaacuacaccaucggccuggacaucgggaccaacagcgugggcuggacggucaccgacgaccagaacaacauccuccgcaucaaguccaagaaggccaucggggcgcggcuguucgaggagggcaagguggccgccgagcgccggagcuuccgcaccacccggcgccggcugucccgccggaaguggcgcaucaagcuccuggaggagcuguucgacgaggagaucagcaagguggacccgaacuucuucgcccggucccacgagagcuggaucucccccaaggacaagcgcgagcgguacagcgccaucgucuuccccacgcccgaggaggacaagaaguuccacaacgaguacccgaccaucuaccaccuccgcgaccggcugaugaaggacgaccagaagcacgacauccgcgagaucuacguggcgauccaccacaucaugaaguaccgggggaacuuccugcacgacgaguccaucgagaccuaccgcagcggcauguccagccucggcgggggcgacgagcggaccauccugaacacgaagauccuggacgaccucaacgacgccuucgccgacaaccuggccacccaggggaucuccgugaacagcgcguccgccgaccagaucaacgagaucgucaccagcggccaccugaacguggacucccagaaggccaucgccaagcuccugcugcccaccacgcucagcuccgacgacaagaagcaggacaagaagaucaagaagcuggccaccgacgcggccaagaacguggccagcgccuggcugggguacaaggccaacuucgcggccauccucaacauccaggaggucgacaaggacaagaagaagaucuacagcuucgcccugcagggcgccgacgaggaggacaagguggagacccuggaguccgugcucagccaggaccagaucgagaucgucgaccgcaucauccggauccgccacgccaucgugcugggcgagaucauccccguggggaugacccuguccgaggcgaugaucgagaaguacgaccagcacgccaaggaccucaagaaccugaagacggucauccgcaaccugaaggaccggaagaacgccgugaagcuccaggccaucuacgaccuguacgugaacaaccgccacgccgacaccgcgaaggccaugaagcuggccggcgucaagaagcggaccgagcuccuggagcccgaggaguucaacaagagcaucgagaagcugcucgacgacuccccggugagcgccgagaucaagaagcgcaucgcggagaaggacuuccugccccugcagcgguccaacagcaacggggugauccccaaccagcuccaccagaucgagcuggacgagaucaucaagaagcaguccaaguacuaccccuuccugggcgagaccaacgagcacgccagcgccgacgucgcccgcaaggccccgacgaagcucgaccagcugcugaccuuccgggugcccuacuacgugggcccccucaucaccaaggaggagcaggaggagcaggacgggcacuccuucgcguggaugauccgcaagaaccccaaggaccacgagaagaucaccccguggaacuucgacgagaaggucgaccggauggccagcgccacgcaguucaucaagcgcaugaccaccaaggacaccuaccugcugggcgaggacgugcuccccuccagcucccugaaguaccagcuguucacgguccugaacgagcucaacaaccugcggaucaaccacaagaagcugacccgcgaggagaaggagcaggucaucgaggaccucuucaagaaguacaagaccgugaaggccgacaaguucaagaacuacuggcagaaggggcacgccggccuggacgugaagauccaggggauggcggaccccgagaaguucaacagcaccauguccacguacaucgaccugcagaagaucuucggcgaccagcucgacgacgcccagcggcagaacgacuucgagaagaucaucgaguacagcaccaucuucgaggaccgcaagauccugggcgagaagcugcgggccgacuucguguggcucuccgaggaccagaucaagcgccugugccggcugcgccuccagggguggggccggcugagccugaagcuccugacccgccugaccgacgccgacgggcagaacgugcucgagcgccugcugaacagcaacgacaacuucaugcagaucgucaaggaccccgugaucaaggccaagaucgagcagaagaaccagaagcuccugcgggcggacugguccgagaacgccacggagagcauccuggacgaggccuacaccuccccgcagaacaagaaggccauccgccaggugaugcgggucgugcacgacaucgugaaggcgugcgacggcaaccuccccgccaaguucgccaucgaguucgcccgcagccaggacgacgaccccaagcggaccgucgcccgcgcggaccggcugcagaagaucuacgcccagaucuccgacgagguggugagccagggggucaaggaccagcuguccggcaugaagucccucaaggaccgcuacuaccuguacuucaugcagggcgggcgggacgccuacaccggcaagccccugaacaucgaccgccucagcgacuacgacaucgaccacaucaugccgcagagcuucaucaaggacgacucccuggacaaccgggugcuggugacccgcgccgucaacaaccagaaguccgacaacgugcccgugcuccuguacgggaaccaccuggucgccgaccucggcaucacgauccgggagaugugggaccgcuggcagaaguccgggaugaucagcaagcggaagcuggcgaaccugcucaccgaccccgccacccugagcgaguaccgcgccgagggcuucaucaaccggcagcugguggagaccagccaggugaucaagcucacggccaccauccugcaguccgaguuccccgacagcaagaucaucgaggucccggccaaguacaacagcauccugcgcaagcaguucgaccucuacaagucccgggaggugaacgacuaccaccacgcgaucgacgccuaccugagcaccaucgugggcaacuaccuguaccaggucuaccccaaccuccgccggcuguucguguacggggaguucaagaaguucucccacggcgaggaggagagcucccaccaggccgugcgccgcgucaagagcaugaacuuccuggacgaccuccugcgggggaagcacggcgacgacaucuacugccgcgugaccggcgaggugaucuucucccggaaggacaucaucagcaagcugaagcaggccuacuccuucaagcagaugcucgucacgcaggagguguucaccaagaaguccgcgcuguucgaccagaccguguaccccagcccggcccgcgacagcaagacccgguccgggcugaucccccgcaagcagggcauggacacggagaucuacgggggcuacagcgggaacaaggacgccuacuucguccucgcccagguggugaaguccaagggccacacccugcaggucgugggcgugcccauccgggcccugcgcgcgcucgccaacugcagcaacuacuccgagcagcugcugaagaucgucaaggcccagguccucuucaacaagaagaccgggaaggccaagaagggcaucagcgacgugcggauccugcuggacaagauccccuaccgccagccggugcucgacggguccgccuucuacaugcugggcagcagcaccuacaaguacaaccugaagcagaucucccucagccagcaguccaugaaguacauccuggacuacaucgacgaccccaacuucaacaagcacgagaugacgaagaucgaccagcagaacgagaaggagugccugcucagcguguacgacgagauccuggacaagauggacaaguaccugucccucuacgacaucaacggguuccggaagaagcugcacgugggccgcgacaaguucaucaagcuggaggucgagaagcaggcggaggccaucaagaacgugcuccggggcuuccacgccaacagcgacaugaccaagcuguccgaccuggggcucagcaccucccugggcuucaugcaggccagcgacgggaucaagcuguccgacaacgccguguucaucuaccagagccccaccggccucuucgagcgccgggucaagguguccgaccugcugaaguga

SEQ ID NO: 2158 - RNA, 4260 nt, Artificial Sequence
  Cas9 variant
augaugaucaagaacauccugggccucgaccuggggaccaacagcaucggcugggcccugaucaagcagaacuucgagaacaaguacggggagauccucggcauggggucccgcaucauccccaugagccaggacgugcugggcgaguucggcaaggggaacuccgucagccagaccgccgcgcggacgggcuaccgcggggugcggcgccugcgggagcgcuuccuccugcggcgcgagcggcugcaccgcgugcucaacguccugaacuuccugccggagcacuacgccucccagaucgacuucgagaagcgguucggcaaguucaaguacgagaccgagcccaagcucgccuacaacaacgacggguucuucuucaagaacagcuucgacgagaugcugggcgacuucaaggaccaccaguuccaccuccuggagaacggccgcaaggugcccuacgacuggaccaucuacuaccugcggaagaaggcccugucccagaagaucgagaaggaggagcucgccuggauccugcugaacuucaaccagaagcgcggguacuaccagcuccggggcgaggacuucgaggaggagaaggaccgcguguucguccggcugaagguggaccgcguggucgacagcggggagaacaucaagggcaagauccuguacgacguguacuucgagaacggcuggaaguacgagaagcagaucgugaagaccgaggacuggaucgggcggacgaaggaguucaucgucaccgaguccauccucaagaacggcgacaccaagcgcaccuucaaggcgguggacagcgagaaggacuggaucgccaucaagacgaagaccgagcaggagaucgacaagucccacaagaccgugggggccuacaucuacgaggcccugcugcagaaccccaagcagaagaucaagggcaagcucguccggaccaucgagcgcaaguucuaccgcgaggagcugaagaagauccuggagcggcagaaggaguuccacccggagcuccagagcgacgaccuguacaacgacugcauccgcgagcuguaccggaacaacgaggcgcaccagaucacgcucuccaagaaggacuucgugcaccuccugcugaacgaccugaucuucuaccagcgcccccugcggagccagaaguccagcguguccaacugcacccucgaguuccgcaaguacaaggacgagaacggggucgagcacgcccaguaccugaagaccauccccaagagcaaccccuacuaccaggaguuccggguguggcaguggauguucaaccugaacaucuaccgcaaggacgacgacaccaacgugacgaaggaguuccucuccagcaccgaggacuacgagacccuguucgaguuccugaacaaccggaaggaggucgaccagaaggcccuccugcgccacuucaagcugaacgagaagacccaccgguggaacuacguggaggacaagaaguacccgugcaacgagacgaagaccaugaucagcacccgccucgagaagguggagaacuaccccuccgacuuccugacccgggagauggagcagaacaucuggcacaucaucuacagcgucaacgacaagaucgaguacgagaaggcccugaaguccuucgcccacaagaacaaccuggacgagaacagcuucuucgaggcguucaagaaguucccgcccuucaaguccgaguacggcagcuucuccgagaaggccaucaagaagcuccugccccugcuccgccugggcaaguacuggaacugggagagcaucgaccggaagucccaggggcgcaucgagaagaucaucacgggcgaguucgacgggaacaucaaggacaaggugcgggagaaggccauccaccugaccgccgagaacgacuuccagggccuccagcuguggcuggcccaguacaucgucuacgggcgccacagcgaggcguccaugaucggcaaguggaacagcgccgacgaccucgaggaguuccugaagggcuucaagcagcacucccugcggaaccccaucguggagcaggucaucaccgagacccuccgcguggugaaggacaucuggcugaaguacgggaacggcgccaaggacuucuucagcgagauccacaucgagcuggggcgcgagaugaagcagacgaaggacgagcggguggacgccaccaagcgcaucaccgagaacgagaacaccaaccuccggaucaaggcccugcuggcggagaugaugaacgacaacuccgucgagaacauccgccccuacagccccaugcagcaggagauccucaagaucuacgaggacggcauccugaaguccgacaucgagaucgacgacgacauccugaagaucagcaagacggcccagccguccagcagcgaccucaagcgguacaagcuguggcuggagcagcgcuacaagucccccuacaccgggcagaucaucccccucaacaagcuguucaccagcgaguacgagaucgagcacaucaucccccagucccgguacuucgacgacagcuucuccaacaagaucaucugcgagagcgccgugaacaagcugaaggacaacuacaucggccucggcuucaucaagcaguucgggggcaugaucguggagugcggguucggcaaguccgucgagaucuucaaggccgaggaguacgaggacuucgugaagaagcacuacgccaacaaccgcagcaagcggaacaagcugcugcucgaggagaucccggagaagaugaucgaccgccagcugaacgacacccggcacaucuccaaguacaucagcggcgugcuguccaacaucguccgccaggaggacgggacggacgagggcgugaacagcaagaacaucgugcccgggaacggcaagaucaccacccagcucaagcaggacugggggcugaacgacgucuggaacgagcugauccucccccgguucgagcgcaugaaccagcugaccaacuccaccgacuucacgagcuggaacaagaaccaccagaaguuccugcccaccgugccgaucgaguucuccaagggcuucagcaagaagcggaucgaccaccgccaccacgcgauggacgcccucgugaucgccugcgccaccaaggaccacaucaaccugcugaacaaccaguccgccaagagcgacaccaagcgguacgaccucaagcgcaagcugaugaaguucgagcgggucguguacagccacuccaagacgggcgagaagaucgagaaggaggugcccaagcaguuccugaagcccugggacaacuucaccgucgacgcgaagaacaagauggagaccaucaucgugagcuucaagcagaaccuccgcgugaucaacaaggccaccaaccacuacgagaaguggaucgagaaggacgggaucaagcggaaggagcugaucaagcaggagggcacgaacugggccauccgcaagcccaugcacaaggagaccgucuccgggaagguggaccugccgggcaucaagauccccaaggggaagauccucaccgccacccgcaagagccuggacacguccuucgaccugaagaccaucaacagcaucaccgacaccggcauccagaagauccucaagaacuaccuggaguucaagggcuccagcgagcuggcguucucccccgaggggaucgaggacaugaacaagaacaucgagaaguucaacgacggcaagccgcaccagagcaucaacaaggugcggaucuucgagcucggguccaaguucagcgucggccagacggggaacaagaaggacaaguacguggaggccgccaagggcaccaaccuguucuucgccguguacgaggacaagaacggcaagcgcuccuacgagaccaucccccugaacgaggucaucgagcggcagaagcaggggcucgacagcguguccuucaagaacaaggaggacuuccugcugugccccaacgaccucguguacguccccagcgaggacgagcuggagaacaucuacaacaucgacuucaagaaccugaccacggagaagaccggcaacaucuacaaggugguguccuucagcgggaaccagaucuucuucauccgccaggacaucgccaucuccaucgucaacaaggcggaguucagcacccucaacaagauggagcgggccaucgacggcagcaugaucaaggagaacugcaucaagcugaagaucgaccgccuggggaacaucgccaagaucuga

SEQ ID NO: 2159 - RNA, 4263 nt, Artificial Sequence
  Cas9 variant
auggccaagcccaaggacuacaccaucggccuggacaucgggaccaacagcgugggcugggucgugacggacgaccagaacaacauccuccgcaucaaggggaagaaggccaucggcgcgcggcuguucaccgaggggaagguggccgccgagcgccgguccuuccgcaccacccggcgccggcugagccgccggcgcuggcggaucaagaugcucgaggagcuguucgacgaggagaucgccaaggucgacccguccuucuucgcccgccugcacgagagcuggaucucccccaaggacaagcggaagcgcuacagcgcgaucguguuccccucccccgaggaggacaagaaguuccacgagagcuacccgacgaucuaccaccuccgggacaagcugaugaaggacgaccagaagcacgacauccgcgagaucuacaucgccgugcaccagaugaucaaggcccggggcaacuuccugcacgacgaguccgucgagaccuaccgcagcggcauguccagccucgggggccgguccgagcgcaccauccugagcgugcagacccuggaggagcucaacgaccuguucgccgagaacgaggggacggaggagguggagcugaacgucgcguccgccgagcagaucaacgacauccucaccggcgggcaccugaacgccgacagccagaaggagaucuccaaccugcuccugcccagcuccuuccccagcuucgacgacaaggccaaggagaagcaggucaagaagcugaucaacaacguggccaccaacaucagcaaggcguggcucggcuacaaggccgacuucuccaccauccugaaccuggccaagguggacaaggaccagaagaagaucuucgccuucgcccuccagggcgaggacgaggaggacaaggugcaggagcuggagagccugcucgagcagucccagacggacaucguggaccggcugaucgagauccgccacgcgaucguccugagcgagaucgugcccguggggaugacccucuccgaggccaugaucgacaaguacgaccagcacaaggaggaccugaucacccugaaggccgucauccgcaacaccaaggacaagaagaaggccgccaagcuccaggcgaucuacgaccuguacgugaagaaccggcacgccgaccuggccaaggccaugaagcucacgggcaucaagaagcgcagcgagcugcuggacccggaggagcucaagaaggggaucuccagccugcuggacgacucccccgaggccguggagaucaagcagcggcucgaggagaagaccuuccugccccugcagcgcagcaacaacaacggcgucauccccaaccagcuccaccagguggagcuggacgagaucaucaagaagcaguccaaguacuacccguuccuggcggagaagaaccccgacgagagcgaggaggcccagaagaaggcccccaccaagcucgacgcccugcugaccuuccgggugcccuacuacgucggcccgaugaucacgaaggaggagcaggaggcgcagaacgggcacuccuucgccuggauggugcgccgggacccccaggaccacgaggccaucacccccuggaacuucgagaagaaggucgacaagauggccagcgccacccaguucaucaagcgcaugaccacgaaggacaccuaccugcucggcgaggacgugcugcccgcguccagccugaaguaccagcuguucaccgugcucaacgagcugaacaaccuccgggucaacgggaagaagcugaccuccgacgagaaggagcaggucaucgagggccuguucaagaagcagaagacggugaaggccgacaaguucgugaaguacuggcaggccaagcacaucggggccgacaucaaggugaagggccucagcgacccguccaaguucaacagcaccaugagcaccuacaucgacuucaagaagaucuucggcgaccagcugaacgacgugaaccgccagaacgacuucgagaagaucaucgaguacuccaccaucuucgaggaccggaagauccuggaggacaagcuccgcgccgacuucgcguggcugagcgaggagcagaucaagcagcugugccggcuccgccugcagggguggggccggcuguccgacaagcuccugacgcgccugaccgacgccgacgggcagaacguccucgagcggcuguggaacagcaacgacaacuucgugcagaucguguccgaccccaacaucaaggccaagaucgagcaggagaaccagaagcugcuccgcgacagccaguccgacaacgccgucgagagcauccuggacgacgccuacaccagcccccagaacaagaaggcgauccgccaggugaugcgggugguccacgacaucgugaaggccugcgacggcaacgugcccgccaaguucgccaucgaguucgcgcgcagccaggaggacgacccgaagcggaccacggcccgcgucaaccagaugcagaagaucuacgaccagaucuccgacgagguggugagccagggggucaaggagcagcuguccggcaugaagucccucaaggaccgguacuaccuguacuucaugcagggcgggcgcgacgccuacaccggcgccaagcugaacaucgaccggcucuccgacuacgacguggaccacaucaugccccagagcuucgugaaggacgacucccuggacaaccgcguccugguggcccgggcggugaacaaccagaaguccgacaagguccccgcccuccuguucgggaacaaggugguggccgaccugggcaucaccguccgcgagaugugggacaaguggcagaagcucgggaugaucagcaagcggaagcugagcaaccugcucaccgaccccgacgcccugaccgaguaccgcgcccagggcuucauccggcgccagcugguggagacgagccaggugaucaagcucaccgcgaccauccugcaguccgaguucccggacagcaagaucaucgagguccccgccaaguacaacuccaucgugcggaagcaguucgaccuguacaagagccgcgaggugaacgacuuccaccacgccaucgacgccuaccucuccaccaucgucggcaacuaccuguaccagguguaccccaaccugcggcgcauguucguguacggggaguucaagaaguucagcuccaacgccgaggagagcgcgcacgacgucgcccggcgcgugaaguccaugaacuuccucgacgaccugcugcggggcacgcacggggacaacaucuacugccgcagcaccggcgagaucguguucaaccggaacgacaucaucuccaagcucaagcaggccuacagcuucaagcagaugcuggucacccaggagguguucacccgcaaguccgcccuguucgaccagacgguguacccgagccccgagcgcgacuccaagaagcggagcggccucaucccccgcaagaaggggauggaccccgagaucuacggcggguacgcgcacaaccaggacuccuacuucguccuggccaagaucgagaaggugaagggcuacacccugcagaucgugggggucccgauccggagccucgagaucaucaacaaggccgaggacuucagcaccgcccugcuggacaucaucaaguccaaggugauguacaacgagaagaccggccagcccaagcgcggcaucaagaacguggagauccucgucaacaagcugcccuaccggcagcccauccuggagaaggacgugagcuacaugcucggguccagcgccuacaaguacaacaugaagcagaucacgcugucccgccagagcaugaaguacauccuggacuacaucgacgacccgaacuucaccaagcacgagaugaccaugaucgacgagcagaacgagcgggagugccuccuguccgucuacgacgagauccuggagaagguggacaaguaccucccccuguucgacggcaacaaguuccgcgagaagcugcacagcgcgcggaaggaguucgugucccucagcgucgacgacgaggccuccgccaucgagaagauccugcgcgggcugcacgccaacagcgagaugcccucccucgagaaccugaagaucaagcccgcccugggcuucuuccagaugaagaacgggaucacccucagcaacgacgcggugcugcuguaccaguccccgacgggccucuucgagcggcgcgugaaggucagcgaccugcugaaguga

SEQ ID NO: 2160 - RNA, 4263 nt, Artificial Sequence
  Cas9 variant
auggccaagcccaaggacuacaccaucggccuggacaucgggaccaacagcgugggcugggucgugacggacgaccagaacaacauccuccgcaucaaggggaagaaggccaucggcgcgcggcuguucaccgaggggaagguggccgccaagcgccgguccuuccgcaccacccggcgccggcugagccgccggcgcuggcggaucaagcuccuggaggagcuguucgacgaggagaucgccaaggucgacccguccuucuucgcccgccuccacgagagcuggaucucccccaaggacaagcggaagcgcuacagcgcgaucguguuccccucccccgaggaggacaagaaguuccacgagagcuacccgacgaucuaccaccuccgggacaagcugaugaaggacgaccagaagcacgacauccgcgagaucuacaucgccgugcaccagaugaucaaggcccggggcaacuuccuccacgacgaguccgucgagaccuaccgcagcggcauguccagccucgggggccgguccgagcgcaccauccugagcgugcagacccuggaggagcugaacgaccuguucgccgagaacgaggggacggaggagguggagcucaacgucgcguccgccgagcagaucaacgacauccugaccggcgggcaccugaacgccgacagccagaaggagaucuccaaccuccugcugcccagcuccuuccccagcuucgacgacaaggccaaggagaagcaggucaagaagcucaucaacaacguggccaccaacaucagcaaggcguggcugggcuacaaggccgacuucuccaccauccugaaccucgccaagguggacaaggaccagaagaagaucuucgccuucgcccugcagggcgaggacgaggaggacaaggugcaggagcuggagagccuccuggagcagucccagacggacaucguggaccggcugaucgagauccgccacgcgaucguccucagcgagaucgugcccguggggaugacccuguccgaggccaugaucgacaaguacgaccagcacaaggaggaccugaucacccucaaggccgucauccgcaacaccaaggacaagaagaaggccgccaagcugcaggcgaucuacgaccuguacgugaagaaccggcacgccgaccucgccaaggccaugaagcugacgggcaucaagaagcgcagcgagcugcucgacccggaggagcugaagaaggggaucuccagccugcucgacgacucccccgaggccguggagaucaagcagcggaucgaggagaagaccuuccugccccugcagcgcagcaacaacaacggcgucauccccaaccagcuccaccagguggagcuggacgagaucaucaagaagcaguccaaguacuacccguuccuggcggagaagaaccccgacgagagcgaggaggcccagaagaaggcccccaccaagcucgacgcccugcugaccuuccgggugcccuacuacgucggcccgaugaucacgaaggaggagcaggaggcgcagaacgggcacuccuucgccuggauggugcgccgggacccccaggaccacgaggccaucacccccuggaacuucgagaagaaggucgacaagauggccagcgccacccaguucaucaagcgcaugaccacgaaggacaccuaccugcucggcgaggacgugcugcccgcguccagccugaaguaccagcuguucaccgugcugaacgagcugaacaaccuccgggucaacgggaagaagcugaccuccgacgagaaggagcaggucaucgagggccuguucaagaagcagaagacggugaaggccgacaaguucgugaaguacuggcaggccaagcacaucggggccgacaucaaggugaagggccucagcgacccguccaaguucaacagcaccaugagcaccuacaucgacuucaagaagaucuucggcgaccagcugaacgacgugaaccgccagaacgacuucgagaagaucaucgaguacuccaccaucuucgaggaccggaagauccuggaggacaagcuccgcgucgacuucgccuggcugagcgaggagcagaucaagcagcugugccggcuccgccugcagggguggggccggcuguccgacaagcuccugacgcgccugaccgacgcggacgggcagaacgugcucgagcggcuguggaacagcaacgacaacuucgugcagaucgucuccgaccccaacaucaaggccaagaucgagcaggagaaccagaagcugcuccgcgacagccaguccgacaacgccguggagagcauccuggacgacgccuacaccagcccccagaacaagaaggccauccgccaggugaugcgggucgugcacgacaucgugaaggcgugcgacggcaacguccccgccaaguucgccaucgaguucgcccgcagccaggaggacgacccgaagcggaccacggcgcgcgugaaccagaugcagaagaucuacgaccagaucuccgacgagguggucagccagggggugaaggagcagcuguccggcaugaagucccucaaggaccgguacuaccuguacuucaugcagggcgggcgcgacgccuacaccggcgccaagcugaacaucgaccggcucuccgacuacgacguggaccacaucaugccccagagcuucgucaaggacgacucccuggacaaccgcgugcugguggcccgggccgucaacaaccagaaguccgacaaggugcccgcgcuccuguucgggaacaagguggucgccgaccugggcaucaccgugcgcgagaugugggacaaguggcagaagcucgggaugaucagcaagcggaagcugagcaaccugcucaccgaccccgacgcccugaccgaguaccgcgcccagggcuucauccggcgccagcugguggagacgagccaggucaucaagcucaccgccaccauccugcaguccgaguucccggacagcaagaucaucgaggugcccgcgaaguacaacuccaucgugcggaagcaguucgaccuguacaagagccgcgaggucaacgacuuccaccacgccaucgacgccuaccucuccaccaucgugggcaacuaccuguaccagguguaccccaaccugcggcgcauguucgucuacggggaguucaagaaguucagcuccaacgccgaggagagcgcccacgacguggcgcggcgcgugaaguccaugaacuuccucgacgaccugcugcggggcacgcacggggacaacaucuacugccgcagcaccggcgagaucgucuucaaccggaacgacaucaucuccaagcucaagcaggccuacagcuucaagcagaugcuggugacccaggagguguucaccaagaaguccgcccuguucaaccagacggucuacccgagccccaagcgcgacggcuccaagcgcagcgggcucaucccccggaagcgcggcauggaccccgagaucuacgggggcuacgcccacaaccaggacucccacuucgugcuggcgaagaucgagaaggugaagggguacacccugcagaucgucggcgugccgauccggagccucgagaucaucaacaaggccgaggacuucagcaccgcccugcuggacaucaucaaguccaaggugauguacaacgagaagaccggccagcccaagcgcgggaucaagaacgucgagauccucgugaacaagcugcccuaccggcagcccauccuggagaaggacgucagcuacaugcucggcuccagcgccuacaaguacaacaucaagcagaucacgcugucccgccagagcaugaaguacauccuggacuacaucgacgacccgaacuucaccaagcacgagaugaccaugaucgacgagcagaacgagcgggagugccuccuguccguguacgacgagauccuggagaagguggacaaguaccucccccuguucgacgggaacaaguuccgcgagaagcugcacagcgcccggaaggaguucgucucccucagcguggacgacgaggcguccgccaucgagaagauccugcgcggccugcacgccaacagcgagaugcccucccucgagaaccugaagaucaagcccgcccugggguucuuccagaugaagaacggcaucacccucagcaacgacgccgugcugcuguaccaguccccgacgggccucuucgagcggcgcgucaaggugagcgaccugcugaaguga

SEQ ID NO: 2161 - RNA, 4263 nt, Artificial Sequence
  Cas9 variant
auggccaaguucaacaagaacuacagcaucggccuggacaucgggguguccagcgucggcuacgccguggugaccgacgacuaccgcguccccgcguucaaguucaaggugcucgggaacaccgagaaggagaagaucaagaagaaccugaucggcuccacgaccuucgugccggcccagagcgcccaggggacccgggucuuccgcgugaaccggcgccggaucgaccgccggaaccaccgcaucgccuaccugcgggacaucuuccagaaggagaucgagaagguggacaagaacuucuaccgccggcucgacgaguccuuccgcguccugggcgacaagagcgaggagcugcagaucaagcagcccuucuucggcgacaaggagcucgagaccgccuaccacaagaaguaccccacgaucuaccaccuccggaagcaccuggcggacgccgacaagaacucccccguggccgacauccgcgagguguacauggccaucagccacauccugaaguaccgggggcacuuccugacccuggaccgcaucaacccgaacaacaucaacaugcagaacuccuggaucgacuucaucgagagcugccaggaggucuucgaccucgagaucuccgacgagagcaagaccaucguggcgaucuucaaguccagcgacaaccggcaggagaaggugaagaagauccuguccuacuuccagcaggagcugcucaagaaggacaagagcaucuucaagcagcugcugcagcuccuguucggccugaagaccaaguucaaggacugcuucgagcucgaggaggagcccgaccugaacuucuccaaggagaacuacgacgagaaccuggagaacuuccucgggagccuggaggaggacuucuccgacgucuucgccaagcugaaggugcuccgcgacacgauccugcugagcggcaugcucaccuacaccgggaccacgcgggcccgcuucagcgccaccaugguggagcgguacgaggagcaccgcaaggaccugcagcgcuucaaguccuucgucaagcagaaccugagcgagcaggacuaccucgacaucuucggccggaagacccccaacggcuucgacguggacaaggagaccaagggguacgugggcuacaucuccaacaagaugguccugacgaacccccagaagcagaagaccauccagcagaacuucuacgacuacaucagcgggaagaucaccggcaucgagggcgccgaguacuuccugaacaagaucuccgacgggaccuuccuccgcaagcugcggacgaccgacaacggcgcggugccgaaccagauccacgccuacgagcuggagaagaucaucgaccgccagggggaggacuaccccuuccuccuggagaacaaggacaagcugcucagcauccugaccuucaagauccccuacuacgugggcccccuguccaaggggaacaacagccgguucggcuggaucaagcgcaccaucucccaggacauccucgacgacaacgacgaggacacgcggaacggcaagauccgcccguggaacuaccagaagcugaucaacauggacgagacccgggacgccuucaucaccaaccugaucgggaacgacaucauccuccugaacgagaagguccugcccaagcgcagccugaucuacgaggaggugaugcuccagaacgagcugacccgggucaaguacaaggacaaguacggcaagacgcacuucuucgacuccgagcugcgccaggagaucaucaacaaccucuucaagaccaacaacaagcgggugagcuccgccaugcugcuggacuaccucgagaacuacaccaaccugcaggccguggagaucgucagcgggaucgagaagggcaagucccugaacagcacccucaagacguacaacgaccugaagaccaucuucuccgaggagcugcucgacagcgagaucuaccagaaggagcuggaggagaucgugaaggugaucaccgucuucgacgacaagaaguccaucaagaacuaccugaucaaguacuucgggcaccucgaguuccugaacgaggagcgcaucaaccagcugagcaagcuccgguacaccggcuggggccgcuacagcgcgaagcugcugcucgacauccgggacgaggacacgggguucaaccugaugcaguuccugcgcaacgacgacgagaaccggaaccucucccagcugaucagcgacuccacccugagcuucgacuccgccaucaagagcauccaguccaagagcaccguggaggacgacguguucgacgagaucaagaagcucgccggcucccccgccaucaagcgcgggauccugaacagcaucaagaucgucgacgagcuggugcagaucaucggcuacccgccccagaacaucgugaucgagauggcccgcgagaacaugaccaccgaggaggggcagaagaaggcgaagacgcggaagaccaagcucgaguccgcccugaagaacaucgagaacagcguccuggagaacggcaaggugccccacuccgacgagcagcuccagagcgagaagcuguaccuguacuaccuccagaacggcaaggacauguacucccuggacaagaccgggagccccacgccccuguaccgcgaccagcucgaccaguacgagguggaccacaucaucccguacuccuuccugcccaucgacagcaucgacaacaagguccugacccaccgggagaacaaccagcgcaagcucaacaacauccccgacaaggagaccguggccaacaugaagcccuucugggagaagcuguacaacgccaagcugaucagccagaccaaguaccagcggcucaccacguccgagcgcaccccggacggcgugcugaccgagagcaugaaggccggguucaucgagcggcagcuggucgagacccgccagaucaucaagcacguggcgcggauccucgacaaccgcuuccuggacacgaagaucaucgcccugaagucccagcucaucaccaacuuccggaacaccuuccacaucgccaagauccgcgagcugaacgacuaccaccacgcccacgacgcguaccuggccguggucgugggccagacccuccugaaggccuaccccaagcuggcccccgagcucaucuacggccaccacgcccacuucaaccggcacgaggagaacaaggcgacgauccgcaagcaccuguacagcaacaucaugcgguucuucaacaaccccgacuccaaggugagcaaggacaucugggacugcaaccgcgaccugccgaucaucaaggaggucaucuacaacucccaggugaacuucgugaagcggaccaugaucaagaagggggccuucuacaaccagaaccccgucggcaaguucaacaagcagaucgccgccaacaaccgcuacccccucaagaccaaggugagcucccuggacaccagcaucuacgggggcuacgggccgaugaacuccgcccugagcaucaucaucaucgcggagcgguucaacgagaagaagggcaagaucgagacggugaaggaguuccacgacaucuucaucaucgacuacaagaaguucaacaacaaccccuuccaguuccucaacgacaccuccgagaacggcuuccugaagaagaacaacaucaaccgcguccuggccuucuacggggugcccaaguacagccucaugcagaagaacgacggcacccggaugcuguucgaguccaagagcaaccugcacaaggccacccaguucaagcucacgaagacccagaacgagcuguucuuccacaugcgccgccugcucaccaaguccaaccugauggaccucaagagcgaguccgccaucaaggagagccagaacuucauccugaagcacaaggaggaguucgacaacaucagcaaccagcuguccgccuucagccagaagaugcugggggacaccacgucccuccggaaccugaucaagggcuacaacgagcgcaagaucaaggagaucgacagcuccgaggaggugaucaaguacuucuacgacaacuucaucaagauguucagcuucgucaaguccggggcgcccaagggcaucaacgacuucuucaacaacaaguacaccguggcccggaugcgcccgaagcccgacaagaaguuccugaacgccacccucauccaccagagcaucaccggccuguacgagacgcggaucgaccuguccaagcucggggaggacuga

SEQ ID NO: 2162 - RNA, 4263 nt, Artificial Sequence
  Cas9 variant
auggccaaguucaacaagaacuacagcaucggccuggacaucgggguguccagcgucggcuacgccguggugaccgacgacuaccgcguccccgcguucaaguucaaggugcucgggaacaccgagaaggagaagaucaagaagaaccugaucggcuccacgaccuucgugccggcccagagcgcccaggggacccgggucuuccgcgugaaccggcgccggaucgaccgccggaaccaccgcaucgccuaccugcgggacaucuuccagaaggagaucgagaagguggacaagaacuucuaccgccggcucgacgaguccuuccgcguccugggcgacaagagcgaggagcugcagaucaagcagcccuucuucggcgacaaggagcucgagaccgccuaccacaagaaguaccccacgaucuaccaccuccggaagcaccuggcggacgccgacaagaacucccccguggccgacauccgcgagguguacauggccaucagccacauccugaaguaccgggggcacuuccugacccuggaccgcaucaacccgaacaacaucaacaugcagaacuccuggaucgacuucaucgagagcugccaggaggucuucgaccucgagaucuccgacgagagcaagaccaucguggcgaucuucaaguccagcgacaaccggcaggagaaggugaagaagauccuguccuacuuccagcaggagcugcucaagaaggacaagagcaucuucaagcagcugcugcagcuccuguucggccugaagaccaaguucaaggacugcuucgagcucgaggaggagcccgaccugaacuucuccaaggagaacuacgacgagaaccuggagaacuuccucgggagccuggaggaggacuucuccgacgucuucgccaagcugaaggugcuccgcgacacgauccugcugagcggcaugcucaccuacaccgggaccacgcgggcccgcuucagcgccaccaugguggagcgguacgaggagcaccgcaaggaccugcagcgcuucaaguccuucgucaagcagaaccugagcgagcaggacuaccucgacaucuucggccggaagacccccaacggcuucgacguggacaaggagaccaagggguacgugggcuacaucuccaacaagaugguccugacgaacccccagaagcagaagaccauccagcagaacuucuacgacuacaucagcgggaagaucaccggcaucgagggcgccgaguacuuccugaacaagaucuccgacgggaccuuccuccgcaagcugcggacgaccgacaacggcgcggugccgaaccagauccacgccuacgagcuggagaagaucaucgaccgccagggggaggacuaccccuuccuccuggagaacaaggacaagcugcucagcauccugaccuucaagauccccuacuacgugggcccccuguccaaggggaacaacagccgguucggcuggaucaagcgcaccaucucccaggacauccucgacgacaacgacgaggacacgcggaacggcaagauccgcccguggaacuaccagaagcugaucaacauggacgagacccgggacgccuucaucaccaaccugaucgggaacgacaucauccuccugaacgagaagguccugcccaagcgcagccugaucuacgaggaggugaugcuccagaacgagcugacccgggucaaguacaaggacaaguacggcaagacgcacuucuucgacuccgagcugcgccaggagaucaucaacaaccucuucaagaccaacaacaagcgggugagcuccgccaugcugcuggacuaccucgagaacuacaccaaccugcaggccguggagaucgucagcgggaucgagaagggcaagucccugaacagcacccucaagacguacaacgaccugaagaccaucuucuccgaggagcugcucgacagcgagaucuaccagaaggagcuggaggagaucgugaaggugaucaccgucuucgacgacaagaaguccaucaagaacuaccugaucaaguacuucgggcaccucgaguuccugaacgaggagcgcaucaaccagcugagcaagcuccgguacaccggcuggggccgcuacagcgcgaagcugcugcucgacauccgggacgaggacacgggguucaaccugaugcaguuccugcgcaacgacgacgagaaccggaaccucucccagcugaucagcgacuccacccugagcuucgacuccgccaucaagaccauccagagcaaguccaccguggaggacgacguguucgacgagaucaagaagcucgccggcagccccgccaucaagcgcgggauccugaacuccaucaagaucgucgacgagcuggugcagaucaucggcuacccgccccagaacaucgugaucgagauggcccgcgagaacaugaccacggaggaggggcagaagaaggcgaagacccggaagaccaagcucgagagcgcccugaagaacaucgagaacuccguccuggagaacggcaaggugccccacagcgacgagcagcuccaguccgagaagcuguaccuguacuaccuccagaacggcaaggacauguacagccuggacaagaccgggucccccacgccccuguaccgcgaccagcucgaccaguacgagguggaccacaucaucccguacagcuuccugcccaucgacuccaucgacaacaagguccugacccaccgggagaacaaccagcgcaagcucaacaacauccccgacaaggagaccguggccaacaugaagcccuucugggagaagcuguacaacgccaagcugaucagccagaccaaguaccagcggcucacgaccagcgagcgcaccccggacggcgugcugaccgaguccaugaaggccggguucaucgagcggcagcuggucgagacgcgccagaucaucaagcacguggcgcggauccucgacaaccgcuuccuggacaccaagaucaucgcccucaagagccagcugaucaccaacuuccggaacaccuuccacaucgccaagauccgcgagcugaacgacuaccaccacgcccacgacgcguaccuggccguggucgugggccagacgcuccugaaggccuaccccaagcuggcccccgagcucaucuacggccaccacgcccacuucaaccggcacgaggagaacaaggcgaccauccgcaagcaccuguacuccaacaucaugcgguucuucaacaaccccgacagcaagguguccaaggacaucugggacugcaaccgcgaccugccgaucaucaaggaggucaucuacaacagccaggugaacuucgugaagcggaccaugaucaagaagggggccuucuacaaccagaaccccgucggcaaguucaacaagcagaucgccgccaacaaccgcuacccccucaagaccaagguguccagccuggacacguccaucuacgggggcuacgggccgaugaacagcgcccuguccaucaucaucaucgcggagcgguucaacgagaagaagggcaagaucgagaccgugaaggaguuccacgacaucuucaucaucgacuacaagaaguucaacaacaaccccuuccaguuccucaacgacaccagcgagaacggcuuccugaagaagaacaacaucaaccgcguccuggccuucuacggggugcccaaguacucccucaugcagaagaacgacggcacccggaugcuguucgagagcaaguccaaccugcacaaggccacgcaguucaagcucaccaagacccagaacgagcuguucuuccacaugcgccgccugcucaccaagagcaaccugauggaccugaaguccgagagcgccaucaaggagucccagaacuucauccucaagcacaaggaggaguucgacaacaucagcaaccagcugagcgccuucucccagaagaugcugggggacacgaccagccuccggaaccugaucaagggcuacaacgagcgcaagaucaaggagaucgacuccagcgaggaggugaucaaguacuucuacgacaacuucaucaagauguucuccuucgucaagagcggggcgcccaaggacaucaacgacuucuucaacaacaaguacaccguggcccggaugcgcccgaagcccgacaagaaguuccugaacgccacccucauccaccaguccaucacgggccuguacgagacccggaucgaccugagcaagcucggcgaggacuga

SEQ ID NO: 2163 - RNA, 4263 nt, Artificial Sequence
  Cas9 variant
auggccaaguucaacaagaacuacagcaucggccuggacaucgggguguccagcgucggcuacgccguggugaccgacgacuaccgcguccccgcguucaaguucaaggugcucgggaacaccgagaaggagaagaucaagaagaaccugaucggcuccacgaccuucgugccggcccagagcgcccaggggacccgggucuuccgcgugaaccggcgccggaucgaccgccggaaccaccgcaucgccuaccugcgggacaucuuccagaaggagaucgagaagguggacaagaacuucuaccgccggcucgacgaguccuuccgcguccugggcgacaagagcgaggagcugcagaucaagcagcccuucuucggcgacaaggagcucgagaccgccuaccacaagaaguaccccacgaucuaccaccuccggaagcaccuggcggacgccgacaagaacucccccguggccgacauccgcgagguguacauggccaucagccacauccugaaguaccgggggcacuuccugacccuggaccgcaucaacccgaacaacaucaacaugcagaacuccuggaucgacuucaucgagagcugccaggaggucuucgaccucgagaucuccgacgagagcaagaccaucguggcgaucuucaaguccagcgacaaccggcaggagaaggugaagaagauccuguccuacuuccagcaggagcugcucaagaaggacaagagcaucuucaagcagcugcugcagcuccuguucggccugaagaccaaguucaaggacugcuucgagcucgaggaggagcccgaccugaacuucuccaaggagaacuacgacgagaaccuggagaacuuccucgggagccuggaggaggacuucuccgacgucuucgccaagcugaaggugcuccgcgacacgauccugcugagcggcaugcucaccuacaccgggaccacgcgggcccgcuucagcgccaccaugguggagcgguacgaggagcaccgcaaggaccugcagcgcuucaaguccuucgucaagcagaaccugagcgagcaggacuaccucgacaucuucggccggaagacccccaacggcuucgacguggacaaggagaccaagggguacgugggcuacaucuccaacaagaugguccugacgaacccccagaagcagaagaccauccagcagaacuucuacgacuacaucagcgggaagaucaccggcaucgagggcgccgaguacuuccugaacaagaucuccgacgggaccuuccuccgcaagcugcggacgaccgacaacggcgcggugccgaaccagauccacgccuacgagcuggagaagaucaucgaccgccagggggaggacuaccccuuccuccuggagaacaaggacaagcugcucagcauccugaccuucaagauccccuacuacgugggcccccuguccaaggggaacaacagccgguucggcuggaucaagcgcaccaucucccaggacauccucgacgacaacgacgaggacacgcggaacggcaagauccgcccguggaacuaccagaagcugaucaacauggacgagacccgggacgccuucaucaccaaccugaucgggaacgacaucauccuccugaacgagaagguccugcccaagcgcagccugaucuacgaggaggugaugcuccagaacgagcugacccgggucaaguacaaggacaaguacggcaagacgcacuucuucgacuccgagcugcgccaggagaucaucaacaaccucuucaagaccaacaacaagcgggugagcuccgccaugcugcuggacuaccucgagaacuacaccaaccugcaggccguggagaucgucagcgggaucgagaagggcaagucccugaacagcacccucaagacguacaacgaccugaagaccaucuucuccgaggagcugcucgacagcgagaucuaccagaaggagcuggaggagaucgugaaggugaucaccgucuucgacgacaagaaguccaucaagaacuaccugaucaaguacuucgggcaccucgaguuccugaacgaggagcgcaucaaccagcugagcaagcuccgguacaccggcuggggccgcuacagcgcgaagcugcugcucgacauccgggacgaggacacgggguucaaccugaugcaguuccugcgcaacgacgacgagaaccggaaccucucccagcugaucagcgacuccacccugagcuucgacuccgccaucaagagcauccaguccaagagcaccguggaggacgacguguucgacgagaucaagaagcucgccggcucccccgccaucaagcgcgggauccugaacagcaucaagaucgucgacgagcuggugcagaucaucggcuacccgccccagaacaucgugaucgagauggcccgcgagaacaugaccaccgaggaggggcagaagaaggcgaagacgcggaagaccaagcucgaguccgcccugaagaacaucgagaacagcguccuggagaacggcaaggugccccacuccgacgagcagcuccagagcgagaagcuguaccuguacuaccuccagaacggcaaggacauguacucccuggacaagaccgggagccccacgccccuguaccgcgaccagcucgaccaguacgagguggaccacaucaucccguacuccuuccugcccaucgacagcaucgacaacaagguccugacccaccgggagaacaaccagcgcaagcucaacaacauccccgacaaggagaccguggccaacaugaagcccuucugggagaagcuguacaacgccaagcugaucagccagaccaaguaccagcggcucaccacguccgagcgcaccccggacggcgugcugaccgagagcaugaaggccggguucaucgagcggcagcuggucgagacccgccagaucaucaagcacguggcgcggauccucgacaaccgcuuccuggacacgaagaucaucgcccugaagucccagcucaucaccaacuuccggaacaccuuccacaucgccaagauccgcgagcugaacgacuaccaccacgcccacgacgcguaccuggccguggucgugggccagacccuccugaaggccuaccccaagcuggcccccgagcucaucuacggccaccacgcccacuucaaccggcacgaggagaacaaggcgacgauccgcaagcaccuguacagcaacaucaugcgguucuucaacaaccccgacuccaaggugagcaaggacaucugggacugcaaccgcgaccugccgaucaucaaggaggucaucuacaacucccaggugaacuucgugaagcggaccaugaucaagaagggggccuucuacaaccagaaccccgucggcaaguucaacaagcagaucgccgccaacaaccgcuacccccucaagaccaaggugagcucccuggacaccagcaucuacgggggcuacgggccgaugaacuccgcccugagcaucaucaucaucgcggagcgguucaacgagaagaagggcaagaucgagacggugaaggaguuccacgacaucuucaucaucgacuacaagaaguucaacaacaaccccuuccaguuccucaacgacaccuccgagaacggcuuccugaagaagaacaacaucaaccgcguccuggccuucuacggggugcccaaguacagccucaugcagaagaacgacggcacccggaugcuguucgaguccaagagcaaccugcacaaggccacccaguucaagcucacgaagacccagaacgagcuguucuuccacaugcgccgccugcucaccaaguccaaccugauggaccucaagagcgaguccgccaucaaggagagccagaacuucauccugaagcacaaggaggaguucgacaacaucagcaaccagcuguccgccuucagccagaagaugcugggggacaccacgucccuccggaaccugaucaagggcuacaacgagcgcaagaucaaggagaucgacagcuccgaggaggugaucaaguacuucuacgacaacuucaucaagauguucagcuucgucaaguccggggcgcccaaggacaucaacgacuucuucaacaacaaguacaccguggcccggaugcgcccgaagcccgacaagaaguuccugaacgccacccucauccaccagagcaucaccggccuguacgagacgcggaucgaccuguccaagcucggcgaggacuga

SEQ ID NO: 2164 - RNA, 4263 nt, Artificial Sequence
  Cas9 variant
auggccaaguucaacaagaacuacagcaucggccuggacaucgggguguccagcgucggcuacgccguggugaccgaggacuaccgcguccccgcguucaaguucaaggugcucgggaacaccgagaaggagaagaucaagaagaaccugaucggcuccacgaccuucgugccggcccagagcgcccaggggacccgggucuuccgcgugaaccggcgccggaucgaccgccggaaccaccgcaucgccuaccugcgggacaucuuccagaaggagaucgagaagaucgacaagaacuucuaccgccggcucgacgaguccuuccgcgugcugggcgacaagagcgaggacauccagaucaagcagcccuucuucggcaacaaggagcuggagaccgccuaccacaagaaguaccccacgaucuaccaccuccggaagcaccuggcggacgccgacaagaacucccccgucgccgacauccgcgagguguacauggugcugagccacauccucaaguaccgggggcacuuccugacccugggcaagaucgacccgaacaacaucaacaugcagaacuccuggaucgacuucaucgagagcugccaggacgccuucgaccucgagaucuccgacgagagcaagaccaucgcggccaucuucaaguccagcgagaaccgccaggagaaggucaagcagauccuguccuacuuccagcaggagcugcucaagaaggacaagagcaucuucaagcagcugcugcagcuccuguucgggcugaagaccaaguucaaggacugcuucgagcucgaggaggagcccgaccugaacuucuccaaggagaacuacgacgagaaccuggagaaccuccugggcgcccuggaggaggacuucagcgacguguucgccaagcucaagauccugcgggacacgauccugcucuccagcaugcugaccuacaccggggccacccacgcgcgcuucagcgccacgaugguggagcgguacgaggagcaccgcaaggaccugcagcgguucaaguccuucgucaagcagaaccucagcgagcaggacuaccuggacaucuucggccgcaagacccccaccggcuucgacguggacaaggagaccaagggguacgugggcuacaucuccaacaagaugguccugacgaacccccagaagcagaagaccauccagcagaacuucuacgacuacaucagcgggaagaucaccggcaucgagggcgccgagugcuuccucaacaagaucuccgacgggaccuuccugcgcaagcugcggacgaccgacaacggcgccaucccgaaccagauccacgccuacgagcucgagaagaucaucgagcgccaggggcgggacuaccccuuccugcuggagaacaaggacaagcuccugagcauccugaccuucaagauccccuacuacgugggcccccucgcgaaggggaacaacucccgcuucgccuggaucaagcggaccacgagccaggacgugcuggacgacaacgacgaggacacccgcaacggcaagauccggccguggaacuaccacaagcugaucaacauggacgagacccgcgacgccuucaucaucaaccucaucggcaacgacaucauccugcugaacgagaagguccugcccaagcggucccucaucuacgaggaggugaugcugcagaacgagcugacccgcgugaaguacaaggacaaguacgggaagauccacuucuucaacagcgagcuccggcaggagaucaucaacaaccuguucaagacgaacuccaagcgcgucagcuccgccaugcugcucagcuaccuggagaacuucaccaaccugcaggccguggagaucgucuccggcaucgagaagggcaagagccucaacuccacccugaagaccuacaacgaccugaagacgaucuucagcgaggagcuccuggacuccgagaucuaccagaaggagcuggaggagaucaucaaggugaucaccguguucgacgacaagaaguccaucaagaacuaccucaccaaguacuucgggcaccuggaguuccugaacgaggagaagaucaaccagcucagcaagcugcgguacaccggguggggccgcuacagcggcaagcugcuccuggggauccgggacgaggacacgggcuucaaccugaugcaguuccuccgcaacgacgacgagaaccggaaccugacccagcugaucagcgacaccacccucuccuucgacagcgcgaucaaggccauccaguccaagagcaccgucgaggacgacguguucgaggagaucaagaaccuggccgggucccccgccaucaagcgcggcauccugaacagcaucaagaucguggacgagcucguccagaucaucggguacccgccccagaacaucaucaucgagauggcccgggagaacaugacgaccgaggagggccagaagaaggcgaagacccgcaaguccaagcuggagagcgcccugaagaacaucgaggacuccgugcucgagagcggcaaggugccccacuccgacgagcagcugcagagcgagaagcuguaccucuacuaccugcagaacgggaaggacauguacucccuggacaagaccggcagccccacgccccucuaccgcgaccagcuggaccaguacgaggucgaccacaucaucccguacuccuuccugcccaucgacagcaucgacaacaaggugcucacccaccgggagaacaaccagcgcaagcugaacaacauccccgacaaggagaccguggccaacaugaagcccuucugggagaagcuguacaacgccaagcucaucagccagaccaaguaccagcggcugacgaccuccgagcgcaccccggacgggguccugaccgagagcaugaaggcgggcuucaucgagcggcagcucguggagacgcgccagaucaucaagcacguggcccggauccuggacaaccgcuucuccgacaccaagaucaucacccucaagagccagcuggucaccaacuuccggaacacguuccacaucgccaagauccgcgagcugaacgacuaccaccacgcccacgacgccuaccuggcggugguggucggccagacccuccugaaggccuaccccaagcuggcccccgagcucaucuacgggcaccacgcccacuucaaccggcacgaggagaacaaggccacccugcgcaagcaccuguacuccaacaucaugcgguucuucaacaaccccgacagcaagguguccaaggacaucugggacugcaaccgcgaccucccgaucgugaaggacgucaucuacaacagccagaucaacuucgugaagcggaccaugaucaagaagggcgcguucuacaaccagaaccccguggggaagcugaacaagcagaucgccgccaacaaccgcuacccccugaagacgaaggucuccagccucgacaccuccaucuacggcggguacggcccgaugaacagcgcccuguccaucaucaucaucgccgagcgguucaacgagaagaagggcaagaucgagaccgugaaggaguuccacgacaucuucaucaucgacuacgagaaguucaacaacaaccccuuccaguuccugaacaacgugagcgaggagggguuccucaagaagaacgaccugaaccgcguccuggcguucuaccggaucuccaaguacagccucaugcagaagaucgacggcacccgcaugcuguucgaguccaagagcaaccugcacaaggugacgcaguucaagcucaccaagacccagaacgagcuguucuuccacaugaagcggcugcucaccaaguccaaccugauggaccucaagagcgagagcgccaucaaggagucccagaacuucauccagacgcaccagaacgaguucgacaacaucgccgaccgccugagcaacuacucccagaagaugcugggggagaccaagagccugcagacccucaucaacggcuacaacgagcgccccaucaagcagaucgacaacaacgaggagaccauccgguacuacuacgacaacuucaucaagauguucuccuucgucaagagcggggcccccaaggacaucaucaacuucuucaacgacaaguacacggugccgcgcaugcggcccaagcccgaccgcaagaugcuggacgcgacccugauccaccaguccaucaccggccucuacgagacccggaucgaccugagcaagcugggcgaggacuga

SEQ ID NO: 2165 - RNA, 4263 nt, Artificial Sequence
  Cas9 variant
augagccgcaagaacuacguggacgacuacgccaucucccuggacaucggcaacgccagcgucgggugguccgcguucacccccaacuaccggcucgugcgcgccaagggccacgagcugaucggggugcggcuguucgacccggccgacaccgccgagagccgccggauggcccgcacgacccggcgccgguacucccgccggcgcuggcggcuccgccugcuggacgcccucuucgaccaggcccugagcgagaucgaccccuccuuccuggcccggcgcaaguacagcuggguccaccccgacgacgagaacaacgccgacugcugguacggcuccgugcuguucgacagcaacgagcaggacaagcgguucuacgagaaguaccccaccaucuaccaccuccgcaaggcgcugauggaggacgacucccagcacgacauccgggagaucuaccucgccauccaccacauggugaaguaccgcgggaacuuccuggucgagggcacccuggagagcuccaacgccuucaaggaggacgagcuccugaagcugcucggccggaucacgcgcuacgagaugagcgagggggagcagaacuccgacaucgagcaggacgacgagaacaagcugguggccccggccaacggccagcuggcggacgcccucugcgccacccgcgggagccgguccaugcgcguggacaacgcccuggaggcccugagcgcggucaacgaccucucccgggagcagcgcgccaucgugaaggccaucuucgccggccuggaggggaacaagcuggaccucgccaagaucuucgugagcaaggaguucagcuccgagaacaagaagauccugggcaucuacuucaacaagagcgacuacgaggagaagugcguccagaucguggacuccggccugcucgacgacgaggagcgggaguuccuggaccgcaugcaggggcaguacaacgcgaucgcccugaagcagcuccugggccggagcaccuccgugagcgacuccaagugcgccagcuacgacgcccaccgcgccaacuggaaccugaucaagcuccagcugcggaccaaggagaacgagaaggacaucaacgagaacuacgggauccuggucggcuggaagaucgacuccggccagcgcaagagcgugcgcggggaguccgcguacgagaacaugcggaagaaggccaacguguucuucaagaagaugaucgagacgagcgaccucuccgagaccgacaagaaccggcugauccacgacaucgaggaggacaagcuguuccccauccagcgcgacagcgacaacggcgucaucccccaccagcuccaccagaacgagcugaagcagaucaucaagaagcaggggaaguacuaccccuuccugcucgacgccuucgagaaggacggcaagcagaucaacaagaucgaggggcugcugaccuuccgggugccguacuucgugggcccccucgucgugcccgaggaccugcagaaguccgacaacagcgagaaccacuggauggugcgcaagaagaagggcgagaucacccccuggaacuucgacgagauggucgacaaggacgccuccgggcggaaguucaucgagcgccuggugggcacggacagcuaccugcucggggagccgacccugcccaagaacucccugcucuaccaggaguacgagguccugaacgagcugaacaacgugcggcucagcgugcgcaccggcaaccacuggaacgacaagcgccggaugcgccuggggcgggaggagaagacccugcucugccagcgccuguucaugaagggccagacggucaccaagcggaccgcggagaaccugcuccgcaaggaguacggccggaccuacgagcugagcgggcuguccgacgagagcaaguucacguccagccucuccaccuacggcaagaugugccgcaucuucggggagaaguacgugaacgagcaccgggaccugauggagaagaucguggagcugcagaccgucuucgaggacaaggagacccuccugcaccagcugcgccagcucgagggcaucagcgaggccgacugcgcccugcuggugaacacgcacuacaccggguggggccggcucucccgcaagcugcugaccaccaaggccggcgagugcaagaucagcgacgacuucgcgccccggaagcacuccaucaucgagaucaugcgcgcggaggaccggaaccucauggagaucaucacggacaagcagcugggguucagcgacuggaucgagcaggagaaccugggcgccgagaacggguccagccucauggagguggucgacgaccugcgcgugucccccaaggugaagcggggcaucauccagagcauccgccugaucgacgacaucuccaaggccgucggcaagcggccgagccgcaucuuccucgagcuggccgacgacauccagcccuccgggcggaccaucagccgcaagagccgccugcaggaccucuaccggaacgccaaccugggcaaggaguucaaggggaucgcggacgagcugaacgccugcuccgacaaggaccuccaggacgaccgccuguuccuguacuacacccagcucggcaaggacauguacaccggggaggagcuggaccuggaccggcucagcuccgccuacgacaucgaccacaucaucccccaggccgugacgcagaacgacagcaucgacaaccgcgugcuggucgcccgggcggagaacgcccgcaagaccgacuccuucaccuacaugccccagaucgccgaccggaugcgcaacuucuggcagauccugcucgacaacggccugaucagccgggugaaguucgagcgccugacccggcagaacgaguucuccgagcgcgagaaggagcgguucgugcagcgcagccucgucgagacgcggcagaucaugaagaacguggccacccugaugcgccagcgguacggcaacuccgcggccgugaucgggcugaacgccgagcucaccaaggagaugcaccgcuaccugggcuucagccacaagaaccgggacaucaacgacuaccaccacgcccaggacgcccugugcgucgggaucgcgggccaguucgccgccaaccgcggguucuucgccgacggcgagguguccgacggcgcccagaacagcuacaaccaguaccuccgcgacuaccugcggggguaccgcgagaagcuguccgcggaggaccggaagcagggccgcgccuucggguucaucgugggcagcaugcggucccaggacgagcagaagcgcgucaacccgcggaccggggaggugguguggagcgaggaggacaaggacuaccuccgcaaggucaugaacuaccggaagaugcuggugacccagaaggugggcgacgacuucggcgcccuguacgacgagacgcgcuacgccgccaccgaccccaaggggaucaagggcauccccuucgacggggcgaagcaggacaccucccucuacggcggguucagcuccgccaagcccgccuacgccguccugaucgagagcaagggcaagacccggcuggugaacgugacgaugcaggaguacagccuccugggcgaccgcccguccgacgacgagcugcggaagguccucgcgaagaagaaguccgaguacgccaaggccaacauccugcugcgccacgugcccaagaugcagcucauccgguacgggggcgggcugauggugaucaagagcgccggcgagcugaacaacgcccagcagcucuggcugcccuacgaggaguacugcuacuucgacgaccugagccagggcaaggggucccucgagaaggacgaccugaagaagcugcucgacagcauccugggcuccguccagugccuguaccccuggcaccgcuucaccgaggaggagcucgcggaccugcacguggccuucgacaagcugccggaggacgagaagaagaacgugaucaccgggaucgucagcgcccuccacgccgacgccaagaccgcgaaccuguccaucgugggcaugacggggagcuggcggcgcaugaacaacaaguccggcuacaccuucagcgacgaggacgaguucaucuuccagucccccagcggccuguucgagaagcgggugaccgucggggagcucaagcgcaaggccaagaaggaggugaacuccaaguaccggaccaacgagaagcgccugcccacgcugagcggcgccucccagccguga

SEQ ID NO: 2166 - RNA, 4263 nt, Artificial Sequence
  Cas9 variant
auggccaagcccaaggacuacaccaucggccuggacaucgggaccaacagcgugggcugggucgugacggacgaccagaacaacauccuccgcaucaaggggaagaaggccaucggcgcgcggcuguucgccgaggggaagguggccgccgagcgccgguccuuccgcaccacccggcgccggaucagccgccggcgcuggcggaucaagcugcucgaggagcuguucgacgaggagaucgccaaggucgacccguccuucuucgcgcgccugcacgagagcuggaucucccccaaggacaagcggaagcgcuacagcgccaucguguuccccucccccgaggaggacaagaaguuccacgagagcuacccgaccaucuaccaccuccgggacaagcugaugaaggacgaccagaagcacgacauccgcgagaucuacaucgccgugcaccagaugaucaagguccggggcaacuuccugcacgacgaguccguggagacguaccgcagcggcauguccagccucgggggccgguccgagcgcaccauccugagcgugcagacccuggaggagcucaacgaccuguucgccgagaacgaggggaccgaggaggucgagcugaacguggcguccgccgagcagaucaacgacauccucacgggcgaccaccugaacgccgacagccagaaggagaucuccaaccugcuccugcccagcuccuuccccagcuucgacgacaaggccaaggagaagcaggucaagaagcugaucaacaacguggccaccaacaucagcaaggcguggcucggguacaaggccgacuucuccaccauccugaaccuggccaagguggacaaggaccagaagaagaucuucgccuucgcccuccagggcggcgacgaggaggacaaggugcaggagcuggagagccugcucgagcagucccagaccgacaucgucgaccggcugaucgagauccgccacgcgaucgugcugagcgagaucgugcccgucgggaugacgcucuccgaggccaugaucgacaaguacgaccagcacaaggaggaccugaucacccugaaggccgugauccgcaacaccaaggacaagaagaaggccgccaagcuccaggcgaucuacgaccuguacgugaacaaccggcacgccgaccuggccaaggccaugaagcucaccggcaucaagaagcgcagcgagcugcuggacccggaggagcucaagaaggccaucuccagccugcuggacgacucccccgaggcgggggagaucaagcagcggcucgagggcaagacguuccugccccugcagcgcagcaacaacaacggcgucauccccaaccagcuccaccagguggagcuggacgagaucaucaagaagcaguccaaguacuacccguuccuggccgagaagaaccccgacgagagcgaggaggcccagaagaaggcccccaccaagcucgacgcgcugcugaccuuccgggugcccuacuacgucgggccgaugaucaccaaggaggagcaggaggcccaggacggccacuccuucgccuggauggugcgccgggacccccaggaccacgaggccaucacgcccuggaacuucgagaagaaggucgacaagauggccagcgcgacccaguucaucaagcgcaugaccaccaaggacacguaccugcucggggaggacgugcugcccgccuccagccugaaguaccagcuguucaccgugcucaacgagcugaacaaccuccgggucaacggcaagaagcugaccuccgacgagaaggagcaggucaucgaggggcuguucaagaagcagaagaccgugaaggccgacaaguucgugaaguacuggcaggccauccacaucggcgccgacaucaaggugaagggccucagcgacccguccaaguucaacagcacgaugagcaccuacaucgacuucaagaagaucuucggggaccagcugaacgacgcgaaccgccagaacgacuucgagaagaucaucgaguacuccaccaucuucgaggaccggaagauccuggaggacaagcuccgcgccgacuucgccuggcugagcgaggagcagaucaagcagcugugccggcuccgccugcagggcugggggcggcuguccgacaagcuccugacccgccugacggacgccgacggccagaacgugcucgagcggcuguggaacagcaacgacaacuucguccagaucguguccgaccccaacaucaaggccaagaucgagcaggagaaccagaagcugcuccgcgacgggcagagcgacgacgcgguggaguccauccuggacgacgccuacaccagcccccagaacaagaaggccauccggcaggucaugcgcguggugcacgacaucgucaaggccugcgacggcaacgugcccgcgaaguucgccaucgaguucgcccgcucccaggaggacgacccgaagcggaccaccgcccgcgugaaccagaugcagaagaucuacgaccagaucagcgacgaggucgugucccagggcgugaaggagcagcugagcgggaugaagucccucaaggaccgguacuaccuguacuucaugcagggcgggcgcgacgccuacacgggcgcgaagcugaacaucgaccggcucagcgacuacgacaucgaccacaucaugccccaguccuucgucaaggacgacagccuggacaaccgcgugcugguggcccgggccgucaacaaccagaaguccgacaaggugcccgccuuccucuucgggaacaagguggucgccgaccugggcaucaccgugcgcgagaugugggacaaguggcagaagcugggcaugaucagcaagcggaagcucagcaaccugcugaccgaccccgacgcgcucaccgaguaccgcgcccagggguucauccggcgccagcugguggagaccucccaggucaucaagcugacggccaccauccuccagagcgaguucccggacuccaagaucaucgaggugcccgccaaguacaacagcaucgugcggaagcaguucgaccuguacaagucccgcgaggucaacgacuuccaccacgccaucgacgcguaccugagcaccaucgugggcaacuaccucuaccagguguaccccaaccugcggcgcauguucgucuacggggaguucaagaaguucuccagcaacgccgaggaguccgcccacgacauggcccggcgcgucaagagcaugaacuuccuggacgaccuccugcggggcacccacggcgacaacaucuacugccgcuccacgggggagaucguguucaaccggaacgacaucaucagcaagcugaagcaggcguacuccuucaagcagaugcucgugacccaggagguguucacccgcaagagcgcccuguucgaccagaccguguacccgucccccgagcgcgacagcaagaagcgguccggccugaucccccgcaagaaggggauggacacggagaucuacggcggguacagcggcaacaaggacgccuacuucguccucgccgaggccgugaaggagaagggccacacccugcagaucguggggguccccauccgggcgcugaacacccucaagaacuccgccaacuacagcgagaagcugcuggagaucaucaagccccaggugauguucaacaagaagaacggcaagccgaagaagggggugaacgacguccgcauccucauggacaacauccccuaccggcagcccgugcuggagggcggggcccuguacaugcucggcagcuccaccuacaaguacagccugaagcagaucacgcugucccaggagagcaugaaguacauccucgacuacaucgacgacccguccuucaacaagcacaucauggugaacaucgaccaccaggacgagaagaagugccugcugagcgucuacgacgagauccucgacaagauggacaaguaccugccccuguucgacaucaacggcuuccgcaagaagcuccacgacgggcgggagaaguucgugaagcugcccgucgagaagcaggccgagguggugaaggacauccugcgcggccuccacgccaacuccgagaugaccaagcccagcgaccuggggcugaccaccgcgcucggcuucaugcaggccccggacgggaucaagaucuccgacgacgccgucuucaucuaccagagccccacgggccuguucgagcggcgcgugaagguguccgaccugcucaaguga

SEQ ID NO: 2167 - RNA, 4266 nt, Artificial Sequence
  Cas9 variant
augaccaaguucaacaagaacuacagcaucggccuggacaucgggguguccagcgucggcuacgccguggugaccgaggacuaccgcguccccgccuucaaguucaaggugcucgggaacacggagaaggagaagaucaagaagaaccugaucggcuccaccaccuucgugagcgcgcagccggccaaggggacccgggucuuccgcgugaaccggcgccggaucgaccgccggaaccaccgcaucacguaccugcgggacaucuuccagaaggagaucgagaagguggacaagaacuucuaccgccggcucgacgaguccuuccgcguccugggcgacaagagcgaggaccugcagaucaagcagcccuucuucggcgacaaggagcucgagaccgccuaccacaagaaguaccccaccaucuaccaccuccggaagcaccuggccgacgccgacaagaacucccccguggcggacauccgcgagguguacauggccaucagccacauccugaaguaccgggggcacuuccugacccuggacaagaucaacccgaacaacaucaacaugcagaacuccuggaucgacuucaucgagagcugccaggaggucuucgaccucgagaucuccgacgagagcaagaacaucgccgacaucuucaaguccagcgagaaccgccaggagaaggugaagaagauccugcccuacuuccagcaggagcugcucaagaaggacaaguccaucuucaagcagcugcugcagcuccuguucggccugaagacgaaguucaaggacugcuucgagcucgaggaggagcccgaccugaacuucagcaaggagaacuacgacgagaaccuggagaacuuccucgggucccuggaggaggacuucagcgacguguucgccaagcugaagguccuccgggacaccauccugcuguccggcaugcucaccuacaccggggcgacgcacgcccgcuucagcgccaccaugguggagcgguacgaggagcaccgcaaggaccugcagcgguucaaguucuucaucaagcagaaccugagcgagcaggacuaccucgacaucuucggccgcaagacccagaacggcuucgacguggacaaggagaccaagggguacgucggcuacaucacgaacaagauggugcugaccaacccccagaagcagaagaccauccagcagaacuucuacgacuacaucuccgggaagaucaccggcaucgagggcgccgaguacuuccugaacaagaucagcgacgggacguuccuccgcaagcugcggaccuccgacaacggcgccaucccgaaccagauccacgcguacgagcuggagaagaucaucgagcgccaggggaaggacuaccccuuccuccuggagaacaaggacaagcugcucagcauccugaccuucaagauccccuacuacgugggcccccuggccaagggguccaacagccgguucgccuggaucaagcgcgccaccuccagcgacauccucgacgacaacgacgaggacacgcggaacggcaagauccgcccguggaacuaccagaagcugaucaacauggacgagacccgggacgccuucaucaccaaccugaucggcaacgacaucauccuccugaacgagaagguccugcccaagcgcucccugaucuacgaggaggugaugcuccagaacgagcugacccgggugaaguacaaggacaaguacgggaaggcgcacuucuucgacagcgagcugcgccagaacaucaucaacggccucuucaagaacaacuccaagcgggucaacgccaagagccugaucaaguaccuguccgacaaccacaaggaccucaacgccaucgagaucgugagcggggucgagaagggcaaguccuucaacagcacgcugaagaccuacaacgaccugaagaccaucuucuccgaggagcuccuggacagcgagaucuaccagaaggagcuggaggagaucaucaaggugaucaccguguucgacgacaagaaguccaucaagaacuaccucacgaaguucuucgggcaccuggagauccuggacgaggagaagaucaaccagcucagcaagcugcgcuacagcggcuggggccgguacuccgccaagcugcuccuggacauccgcgacgaggacaccggguucaaccugcuccaguuccugcggaacgacgaggagaaccgcaaccugaccaagcucaucagcgacaacacccuguccuucgagcccaagaucaaggacauccagagcaaguccacgaucgaggacgacaucuucgacgagaucaagaagcuggccggcagccccgcgaucaagcgggggauccucaacuccaucaagaucgucgacgagcuggugcagaucaucggcuacccgccccacaacaucgugaucgagauggcccgcgagaacaugaccaccgaggaggggcagaagaaggccaagacccggaagaccaagcuggagagcgcccucaagaacaucgagaacucccugcuggagaacggcaaggucccccacagcgacgagcagcuccaguccgagaagcuguaccuguacuaccuccagaacggcaaggacauguacacgcuggacaagaccgggagccccgccccgcuguaccucgaccagcuggaccaguacgagguggaccacaucauccccuacuccuuccugcccaucgacagcaucgacaacaaggugcucacccaccgcgagaacaaccagcagaagcugaacaacauccccgacaaggagaccgucgcgaacaugaagccguucugggagaagcuguacaacgccaagcucaucucccagacgaaguaccagcgccugaccaccagcgagcggacccccgacggcgugcugacggaguccaugaaggccggguucaucgagcgccagcucguggagacccggcagaucaucaagcacgucgcccgcauccuggacaaccgguucagcgacaccaagaucaucacccucaagagccagcugaucacgaacuuccgcaacaccuuccacaucgcgaagauccgggagcugaacgacuaccaccacgcccacgacgccuaccuggccgugguggucggccagacccuccugaagguguaccccaagcuggcccccgagcucaucuacggccaccacgcgcacuucaaccgccacgaggagaacaaggccacccugcggaagcaccuguacuccaacaucaugcgcuucuucaacaacccggacagcaagguguccaaggacaucugggacugcaaccgggaccuccccaucaucaaggacgucaucuacaacagccagaucaacuucgugaagcgcacgaugaucaagaagggggccuucuacaaccagaaccccgugggcaaguucaacaagcagcuggccgccaacaaccgguacccgcugaagaccaaggcgcucugccuggacaccuccaucuacgggggcuacgggcccaugaacagcgcccuguccaucaucaucaucgccgagcgcuucaacgagaagaagggcaagaucgagaccgucaaggaguuccacgacaucuucaucaucgacuacgagaaguucaacaacaaccccuuccaguuccucaacgacacgagcgagaacggcuuccugaagaagaacaacaucaaccgggugcugggguucuaccgcauccccaaguacucccucaugcagaagaucgacggcacccggaugcuguucgagagcaaguccaaccugcacaaggccacccaguucaagcucaccaagacgcagaacgagcuguucuuccacaugaagcgccugcucaccaagagcaaccugauggaccugaaguccaagagcgccaucaaggagucccagaacuucauccucaagcacaaggaggaguucgacaacaucagcaaccagcuguccgcguucagccagaagaugcuggggaacaccaccucccucaagaaccugaucaagggcuacaacgagcggaagaucaaggagaucgacauccgcgacgagacgaucaaguacuucuacgacaacuucaucaagauguucagcuucgucaagagcggggccccgaaggacaucaacgacuucuucgacaacaagugcaccguggcccggaugcgccccaagcccgacaagaagcugcucaacgccacccugauccaccaguccaucaccggccuguacgagacgcgcaucgaccucagcaagcugggcgaggacuga

SEQ ID NO: 2168 - RNA, 4266 nt, Artificial Sequence
  Cas9 variant
augaagaagauccugggccucgaccuggggcccaacagcaucggcugggcccuggugaacgaggccgagaacgagaacgagaaguccagcaucaucaagaucgggucccgcgucauccacuacggcgacaaccucgugaagguggacaagagcgggaagaucuccgcgagcaugaccccggaggaggacuucuccagcggcaagggccugucccccaacgccgggcggaccaagcagcgcagcgcccggcgcaaccugcagcgguacaagcagcgccggaacaaccucaucgagauccugaaggcccacucccugaucgacaacaacuucaucuucagcgaggagggcaacgagacgaccuucaagaccuacaagaaccgcgcccucgcggccaccaacgagaucucccuggaggacuucaucaagguccuguucaugaucaacaagaagcggggguacaagagcucccgcaaggccaagggcgacgaggacgggcagcucaucgacggcauggccaucgcgauccagcuguacgagcacaaccagacgcccggccaguucguguacaaccugcucaagaacgggaagaagaacauccccgacuucuaccggagcgaccugcagaccgaguucgaccgcaucuggaacuuccagaaggccuuccaccaggagucccugagcgacggcaucugcgagaagcucguggggcagaagaagaacgucaccuccgccauccuguucaaggaguucaagaucgagagccuggagaucaagggcaagugggacgagaagcgguucuuccgcuacgagcuccggaacaaggccgugcagcaggagcugaagcugaacgagaucgccgagugccucguggagaucaacggcgagaucagcaacuccagcggguaccugggcgcgaucuccgaccgcagcaaggagcuggucuuccagaagaucaccguggggcaguaccucuacaagcagaucgccgccaacccgaacacgucccugaagaagcagaucuucuaccggcaggacuaccuggacgaguucaacacccucugggagacccaggccaaguaccacaaggagcugaccgacgagcugaagacgcagauccgcgacgugaucaucuucuaccagcggcgccucaagagccagaagggccugaucuccuucugcgaguucgagagcaagcagaucgaggucuucguggacgggaagaaguccaucaagacccggggcaugcgcgugauccccaagagcagcccccuguuccaggaguucaagaucuggcagauccucaacaacaucgagaucaccgaccugaagaccaaggagagccgcgagcugacggacgacgagcggcagcuccuguucgaggagcugaacauccgccccaagaucuccaagaaggaggcccucaagauccugaccgagaagccggcgcaguacgaccugaacuacaaggacaucgagggcaacaagaccaacgccaaguucuacgaggccuacaacaagaucauccaccucagcgggcacgacgagaucgacuucaccgacaagacguccgacaucaacgaguaccugaagcagaucuucagccugcucggcaucaagcccgagauccuggacuucgacuccagccugaaggacgaggacuucgagaagcagcugcacuuccagcucuggcaccuccuguacuccuucgagggggacaacaccaagaccggcgacgagaagcugcugcagaagcugaacaccaaguucggguuccccgucgaguacgccaaggugaucagcaacaucgcccuccccgacgacuacggcagccuguccgcgaaggccauccggaagauccugccgcaccucaaggacggcuucagcuacgggggccgcaagucccggcccgacgagcccagcgccugcgaguacgccggguaccgccacuccaaggccagccugacgaaggacgagaaggagaacaagaccuacaaggacaagcuggagauccuccccaagaacucccugcggaacccgaucguggagaagauccugaaccagaccaucaacgucgugaacgcggugaucggcgacuacgggaagcccgacgagauccgccucgagcuggcccgggagcugaagaaguccgccgaggagcgccaggacgccaccgacuccaucagcaaggcgacggccaagcacgagaaguaccggaagguccuccagaccgaguucggccugaagcacaucucccgcaacgaccugauccgguacaagcucuaccuggagcugaagaacaacggcuucaagacccucuacagcgacaccuacaucgcccccuacgagaucuucuccaagaaguucgacaucgagcacauccugcccaaggccaagcuguucgacgacagcuucuccaacaagacgcucgagcucaagagcgugaaccugaagaagggggacaugaccgccuacgacuucgugaaggaggaguacggcaccgaggggcuggcgaaguacgagcagcgcguccaggaccuguuccugaacaagaagcggaacgaggaccucgaccaggagaacgagucccgcaucaccgacgagaagaucagcaagacgaagcgggacaagcugcugaugccggagaacaagauccccaccggcuucaucgaccgcgagcuccgggacagccaguacaucgccaagaaggccaagaccaugauggaggacaucugcaaggacguggucaccaccacgggcuccgugaccgaccgccugcgcgaggacuggcagcugaucgacaucaugcaggagcucaacuggcccaaguacgccgcccuggggcugaccgaggaguucaccaacgaggagggcaacgugauccggaagaucaaggacuggacgaagcgcaacgaccaccggcaccacgcgauggacgccaucaccaucgccuucaccaagcgcagccacauccaguaccucaacaaccuguccgcccggagcgacaaguccagcuccaucuacgggaucgagcagaaggagcuguaccgcgacaagaacaacaagcuccgguucgcgcccccgauccccaucaacgaguuccgcgccgaggccaagaugcagcuggagaacacccugaucagcaucaaggcccagaacaaggucgugacgaagaacaagaacaagaucuccggccagaagaagcuccaggagacccugacgccccgggggcagcugcaccucgagaccaucuacggcaagaucaaccaguaccagaccgccgagaucaaggugggcgggacccuggacagcgagcugaucaacaaggucgcgaacaagaagacccgcgaggcccuccugaaccggcuggccgaguucggcaacgaccccaagaaggccuucaccgugaagaacacgaucgacaagaacccgaucuaccucgacaagcaccaguccuacaagauccccgagaaggugaagaucgucuggcaggagcccguguacaccauccgcaagagcaucaccccggaccugaagcuggacaagaucaucgaccccaagaucaaggcccuccuggagucccggcugaaggagugcaacggggacgcgaagcucgccuucagcaaccuggccgagaaccccaucuggcugaacaaggagaagggcauccagaucaagcgcgugaccaucacggggaucuccaacgccgccagccuccacgacaagaaggaccugaacggcaagcccauccuggacgagaagggcaacaagaucuccgucgacuucgugaacaccgggaacaaccaccacguggcgaucuacaaggacgagaacggcaaccuccacgacaacgucgugaccuucuucgaggccguggagcgggucaaccagaaccugccggugguggacaagcuguucaagcagaaggagggguggcaguuccucuucaccaugaagcagaacgaguacuucgucuuccccaacgagaucacggccuucaaccccaacgaguucgaccugcugaaccccgacaacuacuaccucaucagcccgaaccuguuccgcgugcagaccauguccaaggugauguacggcaacaacacccugcgggacuacaaguuccgccaccaccucgagaccacgcugcaggacaucaaggagcugcgggacaucgucuucaagcaguucaagagccucagcaucuucgacaagaucgugaaggugcgcaucaaccaccuggggaagaucgucaagaccggcgaguacuga

SEQ ID NO: 2169 - RNA, 4266 nt, Artificial Sequence
  Cas9 variant
augaaggacauccugggccucgaccuggggaccaacagcaucggcugggccguggucaaggaggcccagaacgacaacgagcaguccgagaucguggacguggggguccgcgugaacccccugaccacggacgagaagaccaacuucgagaagggcaagccgaucagcaccaacgcggaccggacccucaagcgcuccgcccggcgcaaccugcagcgguacaagcugcgccggaaggagcucaucgagcugcugaaggagcaccagcucaucagcacggacaccauccugaccgagaacgggaagggcaccacguuccagacccuggagcuccgcgccaaguccgccaaggagaagaucagccuggaggagcuggcccggguguuccucaccaucaacaagaagcgcggcuacaaguccagccggaaggcgaagaacgaggacgaggggcagcugaucgacggcauggagaucgccaagcgccuguacgaggagaaccucaccacggggcagcugucccugcagcuccugaaggagggcaagaagucccugcccgacuacuaccgguccgaccuccaguucgagcuggacaaggucuggaacuuccagaagcaguuccacagccacauccugaccgacgaguucuacgcccagcucaaggggaagggccagcgcgccaccuccgcgcuguuccuggccaaguaccagaucuacaccgccgagaacaagggcagccgggaggacaagaagcuccaggccuaccaguggcgcguggacgcccuguccaaggagcugacgcgggagcagcucgcguucgugaucaccgagaucaacaacaaccugaacaacagcuccggguaccugggcgccaucagcgaccgcuccaaggagcucuacuucaacaacgagaccgucggggaguaccuguggaagcagaucgccgccaacccccacaccagccugaagaaccagguguucuaccggcaggacuaccucgacgaguucgagcagaucuggaagacgcagagcgccuucuaccccgagauccugaccgagucccugaagaaggagcuccgcgacguggucaucuucuaccagcggaagcucaagagccagaagucccuggugagcuucugcgaguucgagaacaaggagaucgagaucaagaaggaggacggcaccuccaccaagaaggugaucggccucaaggucgcgcccaagagcagcccccuguuccaggaguucaagaucuggcagaaccugaacaacgugcucauccgcaagaaggggagcaagacgaagaaggccgccaagaaccagcaggccgugcuguucgaggaggagaagaccaucuccgagcuggaccuggaggccaagcaggcgcuguucaacgagcugaaccugaagggcaaccucaaggccgacuacugccuggagauccugggguacagccccaaggagugggagaugaacuacuccguccucgagggcaaccgcaccaacaaggcccuguacgaggccuaccugaagaucaccgaccucgagggguacgacgccaagaaccaccugaaggugaagcugaacaaggacgagguggagcucgacgaccugaagguccccgcgagcgagaucaaggacauggugcaggccaucuucaaggaggccggcaucaacacggacauccugcacuucaacgccgagcucgacggcaaggacuucgagaaccaggcguccuaccagcuguggcaccuccuguacagcuacgagggggacgacuccaagagcggcaacgagcugcuguacaagcuccuggagaccaaguucggguucaagaaggaguacgcccagauccuggccaacgugucccucagcgacgacuacggcucccugagcaccaaggccaugcggaagauccacccguacaucaaggagaacaaguucagcaccgccugcgagcuggcgggguaccgccacuccaagcacagccucacgaaggaggagaacgacaaccggguccugcgcgacucccuggaggugcucaagaagaacagccugcggcagcccgucguggagaagauccugaaccagaugaucaaccucgugaacgcccugcugaagaaguaccgcaccgagaaccccaacuucaaguucgacgagauccggaucgagcucgcccgcgagcugaagaagaacgccgaggagcgggccaacaugaccgcgaacaucaacaaggccaagaccgagcacgagaagaucaucaagauccugaagaacgaguucggccuccccaacccgacgcgcaacgacaucauccgguaccgccuguacgaggagcugaaggccaacggcuacaaggaccucuacaccaacaucaagaucccccaggagaagcuguucaccaaggagaucgacaucgagcacaucauccccaagucccgggucuucgacgacagcuucuccaacaagacccugagcuuccgcaagaccaaccucgacaagggggagcggacggccuucgacuacauggaguccaaguucggcgccgacaagcuggaggaguacguggcgcgcguggaggaccuguacaagaacaacaucaucagcaaggccaaguaccagaagcuccugaagaaggaguccgagaucggggacggcuucgucgagcgggaccugcgcgagacccaguacaucgccaagaaggccaaggagauccuccugcagaucacccccaacgugcugagcaccuccgggggcaucacggaccggcuccgcgaggacugggaccugaucaacgugaugaaggagcugaaccucccgaaguaccgcgcgcugggccugaccgagauggaggaccggaaguacgggcagcaggucgaggugaucaucgacuggaccaagcgcaacgaccaccggcaccacgccauggacgcccucaccguggccuucacgaagcacaaccacauccaguaccugaacuaccugaacgcccgcaagaacgagaagcacaaggagcacagcaacaucaugggcauccagcagcucgagaccaucaaggucaccgacaagaacgggaacgagaagcggguguucaaggcgcccaugcccaacuuccgccaggugaccaaggccuuccuggagaacauccugaucucccacaaggccaagaacaaggucgugacgaagaacaagaacaagguggccggcagcaacaagguccaggaggugcucaccccgcggggccagcugcacaaggagaccguguacgggaaguaccaguacuacguccagaaggaggagaagaucggcgggaaguucgaccuggagaccaucaagaagguggccaacccgcucuaccagucccugcugaagaagcgccucgaggagaacggcggggaccccaagaaggcguucacgggcaagaacagccuggccaagaaccccaucuaccuggacgacgcccagaccgagcagcuccccgagaaggugaagcuggucuggcuggagaacagcuucuccauccggaaggacaucaccccggagaacuucaaggacgagaagcucaucgacaagauccuggacgagggcgugaagcgcauccugaaggagcggcuccagagcuucgggaacgacgccaagaaggccuucuccgaccuggagaagaaccccaucuggcugaacaaggagaagggcaucaccaucaagcgcgugacgaucagcggggucgcgaacgccgagccccuccacaccaagaaggaccaccugggcaaggagauccuggacaaggaggggaagcccaucccgguggacuucaucuccaccggcagcaaccaccacguggccgucuaccgggacgagaagggcaaccuccaggagaaggugguguccgucuucgaggccguggugcgcgcgaaccaggggcugcccaucaucgacaagaccuacaaccagcaccugggcugggaguuccucuucacgaugaagcagaacgagauguucgucuuccccaacgagagcaccggguucaacccgaacgacaucgaccugcuggaccccaagaacaagcggaucaucucccccaaccucuuccgcgugcagaagcuggccaccggcgacuacugguuccggcaccaccuggagaccacgguggagaccaagagcgccaccaaggacaugaccuacaagcgccugucccucaaccacaucaagaacaucaucaagguccggaucagccaccugggggacaucguguccgugggcgaguacuga

SEQ ID NO: 2170 - RNA, 4275 nt, Artificial Sequence
  Cas9 variant
augaagcgcauccugggccucgaccuggggaccaacagcaucggcugggcccuggugaacgaggccgagaccgacgaggaggucuccagcaucauccggcucggggugcgcgugaacccccugacggucgacgagacccagaacuucgagaagggcaaguccaucaccaccaacgcggagcggacgcugaagcgcagcaugcggcgcaaccuccagcgguacaagcugcgccgggacgcccugguggaguuccucaaggagcugggguucaucaccgacgagaccauccuguccgagcagggcaaccgcaccacguucgagaccugccggcuccgcgccaaggccgccgaggaggagaucagccuggaggagcugucccgggugcuccugaugaucaacaagaagcgcggcuacaagagcucccggaaggucaagaaggaggaggacggggugcugaucgacggcauggagaucgcgaagaagcucuacgaggaggaccugaccccggggcagcugugcagccagcuccuggaguccggcaagaaggugcugcccgacuucuaccgcagcgaccuccaggaggagcuggaccggaucugguccguccagaagcaguuccaccccgacguguucugcgacgccgccaaggaggagaucaaggggaagaaccgcagccagaccugggccauccuggcgaacuacuucguguggaaggaggaggucgugggcuggaacgaccgggaggccaagaacgagacgaucgagaaggagugcaagcucgugggccugaagcgcaccaccaagggguacgagcugaagaaggagaacuaccgguggcgcgcccaggcccucaccgagcagcugggccuggaggagaucgccgucgugcuccaggagaucaacgggcagaucaacgcguccagcggcuaccugggcgccaucuccgaccgcagcaaggugcuguacuucaaccaccagacggucgggcaguaccagauggccgagcucgacaagaacccccacgccucccugcggaacaugguguucuaccgccaggacuaccuggacgaguucgaccggaucugggagaagcaggccgaguuccacaaggagcucaccgcggagcugaagaaggagauccgcgacaugaucaucuucuaccagcggcgccucaagagccagaagggccucaucagcuucugcgaguucgagcggcuggagaucguggucgagaaggacgggaagaagcagaccaaggugaucggcugcaaggugaucccgcgcucccacccccuguuccaggaguucaaggucuggcagacccucaacgacaucaaggugcuggggcgggagaagaagcgcaacgcccugagcgccuccgagagccgggcccucuaccccgaggagaaggagauccuggcccgcgagcuggcgaucaaggagaacaugaagaaggccgacguccugaagcuccuguucgagaacccccaggagcuggaccucaacuucaagcagaucgacggcaaccggacgggcuucucccuguucagcgccuacuccaagaugaucgagaaguacggguacgagccgcuggacuucaagaagcccgccgacgagaucaucggccagcuccgcaccaucuucaccgaccugggguggaacaccaaccuguucacgaucgaccucaccaaggagggcaaggagcuggagaugcagcccuacuuccggcuguggcaccuccuguacagcuucgagggggacaacaccuccaccggcaacggcaagcugaucgagaagaucaugcagcucugcgggguggagaaggaguacgccguggagcuggcgagccuguccuuccaggacgacuacggcagccucuccgccaaggccaucaagcgcauccugcccuaccugaaggaggggaaccucuacgacgucgccugcgaguacgcgggcuaccggcacagcaaguccagccugacgaaggaggagaucgagaacaaggugcugaaggggaagcucgaggugcugccgaagaacucccugcgcaaccccgucguggagaagauccucagccagauggugaacgucaucaacaccaucaucgacaccuacggcaagcccgacgagauccggguggagcuggcccgcgagcugaagaaguccgccaaggagcgcgaggagcucaccaaggccaucgccaagagcacgcgggagcacgaggagauccgcaagcugcugcaggacgaguucggcaugaugaacgugagccggaacgacaucauccgcuacaagcucuacgaggagcugaaggacaacggguacaagacccuguacuccaaccaguacauccccaaggagaagaucuucagcaaggagaucgacaucgagcacaucaucccgcagucccggcuguucgacgacagccuguccaacaagacccuggaguacaaggcgaucaacaucgagaagggcaacaagaccgccuacgacuucgucaaggagaaguacggggaggagggccuccagcaguacaucaaccgcugcgagagccuguucaacgacaagaaggccaagcugcggaagcucaagauggagcagaaggacauccccgacggcuucaucgaccgcgaccugcggaacacgcaguacaucgccaagaaggcccuggcgaugcucaacgagaucugccgccgggugguggccaccaccggguccaucaccgaccagcugcgcgaggacuggcagcuggucgacgugaugaaggagcucaaccugcccaaguacgaggcccugggcuucguggagaccuacgaggacaaggacgggcggaagaucaagcgcaucaaggacuggacgaagcggaacgaccaccgccaccacgccauggacgcccucaccgucgcguucaccaaggacgccuucauccaguacuucaacaacaagaacgccgcccaggacagcggcaaccggaaccacaccaacaucaucgggaucaagacgcgcuacuucgacaagggccgggcgcugcccccgaucccccuggagcaguuccgcaucgaggccaagcagcaccucgagaagcugcugguguccaucaaggccaagaacaagguggucaccgugaacgugaaccggaccaagaagcgcaagggcgagaacaccaagauccagcagacgccccgcgggcagcuccaccuggagaccgucuacggcagccacaagcaguacgugaccaagaucgagaaggugaacgccuccuucgacgccgcgaagaucgccaccgucagcaagcgggccuaccgcaacgcccugcucaagcggcuggagacguucgggaacgaccccaagaaggccuucaccggcaagaacgcgcuggagaagaacccgcucuacgccgacaaguaccagaccauccgcgugcccgagaaggugcagaccgucgaguucgagacgaucuacaccauccggaagcccguggaccccgcccugaacguggacaaggucguggacgugaagguccgcgccauccuggagcggcgccucaaggaguacgggggcgacccgaagaaggccuucgugaacuucugggagaaccccaucuggcugaacaaggagaagggcaucuccaucaagcgggugagcauccgcgggaucaacaacgcgcaguccauccacgucaagaaggacaagaacggcaaccccaucugggacgagaacgggaagcagaucccgguggacuucgugaacaccggcaacaaccaccacgucgccaucuaccggaagcccgugcuggacaagaagggccaggugaccuucgacgaggacgggaaccucauguacgagcuggacgaggucguggugcccuucuucgaggccgucacgcgcgccaaccugggccuccccaucaucgacaaggacuaccgcaagagcgagggguggcaguuccuguucuccaugaagcagaacgaguacuucguguucccgaacgagaagaccggcuucaaccccaaggagguggaccugcucaaccccgacaacuacgcgaugaucagccccaaccuguuccggguccagaccaugagcaaggugauguacgggaacaacgucgugcgggacuacaaguuccgccaccaccuggagaccacggugaaggacaugaaggagcucaaggacaucgccuacaagcaguacaagacccuguccuucggcaacagcgucgugaagauccggaucaaccacaucgggcagaucguguccgucggcgaguacuga

SEQ ID NO: 2171 - RNA, 4275 nt, Artificial Sequence
  Cas9 variant
augaagcgcauccugggccucgaccuggggaccaacagcaucggcugggcccuggugaacgaggccgagaccgacgaggaggucuccagcaucauccggcucggggugcgcgugaacccccugacggucgacgagacccagaacuucgagaagggcaaguccaucaccaccaacgcggagcggacgcugaagcgcagcaugcggcgcaaccuccagcgguacaagcugcgccgggacgcccugguggaguuccucaaggagcugggguucaucaccgacgagaccauccuguccgagcagggcaaccgcaccacguucgagaccugccggcuccgcgccaaggccgccgaggaggagaucagccuggaggagcugucccgggugcuccugaugaucaacaagaagcgcggcuacaagagcucccggaaggucaagaaggaggaggacggggugcugaucgacggcauggagaucgcgaagaagcucuacgaggaggaccugaccccggggcagcugugcagccagcuccuggaguccggcaagaaggugcugcccgacuucuaccacagcgaccuccaggaggagcuggaccgcaucugguccguccagaagcaguuccaccccgacguguucugcgacgccgccaaggaggagaucaaggggaagaaccggagccagaccugggccauccuggcgaacuacuucguguggaaggaggaggucgugggcuggaacgaccgcgaggccaagaacgagacgaucgagaaggagugcaagcucgugggccugaagcggaccaccaagggguacgagcugaagaaggagaacuaccgcuggcgggcccaggcccucaccgagcagcugggccuggaggagaucgccgucgugcuccaggagaucaacgggcagaucaacgcguccagcggcuaccugggcgccaucuccgaccgcagcaaggugcuguacuucaaccaccagacggucgggcaguaccagauggccgagcucgacaagaacccccacgccucccugcgcaacaugguguucuaccggcaggacuaccuggacgaguucgaccgcaucugggagaagcaggccgaguuccacaaggagcucaccgcggagcugaagaaggagauccgggacaugaucaucuucuaccagcgccggcucaagagccagaagggccugaucagcuucugcgaguucgagcgccuggagaucguggucgagaaggacgggaagaagcagaccaaggugaucggcugcaaggugaucccgcggucccacccccuguuccaggaguucaaggucuggcagacccucaacgacaucaaggugcuggggcgcgagaagaagcggaacgcccugagcgccuccgagagccgcgcccucuaccccgaggagaaggagauccuggcccgggagcuggcgaucaaggagaacaugaagaaggccgacguccugaagcuccuguucgagaacccccaggagcuggaccucaacuucaagcagaucgacggcaaccgcacgggcuucucccuguucagcgccuacuccaagaugaucgagaaguacggguacgagccgcuggacuucaagaagcccgccgacgagaucaucggccagcuccggaccaucuucaccgaccugggguggaacaccaaccuguucacgaucgaccucaccaaggagggcaaggagcuggagaugcagcccuacuuccgccuguggcaccuccuguacagcuucgagggggacaacaccuccaccggcaacggcaagcugaucgagaagaucaugcagcucugcgggguggagaaggaguacgccguggagcuggcgagccuguccuuccaggacgacuacggcagccucuccgccaaggccaucaagcggauccugcccuaccugaaggaggggaaccucuacgacgucgccugcgaguacgcgggcuaccgccacagcaaguccagccugacgaaggaggagaucgagaacaaggugcugaaggggaagcucgaggugcugccgaagaacucccugcggaaccccgucguggagaagauccucagccagauggugaacgucaucaacaccaucaucgacaccuacggcaagcccgacgagauccgcguggagcuggcccgggagcugaagaaguccgccaaggagcgcgaggagcucaccaaggccaucgccaagagcacgcgcgagcacgaggagauccggaagcugcugcaggacgaguucggcaugaugaacgugagccgcaacgacaucauccgguacaagcucuacgaggagcugaaggacaacggguacaagacccuguacuccaaccaguacauccccaaggagaagaucuucagcaaggagaucgacaucgagcacaucaucccgcagucccgccucuucgacgacagccuguccaacaagacccuggaguacaaggcgaucaacaucgagaagggcaacaagaccgccuacgacuucgucaaggagaaguacggggaggagggccuccagcaguacaucaaccggugcgagagccuguucaacgacaagaaggccaagcugcgcaagcucaagauggagcagaaggacauccccgacggcuucaucgaccgggaccugcgcaacacgcaguacaucgccaagaaggcccuggcgaugcucaacgagaucugccggcgcgugguggccaccaccggguccaucaccgaccagcugcgggaggacuggcagcuggucgacgugaugaaggagcucaaccugcccaaguacgaggcccugggcuucguggagaccuacgaggacaaggacgggcgcaagaucaagcggaucaaggacuggacgaagcgcaacgaccaccggcaccacgccauggacgcccucaccgucgcguucaccaaggacgccuucauccaguacuucaacaacaagaacgccgcccaggacagcggcaaccgcaaccacaccaacaucaucgggaucaagacgcgguacuucgacaagggccgcgcgcugcccccgaucccccuggagcaguuccggaucgaggccaagcagcaccucgagaagcugcugguguccaucaaggccaagaacaagguggucaccgugaacgugaaccgcaccaagaagcggaagggcgagaacaccaagauccagcagacgccccgcgggcagcuccaccuggagaccgucuacggcagccacaagcaguacgugaccaagaucgagaaggugaacgccuccuucgacgccgcgaagaucgccaccgucagcaagcgcgccuaccggaacgcccugcucaagcgccuggagacguucgggaacgaccccaagaaggccuucaccggcaagaacgcgcuggagaagaacccgcucuacgccgacaaguaccagaccauccgggugcccgagaaggugcagaccgucgaguucgagacgaucuacaccauccgcaagcccguggaccccgcccugaacguggacaaggucguggacgugaagguccgggccauccuggagcgccggcucaaggaguacgggggcgacccgaagaaggccuucgugaacuucugggagaaccccaucuggcugaacaaggagaagggcaucuccaucaagcgcgugagcauccgggggaucaacaacgcgcaguccauccacgucaagaaggacaagaacggcaaccccaucugggacgagaacgggaagcagaucccgguggacuucgugaacaccggcaacaaccaccacgucgccaucuaccgcaagcccgugcuggacaagaagggccaggugaccuucgacgaggacgggaaccucauguacgagcuggacgaggucguggugcccuucuucgaggccgucacgcgggccaaccugggccuccccaucaucgacaaggacuaccgcaagagcgagggguggcaguuccuguucuccaugaagcagaacgaguacuucguguucccgaacgagaagaccggcuucaaccccaaggagguggaccugcucaaccccgacaacuacgcgaugaucagccccaaccuguuccggguccagaccaugagcaaggugauguacgggaacaacgucgugcgcgacuacaaguuccggcaccaccuggagaccacggugaaggacaugaaggagcucaaggacaucgccuacaagcaguacaagacccuguccuucggcaacagcgucgugaagauccgcaucaaccacaucgggcagaucguguccgucggcgaguacuga

SEQ ID NO: 2172 - RNA, 4278 nt, Artificial Sequence
  Cas9 variant
augcgccggaacauccugggccucgaccuggggaccaccagcaucggcuucgccaaggugaucgaggacgaggacuaccagaacuccgccgucgagcugaucggggugcgcgugaacccccucacgaccgacgagcagaccaacuucgagaagggccggccggucagcgugaacgcggaccgcacccugaagcgggggaugcgccggaaccuggaccgcuaccagcuccggcgccaccaccugaucgaggugcugaaggccaaccacaucaucacggucgacaccaagcucgccgaggacggcaagaacaccacccacgccacguacgccgugcgggcgcuggccgccaccgccgagaucccccuggaggcguucgcccgcgugcuccuggccaucaacaagaagcggggcuacaaguccagccgcaaggccaagaacgaggacgaggggcagcugaucgacggcauggccgucgcgaagcggcucuacgaggagaaccugacccccgggcagcuguccuaccuccugcugaaggagggcaagaaguaccuccccgacuucuaccgcagcgaccugaacgccgagcuggacaaggugugguccuuccagaagcaguucuacccggagauccucaccgaggaguucaagaagcaccuggaggggaagggccagcgggccacgagcgccgccuucuggggccaguacggguucaacaccgcggagaacaagggcucccgcgaggagaagaagcugaaggccuaccaguggcggagcgaggccguggaccagcagcucaccaaggaggaggucgccuacgugaucaccgagaucaacaacgaccugaacaaguccagcggguaccugggcgccaucuccgaccgcagcaaggagcuguucuucaacaagcagacggugggccaguaccuguaccagcagcugaagcagaacccccacacccggcucaaggggcaggucuucuaccgccaggacuaccuggacgaguucgagaccaucugggagacccaggcgaaguuccaccccgagcugacggccgcccucaaggaggagauccgcgacgugaucaucuucuaccagcggaagcugaagucccagaagggccugaucagcuucugcgaguucgaguccaaggagaucgagguggagaagaacgggcucaagaucaagaagcgcaucggccugcgggucgcccccaagagcuccccgcuguuccaggaguucaagaucuggcagguccucaacaaccuggaguuccgcaacaagagcagcaaggagguguucgugcccgacaugaccgccaagcagcagcuguucgacgagcucaacaucaaggggaaccugcuggcguccgaggccaucaagauccucggcuacaagaccaaggacugggaggccaacuaccacacccuggagggcaaccggacgaacaagagccuguacgacgccuaccugaagauccucgagcuggagggguacgacgaggaccugcucaagcuguccggcagcgacgacaucgacguguccaagaucgagaaguccgcgagcgagaucaagcagauggugcacgccgucuucgaggugcuggggaucaacagcaccauccucgacuucgacgccgaggccgacggcaaggccuucgagcagcagaccgcguaccgccuguggcaccuccucuacuccgccgaggacgacaacaagaaguaccugcaggaggacaucuucaucuacgggcacgacaacaucggccugaagaagaagcucugcgagcgguucggcuuccgccccgagcacaccaagauccuggucaacguggccuucagcggggacuacggcucccugagcuccaaggccaugcggaagaucuaccccuucaucaaggagcucacguacgacaaggccugccgcgaggcgggguaccggcacagcgccuccagccuguccaaggaggagaucgccacccgcccgcugcagaagcggcucggccugcugaagaagaacgagcuccgcagccccguggucgagaagauccugaaccagauggugaacguggucaacgcccugaucgacgacgagaacaagcggcgcaaggcccgggggcucuccgacgacuuccacuucgacgagauccgcaucgagcuggcgcgggagcugaagaagaacgccaaggagcgcgccgagaugaccaccaacaucaacgccgcgaagcagcuccacgagaagaucaucaagauccugcagacgcaguucggcgugagcaaccccagccgcaacgacaucauccgguacaagcuguacgaggagcucaagaacaacggcuacaaggaccuguacaccaacaccuacaucucccccgacauccuguucagcaagcagaucgacaucgaccacaucaucccgcagaugucccucuucgacgacagcuucuccaacaagaccguggucuuccgcaaggacaaccaggacaaggggaacaagacggccuacgacuacauccugggcaaguacggggagcuggcccucgaggaguacaucagccggaucaccucccuguucgagcugggcaagaagaacaaggaggagggcaucaacaaggccaaguuccagaagcuccagaagcgccugaucgacaucggggacggcuucaucgagaaggaccugcgggagagccaguacaucgccaagaaggcgaagaacaugcucuacgccaucugccgcuccgugguggccaccagcggggagaucaccgcccggcugcgcgaggacugggaccuggucaacgugaugcaggagaucaaccuccccaaguuccgggcccugggccugaccgagaugguggagaagaaggacgggggccagaaggagcgcaucaucgacuggacgaagcggaacgaccaccgccaccacgcgauggacgcccucaccaucgccuucacccggcacucccacauccaguaccugaaccaccugaacgcccgcaaggacgaggccagcaaguggcaccccgucguguccaagaucgaggagaaggagaccgaccucguguacgacgaccugggcaaccggaagcgccgguucaaggcgcccaugccgaacuuccgcgaggucgugaaggagcaccuggagaacgugcucaucagccacaaggccaagaacaaggucgugacgaagaacaagaacaagaucaagaccgccaagggggagaagaucaagaccgagcugacgccccggggccagcugcacaaggagaccaucuacgggcgcuaccgguacuacgaguccaaggaggagaaggugggccccaaguucgacgccgagaccaucgggauggucgugaacccccaguaccgcaagcuccugcuggagcgccucaccaccaacggcaacgacccgaagaaggcguucggcgggaagaacacgcugagcaagaacccccuguacaucgacgaggccaagcaggagcuccugcccgagaagauccugcuccgguggcugaacgacgacuacuccauccgcaaggacgugacccccgagaaccugaaggacgucaagaccaucgagaaggugcucgacgagggcaucaagaagauccugcugaagcggcucguggacuucgggaacgacccgaagaaggccuucagcgaccuggacaagaaccccaucuggcugaacgaggccaagggcaucaccaucaagcgcgucacgaucagcggggugaagaacgccgaggcgcuccacuacaagaaggaccacuucggcaacgccauccugaacgagaacggcaagcugauccccuccagcuucguguccaccgggaacaaccaccacgucgccaucuaccgggacgccgagggcaaccuccaggagcgcguggugagccuguucgacgccguccagcuggugaacgcgggggaggccgugaucgaccgggaguacaacaagggcaucggguggcaguuccucuucaccaugaagcagaacgagauguucgucuucccgaacgagaagaccggcuucgaccccaaggagaucgaccugcugaacacggacaaccgcaagcucaucucccccaaccuguuccgggugcagaagaucgccagcaagaacuacuucuuccgccaccaccuggagaccaacguggaggagcggaaggagcucaaggacaucgucuacaagccccagcugggccugaacgccaucaaggacguggugaagguccgcaucaaccaccucgggaagaucaucuccgugggcgaguacuga

SEQ ID NO: 2173 - RNA, 4281 nt, Artificial Sequence
  Cas9 variant
augccccgcaagaacauccugggccucgaccuggggaccaccagcaucggcuucgccaagaucaucgaggacgacgacuaccagugcuccagcguggagcugaucgggguccgggugaacccgcucacgaccgacgagcagaccaacuucgagaagggcaagcccguguccgucaacgccgaccgcacccugaagcgggggaugcgccggaaccuggaccgcuaccagcuccggcgcgacuaccugaucgagauccugcggacgcaccacaucaucaccgcggacaccaagcucgccgaggacggcaagaacaccacgcacaccaccuacgcccugcgcgcccuggccgcgaccgccgagaucccccucgaggccuucgugcgggugcugcuggccaucaacaagaagcgcggcuacaagagcucccggaaggcgaagaacgaggacgaggggcagcucaucgacggcauggccaucgcccgccggcuguacgaggagagccugacgcccgggcaguucuccuaccagcuccugaaggagggcaagaaguaccugccggacuucuaccgcagcgaccucaacaccgagcugaacaaggucuggaacuuccagaagcaguucuaccccgagauccugaccgacgaguucaagcggcaccucgaggggaagggccagcgcgccaccgccguggcguucuggggccagcacggguucuccauggccgagaacaagggcagccgggaggagaagaagcugcacgccuacaaguggcgcuccgaggccgcccacaagcagcugacgaaggaggagguggcguucgucaucaccgagaucaacaacgaccucaacaagagcuccggguaccugggcgccaucagcgaccgguccaaggagcuguucuucaacaagcagaccgugggccaguaccuccaccagcagcugaaggagaacccccacacccgccugaagggccagguguucuaccgccaggacuaccucgacgaguucgagacgaucugggagaugcaggccaaguucuacagcgcccugacccuggagcucaaggaggagguccgggacguggugaucuucuaccagcgcaagcugaagucccagauggggcugaucagccucugcgaguucgaguccaaggagaucgagaucgagaagaacggggagaaggccaagaagcggaucggccugcgcgucgcgcccaagagcagcccgcuguuccaggaguucaagaucuggcagguccucaacaaccuggaguuccggaacaagaagaccaaggagguguucgugcccgagauggccgccaagcagcagcuguucgacgagcucaacaucaaggggaaccugcuggccuccgaggccaucaagauccucggcuacaagaccaaggacugggaggcgaacuaccacacgcuggagggcaaccgcaccaacaagagccuguacgacgccuggcugaagauccucgagcuggagggguacgacgagaaccugcucaagcuguccggcagcgacgacaucgacguguccaagaucgagaagcccgcccuggagauccggcagauggugcucgccgucuucgaggugcuggggaucagcggcgcgauccuggacuucgacgccgaggccgacgggaaggccuucgagcagcagcccgccuaccagcucuggcaccuccuguacuccgcggaggacgacggcaagaaguacagccaggaggacaucuucaccuacggccacgacaacaucgggcugaagaagaagcugugcgagaaguucggcuuccgcccggagcacaccaagauccuggugaacgucguguucuccgacgacuacgggaaccucagcuccaaggccaugcggcgcaucuaccccuucaucaaggagcugacguacgacaaggccugcgccgaggccggcuaccggcacagcgcggccucccugaccaaggaggagaucgccgcccgcccccuccagaaccggcuggaccugcucaagaagaacgagcugcgcagccccgucguggagaagauccugaaccagauggugaacgucgugaacacccucguggacgacgagaaccagaaccggaaggcccgcgggcuguccgaggacuuccacuucgacgagauccggaucgagcuggcgcgcgagcucaagaagaacgccaaggagcgggccgagaugaccacgaacaucaacaccgccaagcagagccacgagaagaucauccgcauccugcagaccgaguucggcgucccgaaccccucccgcaacgacaucgugcgguacaagcuguacgaggagcucaagaacaacggcuacaaggaccuguacaccaacacguacaucagccgcgacauccuguucuccaagcagaucgacguggaccacaucaucccccagaugagccucuucgacgacagcuucuccaacaagaccgucguguuccggaaggacaaccaggacaaggggaacaagaccgcguacgacuacauccugggcaaguacggggagcaggcccuggaggaguacaucagccgcaucaccucccucuucgagcugggcaagaagaacaaggaggagggcaucgggaaggccaaguuccagaagcugcagaagcggcucguggacaucggcgacggguucaucgagcgcgaccugcgggagagccaguacaucgccaagaaggccaacaacaugcuguacgcgaucugccgcuccgucgugagcaccuccggcgagaucacggcccggcuccgcgaggacugggaccuggugaacgucaugcaggagaucaaccugcccaaguuccgggcccucgggcugaccgagaugguggagaagaaggacggcgcccagaaggagcgcaucaccgacuggaccaagcggaacgaccaccgccaccacgccauggacgcgcuggccaucgccuucacgcggcacagccacauccaguaccucaaccaccugaacgcccgcaaggacgaggccaacaaguggcacccgguggucuccaagaucgaggagaaggagaccgugcugaucuacgacgaccucggcaaccggaagcgcaaguucaaggcgcccaugcccaacuuccgggagguggucaaggagcaccuggagaacgugcugaucagccacaaggccaagaacaagguggucaccaagaacaagaacaagaucaagaccgugcgcggggagaaggugaagacggagcucacgccccggggccagcugcacaaggagaccaucuacgggcgcuaccgcuacuacgaguccaaggaggagaagaucggcccgaaguucgacgccgagaugaucgggauggucaccaacccccaguacaagaagcugcuccuggagcggcuggccgcgaacggcaacgaccccaagaaggccuucuggggcaagaacgcccucaacaagaacccccuguacguggacgaggcccgccaggagcugcucccggagaagauccugcugcgguggcucaacgacgacuacagcauccgcaaggacgugacccccgagaaccugaaggacaucaagaccaucgagaagauccuggacaagggggucaagaagauccuccugaagcggcuggccgacuucggcaacgaccccaagaaggcguucuccgaccucgacaagaacccgaucuggcagaacgaggccaagcgcaucgccaucaagcgggugaccaucagcgggaucaagaacgccgcgccccugcaccacaagaaggaccaccugggcaacgacauccucgacgagaaggggaagcagauccccuccagcuucguguccaccggcaacaaccaccacgucgccaucuaccgcgacgccgagggcaaccugcaggagcggguggugagccuguucgacgccguccagcucgugaacgggggcgagcccgugaucgacaaggaguacaacaaggggaucggcuggcaguuccuguucacgaugaagcagaacgagauguucgucuucccggacgagaagaccggguucaacccccgcgagguggaccugcucagcuccggcaaccggaagcugaucagccccaaccuguuccgcgugcagaagcucgccuccaagaacuacuucuuccggcaccaccuggagaccagcgucgaggagaagaaggagcugaagaacaucgccuacaagccccagcucggccugaacgcgcuguccaacaucgugaaggugcgcaucaaccacaucggggagaucgucagcgugggcgaguacuga

SEQ ID NO: 2174 - RNA, 4281 nt, Artificial Sequence
  Cas9 variant
augaagaacauccugggccucgaccuggggaucaccagcaucuccuucgcccacaucguggaggacgagaacaaggagaaguccgagaucaaggagcugggcguccgcaucgugucccucaccacggacgagcagagcgacuucgagaaggggaaguccaucaccaccaacgccaaccggacccugaagcacggcgcgcgccugaaccucgaccgguaccagcagcgccggaaguaccugaucgaccugcuccagaaggccaaccugaucacgagcuccagcauccuggccgagaacgggaagaacaccacccacuccaccuggcagcuccgcgccaaggccgugacggagcggaucgagaaggaggaguucgcgcgcguccugcuggccaucaacaagaagcggggcuacaagagcucccgcaaggccaagaccgaggacgagggccaggccaucgacgggauggcgaucgccaagcggcucuacgacgagaaccugacccccggccagcugagccuccagcugcugcagcagaacaagaagcuccugccggacuucuaccgcuccgaccugcagcgggaguucgaccucguguggaacuuccagaagcaguucuaccccgacauccugaccgacagcuucuacaaggagcugcaggggaagggcaaggacgccacguccaaggccuucagcaagcgcuaccacuucgacaccgccgagaacaagggguccaaggagagcgugcggcuccaggcguaccaguggcgcgccgaggccaucuccaagcagcugagcaaggaggaggucgccuacgugcugaccgagaucaacaacaaccucaacaacgccagcggcuaccugggcgcgaucuccgaccggagcaaggagcuguacuucaaccgccagaccguggggcaguaccucuacgcccagcugcaggagaaccggcacaacucccugaagaacaaggucuucuaccgccaggacuaccucgacgaguucgagcggaucugggagacgcaggccagcuuccacaaggagcugaccgacgagcugaagaagcagauccgcgacguggugaucuucuaccagcgcaagcucaagucccagaagggccugaucagcuucugcgaguucgaguccaaggagaucgagaucgagaaggacgggaagaccaucaccaagacgaucggcgcccgggucgugcccaagagcagcccccuguuccaggaguucaagaucuggcagauccucaacaacgugaccugcaagcgcaagggcauccggaagaagaaguccuccgccaagagcaccgagcuggaccuguucaacgagccgucccagaccaucuucagccucgacauggagugcaagcagcugcuguucgacgagcucaaccugaagggggaccugaaguccgacaagguccugaagcuccugggcuacagcccccaggagugggagaucaacuacaaccagcuggaggggaaccgcacgcagaaggcgcucuacgaggccuaccugaagaucguggagauggaggcccacgacgugaaggacauccugcagaucaaguccgccaaggacgacuggagccucgacgagagcccccugagcgccagcgagaucaaggagaaggucaaggacaucuuccaggcgcugggcaucugcaccaagauccucuacuucgacccccugcugccggugaaggaguucgagaagcaggacuccuaccagcucuggcaccuccuguacagcuacgaguccgacgacagcaccuccgggaacgagacccuguaccggauccuggagaagaaguacgccuucaagcgcgagcacgcccggauccuggccaacguggcgcuccaggacgacuacggcagccuguccacgaaggccauccgcaagaucuaccccaacaucaaggagaaccaguacagcaaggccugcgagcuggccggcuacaagcacuccaagcucagccugaccaccgaggagcuggaggcccgggagcucaagaacaucaucccccugcugaagaagaacgcgcuccgcaaccccgucguggagaagauccugaaccagaugaucaacguggucaacgcccugaucgagaagaacuccgagcgggacgccgaggggaagaucaccaaguacuuccacuucgacgagauccgcaucgagcucgcccgggagcugaagaagaacgcccagaagcgcuacgagaugacgcagaacaucaacaaggcgaagcuggagcaccagaagaucagcgagauccuccagaagaaguucggcaucaagaacccgaccaaguccgacaucauccgguaccgccuguaccaggagcuggagcacaacggguacaaggagcucuacaccaacgcccccaucgcccgggacaugcuguucagcaagaacaucgagaucgagcacaucgugcccaaggcccgcgucuucgacgacuccuucagcaacaagacccugacguuccaccggaucaacuccaacaagggcgaguacaccgccuucgacuacaucaccagccucaacagcgaggaggagcugaaccaguaccugacccgcguggagaacgcguacaagaccaaguccaucagccucacgaaguacaagaaccugcugaagaaggccuccgagaucggggacggcuucaucaaccgcgaccuccgggacacccaguacaucgccaagaaggccaaggagauccuguuccaggugaccaagaacguccugagcaccuccggcagcaucacggaccgccuccgggaggacugggggcugguggacgugaugaaggagcugaacaugcccaaguaccagucccucggccugaccgaggucgaggagcgcaaggaggggaacaaggugaccgugaucaagaacuggaccaagcggaacgaccaccgccaccacgcgauggacgcccugacggucgccuucaccaagccgagcuacauccaguaccucaaccaccugaacgcccggaaggacgagaacaacaagaacuacuccgugauccuggccaucgaggagaaggagaccaucaaggugcccaccaacaacggcaagaacaagcgcgucuucaucgagcccauccccaacuuccgccagguggcgaagaagcaccucgaggagaucuucaucagccacaaggccaagaacaagguggucacgaagaacgugaacaagccggccgggaccgacaagcagcagaucacccugacgccccggggccagcugcacaaggagaccaucuacggcaaguaccaguacuacgugaacaaggaggagaaggucggggugaaguucgacgagcggaccaucaccaagguguccaacccccucuaccgcgaggcccugcugaagcggcuccaggccaacgacaacgaccccaagaaggcguucaccggcaagaacgcccugagcaagaacccgaucuaccuggacgagacgaagaccaagacccuccccgagaaggucaaccugaccuaccuggaggaggacuucuccauccgcaaggacaucagccccgacaacuucaaggaccucaaguccaucgagaaggugaucgaccagggggugaagcggauccugaucaagcgccugcaggacuacgacaacgaccccaagaaggccuucgucgaccucgagaagaacccgaucuggcugaacaaggagaagggcaucgccaucaagcgggugacgaucagcggcguguccaacgcccagccccugcacaucgggaaggaccaccucggcaagaccacccugaacaaggaggggaacgagauccccgucgacuacgugagcaccggcaacaaccaccacguggcgaucuaccgcgacaaggaggggaaccugcaggagcagaucgucuccuucuucgaggccguggugcggacgcagcagggccucccgaucaucgacaagaccuacaagcaggaggagggcuggcaguuccuguucaccaugaagcagaacgagauguucgucuuccccaacgccaccacgggguucaaccccgccgagaucgaccugcucgaccccaagaacaagaagcugaucagcccgaaccuguuccgcgugcagaagaucgcgaccaaggacuacuucuuccggcaccaccucgagaccaacguggagaccgacaacguccugaagaacacgaccuggaagcgcgagggccugagcgggcucaaggacaucgugaaggugcgcaucaaccaccugggcgacaucgucuccaucggggaguacuga

SEQ ID NO: 2175 - RNA, 4281 nt, Artificial Sequence
  Cas9 variant
augaagcacauccugggccucgaccuggggaccaacagcaucggcugggcccugaucaagcaggacuucgagaacaagcagggggagauccucggcauggggucccgcaucauccccaugagccaggacauccugggcgacuucggcaaggggaacuccgugagccagaccgccgagcggacgaaguaccgcuccguccggcgccugcgggagcgcuuccuccugcggcgcgagcggcugcaccgcauccucaacgugcugggcuuccugccggagcacuacgcgagccagaucgacuucaccaagcgguucgggaaguucaaggaggagaccgagcccaagcucguguacuccaacgagggcuucaucuucaagaaguccuucgaggagaugcugagcgacuucaagacccaccagccccagcugcucgaggacaacaagaagauccccuacgacuggacgaucuacuaccugcgcaagaaggcccugagccggaagaucgagaaggaggagcucgccuggauccugcugaacuucaaccagaagcgcggguacuaccagcuccggggcgaggaggaggaggagaacccgaacaagcugaucgaguucuacucccugaagaucgucgacgugcucgccgacgagccccagaagggcaagagcgacaucugguacucccugauccuggagaacggguggaucuaccgccggagcuccaagacgccccucuucgacuggaaggagaagacccgcgacuucaucgugaccaucgaccugaacgacgacggcagcgucaagaccgacaaggaggggaacgagaagcgguccuuccgcgcccccggcgagaacgacuggacccuggugaagaagaagaccgagcaggagaucgacagcucccggaagaccgugggcacguacaucuacgagacccuccugaagaacccgaagcagaagaucaaggggaagcugguccgcaccaucgagcgcaaguucuacaagaccgagcucaagcagauccuggagaagcagaaggaguuccaccccgagcugcggcaggacgaccucuacagcgacugcgugcgcgagcuguacaagaacaacgaggcgcaccagcugacgcucagcaagaaggacuucgugcaccuguucauggaggacaucaucuucuaccagcggccccugggcucccagaaguccagcaucagcaacugcacccucgaguuccgcaaguacaaggacgagaacgggaccgagcacacccaguaccugaaggccauccccaaguccaacccguacuaccaggaguuccggaucuggcaguggauguacaaccugaacaucuacaagaaggaggacgacacgaacgucaccaaggacuuccucaacaccaaggccgacuucgagagccuguucgaguuccugaacaaccgcaaggagguggaccagaaggcccuccugaagcacuucaagcugaacgacaagacccaccgguggaacuacguggaggacaagaaguaccccugcaacgagacgaagaccaugauccugucccgccucgacaaggucgagaacaucagcgacgacuuccugacccgggagauggagcagaagaucuggcacaucaucuacuccgugaacgacaagguggaguacgagaaggcgcucaagagcuucgccggcaagaacaaccuggaggacaacuccuucuucgaggccuucaagaaguucccgcccuucaagagcgaguacggggccuucuccgagaaggccaucaagaagcugcugccccucaugcgcaugggcaaguucuggaacuacaacaacaucagcgagcaguccaagagccggauccagaagaucaucaccggcgaguacgacgagaacaucaaggacaagguccgcgagaaggcgauccaccugacgaccgagaccgacuuccaggggcugcagcucuggcuggugcaguacaucguguacggccggcacuccgaggccgccaugcuggggaaguggaacagcgccgacgaccucgaggaguuccugaaggaguucaagcagcacucccugcgcaaccccaucgucgagcaggucaucaccgagacgcuccggguggugaaggacaucuggcagaaguacggcaacggggccaaggacuucuuccgcgagauccacaucgagcugggccgggagaugaagcugcccgcggaggagcgcgagcggcucacccgccagaucagcgagaacgagaacaccaacuuccgcaucaaggcccugcuggccgagaugauggacgacaacagcguggagaacguccggcccuucuccccgaugcagcaggagauccucaagaucuacgaggagggcgugcugaacagcgacaucgagaucgaggacgacauccugaagaucuccaagaccgcccagcccagcuccagcgaccucaagcgcuacaagcuguggcuggagcagaaguacaagucccccuacacggggcagaucaucccccucaacaagcuguucaccccggaguacgagaucgagcacaucaucccccagagccgguacuucgacgacuccuucaccaacaagaucaucugcgagagcgccgugaacaagcugaaggacaacuacaucggccucgaguucaucaagaagcucgggggcuccaucgucgagugcgggaacggcaagagcguggcgauccugaagcacgacgccuacgaggacuucaucaagaagcacuacgccaacaaccgcuccaagcggaacaagcugcugcuggaggacauccccgagaagaugaucgagcgccagaugaacgacacccgguacaucagcaaguacaucuccggcgugcucagcaacaucguccgcguggaggacgggaccgacgagggcgugaacuccaagaacaucguccccgggaacggcaagaucacgacccagcugaagcaggacuggggccugaacgacguguggaacgaccucauccugccgcgguucgagcgcaugaaccaccugaccaacagcaccgacuucacggccuggaacgagaaccaccagaaguuccuccccaccgugcccgucgaguucagcaagggguucuccaagaagcggaucgaccaccgccaccacgcccuggacgcgcuggugaucgccugcgccaccaaggaccacgugaaccuccugaacaaccagagcgccaaguccgacaccaagcgguacgaccugaagaagaagcucaugaaguucgagaaggucgcguacaaccacccgcagacgggcgagcgcaucgagcgggaggcccccaagcaguuccugaagcccugggagaccuucaccaucgacgccaagaaccaccuggagaccaucaucgugagcuucaagcagaaccuccgcgugaucaacaaggccacgaacuacuacgagaaguacgucgagaaggaggggaccaaggugaaggagcggguggagcagaagggcaccaacugggccauccgcaagcccaugcacaaggagaccgucuccgggaagaucgaccugccgcggaucaaggugcccaagggcaagauccugacggcgacccgcaagagccucgacaccuccuucaaccugaagaccaucggcagcaucacggacaccgggauccagaagauccugaagaacuaccuccaguacaaggacaacaaccccgagcuggccuucucccccgagggcaucgaggacaugaacaagaacaucgagaaguucaacaacgggaaggcccaccagagcaucuccaaggugcgggucuucgagcugggcagcaaguucccgcucgggcaguccggcaacaagaaggagaaguacguggaggccgccaagggcaccaaccuguucuucgcgaucuaccaggacaagaacgggaagcgcagcuacgagaccaucccccugaacgaggugaucgagcgccagaagcagggccucuccgucguggaccugaaggggguggacgacuucuaccugagccccaacgaccucgucuacgugcccuccgaggacgagcuggagaacaucagcaugaucgacuucaacaagauguccagcgagcggaucuacaagguggucagcuucacgggcaaccagaucuucuucgugcgccaggacaucgccaccuccguggucaacaaggccgaguucagcacccugaacaagauggagcgggccaucgacgggaccaugaucaaggagacgugcgugaagcuccagaucgaccgccugggcaacaucuccaagaucuga

SEQ ID NO: 2176 - RNA, 4281 nt, Artificial Sequence
  Cas9 variant
auguacaacaucggccuggacaucgggaccggcagcgugggguggugccucaccgacgagaacggcuaccugcugaaggucaaccgcaaggggaacaacggcaacacguaccggaacuccgccuggggcgugcgccucuucgagagcgccgacaccgcggccgacugccggaucaagcgcuccacccggcgccgguacaagcgccggcgcacccggaucaucgagcugcgcaagaucaugagcgacaugaucaugcccaucgacccgaacuucuacgcccggcuggacgaggccuuccucuggaacgaggacaaguccgacaaggccaaggcgcccuuccugcuguucaacgacaacggguacgacgacgugaaguacuacacggacuaccccaccaucuaccaccuccgcaagcaccuccuggagaccaaggagaaggccgacccccgguucaucuaccuggcccugcaccacaugaugaaguaccgcggccacuuccuguucgaggggcagagcuucgaggccaucgacaacaucgaggacaccuucaucgagcucgagcaccuggucaacguguacgugaaggagaaggaggacacggacaacaacgcggagaacaacgcccuguaccaggagaugaagaacuaccucgccgacaacaaggucaagaacaaggacaagaaggaguacaucaccgacaccuucaucaaggccgacuacgacaacaaguacuccaaggagcuggccgcggccgugcugggcuacgaguucaacguggggaucaucgucaacgacaacagccucaccgacgaggacggcaaggcccugaaggccaaguucgccgacgcgaaguacgaggagaaggaggagaagcuguccgacacgcucggcgagcgguacuacaucaucgagacccugaagaagaucuacagcuggaaggugcugcacuccauccucggggacaacaaguaccugagcuacgccaugguggacaaguacgagaagcacuccgagcagcugaaggcccucaaguaccuguuccacaaguacaccagccaggacgaguacuccgaguucuuccaccaggagaagaacaaggagggcaaguacaucgucaacuacgccaacuacaucaaggggaucaagcgccugagcaacgagaccaacaagaaguacaacacgaagcagcagcucuaccaguccaucaugaagauccugggcgagcgggccgcggacgacgagguguacaagaagauccugguggagauggagcaggagaccuuccucgagaagaucaacaacgucgacaacagcgccaucccguaccagcugaaccugauggagauggacaagauccucacccagcagggcguguacuacaaggagcugcgcgacaacaaggagcugcuccugaagaugcugaccuccaagauccccuacuacguggggccccucaacaacaacagcaacggcaaccggaacuucgccuggaugacgaagaaggacgggaaggagaacgagaaggucuaccccuggaacgugaaggacguggucgacaucgacgugaccgccgaggacuucaucacccgcaugaccaacuacugcacguaccugccgaacgagaaggugcugcccaaggagagccuccuguaccagcgcuacaugcugcuggaggagcucucccagauccggaucgacggccgcaagcugagcaaggaggaccggaaggccaucaucaacgaccuguucaucgggaagggccgcgucaagguguccgacaaggacuucaaggaguaccucaacaaggucaacuacgugaaggugaacggcaagggguacgacgucaccggcuaccagagcgacgacggguucgcgugcgcccuguccagcuacaacaaguuccggcgcauccugggccacaucgacgagcagaacgagaagaugaucgaggacaucaucuacuggaucaccguguucgaggacaaggacaucgugaagcggaagaucaacaagcaguacgccgaccgccucuccgccgagcagcugaagaagauccugaagcucaaguucaagggguggggccgguacagcuccaagcugcugaacggcaucaagggggacaugggcaccacgaucaucgagaugcucgaggacgcggacgagcgcuucgccuacugcgacuacugccccaacuucaugcagaucaucaacaaggacgagaagaucaagcagaucaucgacgacaaccggccccgcuacgacgggaccaaggaccugcuggacgucauccaggacaugcacaccagcccggccaaccggcgcggcaucuggcagaccaugaaggccaucgaggagaucaucgaguacaugggggagaagccccagcagaucuacaucgaguucgcccgggaggacgaccccaaggcgaagaacaagcgcgccgacucccggaagcgcgccaucgacaaggcccucaagaagcugaaggaggacgugguggacgaguacaacgagaaggucuacaaggagcugaagcaguacgagaagcggcucgacgaggagaagguguaccuguacuucaugcagaacggcaaggaccuguacuuccccgacaaggagcucaaccuggacgagcuggagaagcucgagaucgaccacaucaucccguacagccuguccgacgacgacagccuggacaacaaggcccucgugcugaagggcaacaaccagaacaaggggaacaagaucgucaaggaggcguucccccagcuguucuccaacagcggcacggugaacuacuggaagaaccucaagaaggccgggcugaucuccgagaagaaguacaacaaccugcagaagaacaacguggacgacauccucaccaagggcuucaucaaccgccagcuggucgagacccgccagaucgucaagagcguggccaaccugauccucgacuacuacaacgagcagaucgacgugaucgaggugaaggccucccugagcaccagcgugcggaagaugcugacguacgagaagaaggacaacaacggcuucuggaucgagaacaaggacaacugcauguucuacaagaaccgcgacaugaacgacuaccaccacgcccacgacgcguaccucgccaacaucaucgggcuguacauccagaagaacuacccccggcugcagaaggagcucaacuacucccaguaccgccggaucuggcgcaaguacuacgagaacaccaagaacaacaacggcgucaacugguucgccacccuggggaaguucagcuccaacaacgaggaggccgacugguacggccaggacaucaucgcguacaugcggaagaucuucugcuaccgcgacgugcugaucagcaagaagguggaggagaacaccggggccuucuacuccgagaccaaguacccccgggaggacaaggccggcagcaagcucgucccgcugaagcagggcaacaacaugcgcggggccaacaaccugaaggagcucgacgcccggaaguacggcggguacaagggcggggagaaggcguacuucgugcuggugaaguacugcaucgagaaggcccugaagaagaaggucaagaaggaguaccacauggaguucguggagauccccguguacaucgcccgcggcaucaagaacaaggacaucaaccucuacgacuacgucugcgacauccugaacgaggccaacaagaacuccguggccgacguggagauccugcggaacaagguccccaaguaccagaugaucaucggcgagaacggggaggaguacuaccucgugagcgcgacggaggugaucaacuccaagcaguucguccugggcggggccaaccagcaguacaaccgccugcucaacuacaucaaguacggcaagaacgacaaguggcaguacauccagaccgagcugcuggacgagcagcucaucgggcuguacaaccugcucaucgccaagaucaaggacgaguacaagggcuucagcaaggaggccgugcggauccaggagaacaacuccuucgacaagcuggacgugaaggacaagaaggaguucaucgccgagaugaucaagcugguccagcccgacagcgacuacccguaccucggcaaguacgcgaccgggcuguccaaccgcaugggccggaagaccggggagaaggugggcaagaagaucacgcugguggacaagagcgucaccgggcucuacgagcgccggaccaccuucgagcuggaggacgacuccagcacgaaguccugcuga

SEQ ID NO: 2177 - RNA, 4281 nt, Artificial Sequence
  Cas9 variant
augaagaacauccugggccucgaccuggggaccaccagcaucggcuucgcccacaucguggaggacgagaacaaggagaaguccgagaucaaggagcuggggguccgcaucgugagccucacgaccgacgagcaguccgacuucgagaagggcaagagcaucaccaccaacgccaaccggacgcugaagcacggggcgcgccugaaccucgaccgguaccagcagcgccggaaguaccugaucgaccugcuccagaaggccaaccugaucacccccuccagcauccuggccgagaacggcaagaacaccacccacuccacguggcagcuccgcgccaaggccgugaccgagcggaucgagaaggaggaguucgcgcgcauccugcuggccaucaacaagaagcggggcuacaagagcucccgcaaggccaagaccgaggacgaggggcaggccaucgacggcauggcgaucgccaagcggcucuacgacgagaaccugaccccggggcagcugagccuccagcugcugcagcagaacaagaagcuccugcccgacuucuaccgcuccgaccugcagaaggaguucgaccucgucuggaacuuccagaagcaguucuaccccgacauccugacggacaucuucuacaaggagcugcagggcaaggggaaggacgccaccagcaaggccuucuccaagcgguaccacuucgacaccaccgagaacaagggcagcaaggaguccgugcgccuccaggccuaccaguggcgggcggaggccaucagcaagcagcuguccaaggaggagguggccuacguccugacggagaucaacaacaaccucaacaacgccagcggcuaccugggggccaucuccgaccgcagcaaggagcuguacuucaaccggcagaccgugggccaguaccucuacgcgaagcugcaggagaaccgccacaacagccugaagaacaagguguucuaccggcaggacuaccucgacgaguucgagcgcaucugggagacccaggccuccuuccacaaggagcugaccgacgagcugaagaagcagauccgggacgucgugaucuucuaccagcgcaagcccaagagccagaaggggcucaucuccuucugcgaguucgagagcaaggagaucgagaucgagaaggacggcaagacgaucaccaagaacaucggcgcccgcguggucccgaaguccagcccccuguuccaggaguucaagaucuggcagauccugaacaacgugaucugcaagcggaaggggauccgcaagaagaagaucuccgccaagaccacccagcucgaccugcugaacgagagcucccagacgaucuucagccucgacauggagugcaagcagcugcuguucgacgagcucaaccugaagggcgaccugaaguccgacaaggugcugaagcuccugggguacagcccccaggagugggagaucaacuacaaccagcuggagggcaaccggacccagaaggcccucuacgaggcguaccugaagaucgucgagauggaggcccacgacgugaaggacauccugcagaucaaguccgccaaggacgacuggagccucgacgagagcccccuguccgccuccgagauccgcgagaaggugaaggccaucuuccagacccuggggaucugcaccaagauccucuacuucgacccgcugcugcccgucaaggaguucgaggagcaggacagcuaccagcucuggcaccuccuguacuccuacgagagcgacgacagcacguccggcaacgagacccucuaccggauccuggagaagaaguacgcguucaagcgcgagcacgcccggauccuggccaacguggcccuccaggacgacuacggcagccuguccaccaaggcgauccgcaagaucuaccccaacaucaaggagaaccaguacagcaccgccugcgagaaggccggguacaagcacuccaagcugagccucacgaccgaggagcuggaggcccgggagcugaagaacaucaucccccuccugaagaagaacgcccugcgcaacccgguggucgagaagauccucaaccagaugaucaacguggugaacgcgcugaucgagaagaacuccgagcgggacgccgagggcaagaucaccaaguacuuccacuucgacgagauccgcaucgagcuggcccgggagcucaagaagaacgcccagaagcgcuacgagaugacccagaacaucaacaaggccaagcuggagcaccagaagaucagcgagauccugcagaaggaguucgggaucaagaaccccacgaaguccgacaucauccgguaccgccucuaccaggagcuggagcacaacggcuacaaggagcuguacaccaacgcgcccaucgcccgggacaugcuguucagcaagaacaucgagaucgagcacaucguccccaaggcccgcguguucgacgacuccuucagcaacaagacccugaccuuccaccggaucaacuccgacaagggggaguacaccgccuucgacuacaucacgagccugaacuccgaggaggagcucaaccaguaccugacccgcgucgagaacgccuacaagaccaagagcaucuccccgaccaaguacaagaaccugcucaagaaggcgagcgagaucggcgacgacuucaucaaccgcgaccugcgggacacgcaguacaucgccaagaaggccaaggagauccuguuccaggugaccaagaacgugcucagcaccuccggcagcaucaccgaccgccugcgggaggacugggggcuggucgacgugaugaaggagcucaacaugcccaaguaccagucccugggccugacggagguggaggagcgcaaggacgggaacaaggucaccgugaucaagaacuggaccaagcggaacgaccaccgccaccacgccauggacgcgcucaccguggccuucacgaagcccagcuacauccaguaccugaaccaccugaacgcccggaaggacgagaacaacaagaacuacuccgucauccucgccaucgaggagaaggagaccaucaaggugcccaccaacaacggcaagaacaagcgcguguucaucgagccgauccccaacuuccggcaggucgccaagaagcaccuggaggagaucuucaucagccacaaggcgaagaacaagguggugaccaagaacacgaacaagcccgccgggaccgacaagcagcagaucacccugacgccccgcggccagcuccacaaggagaccaucuacggcaaguaccaguacuacaucaacaaggaggagaagaucggggucaaguucgacgagcggaccaucgccaagguguccaacccgguguaccgcgaggcccugcugaagcggcuccaggccaacgacaacgaccccaagaaggcguucgccggcaagaacgcccugagcaagaaccccaucuaccuggacgaguccaagaccaagacccuccccgagaaggucaaccugacguaccuggaggaggacuucagcauccgcaaggacaucuccccggacaacuucaaggaccucaagagcaucgagaaggugaucgaccagggggugaagcggauccugaucaagcgccugcaggccuacgacaacgaccccaagaaggccuucgucgaccucgagaagaaccccaucuggcugaacaaggagaagggcaucgcgaucaagcgggugaccaucuccggcgugaacaacgcccagccgcugcacaucgggaaggaccaccucggcaagaccacccugaacaaggaggggaaggagauccccgucgacuacgugagcacgggcaacaaccaccacguggccaucuaccgcgacaaggaggggaaccugcaggagcagaucgucuccuucuucgacgccguggugcgggcgcagcagggcauccccaucaucgacaagaccuacaagcaggccgagggcuggcaguuccucuucaccaugaagcagaacgagauguucgucuuccccaacgccaccacgggguucaacccggccgagaucgaccugcuggaccccaagaacaagaagcucaucagccccaaccuguuccgcgugcagaagaucgccaccaaggacuacuucuuccggcaccaccuggagaccaacguggagaccgacaacauccucaagaacgucacguggaagcgcgagggccuguccgggcugaaggacaucgugaaggugcgcaucaaccaccucggcgacaucgucagcaucggggaguacuga

SEQ ID NO: 2178 - RNA, 4281 nt, Artificial Sequence
  Cas9 variant
augaagaacauccugggccucgaccuggggaccaccagcaucggcuucacgcacaucguggaggacgagaacaaggagaaguccgagaucaaggagcuggggguccgcaucgugagccucaccaccgacgagcaguccgacuucgagaagggcaagagcaucuccaccaacgccaaccggacgcugaagcacggggcccgccugaaccucgaccgguaccagcagcgccggaaguuccugaucgaccugcuccagaaggcgaaccugaucaccagcuccagcauccuggccgagaacggcaagaacaccacccacuccacguggcagcuccgcgccaaggccgugaccgagcggaucgagaaggaggaguucgcccgcguccugcuggcgaucaacaagaagcggggcuacaagagcucccgcaaggccaagaccgaggacgaggggcaggccaucgacggcauggccaucgcgaagcggcucuacgacgagaaccugacccccgggcagcugagccuccagcugcugcagcagaacaagaagcuccugccggacuucuaccgcuccgaccugcagaaggaguucgaccucguguggaacuuccagaagcaguucuaccccgacauccugacggacagcuucuacaaggagcugcagggcaaggggaaggacgccaccuccaaggccuucagcaagcgguaccacuucgacaccgccgagaacaagggcucccgcgagagcgugcggcuccaggccuaccaguggcgcgcggaggccaucuccaagcagcugagcaaggaggaggucgccuacgugcugaccgagaucaacaacaaccucaacaacgccagcggcuaccugggggccaucuccgaccggagcaaggagcuguacuucaaccgccagacggugggccaguaccucuacgcgcagcugcaggagaacaagcacaacucccugaagaacaaggucuucuaccggcaggacuaccucgacgaguucgagcgcaucugggagacccaggccagcuuccacaaggagcugaccgaggagcugaagaagcagauccgggacguggugaucuucuaccagcgcaagcucaagucccagaaggggcugaucagcuucugcgaguucgaguccaaggagaucgagaucgagaaggacggcaagaccaucacgaaguccaucggcgcccgcgucgugcccaaguccagcccccuguuccaggaguucaagaucuggcagauccucaacaacgugaccugcaagcggaaggggauccgcaagaagaaguccagcgccaaguccaccgagcuggaccuguucaacgagccgagccagaccaucuucucccucgacauggagugcaagcagcugcuguucgaggagcucaaccugaagggcgaccugaaguccgacaagguccugaagcuccugggguacagcccccaggagugggagaucaacuacaaccagcuggagggcaaccggacgcagaaggcccucuacgaggcguaccugaagaucguggagauggaggcccacgacgugaaggacauccugcagaucaagagcaccaaggacgacugggcccucgaggagagcccccugagcgccagcgagauccgcgagcgggucaaggccaucuuccagacccuggggaucugcaccaagauccucuacuucgacccccugcugccggugaaggaguucgaggagcaggacuccuaccagcucuggcaccuccuguacagcuacgaguccgacgacagcacguccggcaacgagacccuguaccgcauccuggagaagaaguacgcguucaagcgggagcacgccaccauccuggccaacgugacccuccaggacgacuacggcagccuguccacgaaggccauccgcaagaucuaccccuacaucaaggagaaccaguacagcaccgcgugcgagaaggccggguacaagcacuccaagcugagccucaccaccgaggagcuggaggcccgggagcugaagaacaucaucccccuccugaagaagaacgcccugcgcaaccccgucguggagaagauccucaaccagaugaucaacguggucaacgcccugaucgagaagaacuccgagcgggacgcggagggcaagaucacgaaguacuuccacuucgacgagauccgcaucgagcuggcccgggagcucaagaagaacgcccaggagcgcuacgagaugacccagaacaucaacaaggccaagcuggagcaccagaagaucagcgggauccugcagaaggaguucggcaucaagaacccgaccaaguccgacaucacccgguaccgccucuaccaggagcuggcccacaacggguacaacgaccuguacaccaacacguacauccccaaggagcuccuguucagcaagaacaucgacaucgagcacaucguguccaaggcgcgggucuucgacgacagcuucuccaacaagacccuggccuuccgcgaguucaacaucaagaagggcgagagcaccgccuucgacuacaucaccagccucaacaacgaggaggagcugaaccaguaccugaaccggguggagaacgccuacaagacgaagaacaucucccccgccaaguacaagaaccuccugaagaaggcgagcgagaucggcgacggguucaucaaccgcgaccugcgcgacacccaguacaucgccaagaaggccaaggagauccucuuccaggugaccaagaacguccuguccaccagcggcuccaucacggaccggcugcgcgaggacugggggcucguggacgugaugaaggagcugaacaugcccaaguaccagagccugggccucaccgaggucgaggagcggaaggaggggaacaaggugaccgugaucaagaacuggaccaagcgcaacgaccaccggcaccacgccauggacgcgcugacggucgccuucaccaagccguccuacauccaguaccugaaccaccucaacgcccgcaaggacaagaacaacaagaacuacagcgugauccuggccaucgaggagaaggagaccaucaaggugcccaccaacaacggcaagaacaagcgggucuucaucgagcccauccccaacuuccgccagguggccaagaagcaccuggaggagaucuucaucucccacaaggcgaagaacaagguggucacgaagaacaccaacaagccggccggcaccgacaagcagcagaucacccucacgccccgggggcagcugcacaaggagaccguguacggcaaguaccaguacuacgugaacaaggaggagaagaucggggucaaguucgacaaggagaccaucgccaaggugagcaaccccguguaccgcgaggcccugcucaagcggcugcaggccaacgacaacgaccccaagaaggcguucgccggcaagaacgcccuguccaagaacccgaucuaccucgacgaggccaagaccaagacgcugaccgagaaggucaaccugaccuaccucgaggaggacuucagcauccgcaaggacaucucccccgacaacuucaaggaccucaagagcaucgagaaggugaucgaccagggcgugaagcggauccugaucaagcgccugcaggacuacgacaacgaccccaagaaggccuucgucgaccuggagaagaaccccaucuggcugaacaaggagaaggggaucgcgaucaagcgggugaccaucuccggcgugaacaacgcccagccgcuccacaucgggaaggaccaccugggcaagacgacccugaacaaggaggggaaggagauccccgucgacuacgugagcaccggcaacaaccaccacguggccaucuaccgcgacaaggagggcaaccuccaggagcagaucgucuccuucuucgaggccguggugggggcgcagcagggccugcccaucgucgacaagaccuacaagcaggccgagggguggcaguuccuguucacgaugaagcagaacgagauguucguguucccgaacgaggccaccggcuucaaccccgccgagaucgaccuccuggaccccaagaacaagaagcagaucagccccaaccuguuccgggugcagaagaucgccaccaaggacuacuucuuccgccaccaccucgagaccaacgucgacacggacaacgugcugaagaacaccaccuggaagcgggaggggcuguccggccucaaggacaucgugaagguccgcaucaaccaccugggcgacaucgugagcaucggggaguacuga

SEQ ID NO: 2179 - RNA, 4284 nt, Artificial Sequence
  Cas9 variant
augaagaagauccugggccucgaccuggggaccagcuccaucggcugggcccuggugaacgaggccgagaccagcgaggagaaguccagcaucaucaagcucgggguccgcgugaacccccugacgguggacgagcugcagaacuucgagaagggcaaguccaucaccaccaacgcggaccggaccgccgggcgcagcaugcggcgcaaccuccagcgguacaagcugcgccgggagaaccugaucgagguccucaaggaguacaacuucaucacggacgagaugauccuguccgagaacggcaaccgcaccaccuucgagaccuaccggcugcgcgccaaggccgccguggaggagaucagccucgagcaguucgcgcgggugcugcugaugaucaacaagaagcgcggcuacaaguccagccggaaggccaagggggccgagaacggcacgcucaucgacgggauggaggucgccaagaagauguacgacgagggcaucaccccgggggagcugugccugcagcuccugaccgcgggcaagcgcuacuuccccgacuucuaccgguccgaccugcaggccgaguucgaccgcaucuggaacuuccagaagcaguucuaccccgacagccucaucgacaaggugaaggacgaggugcggggcaagaacaagucccagaccugggccauccuggccaaguacuucgucuggaaggagguggagaacagcuggaacgaggaggaggcccagacgcgccggguggagaaggaguaccgccuggucgggaucaagcggggcgugaagcgcgaggagcucaagcuggagaacuuccaguggcgcgugaaggcgcuguccgagcggaugaaccccgaggagcucgccaucguccugcaggagaucaacgagcagaucagcaacuccagcggguaccugggcgccaucuccgaccgcagcaaggagcucuacuucaaccggcagaccgugggccaguaccagauggccgugcuggacaacaacccgaacaucgggcugcgcaacauggucuucuaccggcaggacuaccucgacgaguucaacaccaucugggagaagcaggccgaguuccacaaggagcugaccgaggaccugaagaaggagauccgcgacaucgugaucuucuaccagcggcgccucaagagccagaagggccugaucaacaucugcgaguucgagcggcgccagaucgagguggagaucgacgggaagaagaagaucaagacgaucggcucccgggucaucccccgcagcagcccccuguuccaggaguucaagaucuggcagacccucaacgacaucgagguguccgugcugggggucaagaacaagcggaagaagcaggacgacaacuccaccacccugcucgacagcgcggagaacaucgacucccugaagcugaacgugagccgcccccucgacgccgacgagaagucccugcuggccaaggagcuguucauccgggacaagcugaccaagagcgacguccugaagcuccucuucaacaacccgcagaaccugaaccugaacuucaagaacaucgacggcaaccgcaccggcuccgcccucuaccaggccuucagcaagauccuggagaucuccgggcacgagagcaucaacuucaagaaguccgcggacgagaucguggagcaggucaagaccaucuucagcgcccugggcuggaacaccgaggugcucugcuucgacuccgagaaggagcuggacaagcagcccuacuucaagcuguggcaccuccuguacagcuucgagggggacuccacgcccaccggcgacgggaaccugauccagaagaucgccgaccucugcggcuucgagaaggacuacgccagcauccuggccaacaucaccuuccaggaggacuacggcagccuguccaccaaggcgauccggaagauccucccccaccugaaggacgggaaccaguacgacguggccugcgaguacgccggcuacaagcacagcaaguccagccugaagaaggaggagaucaagaacaaggugcucaaggacaagcuggagcugcucccgaagaacucccugcgcaaccccgucguggagaagauccugaaccagauggugaacgucaucaacgccaucaucacgaccuacgggaagcccgacgagauccggaucgagcucgcgcgcgagcugaagaagaacgccaaggagcgcgaggagcugaccaagagcaucguggacaccacgaagacccacgagggcauccgggccauccuccagaacgacuucgggaugucccacgugagccgcaacgccaucauccgguacaagcuguacgaggagcugaaggacaacggcuacaagacccucuacuccaacaccuacauccccaaggagaagcuguucagcaaggacuucgacaucgagcacaucaucccgcaggcccgccuguucgacgacuccuucagcaacaagacgcucgaggucaaguccaucaacaucgagaagggcagcaagaccgcguacgacuucguggaggagaaguacggggagcagggccugcaggaguaccugaaccggugcgagguccucuuccgcgacaagaagaccaagcugcggaagcugaagaugcaggaguccgagauccccgagggguucaucgaccgcgaccuccggaacacccaguacaucgccaagaaggcccugagcaugcugaacgagaucugccgccgggugguggccaccacgggcgccaucaccgacgagcuccgcgaggacuggcagcugguggacgucaugaaggagcugaacugggagaaguacaaggugcucggccugguggaguacuucgaggacaacgacgggcggcugaucggccgcaucaaggacuggaccaagcggaacgaccaccgccaccacgcgauggacgcccucaccgucgccuucacgaaggacguguucauccaguacuucaacaacaagaacgccucccugaagcccgacaccaacgaggccgcgauccggaacaaguacuuccagaacgggaaggccaucccgcccaugagccuggacgaguuccgcgccgaggccaagaagcaccucaacgacacccugaucagcaucaagaccaagaacaagguggucacgaucaaccugaaccggaccaagaagaagaacggcaucaacaagaagcagcagcagacgccccgcgggcagcuccaccuggagaccguguacggcucccacaagcaguacguggucaaggaggagaaggugaacgcgagcuucgacgccgccaagaucgccacggugaacaagcccgccuaccgggacgcgcugcuccgccgccugcaggagaacggcaacgacuccaagaaggccuucaccgggaagaacagccuggacaagcagcccgucuggcucgacgccaagcagaacgagugcgugccggagaaggugaagaccgucaugcuggagaccguguacacggugcggaagcccaucgacgagaagcugaacgucgacaaggugguggacgcccgcauccggaagcuccugcaggaccgcaucaaggaguacggcaacgccaaguccgcguucgccaaccuggacgagaaccccaucuggcucaacaaggagaaggggaucaccaucaagcgggucagcguguccggcaucagcaaggcccagucccugcacgagaagaaggacaaggacgggaacuucauccuggacaaggacagccgccggauccccguggacuucgucaacaccggcaacaaccaccacguggccaucuaccgcaagccggugcucgacaagaagggccaggccgucuucgacgagaacggggagcugaaguucgagcuggaggaggugguggucuccuucuucgacgcggugacccgggugaaccucagccagcccaucaucgacaaggacuacaagcgcuccgagggcuggaaguuccuguucagcaugaagcagaacgaguacuucgucuuccccaacgagaagacgggguucgacccgaaggagaucgaccugcucaaccccgagaacuacgcccugaucucccccaaccuguuccgggugcagaagaucgccagcaaggacuacgucuuccgccaccaccucgagaccgugguggccgaccggaaggagcugcaggagaucaccuggaagcgcaucuccagccuguccauccucaaccggaucaucaagguccgcgugaaccacaucggccagaucgugaugaucggggaguacuga

SEQ ID NO: 2180 - RNA, 4284 nt, Artificial Sequence
  Cas9 variant
auggccaagcccaaggacuacaccaucggccuggacaucgggaccaacagcgugggcugggucgugacggacgaccagaacaacauccuccgcaucaaggggaagaaggccaucggcgcgcggcuguucgccgaggggaagguggccgccgagcgccgguccuuccgcaccacccggcgccggcugagccgccggcgcuggcggaucaagcuccuggaggagcuguucgacaaggagaucgccaaggucgacccguccuucuucgcgcgccuccacgagagcuggaucucccccaaggacaagcggaagcgcuacagcgccaucguguuccccucccccgaggaggacaagaaguuccacgagagcuacccgaccaucuaccaccuccgggacaagcugaugaaggacgaccagaagcacgacauccgcgagaucuacaucgccgugcaccagaugaucaaggcccggggcaacuuccuccacgacgaguccgucgagacguaccgcagcggcauguccagccucgggggccgguccgagcgcaccauccugagcgugcagacccuggaggagcugaacgaccuguucgcggagaacgaggggaccgaggaggccaagcucaacguggccuccgccgagcagaucaacgacauccugacgggcgggcaccugaacgccgacagccagaaggagaucggcaaccuccugcugcccuccagcuuccccuccuucgacgacaaggcgaaggagaagcaggucaagaagcucaucaagaacguggccaccaacaucagcaaggccuggcugggcuacaaggccgacuucagcaccauccugaaccucgccaacguggacaaggaccagaagaagaucuucgcguucgcccugcagggcggggacgaggaggacaagguccaggagcuggagucccuccuggagcagagccagaccgacaucguggaccggcugaucgagauccgccacgccaucgugcucuccgagaucguccccguggggaugacgcugagcgaggccaugaucgacaaguacgaccagcacaaggaggaccugaucacccucaaggccgugauccgcaacaccaaggacaagaagaaggcggccaagcugcaggccaucuacgaccuguacgucaacaaccggcacgccgaccucgccaaggcgaugaagcugaccggcaucaagaagcgcuccgagcugcucgacccggaggagcugaagaaggccaucagcucccugcucgacgacagccccgaggccguggagaucaagcagaugcuggaggagaagacguuccugccccuccagcgguccaacaacaacggcgugauccccaaccagcugcaccaggucgagcuggacgagaucaucaagaagcagagcaaguacuacccguuccucgccgagaagaaccccgacgaguccgaggaggcgcagaagaaggcccccaccaagcuggacgcccugcugaccuuccgcgugcccuacuacguggggccgaugaucaccaaggaggagcaggaggcccaggacggccacagcuucgccuggaugguccggcgcgacccccaggaccacgaggcgaucacgcccuggaacuucgagaagaagguggacaagauggccuccgccacccaguucaucaagcggaugaccaccaaggacacguaccuccugggggaggacguccugcccgccagcucccucaaguaccagcuguucaccgugcugaacgagcucaacaaccugcgcgugaacggcaagaagcugaccagcgacgagaaggagcaggucaucgaggggcuguucaagaagcagaagaccgugaaggccgacaaguucgugaaguacuggcaggcgaagcacaucggcgccgacaucaaggucaagggccuguccgacccgagcaaguucaacuccacgaugagcaccuacaucgacuucaagaagaucuucggggaccagcugaacgacgugaaccggcagaacgacuucgagaagaucaucgaguacagcaccaucuucgaggaccgcaagauccucgaggacaagcugcgggccgacuucgccuggcuguccgaggagcagaucaagcagcucugccgccugcggcugcagggcugggggcgccucagcgacaagcugcugacccggcucacggacgccgacggccagaacgugcuggagcgccuguggaacuccaacgacaacuucguccagaucgugagcgaccccaacaucaaggcgaagaucgagcaggagaaccagaagcuccugcgggacgggcaguccgacgacgccguggagagcauccuggacgacgccuacaccagcccccagaacaagaaggccauccgccaggucaugcggguggugcacgacaucgucaaggcgugcgacggcaacgugcccgccaaguucgccaucgaguucgcccgcagccaggaggacgacccgaagcgcaccaccgcccgggugaaccagaugcagaagaucuacgaccagaucuccgacgaggucgugagccagggcgugaaggagcagcucuccgggaugaagucccugaaggaccgcuacuaccuguacuucaugcagggcgggcgggacgcguacacgggcgccaagcucaacaucgaccgccuguccgacuacgacaucgaccacaucaugccccagagcuucgucaaggacgacucccuggacaaccgggugcucguggcccgcgccgucaacaaccagaaguccgacaaggugcccgcccugcuguucgggaacaagguggucgcggaccucggcaucaccgugcgggagaugugggacaaguggcagaagcugggcaugaucagcaagcgcaagcugagcaaccuccugaccgaccccgacgcccugaccgaguaccgggcccagggguucauccgccggcagcucguggagaccagccaggucaucaagcugacggccaccauccugcaguccgaguucccggacagcaagaucaucgaggugcccgccaaguacaacuccaucgugcgcaagcaguucgaccucuacaagagccgggaggucaacgacuaccaccacgcgaucgacgccuaccuguccaccaucgugggcaacuaccuguaccagguguaccccaaccuccgccggauguucgucuacggggaguucaagaaguucagcuccaacgccgaggagagcgccuacgacguggugcgccgggucaaguccaugaacuuccuggacgaccugcuccgcggcacccacggcgacaacaucuacugccggagcacgggggagaucguguucaaccgcaacgacaucaucuccaagcugaagcaggcguacagcuucaagcagaugcuggugacccaggaggucuucaccaagaaguccgcccucuucgaccagaccguguacccgagccccgagcgggacuccaagaagcgcagcggccugaucccccgcaagaaggggauggacacggagaucuacggcggguacuccggcaacaaggacgccuacuucgugcuggccgaggccgucaaggagaagggccacacccuccagaucgugggggugcccauccgggcgcugaacacccugaagaacagcgccaacuacuccgagaagcuccuggagaucaucaagccgcaggucauguucaacaaggacaccggcaagcccaucaaggggaucaaggacgugaagauccugauggacaagauccccugccgccagcccgugcucgagggcgagagcuacuacaugcuggccagcuccaaguaccgguacagccugaagcagaucucccucagccagauguccaugaaguacauccuggacuacaucgacgacccgaacuucaacaagcacgagaugaucaacaucgaccagcaggacgagaaggagugccugcucagcgucuacgacgagauccuggagaagauggacaaguaccugccccucuucgacauccgcuccuuccggaagaagcugcacgacgggcgcgacgccuucaucgcccugcccguggcgagcgaggagaagaagcccggcaaggucgacgugauccggaaggugcucaagggccugcacgccaacgccgacaucacgaaccuggccgagcucggguucggcaccgccgcgcugggggcccuggucuccaccggcgggaucaagaucagcgacgacgccguguucaucuaccaguccccgaccggccucuucgagcgccgggugaaggucagcgaccugcugaaguga

SEQ ID NO: 2181 - RNA, 4287 nt, Artificial Sequence
  Cas9 variant
augaagaagauccugggccucgaccuggggaccaccagcaucggcuccgccuacgugcuggaggccgagaaguccgcggagcagacgaagaucgucuaccucgggacccgcaucauccugagcagcgccgacgccgagaacuucuccaagggccugagcugcucccccaccaccgaccggacguucaagcgcagcaugcggcgccggcuccagcgcuacaagcagcggcgcuccagccugauccagcaguucaagaagaucgggaucaucaccaacaccgagcagaucauccgggagccgaucuccgagacccacgagcugcuccgcauccggagcaaggccguguccgagcgcgugagccuggaggaguucgcccggauccugcucacgaucaacaagcgccggggcuacaaguccaaccgcaagaccagcaaguccaccgaggaggacggcaagcuggucgacgcgauggccgugaccaaggagcugaucaagcucaagaagacgcccgggcaguacauguucgagcgguucaagcgcggcaaguacgccgagaucgacuucuaccccuucgaccugaucaacgagcugaagcagaucugggaggugcaggggcagaaguaccccgacguccucaccgaggaccugcugagcucccuccugaagcagaagaccggcaaggccaaggagcugaucuacagcaagagcgaccucaacccggcggaggugcccaucgacuaccagaaggggaagaagcugcggaagaccauccugaacaaguacuucgccuacgagucccgcagccucgccgccacgaacaucauccccguggagcaggucaucaccgccaucguggcgaucugcaagcagaucaacaacuccagcggcuaccugggcgccaucggggaccggucccgcgugcuguacgccaacaaccagaccaucggccaguaccucuacgagcgcaucaaggccaacccccacgaccggauccgcggggaggucuucuaccggcaggacuaccuggacgaguucgaccgcaucugggagugccagcagaacuacuacccggccauccugaccaacgaccggaagcaguucauccgcaaccggaucaucuucuaccagcgcccccucaagagcaagaaguccgagcuggcguucugcgaguucgagagccgggagguggagcacaacggcaagaaguacacggagggccugcacguggcccccaaguccagccccgucuuccagcacuuccgccucuggcagcggcuggggcagaucgagguguccccgcugcgcaaguggaacaagcagagcaacgagcuguucgagcagcagaacgacaccgaccaggagcggauccugaacaccgaggccaagcagaagcuguucuccuaccucaaccugcuggaccaccucaccgacaacgagauccugaacauccugggcuacagccccgacaaguggaagaucaacuuccgcgagaucaucgggaaccggacgaacaacuccaugaugaaggccuucuucaacaugaaggagaugaccgacggcgagcagaucaacugggagaagaaccucaccaagaucaccaacgggcagagccugaucucccccgagcagaucguggaccugauccgccaguucuucgagcgggagggcaucacgaccagccugcucuacuucgaccccaccaccgacaacuuccgcgagcagucccacuacagccuguggcaccuccucuacagcuacgaggacgacaacuccccgacgggcaccaccagccugugcaagacccuggccaagcgguacgggaucccccacgagcucugcccccugcuggcgucccucacguucgagccccaguacggcagccuguccaccaaggccaugcgcaagauccugccguucaugcaggagaacggguacgacaaggccugcgagcucgccggcuaccgccacagcgccuggaccaccaaggaggagaacaccgagcggacgcugaagaacucccugccccuccugcgcaaggggagccugcggaaccccgucguggagaagauccucaaccagaugacccacgugaucaacacccacaucuccgaguacggcaaccccgacgagauccgcaucgagauggcgcgggacaugcaggccaacagcaagcagcgcaaggccaugaccacggccaucgcggaggccaccaagcggaacacccaguucaucgaggagauccagaaggaguucggcuucaacccguccaagaacgaccugaucaaguacaagcuguggaaggagcucgcgccccuggggagcaagacccuguacuccaacacguacauccccaaggaggagcuguucaccgccaaguucgagaucgagcacaucaucccccgcgcccuguucuacgacgacagcuucuccaacaagacccuggagcucaacagcgucaacaagcugaagggcaacaagaccgcccuggacuacauggacacgcucucccaggagcaggccaacgacuacaucauccggguggaggagcugaagaagaucggggccaucacccaggccaaguacaagaagcugcucauccgcgagaaggaccugggcgacgacuucaccaaccgggaccugaccaacacgcgcuacaucauccggcacgccgcggacaugcuccuccaggugaccccgagcaucguccacaccaacgggagcaucaccgccauccugcgccgggacugggagcuccuggacauccugaaggagcucaaccugcccacguacgaguccaucgaccgcaagaucagcgaccccaaggagaagcugaccgaguccguggagcggaaggacggccaggccaucaagaugaucaaggacuggagcaagcgcgacgaccaccggcaccacgccauggacgcccucaucaccgcgcugaccacgcgcaagcacguccaguaccugaacggcaaccgcggggccgaggagaccgacaaggugcagaagcuccagcagcugaaggcccugcggaagcagcucaucggcuccgacgggcacuucaucccgcccaugcacgacauccgcgugcaggccaaggaggcgcugagccgggucaucaucuccaccaaggccaagggcaaggugaccacgcccaacaccaacaucaucugcagccgcgacaagaccaccggccggaagaucuacgugaagcagacgacccugacgccccgcggggcccuccacaaggagaugcaguacggcugcaaccacuacuaccuggagaagcagaucccgaucggguccaagcugaccgaggaggagauccggcucgucagcucccccaagauccgcagcaugcuguccgagcggcugcaggccuacaacaacgaccccaagagcgccuucaccggccgcaacuccauggacaagaagccccucgaggacaagaacaagaagcugguguacaccgacaagaaggugaagcagaccauccuggcgaaccgguucgucaagcgcgaccgggugaacagcaagcucgaccuggacaaggugaucgacaccgggaucaagcgcauccuggagcggcgccucaagcaguacggcggcaaguacgagaccgccuucuccgaccuggagaacaacccgaucuggcugaacgaggagaaggggaucgccaucaagagcguccggauccgcggcaagaacaacacgaucaccauccggcagaccaacacgugccgcaucaaguacguggccaacgacaacaaccaccaccucgccguguacgcgcugcccgacggguccaucgaggacgacaucgucagcuucuucgacgccguggagcggagccgcaagggccugcccaucaucgacaagcacaagaaccagucccucggguggaaguuccuguucagcgugaagcagaacgaguacuuccugcucccccagcagggcgagaagaucgacaucgacaccggcgagaucuccaugcagaccaccuucagcccgaaggaccugucccccgaguacaucaugaaccccgacaacuacgccgagcuggcgccccacaucuuccgcguccagagcaucuccaagaccccgcaggggaaccgggacgugcgcaucuaccucuucaagcagcaguacaucagcggcucccagaaggacagccugcaccugaaggggaucacgcaccggcagaucuccagcgccaaggaccucgccggccuggugaagauccgcgucaaccaccuggggcggaucguggccgugggcgagaaguga

SEQ ID NO: 2182 - RNA, 4287 nt, Artificial Sequence
  Cas9 variant
augaagaagauccugggccucgaccuggggaccgccagcaucggcuccgccuacgugcuggaggcggagaaguccgccgaccagaccaagaucgucuaccucgggacgcgcaucauccuguccagcgccgacgccgagaacuucuccaagggccugagcugcucccccaccaccgaccggaccuucaagcgcagcaugcggcgccggcuccagcgcuacaagcagcggcgcuccagccugauccagcaguucaagaagaucgggaucaucacgaacaccgagcagaucauccgggagccgaucuccgagacccacgagcugcuccgcauccggagcaaggccguguccgagcgcgugagccuggaggaguucgcgcggauccugcucaccaucaacaagcgccggggcuacaaguccaaccgcaagacgagcaaguccaccgaggaggacggcaagcuggucgacgccauggccgugaccaaggagcugaucaagcucaagaagacccccgggcaguacauguucgagcgguucaagcgcggcaaguacgccgagaucgacuucuaccccuucgaccugaucaacgagcugaagcagaucugggaggugcaggggcagaaguaccccgacguccucacggaggaccugcugagcucccuccugaagcagaagaccggcaaggcgaaggagcugaucuacagcaagagcgaccucaacccggccgaggugcccaucgacuaccagaaggggaagaagcugcggaagaccauccugaacaaguacuucgccuacgagucccgcagccucgccgugaccaacaucauccccgucgagcaggccaucacggcgaucguggccaucugcaagcagaucaacaacuccagcggcuaccugggcgccaucggggaccggucccgcgugcuguacgccaacaaccagaccaucggccaguaccucuacgagcgcaucaaggccaacccccacgaccggauccgcggggaggucuucuaccggcaggacuaccuggacgaguucgaccgcaucugggagugccagcagaacuacuacccggcgauccugaccaacgaccggaagcaguacauccgcaaccggaucaucuucuaccagcgcccccucaagagcaagaaguccgagcuggccuucugcgaguucgagagccgggagguggagcacaacggcaagaaguacaccgagggccugcacguggcccccaaguccagccccgucuuccagcacuuccgccucuggcagcggcuggggcagaucgagguguccccgcugcgcaagugggacaagcagagcaacgagcuguucgagcagcagaacaacgccgaccgggagggcauccugaacacggaggccaagcagaagcuguucuccuaccucaaccugcuggaccaccucaccgacaacgagauccugaacauccugggguacagccccgacaaguggaagaucaacuuccgcgagaucaucggcaaccggaccaacaaccucaugaugaaggcguucuucuccaugaaggagaugaccgacggggagcagaucgacugggagaagaaccugacgaagaucaccaacggccagagccugaucucccccgagcagaucguggaccugauccgccaguucuucgagcgggagggcaucaccaccagccuccuguacuucgaccccgccacggacaacuuccgcgagcagucccacuacagccuguggcaccuccuguacagcuacgaggacgacaacuccccgaccgggaccaccagccugugcaagacgcucgccaagcgguacggcaucccccacgagcugugcccccugcucgccucccugaccuucgagcgccaguacgggagccuguccaccaaggccaugcgcaagcuccugcccuucaugcaggagaagcgguacgacgaggcgugcgagcuggccggcuaccgccacagcgccuggaucaccaaggaggagaacgccaagcggacgcucaagaacaagcugccgcugcuccgcaaggggucccugcggaaccccgucguggagaagauccugaaccagaugacccacgugaucaacacccacaucgcggaguacggcaaccccgacgagauccgcaucgagauggcccgggacaugcaggccaacagcaagcagcgcaaggccaugaccgccgcgaucaccgaggccacgaagcggaacacccaguucaucgaggagauccagaaggaguucggcuucaaccccuccaagaacgaccucaucaaguacaagcuguggaaggagcuggccccgcucgggaacaagacccuguacagcaacaucuacauccccaaggaggagcuguucaccgccaaguucgagaucgagcacaucaucccccgcgcccucuucuacgacgacuccuucagcaacaagacgcuggagcugaacuccgucaacaagcucaagggcaacaagaccgcgcuggacuaccuggacacccucgggcaggagaaggccaacgacuacauccugcggguggaggagcugaagaagaucggcgccaucacccaggccaaguacaagaagcuccugauccgcgagaaggaccugggggacgacuucacgaaccgggaccucaccaacacccgcuacaucauccggcacgccgcggacaugcugcuccaggugacccccagcaucguccacacgaacggcuccaucaccgccauccuccgccgggacuggggccugcuggacauccucaaggagcugaaccugccgaccuacgagagcaucgaccgcaagaucuccgaccccgaggagaagcucacccagagcguggaccggaaggacgggcaggccaucaagaugaucaaggacuggagcaagcgcgacgaccaccggcaccacgccauggacgcgcugaucacggcccugaccacccgcaagcacguccaguaccucaacggcaacuccggggccgaggagaccgacaaggcccagaagcuggagcagcugaaggcccuccgcaagcagcugaucggcagcgacggccacuucaucccgcccaugcacgacauccgggugcaggcgaaggaggcccugucccgcgugaucaucagcacgaaggucaaggggaaggugaccacccccaacaccaacaucaucugcucccgggacaagacgaccggccgcaagaucuacgugcggcagaccacccucacgccccgcggggcccugcaccuggacaccaaguacggcaucaaccgguacuaccaggagcgcgaggucagcaucggguccaagcucacccaggaggagauccggcuggugagcagcccccacauccagagcauccugcucgagcgccugcgggccuucgacaacaacccgaaguccgccuucaccggccgcaacagcguggacaagaagccccuggaggacaagaacaagaagcucgucuacacggacaagaaggugaagcagaccauccuggcgaaccgguucgugaagcgcgaccaggucaacuccaagcugaaccucgacaaggugaucgacaccggcaucaagcggauccuggaggggcgccugcagcaguacggcgggaaguacgagaccgccuucagcgaccucgagaacaaccccaucuggcugaacgaggagaagggcaucgccaucaaguccgugcggauccgcgggaagaacaacgccauccccauccaccagacggacacgugcccgaucgacuacgucgccaacgacaacaaccaccaccuggcgguguacgugcuccccgacggcaccaucgaggacgacaucgucaccuucuucgacgccguggagcggagccgccagggccugcccaucguggacaagaacaagaaccagucccugggguggaaguuccucuucagcaucaagcagaacgaguacuuccugcugccccagcaggccgagaagaucgacaucgacaccggcgagaucuccacccagaccaccuucagcccgaaggaccucagccccgaguacaucaugaaccccgacaacuacgccgagcuggcgucccacaucuuccgcguccagagcaucuccaagacgccccaggggaaccgggacgugcgcaucuaccuguucaagcagcaguacaucagcggcucccagaaggacagccuccaccugaaggggaucaccuaccggcagaucuccagcgccaaggaccuggccgagcucgugaagauccgcgucaaccaccugggccggaucguguccgugggcgagaaguga

SEQ ID NO: 2183 - RNA, 4287 nt, Artificial Sequence
  Cas9 variant
augaccaagaagauccugggccucgaccuggggaccacgagcaucggcugggccuacgugaucgaguccgacaaccccgacgagagcgagaucaagcagaucgggguccgcgugaacccgcugaccaccgacgagcagaccaacuucgagaagggcaagcccuucuccaucaacaaggagcggacgcucaagcgcggggcccggcgcaaccuggaccgguacaaggaccgccggaacaaccugaucgaggugcucaagaaggcgaacauccugagccaggacuccauccugaccgaggagggccagcacaccacccaccagacguggcagcuccgcgccaaggccgccgucgacaagaucgagaaggaggagcuggcccgggugcugcucgcgaucaacaagaagcgcggcuacaagagcucccggaaggccaagaacgaggacgaggggcaggccaucgacggcauggccguggcgaagcgccuguacgacgagcagaucacgugcgggcagcuggucuaccagcuccugcgggagggcaagaaguccauccccgacuucuaccgcuccgaccugcaggccgaguucgacaagguguggaacuuccagaagcaguucuaccccaagauccucaccgacgaguucuacaaggagcugaaggggaagggccagcgggccaccagcgcccuguucuacaagaccuacaacuucaacaccgccgagaacaagggcucccgcgaggagaagaagauccaggcguacaaguggcggagcgaggccaucucccagcagcucgagaaggaggagguggccuucguccugaccgagaucaacaacaaccugaacaacagcuccggguaccucggcgccaucagcgaccgcuccaaggagcuguacuucaacaagcagaccguggggcaguaccuguaccagcagcuccaggagaaccggcacgcccgccugaagaaccagguguucuaccggcaggacuaccuggacgaguucgaggcgaucuggaaggagcaggccaagcaccacacggagcucaccgaggagcugaaggccgagauccgcgacaucaucaucuucuaccagcgcaagcucaagagccagaagggccugaucuccuucugcgaguucgagagccgggagauccagaucgacggcaagaagaagaccaucgggcugcgcgucgcccccaagagcagcccccuguuccaggaguucaagaucuggcagaaccucaacaacgugcuggugcggaagaagggcagccgcaagcggaacgucaagcaggagauccaggggucccuguucgaggaggagaaggagaucuucguguucgaccucgagaccaaggagaagcuguucgaggagcugaaccucaagggcaaccugagcgccaacaaggugaucgagcugcucgggcacaagcccacggagugggagaucaacuacuccgcgcuggagggcaaccgcaccaaccaggcccuguacaacgccuaccucaagauccuggacaucgagggcuacgacgaggaccugcugaagcucagcgacaaggacgacaucaacgucgccgaccugaagacccccgccuccgagaucaagaacauggugcgggacaucuuccaggugcuggggaucagcaccgacauccucgaguucgacgcggagcuggacggcaaggacuucgagcagcaggccuccuaccagcuguggcaccuccuguacagcuacgagggggacgacucccagagcggcaacgagaagcuguacgagcuccuggagaagaaguucggguucaagaaggagcacucccagguccuggccaacgugacgcucagcgacgacuacggcaaccuguccagcaaggccaugcgcaagaucuacccguucaucaaggagaacaacuacuccaccgcgugcgagcuggccggcuaccggcacagcaagcacucccucaccaaggaggagaucgagaaccgcccccuggacgacaagcuggagcuccugaagaagaacagccugcggcagcccguggucgagaagauccucaaccagauggugaacgucgugaacagccugcuggagaagaaccgcaaggagaaccccgacuuccgguucgacgagauccgcaucgagcucgcccgggagcugaagaagaacgccaaggagcgcgccgagaugaccacgaacaucaacuccgcgaagaccgagaacgagaagaucuucaagcugcuccaggccgaguucgggcugaagaacccgacccggaacgacaucauccgcuaccggcuguacgaggagcucaagaacaacggcuacaaggaccuguacaccaacaaguacaucccccgcgagauccuguucagcaagcaggucgacaucgagcacaucaucccccagucccgccucuucgacgacagcuucuccaacaagacgaucguguaccgggagaccaaccuggacaaggggaaccagaccgccuucgacuacaucgacagcaaguacggcaacgagaagguggaggaguacauccugcgcaucgaggcccuccacgacgccuggaagaagaacaaggaggaggggaucuccaaggcgaaguaccagaagcugcugaagaaggagaccgagaucggcgacggcuucaucgagcgggaccuccgcgagagccaguacaucgccaagaaggccaaggagaugcuguucaagaucacgcgguccguggucagcaccuccgggagcaucaccgacaagcugcgcgaggacuggggccucaucaacaucaugaaggagcugaaccugcccaaguaccggucccucgggcugaccgagaugcaggagcgcaaguucggccagaagguggaggugaucaacgacuggaccaagcggaacgaccaccgccaccacgccauggacgcccugacggucgcguucaccaagcacaaccacauccaguaccucaacuaccugaacgcccggaagaacgagaaccacaagcugcacaacaacaucaucgccaucgagaaccucgagaccgagaccaugaucgacaacaacggcagcaagcgccggguguucaaggccccgaugcccaacuuccgccagguggcgaaggagcaccuggagaacguccugaucucccacaaggccaagaacaagguggugacgaagaacaagaacaagaucgccgggaaggucgccgcccaggagacccucaccccgcggggccagcugcacaaggagaccguguacgggaaguaccaguacuacgugaacaaggaggagaagaucggcacgaaguucgacgaggagaccaucaacaaggucagcaacccccaguaccgcaagcugcuccuggagcggcuguccgcgaacgggaacgacccgaagaaggccuucagcggcaagaacgcccucagcaagaaccccaucuaccugaacgagaccaagaccgagacggugcccgagguggucaagcugaccuggcucgaggaggacuacuccauccgcaaggacaucacccccgacaacuucaaggacgagaaguccaucgacaagauccuggacgagggcgugaagcggauccugaagaagcgccuccggaagaacgacaacgacccgaagaaggccuucagcgaccuggacaagaaccccaucuggcugaacgaggagaaggggaucagcaucaagcgcgugaccaucuccggcgucaacaacgccgagccccuccacuacaagaaggaccacuucgggaacgacauccuggacgagaagggcgacaagauccccguggacuucgugagcacggggaacaaccaccacgucgcgguguaccgcgacgagaagggcaaccugcaggagaacaucguguccuucuucgaggccgucauccgggugaaccagggccucccgaucaucgacaaggccuacaaccagcaccugggguggcaguuccuguucaccaugaagcagaacgagauguucguguuccccaacgagaaguccggcuucaacccccaggagaucgaccuccuggacccgagcaacaagaagaagaucagccccaaccuguuccgcguccagaagauguccaaggugaucuacgggaacagccccgugcgggaguacgucuuccgccaccaccucgagaccaacguggacgagaagaaggagcugaaggacaucaccuucaagaacaucaagucccugggcuacuucgaggacaucgugaagguccggaucaaccaccucggggacaucgugagcgugggcgaguacuga

SEQ ID NO: 2184 - RNA, 4293 nt, Artificial Sequence
  Cas9 variant
augaagcacauccugggccucgaccuggggaccaacagcaucggcugggccguggucaaggaggcccagaacgacaacgagcaguccgagaucguggacguggggguccgcgugaacccccugaccacggacgagaagaccaacuucgagaagggcaagccgaucagcaccaacgcggaccggacccucaagcgcuccgcccggcgcaaccugcagcgguacaagcugcgccggaaggagcucaucgagcugcugaaggagcaccagcucaucagcacggacaccauccugaccgagaacgggaagggcaccacguuccagacccuggagcuccgcgccaaguccgccaaggagaagaucagccuggaggagcuggcccggguguuccucaccaucaacaagaagcgcggcuacaaguccagccggaaggcgaagaacgaggacgaggggcagcugaucgacggcauggagaucgccaagcgccuguacgaggagaaccucaccacggggcagcugucccugcagcuccugaaggagggcaagaagucccugcccgacuacuaccggagcgaccuccaguucgagcuggacaaggucuggaacuuccagaagcaguuccacagcgacauccugaccgacgaguucuacgcccagcucaaggggaagggccagcgcgccaccuccgcgcuguuccuggccaaguaccagaucuacaccgccgagaacaagggcagccgggaggacaagaagcuccaggccuaccaguggcgcguggacgcccuguccaaggagcugacgcgggagcagcucgcguucgugaucaccgagaucaacaacaaccugaacaacagcuccggguaccugggcgccaucagcgaccgcuccaaggagcucuacuucaacaacgagaccgucggggaguaccuguggaagcagaucgccgccaacccccacaccagccugaagaaccagguguucuaccggcaggacuaccucgacgaguucgagcagaucuggaagacgcagagcgccuucuaccccgagauccugaccgacgagcugaagaaggagcuccgcgacguggucaucuucuaccagcggaagcugaagucccagaagucccuggugagcuucugcgaguucgagaacaaggagaucgagaucaagaaggaggacggcaccagcaccaagaaggugaucggccucaaggucgcgccgaaguccagcccccuguuccaggaguucaagaucuggcagaaccugaacaacgugcucauccgcaagaagggguccaagacgaagaagguggccaagaaccagcaggccguccuguucgaggaggagaagaccaucagcgagcuggaccuggaggccaagcaggcccucuucaacgagcugaaccugaagggcaaccucaaggcggacuacugccuggagauccugggguacucccccaaggagugggagaugaacuacagcgugcucgagggcaaccgcaccaacaaggcccuguacgaggccuaccugaagaucaccgaccucgagggguacgacgccaagaaccaccugaaggugaagcugaacaaggacgaggucgagcucgacgaccugaaggugcccgccuccgagaucaaggacauggugcaggcgaucuucaaggaggccggcaucaacacggacauccugcacuucaacgccgagcucgacggcaaggacuucgagaaccaggccagcuaccagcuguggcaccuccuguacuccuacgagggggacgacagcaaguccggcaacgagcugcuguacaagcuccuggagaccaaguucggguucaagaaggaguacgcgcagauccuggccaacgucagccucuccgacgacuacggcagccuguccaccaaggccaugcggaagauccacccguacaucaaggagaacaaguucagcaccgccugcgagcuggccggguaccgccacagcaagcacucccucacgaaggaggagaacgacaaccgggugcugaaggacagccuggagguccucaagaagaacucccugcgccagcccgugguggagaagauccugaaccagaugaucaaccucgucaacgcgcugcugaagaaguaccggaccgagaaccccaacuucaaguucgacgagauccgcaucgagcucgcccgggagcugaagaagaacgccgaggagcgcgccaacaugaccgccaacaucaacaaggcgaagaccgagcacgagaagaucaucaagauccugaagaacgaguucggccuccccaacccgacgcggaacgacaucauccgcuaccggcuguacgaggagcugaaggccaacggcuacaaggaccucuacaccaacaucaagaucccccaggagaagcuguucaccaaggagaucgacaucgagcacaucauccccaagagccgcguguucgacgacuccuucagcaacaagacccuguccuuccggaagaccaaccucgacaagggggagcgcacggccuucgacuacauggagagcaaguucggcgccgacaagcuggaggaguacguggcccgggucgaggaccuguacaagaacaacaucaucuccaaggcgaaguaccagaagcuccugaagaaggagagcgagaucggggacggcuucguggagcgcgaccugcgggagacccaguacaucgccaagaaggccaaggagauccuccugcagaucacccccaacgugcuguccaccagcgggggcaucacggaccgccuccgggaggacugggaccugaucaacgucaugaaggagcugaaccucccgaaguaccgcgcccugggccugacccagauggaggaccgcaaguacgggcagcaggucgaggugaucaccgacuggaccaagcggaacgaccaccgccaccacgcgauggacgcccucacgguggccuucaccaagcacaaccacauccaguaccugaacuaccugaacgcccggaagaacgagaagcacaaggagcacuccaacaucaugggcauccagcagcucgagaccaucaaggugaccgacaagaacgggaacgagaagcgcguguucaaggcccccaugcccaacuuccggcaggucacgaaggcguuccuggagaacauccugaucagccacaaggccaagaacaagguggugaccaagaacaagaacaaggucgccggcuccaacaaggugcaggaggugcucacgccccgcggccagcugcacaaggagaccgucuacgggaaguaccaguacuacgugcagaaggaggagaagaucggcgccaaguucgaccuggagaccaucaagaagguggccaacccgcucuaccagagccugcugaagaagcggcucgaggagaacgggggcgaccccaagaaggcguucaccgggaagaacucccuggccaagaaccccaucuaccuggacgacacccagaccgagcagcuccccgagaaggucaagcugguguggcuggagaacagcuucagcauccgcaaggacaucacgccggagaacuucaaggacgagaagcucaucgacaagauccuggacgagggcgugaagcggauccugaaggagcgccuccaguccuucggcaacgacgccaagaaggccuucagcgaccuggacaagaaccccaucuggcugaacaaggagaaggggaucaccaucaagcgggucaccaucuccggcguggccaacgcggagccccuccacaccaagaaggaccaccuggggaaggagauccuggacaaggagggcaagcccaucccgguggacuucaucagcacgggguccaaccaccacgucgccguguaccgcgacgagaagggcaaccuccaggagaagguggucagcguguucgaggccgugguccgggccaaccagggccugcccaucaucgacaagaccuacaaccagcaccuggggugggaguuccucuucaccaugaagcagaacgagauguucguguuccccaacgaguccaccggcuucaacccgaacgacaucgaccugcuggaccccaagaacaagcgcaucaucagccccaaccucuuccgggugcagaaguucuccaagcugcaguacgggaacagcuucguccgcgaguucguguuccggcaccaccuggagacgaccguggaggaccgcaaggagcugcagggcaucaccuacaagcagaugaagaacuccaccuucuucaacgacaucaucaagguccggaucaaccaccucggggacaucgugagcaucggcgaguacuga

SEQ ID NO: 2185 - RNA, 4293 nt, Artificial Sequence
  Cas9 variant
augaagcacauccugggccucgaccuggggaccaacagcaucggcugggccguggucaaggaggcccagaacgacaacgagcaguccgagaucguggacguggggguccgcgugaacccccugaccacggacgagaagaccaacuucgagaagggcaagccgaucagcaccaacgcggaccggacccucaagcgcuccgcccggcgcaaccugcagcgguacaagcugcgccggaaggagcucaucgagcugcugaaggagcaccagcucaucagcacggacaccauccugaccgagaacgggaagggcaccacguuccagacccuggagcuccgcgccaaguccgccaaggagaagaucagccuggaggagcuggcccggguguuccucaccaucaacaagaagcgcggcuacaaguccagccggaaggcgaagaacgaggacgaggggcagcugaucgacggcauggagaucgccaagcgccuguacgaggagaaccucaccacggggcagcugucccugcagcuccugaaggagggcaagaagucccugcccgacuacuaccggagcgaccuccaguucgagcuggacaaggucuggaacuuccagaagcaguuccacagccacauccugaccgacgaguucuacgcccagcucaaggggaagggccagcgcgccaccuccgcgcuguuccuggccaaguaccagaucuacaccgccgagaacaagggcagccgggaggacaagaagcuccaggccuaccaguggcgcguggacgcccuguccaaggagcugacgcgggagcagcucgcguucgugaucaccgagaucaacaacaaccugaacaacagcuccggguaccugggcgccaucagcgaccgcuccaaggagcucuacuucaacaacgagaccgucggggaguaccuguggaagcagaucgccgccaacccccacaccagccugaagaaccagguguucuaccggcaggacuaccucgacgaguucgagcagaucuggaagacgcagagcgccuucuaccccgagauccugaccgacgagcugaagaaggagcuccgcgacguggucaucuucuaccagcggaagcugaagucccagaagucccuggugagcuucugcgaguucgagaacaaggagaucgagaucaagaaggaggacggcaccagcaccaagaaggugaucggccucaaggucgcgccgaaguccagcccccuguuccaggaguucaagaucuggcagaaccugaacaacgugcucauccgcaagaagggguccaagacgaagaagguggacaagaaccagcaggccguccuguucgaggaggagaagaccaucuucgagcuggaccuggaggccaagcaggcccucuucaacgagcugaaccugaagggcaaccucaaggccuacuacugccuggagauccugggguacagccccaaggagugggagaugaacuacuccgugcucgagggcaaccgcaccaacaaggcgcuguacgaggccuaccugaagaucaccgaccucgagggguacgacgccaagaaccaccugaaggugaagcugaacaaggacgaggucgagcucgacgaccugaaggugcccgccagcgagaucaaggacauggugcaggccaucuucaaggaggcgggcaucaacacggacauccugcacuucaacgccgagcucgacggcaaggacuucgagaaccaggccuccuaccagcuguggcaccuccuguacagcuacgagggggacgacuccaagagcggcaacgagcugcuguacaagcuccuggagaccaaguucggguucaagaaggaguacgcccagauccuggcgaacgucucccucagcgacgacuacggcucccugagcaccaaggccaugcggaagauccacccguacaucaaggagaacaaguucuccaccgccugcgagcuggccggguaccgccacagcaagcacagccucacgaaggaggagaacgacaaccgggugcugaaggacucccuggagguccucaagaagaacagccugcgccagcccgugguggagaagauccugaaccagaugaucaaccucgucaacgcccugcugaagaaguaccggaccgagaaccccaacuucaaguucgacgagauccgcaucgagcucgcgcgggagcugaagaagaacgccgaggagcgcgccaacaugaccgugaacaucaacaaggccaagaccgagcacgagaagaucaucaagauccugaagaacgaguucggccuccccaacccgacgcggaacgacaucauccgcuaccggcuguacgaggagcugaaggccaacggcuacaaggaccucuacaccaacgaguacaucgagaagcaggaccuguucaccaagaacaucgacaucgagcacaucauccccaagucccgcguguucgacgacagcuucuccaacaagacccugagcuuccggaagaccaaccucgacaagggggagcgcacggcguucgacuacaucgaguccaaguucggcgccgacaagcuggaggaguacgucgcccggguggaggaccuguacaagaacaacaucaucagcaaggccaaguaccagaagcuccugaagaaggaguccgagaucggggacggcuucguggagcgcgaccugcgggagacccaguacaucgccaagaaggcgaaggagauccuccugcagaucacccccaacguccugagcaccuccgggggcaucacggaccgccuccgggaggacugggaccugaucaacgugaugaaggagcugaaccuccccaaguaccgcgcccugggccugacccagauggaggaccgcaaguacgggcagcaggucgaggugaucaucgacuggaccaagcggaacgaccaccgccaccacgccauggacgcccucaccguggcguucacgaagcacaaccacauccaguaccugaacuaccugaacgcccggaagaacgagaagcaccgcgagcacagcaacaucaugggcauccagcagcucgagaccaucaaggugaccgacaagaacgggaacgagaagcgggucuucaaggccccgaugcccaacuuccgccaggugaccaaggccuuccuggagaacgugcugaucucccacaaggccaagaacaaggucgugacgaagaacaagaacaagguggcgggcagcaacaagguccaggaggugcucacgccccggggccagcugcacaaggagaccguguacgggaaguaccaguacuacguccagaaggaggagaagaucggcgggaaguucgaccuggagaccaucaagaagguggccaacccccucuaccagucccugcugaagaagcgccucgaggagaacggcggggacccgaagaaggccuucaccggcaagaacagccuggccaagaaccccaucuaccuggacgacgcccagaccgagcagcuccccgagaaggugaagcuggucuggcuggagaacuccuucagcauccggaaggacaucacccccgagaacuucaaggacgagaagcucaucgacaagauccuggacgagggcgugaagcgcauccugaaggagcggcuccagagcuucgggaacgacgcgaagaaggccuucuccgaccuggacaagaacccgaucuggcugaacaaggagaagggcaucgccaucaagcgcguggccaucagcggggucgccaacgcggagccccuccacaccaagaaggaccaccugggcaaggagauccuggacaaggaggggaaguccauccccguggacuucaucagcacgggcaacaaccaccacguggccgucuaccgggacgagaagggcaaccuccaggagaaggugguguccgucuucgaggccguggugcgcgccaaccaggggcugcccaucaucgacaagaccuacaaccagcaccugggcugggaguuccucuucaccaugaagcagaacgagauguucgucuucagcaacgaguccaccggguucaacccgaacgacaucgaccugcuggaccccaagaacaagaagaucaucagccccaaccucuuccgggugcagaaguucuccaagcugcaguacggcaacagcuucgugcgcgaguucgucuuccggcaccaccuggagacgaccguggaggaccgcaaggagcugcaggggaucaccuacaagcagaugaagaacuccgcguucuucaacgacaucaucaaggugcggaucaaccaccucggcggcaucgucagcgugggggaguacuga

SEQ ID NO: 2186 - RNA, 4293 nt, Artificial Sequence
  Cas9 variant
augaaggacauccugggccucgaccuggggaccaacagcaucggcugggccguggucaaggaggcccagaacgacaacgagaccuccgagaucguggaccugggggugcgcgucaacccccucacgaccgacgagaagaccaacuucgagaagggcaagccgaucagcaccaacgcggaccggacgcugaagcgcuccgcccggcgcaaccugcagcgguacaagcuccgccggaaggagcugaucgagcugcucaaggagcaccagcugaucagcaccgacaccauccugaccgagaacgggaagggcacguccuuccagacccucgagcugcgcgccaagagcgccaaggagaagaucucccuggaggagcucgcccggguguuccugaccaucaacaagaagcgcggcuacaagagcucccggaaggcgaagaacgaggacgaggggcagcugaucgacggcauggagaucgccaagcgccucuacgaggagaaccugaccacggggcagcugagccuccagcugcugaaggagggcaagaagucccuccccgacuacuaccggagcgaccugcaguucgagcuggacaagguguggaacuuccagaagcaguuccacucccacauccucaccgacgaguucuacgcccagcugaaggggaagggccagcgcgccaccagcgcgcuguuccucgccaaguaccagaucuacaccgccgagaacaagggcucccgggaggacaagaagcugcaggccuaccaguggcgcgucgacgcccugagcaaggagcucacgcgggagcagcuggcguucgugaucaccgagaucaacaacaaccugaacaacuccagcggguaccucggcgccaucuccgaccgcagcaaggagcuguacuucaacaacgagaccgugggggaguaccuguggaagcagaucgccgccaacccccacaccagccucaagaaccaggucuucuaccggcaggacuaccuggacgaguucgagcagaucuggaacacgcaggcccaguucuacccccagauccugaccgacgagcucaagaaggagcugcgcgacguggugaucuucuaccagcggaagcugaagucccagaagucccucgucuccuucugcgaguucgagaacaaggagaucgagaucaagaaggaggacggcaccagcaccaagaaggugaucggccugaagguggcgccgaaguccagcccccuguuccaggaguucaagaucuggcagaaccucaacaacguccugauccgcaagaagggguccaagacgaagaaggccgccaagaaccagcaggccgugcuguucgaggaggagaagaccaucagcgagcuggaccucgaggccaagcaggcgcuguucaacgagcugaaccucaagggcaaccugaaggccgacuacugccuggagauccucggguacucccccaaggagugggagaugaacuacagcgugcuggagggcaaccgcaccaacaaggcccuguacgaggccuaccucaagaucaccgaccuggagggguacgacgccaagaaccaccugaaggucaagcucaacaaggacgagguggagcuggacgaccugaaggugcccgcguccgagaucaaggacaugguccaggccaucuucaaggaggccggcaucaacacggacauccuccacuucaacgccgagcuggacggcaaggacuucgagaaccaggcgagcuaccagcuguggcaccuccuguacuccuacgagggggacgacagcaaguccggcaacgagcugcucuacaagcugcuggagaccaaguucggguucaagaaggaguacgcccagauccucgccaacgugagccuguccgacgacuacggcagccuguccaccaaggccaugcggaagauccacccguacaucaaggagaacaaguucagcaccgccugcgagcucgcgggguaccgccacagcaagcacucccugacgaaggaggagaacgacaaccgggugcugaaggacagccucgagguccugaagaagaacucccugcgccagcccguggucgagaagauccucaaccagaugaucaaccuggugaacgcccugcucaagaaguaccggaccgagaaccccaacuucaaguucgacgagauccgcaucgagcuggcccgggagcugaagaagaacgccgaggagcgcgccaacaugaccgcgaacaucaacaaggccaagaccgagcacgagaagaucaucaagauccucaagaacgaguucggccugcccaacccgacgcggaacgacaucauccgcuaccggcuguacgaggagcucaaggccaacggcuacaaggaccuguacaccaacaucaagaucccccaggagaagcuguucaccaaggagaucgacaucgagcacaucauccccaagagccgcguguucgacgacuccuucagcaacaagacccucuccuuccggaagaccaaccuggacaagggggagcgcacggccuucgacuacauggagagcaaguucggcgccgacaagcuggaggaguacgucgcgcggguggaggaccucuacaagaacaacaucaucuccaaggccaaguaccagaagcugcugaagaaggagagcgagaucggggacggcuucguggagcgcgaccuccgggagacccaguacaucgccaagaaggccaaggagauccugcugcagaucacccccaacguccucuccaccagcgggggcaucacggaccgccugcgggaggacugggaccugaucaacgugaugaaggagcucaaccugccgaaguaccgcgcgcugggccucaccgagauggaggaccgcaaguacgggcagcaggucgaggugaucaucgacuggaccaagcggaacgaccaccgccaccacgccauggacgcccugaccguggccuucacgaagcacaaccacauccaguaccugaacuaccucaacgcccggaagaacgagaagcacaaggagcacuccaacaucaugggcauccagcagcuggagaccaucaaggugaccgacaagaacgggaacgagaagcgcgucuucaaggcgcccaugcccaacuuccgccaggugaccaaggccuuccuggagaacauccucaucagccacaaggccaagaacaagguggucacgaagaacaagaacaagguggccggcuccaacaaggugcaggagguccugacgccccggggccagcugcacaaggagaccguguacgggaaguaccaguacuacgugcagaaggaggagaagaucggcgggaaguucgaccucgagaccaucaagaaggucgccaacccgcuguaccagagccugcucaagaagcggcuggaggagaacggcggggaccccaagaaggcguucaccggcaaguacucccuggccaagaaccccaucuaccucgacgacgcccagaccgagcagcugcccgagaaggugaagcugguguggcucgagaacagcuucagcauccgcaaggacaucaccccggagaacuucaaggacgagaagcugaucgacaagauccuggacgagggcgucaagcggauccucaaggagcgccugcaguccuucgggaacgacgccaagaaggccuucagcgaccuggacaagaaccccaucuggcucaacaaggagaagggcaucaccaucaagcgggugacgaucuccgggguggcgaacgccgagccccugcacaccaagaaggaccaccugggcaaggagauccucgacaaggaggggaagcccaucccggucgacuucaucagcaccggcuccaaccaccacguggccguguaccgcgacgagaagggcaaccugcaggagaaggucgugagcguguucgaggccgucgugcgggcgaaccaggggcugcccaucaucgacaagaccuacaaccagcaccucggcugggaguuccuguucacgaugaagcagaacgagauguucguguuccccaacgaguccaccggguucaacccgaacgacaucgaccugcucgaccccaagaacaagcgcaucaucagccccaaccuguuccggguccagaccaucuccguggugaaguacggcaacgccaucguccgcgacuucaaguuccggcaccaccuggagaccacgguggaggacaagaaggagcugcaggggaagaccuaccagcagaucaagagccucagcccccugaacgacaucaucaaggugcgcaucaaccaccugggcgacaucgucagcgugggcgaguacuga

SEQ ID NO: 2187 - RNA, 4293 nt, Artificial Sequence
  Cas9 variant
augaagcacauccugggccucgaccuggggaccaacagcaucggcugggccuacgugaaggaggccgagaacgacaccgagacguccgagaucgucgaccugggggugcgcgugaacccccucaccaccgacgagaagaccaacuucgagaagggcaagccgaucagcacgaacgcggaccggacccugaagcgcuccgcccggcgcaaccugcagcgguacaagcuccgccggaaggagcugaucgagcugcucaaggagcaccagcugaucagcgagaacaccauccugaccgagaacgggaagggcacgaccuuccagacccucgagcugcgcgccaaguccgccaaggagaagaucagccugggcgagcucgcccgggucuuccugaccaucaacaagaagcgcggguacaaguccagccggaaggcgaagaacgaggacgagggccagcugaucgacgggauggagaucgccaagcgccucuacgaggagaaccugacgaccggccagcugucccuccagcugcugaaggaggggaagaagucccuccccgacuacuaccgguccgaccugcaguucgagcuggacaagguguggaacuuccagaagcaguuccacagcgacauccucaccgacgaguucuacgcccagcugaagggcaagggccagcgcgccaccuccgcgcuguuccucgccaaguaccagaucuacacggccgagaacaaggggagccgggaggacaagaagcugcaggccuaccaguggcgcguggacgcccuguccaaggagcucacccgggagcagcuggcguucgucaucaccgagaucaacaacaaccugaacaacagcuccggcuaccucggggccaucagcgaccgcuccaaggagcuguacuucaacaacgagaccgugggcgaguaccuguggaagcagaucgccgccaacccccacacgagccucaagaaccagguguucuaccggcaggacuaccuggacgaguucgagcagaucuggaacacccaggcccaguucuacccccagauccugaccgacgagcucaagaaggagcugcgcgacgucgugaucuucuaccagcggaagcugaagucccagaagucccucgugagcuucugcgaguucgagaacaaggagaucgagaucaagaaggaggacggcaccuccacgaagaaggucaucgggcugaagguggcgcccaagagcagcccccuguuccaggaguucaagaucuggcagaaccucaacaacgugcugauccgcaagaagggcagcaagaccaagaaggccgccaagaaccagcaggccguccuguucgaggaggagaagaccaucuccgagcuggaccucgaggccaagcaggcgcuguucaacgagcugaaccucaaggggaaccugaaggccgacuacugccuggagauccucggcuacagccccaaggagugggagaugaacuacuccgugcuggaggggaaccgcaccaacaaggcccuguacgaggccuaccucaagaucacggaccuggagggcuacgacgccaagaaccaccugaaggugaagcucaacaaggacgaggucgagcuggacgaccugaaggugcccgcgagcgagaucaaggagauggugcaggccaucuucaaggaggccggcaucaacaccgacauccuccacuucaacgccgagcuggacgggaaggacuucgagaaccaggcguccuaccagcuguggcaccuccuguacagcuacgagggcgacgacuccaagagcgggaacgagcugcucuacaagcugcuggagaccaaguucggcuucaagaaggaguacgcccagauccucgccaacgucucccugagcgacgacuacgggaaccuguccaccaaggccaugcggaagaucuacccguacaucaaggagaacaaguucagcacggccugcgagcucgcgggcuaccgccacuccaagcacagccugaccaaggaggagaacgacaaccgggugcugaaggacagccucgaggugcugaagaagaacucccugcgccagcccgucguggagaagauccucaaccagaugaucaaccuggucaacgcccugcucaagaaguaccggaccgagaaccccaacuucaaguucgacgagauccgcaucgagcuggcccgggagcugaagaagaacgccgaggagcgcgccaacaugaccgcgaacaucaacaaggccaagacggagcacgagaagaucaucaagauccucaagaacgaguucggccugcccaacccgacccggaacgacaucauccgcuaccggcuguacgaggagcucaaggccaacggguacaaggaccuguacaccaacaucaagaucccccaggagaagcuguucaccaaggagaucgacaucgagcacaucauccccaagagccgcguguucgacgacuccuucagcaacaagacccucuccuuccggaagacgaaccuggacaagggcgagcgcaccgccuucgacuacauggagagcaaguucggggccgacaagcuggaggaguacguggcgcgggucgaggaccucuacaagaacaacaucaucuccaaggccaaguaccagaagcugcugaagaaggagagcgagaucggcgacggguucguggagcgcgaccuccgggagacccaguacaucgccaagaaggccaaggagauccugcugcagaucacccgcaacgugcucuccacgagcggcggcaucaccgaccggcugcgcgaggacugggaccuggucaacgugaugaaggagcucaaccugcccaaguaccgcgcgcuggggcucaccgagauggaggaccggaaguacggccagcaggucgaggugaucaucgacuggaccaagcgcaacgaccaccggcaccacgccauggacgcccugacgguggccuucaccaagcacaaccacauccaguaccugaacuaccucaacgcccgcaagaacgagaagcaccgggagcacuccaacaucauggggauccagcagcuggagaccaucaaggugaccgacaagaacggcaacgagaagcgcgucuucaaggcgccgaugcccaacuuccgccaggugacgaaggccuuccuggagaacgugcucaucagccacaaggccaagaacaaggucgugaccaagaacaagaacaagguggccggcuccaacaagguccaggaggugcugaccccgcgggggcagcugcacaaggagaccguguacggcaaguaccaguacuacguccagaaggaggagaagaucgggggcaaguucgaccucgagacgaucaagaagguggccaacccccuguaccagagccugcucaagaagcggcuggaggagaacgggggcgacccgaagaaggcguucaccggcaagaacucccuggccaagaaccccaucuaccucgacgacgcccagaccgagcagcugcccgagaaggugaagcuggucuggcucgagaacagcuucuccauccgcaaggacaucacccccgagaacuucaaggacgagaagcugaucgacaagauccuggacgagggggugaagcggauccucaaggagcgccugcagagcuucggcaacgacgccaagaaggccuucagcgaccuggacaagaacccgaucuggcucaacaaggagaaggggaucacgaucaagcgggugaccaucuccggcgucgcgaacgccgagccccugcacaccaagaaggaccaccuggggaaggagauccucgacaaggagggcaagcccauccccguggacuucaucagcaccggcuccaaccaccacguggccgucuaccgcgacgagaaggggaaccugcaggagaagguggugagcgucuucgaggccguggugcgggcgaaccagggccugccgaucaucgacaagacguacaacgagcaccucgggugggaguuccuguucaccaugaagcagaacgagauguucgucuuccccaacgaguccaccggcuucaaccccaacgacaucgaccugcucgacccgaagaacaagcgcaucaucagccccaaccuguuccgggugcagaccaucuccguggucaaguacgggaacgccaucgugcgcgacuucaaguuccggcaccaccuggagacgaccguggaggacaagaaggagcugcagggcaagaccuaccagcagaucaagagccucagcccccugaacgacaucaucaagguccgcaucaaccaccugggcgacaucgugagcgugggggaguacuga

SEQ ID NO: 2188 - RNA, 4293 nt, Artificial Sequence
  Cas9 variant
auggcccagaaguacauccugggccucgaccuggggaccaacagcaucggcugggccguggucaaggaggcggagaacgacaacgagcaguccgagaucguggacguggggguccgcgugaacccccugaccacggacgagaagaccaacuucgagaagggcaagccgaucagcaccaacgccgaccggacccucaagcgcggggcccggcgcaaccugcagcgguacaagcugcgccggaaggagcucaucaagauccugaaggagcaccagcugaucuccgacgacacgauccucgccgagaacggcaagggcaccaccuaccagacccugaagcugcgcgccaagagcuccaaggagaagaucagccucgaggagcuggcgcggguguuccugacgaucaacaagaagcgcggguacaaguccagccggaagaccaagaacgaggacgagggccagcucaucgacgggauggagaucgccaagcgccuguacgaggagaaccugaccaccggccagcucucccugcagcugcucaaggaggggaagaagucccugcccgacuacuaccggagcgaccuggagcucgagcuggacaaggucuggaacuuccagaagcaguuccacagcgacauccugacggacgaguucuacacccagcucaagggcaagggccagcgcgccaccuccgcccuguuccuggagaaguaccagaucuacaccguggagaacaaggggaaccgggaggagaagaaccuccaggcguaccaguggcgcguggacgcccugagcaaggagcugacgcgggaggagcucgccuucgucaucaccgagaucaacaacaaccugaacaacuccagcggcuaccugggggccaucuccgaccgcagcaaggagcucuacuucaacaacgagaccgugggcgaguaccuguggaagcagaucgccgcgaacccccacaccucccugaagaaccagguguucuaccggcaggacuaccucgacgaguucgagcgcaucuggaacacgcaggcccaguucuacccccagauccugaccgagagccugaagaaggagcuccgggacgucgugaucuucuaccagcgcaagcucaagagccagaagucccuggugagcuucugcgaguucgagaacaaggagaucgagaucaagaacgaggacggcaccaccacgaagaaggucaucgggcucaagguggccccgaaguccagcccccuguuccaggaguucaagaucuggcagaaccugaacaacgugcucauccgcaagaagggcuccaagaccgagaaggucgccaagaaccagcaggucgugcuguucgaggaggagaagaccaucagcgagcuggaccuggaggccaagcaggcgcuguucaacgagcugaaccugaaggggaaccucaaggccgacuacugccuggagauccugggcuacuccagcaaggagugggagaugaacuacuccgugcucgaggggaaccggaccaacaaggcccuguacgaggccuaccugaagaucacggaccucgagggcuacgacgccaagaacuaccugaaggucaagagcaacaaggacgagguggagcuggacgaccucaaggugcccgcguccgagaucaaggagauggugcaggccaucuucaaggaggccggcaucaacaccgacauccugcacuucgacgccgagcuggacgggaaggacuucgagaaccagggcagcuacaagcucuggcaccuccuguacuccuacgagggggacgacagcaaguccggcaacgagcugcuguacaagcugcucgagaccaaguucgggcugaagaaggaguacgcccagauccuggcgaacaucagccucuccgacgacuacggcaaccugagcaccaaggccaugcgcaagauccaccccuacaucaaggagaacaaguucuccacggccugcgagcuggccggcuaccggcacagcaagcacagccucaccaaggaggagaacgagaagcgcguccugaaggacgggcuggaggugcucaagaagaacucccugcggcagccgguggucgagaagauccugaaccagaugaucaaccucgugaacgcgcugcugaagaaguaccgcaccgagaaccccaacuucaaguucgacgagauccggaucgagcucgcccgcgagcugaagaagaacgccgaggagcgggccaacaugaccgccaacaucaacaaggcgaagacggagcacgagaagaucgacaagauccucaagagcgaguucggccugcccaaccccacccgcaacgacaucauccgguaccgccuguacgaggagcugaaggccaacggguacaaggaccucuacaccaaccgguacaucuccagcgagaagcuguucuccaaggagaucgacaucgagcacaucauccccaagagccgcguguucgacgacuccuucagcaacaagaccaucgucuaccggaccgacaaccuggacaagggcgagcagacggccuacgacuacaucgaguccaaguucggggccgagaagcucaaggaguacaugacccgcgugaaggaccuguaccagaagaagaucaucagcaaggccaaguaccagaagcugcucaagaaggaguccgagaucggcgacggcuucguggagcgggaccugcgcgagacccaguacaucgcgaagaaggccaaggagauccugcuccagaucacccacaacguccugagcacguccgggggcaucaccgaccggcugcgcaaggacugggggcucgugaacgugaugaaggagcugaaccugccgaaguaccgcgcccucggccugaccaagauggaggaccggaaguacggccagcaggucgaggugaucaccgacuggacgaagcgcaacgaccugcggcaccacgccauggacgcccucaccguggcguucaccaagcacaaccacauccaguaccugaacuaccugaacgcccgcaagaacgagaagcacaaggagcacaacaacaucauggccauccagcagcucgagaccaucaaggucacggacgagaacgggaacgagaagcggaucuucaaggcccccaugcccaacuuccgccagguggcgaagaccuuccuggagaacgugcugaucagccacaaggccaagaacaaggucgugaccaagaacaagaacaagaucuccggcagcaacaaggugcaggagguccucaccccgcgggggcagcugcacaaggagacgguguacggcaaguaccaguacuacgugcagaaggaggagaagaucggggccaaguucgacuccgagaccaucgagaaggucgccaacccccuguaccagagccuccugaagaagcgccuggaggagaacggcggcgaccccaagaaggccuucaccgggaagaacagccucgcgaagaaccccaucuaccuggacgacacccagacggagcagcugccggagaaggugaagcucguguggcuggagaacuccuucagcauccggaaggacaucacccccgagaacuucaaggacgagaagcugaucgacaagauccucgacgagggcgucaagcgcauccugaaggagcggcugcaguccuucgggaacgacgccaagaaggccuucagcgaccucgagaagaaccccaucuggcugaacaaggagaagggcaucgccaucaagcgcgugaccaucuccgggguggccaacgcggagccccugcacaccaagaaggaccaccucggcaaggagauccuggacaaggagggcaagccgauccccgucgacuucaucagcacggggaacaaccaccacguggccguguaccgggacgagaagggcaaccugcaggagaagguccucuccguguucgaggccgugguccgcgccaaccaggggcugcccaucaucgagaagaccuacaaccagcaccugggcugggaguuccucuucagcaugaagcagaacgagauguucguguuccccaacgaguccaccggguucaacccgaacgacaucgaccugcuggaccccaagaacaagcggaucaucagccccaaccucuucaaggugcagaagcuggccaccaagaacuacauguucacgcaccaccuggagaccaaguccaucgacggcgacaugcugaagaacaagaaggagcucagcggcauccuguacaacuucauccagaccccgcagaagcuguacgggaucaucaagguccgcaucaaccaccucggcgacaucguguccgugggggaguacuga

SEQ ID NO: 2189 - RNA, 4296 nt, Artificial Sequence
  Cas9 variant
augaagcgcauccugggccucgaccuggggagcuccagcaucggcugggcccuggugaacgaggccgaguccaagaacgagcggagcuccaucgucaagcucggggugcgcgugaacccccugaccgucgacgagagcaucaacuucgagaagggcaaguccaucaccacgaacgcggaccggacccugaagcgcagcaugcggcgcaaccuccaccgguacaagcugcgccgggaggcccugaucgaggugcucaaggagugcaaguucaucaccgaggacaccauccuguccgagaacgggaaccgcacgaccuucgagaccuaccggcugcgcgugaaggcccucaccgaggagaucagccuggaggaguucgcccggguccugaucaugaucaacaagaagcgcggcuacaaguccagccggaaggccggcggggcggaggaggacacgcucaucgacggcauggacaucgcccgcaagcuguacgacgccaaccugaccccgggggagcucugccugcagcugcucuccgccggcaagaaggugcugcccgacuucuaccggagcgaccugcagaacgagcucgaccgcaucugggagaagcagaaggaguacuaccccgggauccugaccgcggcccugaaggaggagcuccggggcaagaagcgcgacgccgugugggccaucugcgccaacgcguucgucuggaaggagaccuacacggaguggaacaacgaggaguccaagaacgagcagaucgagaaggagcacaagcuggagggcaucuacagcaagcggaagcgcgacgaggccaagaaggagaaccugcaguggcgcguguccgggcucaaggagaagcugagccuggagcagcucgugaucauccugcaggagaucaacacccagaucaacaacuccagcggcuaccuggggaccaucagcgaccgguccaaggagcucuacuucaacaagcagaccgucggccaguaccugauggacauccuggacaacaaccccaacgccagccuccgcaacaucguguucuaccggcaggacuaccuggacgaguucaacgugcugugggagaagcaggccgaguuccacaaggagcucacgggcgagcugaagaaggagauccgcgacaucaucaucuucuaccagcggcgccugaagucccagaaggggcucaucagcuucugcgaguucgagucccggcagaucgaggucaagaucgacggcaagcgcaagauccggaccguggggaaccgcgugaucccgcggagcagcccccuguuccaggaguucaagaucuggcagauccugaacaacaucgaggucaccgccgugggcaacaagaacaagcagcgcaugcagaacggguccaacgagcccgacgacaccgagcagcucgagcugaacggccggcgcuaccuguaccaggaggagaaggagcugcucgcgaaggagcuguucgugcgggacaagaugacgaagcuggacguccuccgccugcuguucgacaaccccgaggagcucgaccugaacuucaagaccaucgacggcaacaagaccggguaccuguucuuccaggccuacuccaagaugaucgagaugagcggccacgagccgguggacuucaagaagcccaucgagaagaucguggagcaggucaaguccguguucguccuccugaacuggaacaccgacauccugagcuucgacuccaacaaggagcucgacaagcagagcuacuacaagcuguggcaccuccucuacuccuucgagggggacaacacgcccaccggcaacgggugccuggugcagaagaucauggacagcuacggccugggcaaggaguucgccaagauccucgccaacaucaccuuccaggaggacuacgggucccugagcgccaaggcgauccacaagauccugccccaccucaaggagggcaaccaguacgacguggccugcgaguacgccggguaccggcacuccaagagcagccugaccaaggaggagaucgccaacaagguccugaaggacaagcucgaggugcugccgcgcaacucccugcggaaccccguggucgagaagauccucaaccagauggugaacgugaucaacgccaucaucgaggcguacggccgccccgacgagauccgcgucgagcuggcccgggagcugaagaagaacgccaaggagcgcgagaagcucaccaagagcaucgccgagaccaccaagacccacgaggcgcacaagaagcugcugcaggaggaguucgggcucaagaacgugggccgguccgacauccugcgcuacaagcuguacaaggagcucgagagccggggcuacaagacgcuguacuccaacaccuacaucccccgcgagaagcuguucagcaaggaguucgacaucgagcacaucaucccgcaggcccggcuguucgacgacuccuucagcaacaagacccuggaggcccgcaacgugaacaucgagaaggggaaccggaccgccuacgacuucgucaaggagaaguucggcgaguccgggacggacaacagccuggacugcuaccucaacaacaucgaggugcuguucguguccggcaagaucagcaagaccaaguacaccaagcugaagaugaccgagcaggacauccccggcggguucaucgagcgcgaccuccggaacacccaguacaucgccaagaaggcgcuguccaugcugaacgagaucagccgcugcgucguggccacguccggcagcaucaccgacaagcuccgggaggacuggcagcugguggacgucaugaaggagcugaacugggagaaguacaaggcccucgggcugguggaguacuucgaggacaaggacggcaagcagaucgggcgcaucaaggacugguccaagcggaacgaccaccgccaccacgccauggacgcccugaccguggcguucaccaaggaggucuucauccaguacuucaacaacaagaacgccagccucaaccccaacacgaacgaguacgccaucaagaacaaguacuuccagaacggccgggccaucgcccccaucccgcugaacgaguuccgcgcggaggccaagaagcaccuggagaacacccucaucagcaucaaggccaagaacaaggugaucaccaacaacaucaacaagaccaagaagcggggcggggugaacacgaagaagcagcagacgccccgcggccagcugcaccuggagaccaucuacgggugcugccggcaguaccucaccaaggaggagaaggucaacgccuccuucgacgugagcaagaucgcgacgguguccagcuccgucuaccgcgacgcccugcugaagcgccuccaggagcaccacaacgaccccaagaaggccuucgccggccggaacagccuggacaagaagcccguguggcuggacaaggagcagauccgcaaggugccggagaaggucaagaccgugaccuucgagaccaucuacacgauccggaaggagaucucccccgaccuccgcguggacaagaucaucgacagcgggguccggaagaugcugaccggccgccugaaggaguacggcaacgacgccaagaaggcguucuccaaccucgacgagaagcccaucuggcugaacaaggagaaggggauccccaucaagcgggugaccaucagcggcaucuccaacgcccagagccugcacgugaagaaggacaaggacgggaagccgguccucgacggcaacgggcgcaacauccccguggacuucgugaacaccggcaacaaccaccacgucgccguguaccggcgccccgugaucgacaagaacggccagauggucaucgacgagaacgggaaccugaaguacgagcuggaggaggugguggucacguucuucgacgccgugacccgggugaaccucggccagccgaucaucgacaaggacuacaaggccuccgagggguggcaguuccuguucagcaugaagcagaacgaguacuucgucuuccccaacaagaagaccggcuucaaccccaaggagaucgaccugcucgacgcggacaacuacgggcugaucucccccaaccuguuccgcgugcagaaguucacccacaagaacuacguguuccggcaccaccucgagacgaccaucaaggacaccagcuccauccugcgcggcaucaccuggaucgacuuccggagcuccaagggccuggacagcaucgucaaggugcgcgucaaccacaucgggcagaucgugagcgugggcgaguacuga

SEQ ID NO: 2190 - RNA, 4299 nt, Artificial Sequence
  Cas9 variant
augaagaagauccugggccucgaccuggggagcaacuccaucggcugggcccuggugaacgaggccgagaaccgcgacgaggcgagcuccaucaucaagcucgggguccgggugaacccccugaccguggacgagaugcagaacuucgagaagggcaagagcaucaccacgaacgccgaccgcacccugaagcgguccaugcgccggaaccuccagcgcuacaagcugcggcgcgacgcccugaucaagcuccugaagaaggucggguucaucgccgacggcaccauccugagcgagcagggcaaccgguccaccuucgagacguaccgccuccgggccaaggcgccggacgaggagaucagccugcaggagcuggcccgcgugcuccugaugaucaacaagaagcggggguacaaguccagccgcaagaucaaggagaaggaggccggcacccugaucgacgggaugaagguggccaagaagcucuacgacgaggaccugacccccggccagcugugccuccagcugcuggaguccgggaagaagucccuccccgacuucuacagcagcgaccugcaggaggaguucgaccggaucuggaacuuccagaagcaguucaaccccaaggcguucugcgacaccgccaaggaggagaucaagggcaagaacaagucccagacgugggccauccuggccaaguacuucaucuggaccgacgagauggucguguggaacgagaaggagagcaagaccgagcgcguggagaaggagugcaagcucgucggccugaagcggaccgugaagaaggaggagcagcgcaaggagaacuaccgguggcgcgugcaggcccugacggagcagcucgaccuggggaaggucgcgguggugcugcaggagaucaacggccagaucuccaccagcuccggguaccucggcgccaucagcgaccggagcaagguccuguacuucaaccgccagaccgugggccaguaccagauggccgagcuggagaagaacccgaacaccucccuccgcaacaugguguucuaccggcaggacuaccuggacgaguucgacaagaucugggagaagcaggccgaguuccacaaggagcugacggucgagcucaagaaggagauccgcgacaucaucaucuucuaccagcggcgccucaagagccagaaggggcugaucggcuucugcgaguucgagaaccgggagaucaugguggagaagaacgggaagaugcaggccaagguggucggcugcaaggugaucccccgcucccacccccucuuccaggaguucaagaucuggcagacccugaacaacguggaggucuucgcgggggagaagaagugcaagcggaagcgcaccgacgccuuccccggccuguucgacggcaccgaggacacgcucaugguggagggguggcgguaccuguaccaggaggagaaggagauccuggccaaggagcucagcgucaagaagucccugaagaaggaguacauccugaagcugcuguucgacaacccgcaggaccuggacaugaacuucgagcagaucgagggcaacgacaccgggaacgugcuguucagcgccuacuccaagaugaucgagaaguacggcuacgagccccucgacuucggcaagagcaccgacgagaucaucgagcgccuccaggugaucuucaccgaccugggguggaacacggaccugcuguucgucgaccugaacaaggagggcaaggaccucgagaagcagcccuacuucaagcuguggcaccuccuguacuccuucgagggggacaacacccccaccggcaacgggaagcugguggagaagcugauggagcucugccacgugggcaaggagugcgcccuggagcuggucaacaucagcuuccagaacgacuacgggucccucagcgcgaaggccaucaagaagauccugccguaccugaaggagggcaaccgguacgacguggccugcggcuacgccggguaccgccacuccaagagcucccucaccaaggaggagaucgagaacaaggugcugaaggacaagcuggacauccuccccaagaacagccugcggaaccccgucaucgagaagauccugaaccagauggugaacgugaucaacgccaucaucgacacguacggcaagcccgacgagauccgcgucgagcucgcgcgggagcugaagaaguccgccaaggagcgcgacgagcugaccaaggccaucgccaagagcacccgggagcacgaggagauccgcaaggugcuccaggaggaguucgggaugaucaacgugucccggaacgacaucauccgcuacaagcuguacgaggagcugaaggacaacggcuacaagacccucuacagcaaccaguacaucccgaaggagaaggucuucagcaaggagaucgacaucgagcacaucaucccccaggcgcgccuguucgacgacucccugagcaacaagacgcucgaguacaaggccaucaacaucgagaagggcaacaagaccgccuacgacuucgugaaggagaaguacggggagaagggccugcagcaguaccugaaccggugcgagucccucuucaaggggcaccgcaccaagcugcggaagcugaagaugggccaggagaacauccccgagggguucaucgaccgcgaccuccggaacacccaguacaucgccaagaaggcccuggcgaugcugaacgagaucugccgccggguggucgccacgaccggcagcaucaccgaccgccuccgggaggacuggcagcugguggacgugcugaaggagcucaaccugcccaaguacgagacccugggccucgucgagguguacgaggacaaggacgggcgcaagaucaagcggaucaaggacuggaccaagcgcaacgaccaccggcaccacgccauggacgcccugacgguggccuucaccaaggacgucuucauccaguacuucaacaacaagaacgcggccuggcaggccgacugcaaggagcacuccgacaucaucggcaucaagacccgcuacuucgagaacgggcgggcccugccgcccaugccccucgugcgcuuccgggccgaggccaagagccaccuggagacccugcucguguccaucaaggcgaagaacaaggucgugacgaacaacgugaacugcaccaagcgcaagggcggggagaacaagaagcugcagcagacgccccggggccagcugcaccucgagaccaucuacggcagccaccgccaguacgucaugaaggaggagaaggugaacgccuccuucgacagcuccaagaucgccaccgugugcaagcaggcguaccggaacgcccugcuggagcgccucgccgccuucgggaacgacccgaagaaggccuucaccggcaagaacagccuggagaagaaccccgucuaccuggaccgcgagcagaccgcgcgggugcccgagcgcgugcggaccgucgagcucgagacgguguacaccauccgcaagcccguggacccgaaccuguccgucgacaaggugguggacgccaagguccggagcauccuggagcagcgccuccgggaguacgacggggaggccaagcgcgccuucgugaaccuggacgagaaccccaucuggcugaacgaggagaagggcaucgccaucaagcgggugaccauccgcgggaucaacaagguccagucccuccacggcaagaaggacaagaacggcaaccugauccuggacgagaccgggaagaagauccccguggacuucgugaacacgggcaacaaccaccacgucgcgaucuaccggaagccggugcucgacaagaccgggcaggagaugcuggacaacgagggcaaccccguguacgagcuggacgaggucguggucagcuucuucgaggccgugacccgcgugaaccucgggcugcccgucaucgacaagaacuacaacaaguccgagggcuggcaguucauguucaccaugaagcagaacgaguacuucguguuccccaacgagaagacgggcuucgacccgaaggagguggaccugcucaaccccgagaacuacgccgucaucagccccaaccuguuccgggugcagaagaucaccgagaaggacuacauguuccgccaccaccuggagaccaagguggucgacgacaaguuccucaaggagaucaccuggaagcggauccugacgcccaacaagcuggaggggaucgugaaggugcgcgucaaccacaucggccagaucgugagcgugggggaguacuga
